United States Patent 12,553,090 (MOLECULAR PREDICTORS OF PATIENT RESPONSE TO RADIOTHERAPY TREATMENT) - sequence listing, part 2

SEQ ID NO: 31 - DNA, 198155 bp, Homo Sapiens
ttatgctgcctcgccccggcggccgtccagcgggaggcggagcgagtccaaaatggcggctctcaggctggcgcgctccgtgctgctggggctttgaggtggtcgccgggggtccgggggaccctttccccgccgcggaagccctagaggatgaatcggggaccctgctaaggtctggcggcggggctggagagcagtggcagcaagggctgcggtggcgtccacgcagcgggatgtgcgagagttactccaggtcgttgttgagggtctcggtggcgcagatctgccaggcgctgggctgggactcggtgcagctcagcgcctgccacctcctcacggacgtgctgcagcgctatctgcagcagctgggccggggctgccatcggtactctgagctctgtgagtaccgggctgggtgcgggagggctgccccggcaagtcaagggtgacaccttcgctctccctgtccctccgcgtccccggggtgtgcatcccgcaccccgcctcgagatctgctgtttcctcggcctcccacgtccctgggcttccactgccgctccaaactctagtcatccttcgggtgcctcttccttatccgctaacttcccgccaccagcccgggagtcgggtcttcgctcccagctccacaccctcctaccgctcctccgctctgaattgtgtctggatctctctcattgtctcctgtttgctgcgggtagatccacccccagcgtgccctacaccctcttttacctcggtcctttttctcccttgcccgcaaactactacaactagttgtcacaggcgctccgtctaccggccgtttcttacaagactggccattcctgggctcctaactacatagactcgttgacagctctgctccgttagggacactgcctcgtctttctgtatctgttcgtttcgtgaacgacatctccatttactgtttttccaaggctgactttgtcagtttcgctgattagatgtactttcacttacgtctcggttaccagtgagatgtcagtggctatcgaagtaggatagagggaccgtgggcagttgacaagattctccaggtaatctgggctacagtacttatgagttttaaatgaatgtctggtaatatctatagctagtggtatttaataatttaatggaaggaatggaatattttaatagaagctccacattatcttgttgatgtgaagcattgtatgtgtgtttgttgaggagaggaaactaccactcattttagtttcaagtcatgatgtttaaggtggtgagctggagaactgaatgaagtgtttcataggatattttgttttgttaaagtggttcctatactggaaaattgagactcacagacacacgctgtatttcttaggccccaagtttcgttcccgcttccacagggctgccaaaataatctgtccatagcacagatctgatcctgtcattattcttaaaaacattttaactatacttcgttggttacaggctaaaaatcgaaactcttagcagtacacagttccctttgtgagctagcattttgcttaccttttgccagcctgccatgctaatctgcgaccacgctgagctacctgccttttccaaaatgttttaagctgtccattcctacatgcgtgctgtttcttacctagagtgtcctttgcccgtggcccaccaatagtattacttttattttcagatgcacttatcacttgctctagggaactcatgttatctgctttcataattctgtgcatatttcttttatattatttgtcatcttgttttgtaatcacctgtgtatgtctctttcccctctccaggagaaaaattgattatatttgtattctgtaacctgtagggccattatataataggcacctgagaaatatttgttgaataaatgaatgaactgataaaccactaccctaaaagccacttattgactttacatattgagttccaaaaatgtatatgttttgaatgcttgatttcactgatacttctattactcttcttcttttgagacagggtctcactctgtcgccgagcgtggagtgcagtggtgcgatcttagctctctatagcctcgaacttcagggctcaagtgatcctcccgcctcagccttccaagtagctgggactacagggatacgccaccatgcctggctaatctttttattttttgtagagatgtggtctggttatattgctcaggcttgtgtcaaactcctgggctcaagtgatcctcctgcctcagcatttcaaagtgctgggattacaggcatgagccaccatgcccagctcactgatacatctgaatgtggaaccacaaagtaatatgcgtgcatttttatcttgaaagtacatcaccagctgactactcttctggcttttgtttctttttcctctggcctccgctgcagtggtccttgagtataccgttagtgataggctaggctaggctaggctaggcatagtccagattatgtttgctaccatgtatctttagatattcaaaatgtctcctgaatacatagttacctttactgccatttatacaaaacagaagggagctgccactctatgtgactaggtattccaaagtcatccaggggtcactgcagctcttcagtgtaaaccttgttcctaattaccaagtttccgtagccagtttcttggtttcagtgagaatgagattgtcaggttcattattcccacgtaatttggtgacttttttttaatgctaattttggtatacttattagatatttttagattcttttttctataccagccttattctaaaatcaaattctgtagctccaggttaccactatggaatcttgtattccacccctttaaatcctttctgttgttttaacaaacacttactgagcatcacttacgaaccaacccctgtactaggcattggagacataaaattactaagatacaatccctgaccataaggtgtgttcaagagttccagaatgtcaggaaacaacaaactgatggtgtttgtttcttctaaaagaaatgttctcaagttaaagcaagtattagaagttaccattaattcaaataatgaacaaataatgaacttaagaattgccttagggtaacaatgtctccaagcattcaagggcagatgtctctgtcggtgtcacattatatgttaaatatgttggcatgtactgaaagcaggtgctaaatctttcagactgactcttcaacactagtactgtaatatttttttgcatggtacagggagtaaatgtaaaagggataagaggagagatggctgtaggctatagattctggggtaggattacttcacagaaaagataagatttgagttgagctgtgaagtatggttgtataaaggtatagagtattccagcttagagaatcacataaactaagctgtccaggtgagattaagcataataaaagtaccagtaaggtgttcagctccctatgcagctagttcattccaagggtgtctgagtaaaatgttcaacagagtgagatcaggttatggaaggacttgaaagctagacaaaagaattaaaacatgtagtagaaaacattgcatactcctaagtaggggaatagtatgattaaagtggtattttaagaaaattgtactgacagtgatgtgcataagagattgaagtgggcagaacttgagactatactgagatagtgacagtaagaatagagagaaaggaaaaaaatctgaaatcatggttaaaaaaaaaaaaaaaaggtggccgaaggggacggggacagggttagaaactaccaggttttggtttgaggctgcaaagcatatggaggaatttaagattattatattttttagactgagagagtaataatagctttaataggaatagaagagatgaaatgcctgtttacattcagtaagaagaagagtattcgttttatttattttctttttttaatgcatcacagaagtaacccatacttatagaaaaaaaaaatcaaagactgcagaagtatgtggagttagaagtcagtctcctgcttccaccacagccctcgcctctactgcagcttccacccctcgaactgttaaccattggctgaatatccttccagaggtttctgtatgcattactacacatgcgtccaattctagcaatatttggattctttttcattttacagtgtgatttaatttcagacatactgagtttgaagtgatcaaatttcaggatttcagttaaaaagtcaggatttcagttaaatcctttaggctattgaaaatcagaaaatggaattttcatagacatttttaaagatgtagagaccttaagctctgctaagaataggcataagaaaaacttgcttttgtaaagaaaaaaatctctatatctaactttttatctctgttttatgtggtgttttctaattacatttgaaaatttatagataaattatctttatggctaggcatgttggtggtgcactggtagtcccagctactcagaaggtgaaggtaggaggatggcttgagcctgggaaggtaaggttgcagtgagccatgattgcccttctgcactccagcctgggcagcagagtgagaccctgtctcaaaaaacgaacaaaaaccaaacttttatgatctaagccttctttgtaaatattcttagattttaaaaattgatttaatggtataattcattcaataggtatttattgagtgccagctatgtgccagccactgtttaagattctgcagatgcatcagggaacaacagaggaaatgtaaccaacattgactttgtcagcacagcacactacttatttgatgattaaaaaaaaaaaaaaggccaggcacattggctcatgcctgttatcccaccactttgggaggcagaggcaggaggattgattgaggccaggagttcaaaaccagcctgagcaacatagcaagaactcatctctacaaaattaaaaaaaaaaaaattacccaggcatggtggcatgtgcttatagtcccagctactcaggagactgagaggggaagatcgcttgagcctagaagtttgaggcagcaaggagctgtgatcataccactgcacttcagcctgggcaacaagcaagatgccatctcttttttttttttttttctgagatggagtcttgctctgttgcccaggctagagtgtagtggcacgatctcggctcactgcaacctccgcctcctgggtttgagcagttctcctgcctcagtcccctgagtagctgggattacaggcctgcgccaccacgcccggctaatttttgtatttttagtagagacggggtttcaccgtgttgaccaggttggtctcgaacccttgaccttgtgatccgcccacctcggcctctcagtgctgggattacaggcgtgagccatcgcgcccagctaagatgccatctcttaaaaaaaaaaaaaaagacaaaacactattttattattattatttttggggcattttctgtgtgtcaggtgctgttccagatgcttttgatcatctgtaaactactttgaaatttgttctataatagctaatcatgaatgtggtttttctgtggtgttctggctagttgtctgattatatttaaacttgactttaataatcagcttaaacatgattctgtgatactctttaaaatctattaaattctttccaataactaggttaaaatgtttgattctgagctgcatatttacttactactttttcttaatatttaaaaatatattcgtgggatttcttcaaataatttgatttgcttttcactttgtttcagatggccgaacagacccaattttggatgatgttggtgaagctttccagctgatgggggttagtctacatgaactagaagactatattcacaacattgagcctgtcaccttcccacaccaaattccgtcatttcctgttagcaagaacaatgtacttcagtttcctcaacctggaagtaaagatgcagaggaaagaaaagaatacattcctgattacctgccacccattgtgtcttctcaagaaggtttgtgagtgtttcttcttcatatgttagtgattattttaatggatttttaatcctcttagctttccatgctatgtcaactttataaattctggaaacacaatagaaacatttactgttacttacaaattattctaacccttaaaccaacaaacttgcaactgacattaccaagccgagtcacggtgtaatcaaggtcatgtctgaagcatttatctcctttgtaaagttcaagtagaggaaaacagtgaagccaaagagaagcctttcaacagccctattatatgagaatgggatattaggtaaattagaaaacatttgaaacaaaaagaaaaattggggtagctcttttcctcctcgcttattattcaggccatgagttgaatgccatggctttatactggaaacagtgagtgaatcgtgagtattcagtgacattgtgtagacttctgttttttatcatgaggagcaatgtttattgtttgatcatatagaacttttgattataaaatgatagctaatcaggtataatggtcagtccaattgcagagttcccttttttcctgcataattttagatgttgatcactaagttcactaagattctaaggagatatttaagtaatttctggtctctaacacaagtacacgatattttttcttataagagttggaaaagttgcaataagttctttcattttgtaaaaaattctaaaacctgtatacttcaggacaatgcaaatgatgccagcaattacttttacttatgattttctattgtaaaatatacataacataaatggaccattgtaaaggtgtgcagttctgtggcattaagtatacattgttattcagccatcatccccatccttctccagaacttttgttccctcccaaattgaaacactgttcccattaaacataactccccattctccaccacttccagcccctggcaaccaccattcctttttttgtctctctgaatttgtctattctaggtaccttttataaatggacttggacattatttgtctttttatgactggcttacttcacttagtatgatgtcttcagggttcattcatgttgtagcctgtgtcgggatttcgttgtgtgtttcgttgtgtgtttaaggcagaataatatatgtacattccacatttgtttatccattcactcactgatggacatttgggttgtttcaaccttttggctcttgtgattaatgccgctatgaacatcgatgtgcaaatctctgttcaaattcttgctttcaggtgtttttttttgggtctgtaccttgaagtagaattgctggatcatatagtaattgtctatttaatttttgaggaagcaccacactgttttccacagtggctgtaccatctaagcttcctatcagcagtgcccaagggttccaatttcttgcaattcatttcttagaatcggttctactttaatagcattttgaagtgttacctatttgtctcaggaagtatgtttaaatttggcataagttgttgtacagtctgtgtgtcagggttgcctcatctgaaaaactggacagctactggacctaagtggtagggatttgttgtgaattggtggctcatcatttaggtgctctggatcttagctgcagtgggttctactgaatgatactaacacaccgacagcccagaaccaaaactaggactttgatcataatctacacttaactatttggtccttcttgtcttatttttatagcatgcaaatattccataataaaattctcttaaagtgctatggttatcatatttaaatactagcaaggaaatgtaactaagataacaggtttagattaggtagtgaagaagtatgaaaaacaatttagtgttttttttgttttgttttgtgttgttttgatactgacttctggctgaaattactatattactatagatttttgggtttcttttctgggttatttgaagcaaaaaaagaaactcatttagttttatgcaaacaatataaattataaacattttaaaaggaaaataacaaatcttgagaacactacttttcactttttatctaacacatgtggattaagaaggaaaaatattgctgatttgtaatatatgcatatggtttataaggatgcagtaagtggtaggcagtacagtaagatgcttgtcaaaacgttctcctcttcataagaaaaggatataaaatgcaattctttggttaccatttaaaaatataaccatacaagaccatttcttgtcatttacaatctgaaatatttttttttcatgggtacagcatgttagaaagttcctggtattctgattagtggtgcaaagtgaggtacagaggtgaacccctttgataatgatgctgttcaccatgctctttattttccttttatttccttaagagccacagacaggccagactttggtcttaaaatattattagcaaggtccttccatggggttccctcttatcagccactcagcttggttcatgtcaaaaaagcctgtgaaagtctccctccacagcagctggagctggcgagtgtgcacacatagaaggcctgaaggggcagcaggctgtgagaggcacagcgtggacctcacggcatcactgagacatgactcagcgagtcactgagtttctggtcttcccaagtcactttacctttctgaactttatattcatctgtaaaataagtgtaataacacctaccacattggggaaatggagaatcaagtaatttttttttgttaacacatttatataaaattggacagtgtttaacatataaaatacataacagtgggccaggtgtgatggcttatgcactttgggaggctgaagcttgagcccaggagtttgataccagcctgggcaacgtcatgagacctcatctctactaaaaataaaaaacttggctgggcgcagtggctcacgcctgtaatcccagcactttgggaggcggagacgggcggatcacgaggtcaggagatcgagaccatcctggctaacacagtgaaaccccgtctctactaaagatacaaatattagctgggcgtggtggcgggtgcctgtagtcccagctactcgggaggctgaggcaggagaatggcgtgaacagaggaggtggagcttgcagtgagccgagattgtgccactgtactccagcctgggtgacggagcgagactctgtctcaaaaaaaaaaaaaaaaacaaaaacaaaaacttagctgggcatggtggtgcacgcttgtagtcccagctatcagagtctgtggtgggaggatcagttgagcccaggggtcaaggctgcagtgagctatgatcacaccacagcactccagcctgagtgacagcgagaccctgtctcaaaaaaaaataaaacacatgacagcgaatattagttctcgtcccctttttcttttcttgctcttaaataatttacttttgaattgaaatacaatatacattagtgaagtcacgctataaggggaatcggtgtcaagctgcattcagtggcacacccatagtcctagctacttggaaggccaaggcaggaagatcgcttgagcccaggagtttgaggctgtagtgcgcaatgattgagcctgtgaatgcccactgcacttcagcctgggcaacatagcaggaccctgtctctgaaaaaaagagacgaatcaatgtaaagtagtgttaccatcacgtgctgaggatctgagggaacagacttactagctgggctggataggtacttgactgaggagctgtgtgattatccgcagtgtgaagatgacagatgaggagatgatgtggaaggagttattgcctgctttatctgattatatgtttagaagtgagacctctttgaaaatattttatacatgcatatttttgcttggactgttacagttctgatggctggtacccagtgtgttttatccaagaacattctctccccagcttgccatacatattttcagattcacaccaataccatatttttttgcttcctattttattgtgctgaggaatgtctgaaaatagtacagcgtactatgccaaagtcattgttggttctcacagtgtggtctctagatcactggtcaatgggggtcttctgggggggtctgttgattggttcaaaatatttgcataagaaagaaatataggctgggcgcagtggctcacacctgtaatcccagcactttgggaggccgaggtgggcggatcacttgaggtcaggagttcaagacgagcctggccaacatggtgaaaccctgcctctactgaaaatacaaaaattagctgggtgtggtggtgcctgtagtcccagctactcgggaggctgagatgggagaatcacttgaatccgggaggcagaggttgcagtcagccgagatcgtgccactgcactccagcctgggtgacagagtgagactccgtctcaaaaaaaaaaaaaaaaaaaaaaaaaaaaggaatataaaccatgtaccctgacttattgcaggaaacttaccaagctcaacttaaacttggtaaagatactgtgaggttgccacttttagagtttctattttttaaaatttaaaatagactattttttagaacagttttgatttacagaaaaaattgagaagttagtttggagagttcactcacatctgaaccatttcttctgttattaaccttttacgtgactatggtacgtgtatcacaattaatgaacaatattgacatgttattattaagtgacgcccgcactgtattgacattccttagtttttactggatgtcctttttctgtttctggatcccatccaggatatcatattgtgtttggttgtcacgtctccttagacttttcttggctgtgacagtttttcagacttttcttgtttttgacgaccttgacagttttgaggattattggttaggtatattgtcggatgcccctctagtggaatttttctgatgttttcctcatgattagactggggttatgagatcttggggagaaagaccacagaggtcaagggccatttttatgacatcatatcaaaggtctatcctgtcatcataatttatcactgttgatattgatggtgatcacatggctggggtagtgtttatctggtttcttcacagtaaagtttctcttctatcccctcttcccctactgtgctctttggaaagaagtcactgtgcgtagcccgcccttaaggaatgggagttatgcgtcccgctttgaaggtggaatatctgcatatgttgttaggaactcttctgcatggggatttctctctttccccactaagatttctatttttattattaaaccctttaaaagtaaacatttacatgtttgaaaaaattaacaaaagtaatacaaacttgctgaaaaaatatattgccaagtgaattcgttatgaaatggaagtgtctcttcacttcccttcctcccccttcccaagaataacctagttggcagatggggctcctctgcatcttcccgtgtgaccttttgcactccttggactcaagaatctatgtccacttcagtacctgccatttctttctcaagctcctgccatccttttcttgaagcagttcttgctgtgaacaccaattactatctaaatggttgatctgaaggaaatttaaaccctttctcccagttcaagaaacagaactttaccagctatctcagaatagcttctatgtgcccaaccccaccccaccccttcctccctccctccaaaaataaccaaccactgtcctgactttgtaggaattactccttagctttatagttttatcagccaaatgcgtatccctagacacattaatttaatgttcttcacacatgcacacctttttcactttacatgtcttttttttttttttttttttttttttttgagaaggagtcttgctctgtcacccaggctggagtgcagtggcgcaatctcggctcactgcaaactccacctcctgggttcaagcgattctcctgcctcagcctcccgagtagctgcaattacaggtgcatgccactgtggctggctaatttttgtatttttagtagagacggggtttcaccatgttggccaggctggtctggaactcctgacctcaagtgatccgccagcctcggcctcccaaagtgctgggattccaggcgtgagccaccccgcccaaccatgtcatttaccttttagtttgtgactctccttccattcctttctttgtcttacagtttatttgttagaaatctgggttgtttgatctgcagagtgccccacagttggatgttgcgcattgtgcactcataatgcagctcaatgtgtttctcaaaattggcagcaagaatctgaggcttgaccagatttaggtttggcaagatatcagctgatgatgtccagttttcacttttgttggtgttagcagtgctgatgctcagtgcctagatccattaattcattaggggttacaaagtaatgataatactatcactttgtttttatttcattctttagttgaaataactttataagaaaatccttttcctcatccactatttagtaacttaatggcatagtttatatagggaaagcagggttaacgcttgatttttttcatatggtatattcccagttttcatgagaataaattggttccttgttatccttagcaggtgactagtttcatttaatactctatcattgtgaactcacagatttaaacatacttgacggatttcattcattactttttttttttgagatggagtctcactccatcgccgaggctggagtgcagtggctcaatcttggctcactgcaacctctgcctcccaggttcaagggattctcctgcctcagcctctccagtagctgggattacaggcatgtgccaccacgcccggctaatttttgtatttttagtagaggcgaggtttcaccatgttggccaggctggtcttgatctcctgatcttgtgatcctcctgcctcggcctcccaaagtgctgggattacaggagtgagctaccgtgcccggcctcattacagttttttacccatattgtagctttaattgttgcatctttggccagtggcagcttcttcactcttgcttctgagtccttttgacacatgacccgaattggctttggtgacgtcctcaccttctggtatatcaaaatgttctagactcagcatgtatagtcatgttctatgcttggtataaattatctgtccaggaaaccctggtttcttggaaagtagtatttcttttctttttttaattttaattttttttaattataaaatttcaggttacatttgtatatatctggggggtgcaaagcgatgttatgttttataaatacaatgtggaataattaagtcaagctagttaacatacctgtcacctcaaatgcctatcgttttttgtggagagaacatttaaaacttactctcttaatgattttcaaatgtgtaatacattattatttttctttttcaccatgctgtgcaatgtatcaaaaaaagtactcctcctgtcagattgaggctttgtaccctttgcctatcatctctgtatccccacatccccacatcccctgccccagcctctgtaaccactgttctactctctgcttcttggaatttggttcttttcgtccacatataagtgagaacatgtggtatgtctccttctgtgcctggcttacttcacttagcagaattgtttgaattccatctatgttgtcacaaatgacaaaatttccttctttttttaaaggctgaataataatactttttaatttttatgggtacacagtaagtataaatatttatggagtacataagaattttaataaaagcacaccacaatgtgtagtaattacatcagactaaattggatatttaccacctgaagcatttatcatttctttcttatttatttatttatttttgagacagtctcgcactgtcacccaggctggagtgcagtggtgtgatctcagctcactgcaagctccatctcctaggttcaagtttaagtgattcttgtgccccaccctccccagtagttgggattacaggtgcccaccaccacacccggctaatttttgtgtttttagtagagatgcgatttcaccatgttggccaggctggtctgaaacccctggcctcaagtgatctgcccacctcagcctcccaaagtgctgggattacaggcatgagccactgcacctggcccagcatttatcatttctttgtgctacagatattccagttatactcttttagttatttttaaatgtacagggtgcagtagctcacacttgtaatcttgtcactttgggagtctgaggcaggaggatgatttgaggccaggagttcgagataaaatgttcaataaattattgttgactttagtcaccctgtggtgctattaaaggctgaatagtattctgtggtgtatatatattacattttctttatccactcatctgttaatggacacttaggttatttctgtaacttggctattgggaacagtgctgcagtgaacttgggagagcagaatctcttccacataatcttttcaaatcttttgggtaaatactcaggagtggggttgctggattatatggtaattctattttgagtttttggaggaaactccacatagttttccatgactactaatctaaattcccaccaacagtgtacaaggattcccccttttctccacatccctgctaacacttgttacctttcatcttttttatagcagccattctaacaggtgtgaggtaatatctcactgtggttttatttctgtaatgattagtaatgttgaacattttttcatgtatttgttggcagtttgtatgtcttattttgaggaatgtctattcattttttattggattatttctttctgtagggttttcttttttccttttttggggacccagcaatactgctgatttattacaagtccccaagagggcttcagtttttcttttcaacatcctgttctgtagcttccatgtctctttttgtccatatgtggaggagccaggcattggcacgggccatgcagcaactagcaaaggctctgaaattcttctcctcagtggtgacttgagctttctccttctcatagacattctggatgggcatgactggtcctgtcagctgggtggccaattgcagttcttcagcagaactgtctcccttcctggggaccgagggcttcctggggaagaggatgagtttggagcggtaccccttcagccgctgcacagtgcgtgtggaagtggggcttcaagatcttgccattcccgctgggcaccatggctgcctgctgtcctccggcacaggacaacagccagactgttctttctatagagttgtttgggttccttatatattttgcctttttttttggtggtggttgtggctcttgttgttgttgagttgcttacatgttttgggcgtgagccccttgtcagatgtgtgggtgcacgtgttttcctcctcacccacaggttgtgccttcactctgctgtttcctttattgtgccaaagctttttattttgatggaatcccatttgttcagttttgcttttgtcaccctgcgcttttggggccaaatataaaaaataattgcccagaccagtgtcttacagtttttcccctatgttttcttttagcagttttgtagtttcaagtcttacatttaggtctttattccattttgagttgatttttctaagtggtatgagataaggatccaatttcattcttctgcatatggatatccagttgtctccacgctgggaaatagcatttcaagtacacagtctcggtgctaagggatacttattatatataactcggttgttcattgtttctaggcaataagtaaataaatatttatatacatgtagatgtgtgtgaatagatagataggtggatagggttcctcctgagttcatgcagattttccaattcatatttaggactacaaggtttttattttttatgttacatccataaatactgtcatccatactgagaattctggttctcaggaataaagaagatgataaaattagaatattccataattattcatttgctttatcccagattacacgtacaatattgcaactgatactatcattcatgattactgaaacaggtaaaaaaaattttttttgctcattctgtcctatgaaaccaattttctttcattttaccgtgtgtatcttgtcagatcatatagctactgtcttgagttctgctacctaatttctgagttttttctgattttgatttatatactttcatgtcttttagatcatttcaagatagaacattataggttcatcagttttttcgagtgtgtgtttctctcgtactttcattgtctggagggatgttttgctatttagtcttctcttctttatagaaactatatgtgagttagttttctgagcctttagaacacaggtgtccaatcttttggcttccctgggtcacactggaagaagaaggattgtctttggccacacataaaatacactaacaccatcgatagctgctgagctagaaaaaaaagtcacacacaaaaaagtcataatgttttaagaaagtttacaactttgtgttgggctgcattcaaagccgtcctgggccgcatatggcccatgggctgtgggttgacaagcttgctttagaaggagattcagggtagctcctctgactttgcagtgctccctcttctatcgtttttgcggaatgttccaaatatgggaacttgctcactgagattttttgtttgttttcctccaccacttttacctggatcttctcttcccttcatgtcagttttcctttttctggccagctgtgattccactgccagctgtgtcctctcagcgaggctctgtcctggcagagagcagccagggtcaagtctgagagctcctgggctcaacttctagccccattggatctcactcagccccttgtactccctgtactggaagtggtcccatccttcccagcctcagccgctcttctcgggttggcctgccgggctttccagcagaggcctggtggcccttttggggttttcctgtttcaggtcagtcttcccgttgcttctcactgtttcccttgcatagatgcctcatactcgggtctcatggcgcttggtggcatgttgtcacctgcatgtattttggcactgatgggtgtactctgtcacctggttatgttgggaagatgcacaaactaccttgccccagctaccactttcttcccaggattccccttattgaagctttttgctgctttcatcactgttgggcaattcctgaagctgcttttcttcagcgccatcatactcccttaactctccttatatgatgagctccatcttggggcctttcttgggcacgtcttccctggctctcctactgctaaaacattggtgcttctaaaattttatccttcacctactatgtttctcacgttacttagtttcagagttgactttcctactctcatagtttgaacccccatctgtatgctgatgcctccccaaactgtccctctacatccacctctcagaccctgcaaccagttgcagttggccatttccacgttttcttttttctttcttttttttttttttgagacggagtttcgctcttgttgcccaggctggagtacaatggcacaacctccggctccctggttcaagtgattctcctgtctcagcctcccgagtacctgggattagaggcatgagctaccaagcccagctaattttgtattttcagtagagacggggtttctccatgttggtcaaactggtcttgaactcccgaccttgggtgatctgcccaccttggcctcccaaagtgctgggattacaggcgtgagccactgcacccggcccatttccacattttcttaccacgaatacacctgtgttatccatctcagttggtggcaccatctctactcagtcacctaagctagaaacatgagaattagcattgacctcttctctcattctccttcattccctatctctaattctgctaattttctttcttaaaaaatttccaaaatattattgcatcacttcctttgtttaaacctttatctcttgtctgaactgtccttatcctctaaacgaaactattagacaaaaaattaacacatcccacattataaaacactttgttggctctccaactgcttacagttaccaaaaatacctatggagaggagttttcttttttgcatcaaaatgaaaagagctttggttgagtgtgatggctcatgcctataatcccagcacttgggaggccaaggcaggaggatcgtttgagcccaggaatttgagaccagcctggacaacatagtgagaccttgtttctataaaaaatttaaaaatctggccaggcgtggtggctcacacctgtgatcccagcactttgggaggccaaggtgggcaaattgcttgaagtcaggagttcaagaccagcctggccaacagggtgaaatcctgtctctactaaaaatacaaaatttagctggacatggtggcatgggcctgtagtcccagctactcgggaggctgaggcaggagaattgcttgaaccagggaggtggaggttgcagtgagccgagattgcaccactgtgctccagtctgggcaaaaaaaaaaaaaaaagtcagctgggtgtggtggctcatgcctgtaatttcagcactttgagaggttgaggcgggctgatcacttgaggccaggagttcaagaccagcttggccagcatggcgaaacctcgtctctactaaaaatacaaaaattagctgggcgtggtggtgcgtgcctgtaatctcatctactcgggtggctgaggcacaagatttgcttgaacctgggaggcagaggttgcagtgatctgagattgcaccagtgtactccagcctgggcaaaagagcaagactctgtctcagaaaaaataaaaaataaaacaattagccaagagtggtgatgtaagcctgagaggctgaggtggtgtaagtactcagaggctgaggtagggggatcacttgagtctgggaggttgaggctgaggctgcagtgagccactgcactccagcctgggtgacagagtgggaccctgtctcaaaaaaataaaaagggaatagctgtagttattcaagagaaaagatgtttattcttacaacgtagattacttactgatttaatagaggaatgttaatgaagatatttgcatggctttcagttgctaaaataatgtttgtgtatgtaaaagcagccatcaaataatttatccttgatatcacataatatattcataaacattatctcatttaatcttgaaacaggtcctaaaggcagatgctgctatcattcccatttatggaaggagaaatggaagtttaaaaatcataattgaattaacctgcctcgtgttgcattgggaattgggagcaaagctggattagggtttagttgactccgttcagtgctgtgtgtatgggtacctgccatgagtcggatcctacacaaggaactggtgttgaatatagagagatgagtgagatattcctctctccccattttggcctttctgctgttgtttggaagtccctgcttggccaggactgtcctaagcagaagagtacctttaccaagccagttttgtttttttttgttgttgttgtttgtttgtttgtttgtttttgagacagagtctcactctgttgcccaggccagagtgcagtggcctgatctcgactcactgcaacctctgcctcccgggtttgagcgattctcctgccttagccttccaagtagctgaaattacaggtgtgcaccaccacgcctggctaatttttgtaatttttgtagaggtgggatttcaccatgttggccaggctggtctcaaactcctgacctcaggtgatccacccacctaggcctctcaaagtgttgggattatgggcgtgagccactgtgcctggccaagctggttttcttaatgggcaggcaggcttcttgaataccttctggccccctaacatccgacgctataagcctcctccacacccagcctcctagttaaggatctggctgcctctctcttggccctctcagataccttcctgttcattaccttgttaggctggagttccagggtctggggaacgttccttctgtgtatctagggaagttgtctggaggcattgcttgtttttttttttttttggtttgtttgttttgttttgtttttaaatccagcagcatctgagccagataattgcagctgaaatcgtaccaagggctgatgttgggatatgcctgtggtgttcagtacacgtgtcttagcataaacctacagggccctgtgtgatcggactcctgcccacttgacatgttagttacttgcccctcgttgcttcgtgctttaccttccagaatcattaaactgctgatgtttcccaaaaataactatgtacctgggtcagctcatgctggcatggagttctcgtccatcaccatgcccaccctggcttctttgagcgcccgtataatatatatctctaccatcatacttcatatattttgttataattgctggttttatttgcctctgtaacttacccaggtcttgctttctctttaagtcctacactcattctccatttcaccatttttttggcagaaaacctatggtcctgctactctatgagagttgaattcaagacatggagaaacttactgactcctgttcttagggaaagtttttcagaataatggaggagcagtcgcaaaaattagcttgtccaaagtcacatggctgcgaagtgatagaggtgacagtgggatcccaggtttcatagtcttggccccatcttctgtgtatcattcatggccctggcattattctcaagggcacagatagaagaacaaaggcttgtattgtggctcttcgtttgtttcttttcctttcaaattggtttcttgagtacaattattttttttttaattgtgttttgttaacatcttattcttctattcaggttactttttctgcttattcttgttatcctcaggaatgattttttactgacagcataaagattgaagtagatcttttagaaatctctgtgtctcttgctttacattcaggccagcaagatttagcgcctcagcggaggtgtatacatgtcagcagtcagcatggagagtagaagtcccagcatacacagattgagagggactttacaaatttaaatggactttgccaaaattctctgcctttcaaaaaggtttttcctttaatttatctggatttataaaaacagaagcacatttccaatgctatagtaagagatttttggatgggggagtatttaagggattgaaaaattttttttttaagttttaatgtttctaaattaacaaagtaattctatgaagtatcttaggaaaatgagtgttttttttttttcgagacggagtctcacactgtcacccgggctggagtgcagtggcgccatctcggctcactgcaaactccacctcatgggttcacgccattctcctgcctcagcctcctgaatagctctgactacaggcgcccgccaccacgcctggctaattgtttgtatttttggtagagatggggtttcaccgtgttagccaggatggtctcgatctcctgaccttgtgatccgcccgcctcggcctcccaaagtgctgggattacaagcatgagccaccgcgcccggcctggaaaatgagtgttttgatatttactataaacaccaaatttgtctacttctctcttctaggcatccagaatgaaaaaaaaaaaaaagattggttttttttctaaatttagaatttgccagaaatttaacatttctttatctgtgcttacggtttttggaaattttcccacgtgtgtgaggggaagacgggaatatcaaggaggagcaggcaatacatgcttgtggctggctcagtgtaagaccccaaagttagtacttttgctgtaagttaggacttactttgtcttgctttcttgaatttgaatctgaaattgaacagtgtactcattgccttttatttagctaatgactgcttacagccacatagaactttgctatttcatgttttcttttctttctttcttttttttttttgagatggagttttgctcttgttgcccaggctggcgtgcaatggcgtgatctcggctcactgcaacctccacctcccaggttcaagctattctcctgcctcagcctcccaagtagctgggattacaggcacacgctgccacacctggctaatttttggtatttttagtagagagggggtttcaccatgttggccaggctggtctggaactcctgacctcaggtgatccgcccacctcggcctaccaaagtgctgggattacaggcgtgagctgccgcgcccggcctagagctttcctatttcagataaaataatagcaagttatttgcttcttttacggtggttatatactgatggtgtgccattggtgccaaaagtaaattcaaaataattgtttccttccttcattcgtcaaggagctgtggagagcctgctgtctgcaggctcactgcttatttctgaaaagagaggtaaagaaatagaggtccttccctgctttcctagagcttacagtctacttggggaaagaagggctggactcatgtttatatactatttaaaattataatttgggattcttaaaggaaaacagagtgctccagtactataaacatcagaggtctctaacctagtgtgcttacaggaataagggaatcaatggatattttttaagtagggggttaggatgatttcattataaattctgttggtactgagaaggatggactcaagaggagatgtcactggaagagtcttgataaagcttgtggtagtcacccaagggacatgataggaaggaccaaatttgggagatattggatggtcaggatttggagatagataaattgtagaggatgtgctacagagaggagcctaggtttcaagcttgggagattggctaggtaatcagatatctaaatatccagatcttaaacagactggccagatctggagtgagaatttagaatggaccttatagtctgcaggcaatcctctaacaaaactttttatttattttttttaaataatcaggtagagctcaggattgtaaaacatgacacgaacctcgtacccagggcagacttggttgcttatgttaagggcagcaggtacacttgctttaaatcaggtggatggtgggcttttaccaaatgactgcctatgttggccaggcaccacgcccgatgtgggaggcagaggccctcctatcgttcattgagttgcgtgagtaccctatttaattaaagatggccctgtttgtcattgtaggatattgaattaatattgttttttttttttgtttttttttttgtttttttttttttttgagacagagtcttcctctgtcacccaggctgaagtgctgtggcacgatcgtagttcactccaacctctgcctcccgggctcaagcagtcctaccaccagctgggatcacagacatgcaccaccacactcaactaattttttaattttttgtagagatgaggtttcagtatattgccctggctggtcttgaactgcaaggctcaaccagtcttccagcgttggcctcccaaagtgctgggattacaggtgtgtgccaccacacccagccttgaattaatattctttgagttcctagaacagaattgctgtaaaagaagaactaaaatcagttttgttctaaaagattaaacaataaccttaaattttttagatgcgggcttaaagctatatatatatatatttgtccgatgatacctaatggtcactattgtcatgtctaccaaaaatttaatagcttggtatgtcattgaagcgtgacagttcaaagccatgttttaactttctccccaataagatatatctgttatttcctcttccaagcccaaattccatcatttgtaaaatgggaatagtaacctccattggataattattataatcaaattagatataaatgtcgtatatttttacagatcttagatatgattttccaagggcaggcccacatttacagtctgttcctgaaaaatctcagcactgaatgtaatggttgtcatactttgttttctgaagaaacgcttacagtacagtaaatatatgcatttgcaataatatcctccggaattctttctaatctgggaattctgacatgctttgcacctgctagggcgtagtctgtgtctgtctggggcttttactgctttctggttaagtgaggctctcctctgcctttcccatggaactgcgcagaagctgcacaggccagaccttgtgaatatgttcttgagacagggtctttccctgtcacccaggctggggtgcatatagcttactgcagcctcaaattcccagactcaagcaatcctcccacctcagcctccttagtagctgggactaccagcttgcaccaccatgcccagctaacttttttttttttttgtagagatgggctcttgctgtgttgcctagactggtcttgaactcctgggctcaagcgatcctccccactcagcctcctaaagtggtggaataacaggcatgagccaccgttcccagcttacagtcatcttttaaatgtctgcatttgtcttccatcattttttgatctgcttttagttgtagtcatctacaggtttaagtaacttttaatcttttttgaacccttagtcatattgaagatgttttatttaaaatactacttaaatgtagttattcgtatctagttttaccacaggaaaaaagtataataatatttctctctccctgttgtgtgtctcccctatctctttctcactctttttttttttttgagcactgtgatcagtcgttggataattgtgttgcttaattattgatattttgtgcttatgtcacacatacaattaacatgcattaattgattatttctcccatgtaatcagacttggtttaaatttataattcattttcactacatattatgtagtgaaaatataatggttaaatacactcttgttagttaaattttatcatccattttactctttgtggacttcaaattttgcagtataaataagaaaacggactgttttatatggaagtgattacaattcagtaggtggcactctttcaatttctgttagtgttaatgaatatccaattaaatgtcaaagaatgttttaaaatcttgagaaaaagcatacaactttagtcattgatgccttgttttagaaaggatagtaacaatttgttcataatttagcgtctctggaactttgtgagaatagttacgtatgaatatacttaatatttatttgccttgaggaaacttacctaaaacagaatttcttttaataaaggctttgtgatatcctatctgaaactgtagattttctattcagaaatttaaattactgtccattattgtccattttccttccatgttttgatttttaaacattattactagagtcccagtacaacatgctttaaaaacattaacacagttctctcattctgacacagcagcttttcttcttcttcttgttctttttttttttttttttgagacggagtcttgctctgtcaccaggctggagtgcagtggcgcgatctcggctcactgcaacctccgcctcctgggttcaagcgattcccctgcctcagcctcctgagtagttgggattacaggtgtgtgccaccacacccagctaatttttttgtattttagtagagatggggtttcaccatgttggccaggatggtctccatctcctgaccttgtgatccgcctgcctcggccttccaaagtgctgggattacaggcatgaaccaccgtgcctggccagcttttcttctttttagtctatgcctgtctttttccattatgaacataatatttagctagctggatcagttaacacaacttagttttgctctttttattcagcattatttatgttctgcttttttttaacgtatcatttgttatgttttccttgttcctgtgtattttttgtatttcctatttttaaaagaatatgccattagttacttagccaatcgcttattgttgggcatttttaatattttaaaatattgcaatgttgcatcaaatatctttgcacatgtttttcttttatattatttccttatgataaattcccagggtagaagtttttaggtcaaaggtataaacacatttatggtttttgacacatattacccattgatttccaaaagagttgtatcagtttacagtgccgtaatgaatgtatgattacaccagtgtcccagcagtctccctggaatagcatttcaaagtgtattgtttttttactagcttagattaaacaatttgggaggtgtgtcattttgttttaaaatttttagttgaaatgtgggaactaccaaaaaaaaaaaatctcccactggaatataactgctgttatttttttgacgccgccctccaggtctttgtgtgtgtgcgtgtgtgtgtgcacacggttcctgctttagcatagcttaagtgtagtgttgaattttatgtcctccgtttttcgtttaattaagtcacttactatatgctagtcattaatttctatttgctgggcagtgctaggggtaggggtgaacccaaagtgcataaaatgcactgaaatgatttggtttgggtggttctgttagtcacgaaagggtatgtggaagcgagaatgtgtttgagataggtggtaatgtgaaaatatttatgtttgtgaaatatttttatcttaaatgcttgcttggtgaatatctgtgagtattatagcagtatctgatcagatttagagtgaaggtgagaggtctcatctgaaatgaagatgaagagccttactccgtgtggctgtataatctcagcatcattttcaattggccgtgtgagaggccattccttagtattgagcatcttagtcttttctgatttttaacttatgtgaatagcattgctttcttgacatttcagattttttgtttttaatttttatttctatttgtttcttttcaaatgcgttgaaggcaacagattatttcttatggttgaaaaagtttgatttctgagtttaaaaggatgaagtggtttgtgtgtttttgttttttttttttttttttgaggcaatgtctcgcctgtcacccaggctggagtgcagtggcgcaatctcggctcactgcaagctccgcctcctgggttcacgccagtctcctgcctcagcctcccaagtagctgggactacaggcgcccgccaccacgcctagctaattttttgtgttttggtagagatggggtttcaccgtgttagccaggacggtctcgatctcctgacctcgtgatctgcccgccttggcctcccgaagtgctggcattacaggcatgagccactgcgcccggccaaaaggatgaagtttttaaaaatagtttttgataaaatttcttcaaaaagtattgtattaatttacagtactactggtaatatagaatacccattatattctgtcctttcatttaaaataatgtttctaatttgatagttgctttatctgcatttgtgatttttagttcttctggtaccaacatttaacataatttgaggaaagtgttcttaacccttggtgtactgtttgggtccactggctccagtttagttttcaagttttgtttttgaacagttttaactattacagttttgagtggttttgactagttgaaaagattggcatttcatgatttttattctttcctagaggctaacaaaaaaggagaaaaatgatcatttaaaaaaactgaaaaaaattcattctcttttgctgtcaccaaatatccactggacctcctataaagctaagacatgatgagacttcagggatcatatttcctgcatcttgaaacattttactattttatcgttgtaggaattattatcattcatcattactcatcagttatttccaaatatgctaaaaaagactaaaataataagtggaagaatgatgaaatcacctaagtaataatgatacaatagtgaaatagattgtcatccttcattttcttactgtgtgagacccagaacattatatttcaagaatagattaaaaaggactggaaacaccttctttttagtctgcttatagctttcatttgaatacagttgaaatttagaatttttcattttcagcttaaaatggacaagaaaaaaattgacatgtttcacagttattaaacaaatcaaaataaatgcaaagagatagcatttctggctgatgaggattataatggaattggccatataagtgaaatttcagactctgggtcttcagattacaacatcctagaagaattataagaaaattcctctaggatgacatctgataatatttcatatttgtcaatatgaattgacatatgtctaagaacaaacaagaaatatggtctctcatctagtcattcaaaaggactttatcatgcaataatatttttgtgacaagaacctagaccatcctgttctgaaagaatatatgagagtttaaaaatattttatgctgttaagcaccaaaatttacctgacacaaaaggttacatgtgtttaaattcttttttttaagacagagtcttgccctgtcgtacaggctggagcgcagtggtgcagtcatagctccctgaagccctgacttcctgggctcaagggatcttccgcctcagccttctgggtagctggaactacaggcatgtgttaccacatccagctaatttttttttatttctgtagagacagagtcttgctgtgttgccctggttggtctcaaactcctgggttcaagtgatcctcccaccttggcttcccaaagtgctgggattacagatgtgagctaccatgcctggtatgtttagattcttgttaaaacttctttttttcttaattttgagacaagagtttcgctctgtcttccaggctggagtgcactggtgcaatctgggcccaccgcaacctccacctactgggttcaagtgattctcctgaggctgagcctcccgagtagctgagactacaggcacccatcaccacacccagctaatttttgtatttttagtagagacggggtttcaccatggtgtccaggctgatcgcaaactcctgacctcaggtgatccacccatcttggcttcccaaagtgctgggattacaggcatgagccactgtgcccagcctatatttctaataaaattgttttcactatctttttattcatagttctatgcattcttcattaaatggcttaacaatataaaggttccattggagccagatgttaactggtactagctattcttcctgatatactgagggttaaagtaaaaaatatttctcagatttaatggcattattacattttaacacttctctagtgtacagtcctaattatgtctgacatacacaattgggaatagttagaaggaaatcattctggaccaatcagtaatggaatgaaaaactcaggaagtcccaatgccatggtaaaggagaaaaactcctttttcatttcctttcatgtacagtgtgttcagattaactttaaaggagagtgagatgtaggtcttaagattttgtctgcaattgagtattacctgtatatggagcccatctcagcaggcacccagtcatcagccagcaaccccttccaggtccctcgacctggtccctcgacagctgctagatatcctgttgcaaattaaatatgaagcagggatggacttaattttgcatttaaaggatttcttaaagttcagcctcaaatgaagttgttagtgttttcatttttattgaagctggctttgttggaaaggaaggggcagctagaattgtcctcagtggtattaaagaaaaatgctctggaaaaaataaagtttatgcctaaagtttggcataaactttatgccaatatgcctttatatatctatatgccacatttcataactcttcttataaatactgcacagttgtcaggcctgccaaaatggtatgtagcctactgtgtcagtacagcctgttagtaaacatatgtttatagtttaactgtttcccagtagggtgtttttgagactttcctttttcagctttgtctttctgaatggtagtaacaaagggaaataaaacatggtgagtttatatcacactttgagggacaggaggctaaactctagaattaaacttatgaaccgcaacaacacttacatgtttccttaggtaccaagtgcttcacacacattaactcattgaatcctcataataatcctgtgaaggaagtactagtattatctttttttttcttatagatgagggaaataaagtgtagggataacttttaaggtatgttagaaactggtagatctaggatttgaattcagacagtctgactctaaagagcttttttaaaaaaattactgagctatttttgtctttagattatattactacaagtgatattcccgtttgtaagacatcatcctaaaggttcagtgatccataaggaatatttgggatatgttatgccactggtgtcatcctgtagatcttgcacttctgggacgatttagggttattgcatgggatgtgtgaatttatgtttcataagcattgtatgtaggctaaattttaaaaaattatgtaattgtgttttaaatgtgcataatagttgtggcttggaaaattaaacttcatttagtattgcttagttcatagctttctgttattatgtattgcccccaattatcatatattaaaattataacaactattgggggggttcatgcgaactttttttttttttcttttttgagacagtgtctctcactctgtcacccaggctggagtgcagtggcacgatcttggctcactgcaacccccgcctcccaggctcaagcgatcctcccacctcagcctcccaagtagctgggaccacaggcatgcaccaccatgtctgtctaatttgtgtattttttgtagataccaggttttcaccatgttgcccaggctggtcttgaaatcctgagctcgggcagtctactcaccttggcctcccaaggtactgggattacaggcgtgagccaccatgcctggcctcatgaaaacttttgatgttaaaaaatagggaatattatttgttaaaaattgttgggattcattgagtgagaagtttacaggctttgcttaaaatatagatcctcgtatttcctgataagtcctctctgtctgggccagggtaaattgcatagccaatagcaacaaaactcagtgttattttctattcttagtgatgtacctgtggattaaatctttactatgttttaataaagaagcaaactggacagttactactcttttcattgatttgctttcatgagtgagaaaatgctgcattcattttatactgcgacggataggacaattcatgatgtcagtttggagaagccatatgtcagaggcaaaagctatatcatacataaatttaaagttaaaaactaatactatttaaggctgggagcagtggctcatgcctttaatcctagcactttgggaggctgaggtggacagaccacttgaggtcagcagtttgagaccagcctggccaacatggtgaaaccctgtctttactaaaaatacaaaaattagccaggcatggtggcacatgcatgtaatcccagctgcttggaaggctgaggcatgagaattgcttgaacccaggaggcagaggttgcagtgagctgagatggtgccactgcactccagcctagcaagagagcaagactccatctcaaaaaaaaaaaaatatatatgtatatatatatacacacacatacatacatacactaatacgatttaaaatatcagcctcacaatacatattctaatatttaagagagaaaagtttagctttagggtttcaggtttattttccagttcgcccaaacatctaagttagctgtactgtcatctctgtgtttatggtgctttgtacatgtgtatgttatggtacttattattcattttattcagttctttcagcacatatttattgttctctgattgtgtgtgccagtcactatcatgaacacagaaaatatgtaagtgaacaaagcagataaacagtctctgcttttgtggagtttacacttccatggatggaacagaaaggaaataataaacataacaaataagtaaattctatagtatgtttggaagaggataagtactatgagaaaaacatagagcattttaaggagaaataaaaatgctagagtgtgggaaggaaagttgcaattaaaaatatgctagtcaggggaactagtgagaaagcaacattctagcaaagacttcaaagaggggagagggatagccaggcaggccatctggggagtgagcacttcaagcagagaggatctggtgtaaggctcacaaaagggcacatggctgcggtgtttgggcacagtgtggaggtcagtgtgactggaacagggggtggttggggcagagtgttaggagaggagggatcaagaggtagcaccagagatcatcatggcaggccttgtggcaggagtttgacttttactctcagtgagaggaattgaagcattttcatgttaaaacaacttttttttttatcataggaaattttcaagcatgtaaaagtaaacagactacaacaattaacttccgtcatcacccagcttcacccgtatctactcatggccagtcttattcatctgtgcccctttcccttctcccctttcatgttggcttgatgaaaagccctgatgaccttattttattttacccacaaatgttttaagcatataactctaaaagataactatttttggcatatctacggtagtattatcacacccttaaaattaataattattttttcttccttttgttttcaagacagggtctcactctggcactcaagctggagtgcagtggtacagtcctggcttgctgcagcctcaaactcccaggctttaagcaatcctcccacctcctgagtagctgagactacaggcgtgagccaccatgcctggctttttttttttcttaattttagtagagatgacgtcttgtcatgttgcccaggttggtcttgaactctcgggctcaaacgatccttccacctcagcatctcaaagcactgggattataagtctgagccaccatgccaagcctttcccccaccatctcccagagacggggtctcactttgttgcccaggctggagtgcagtggtgtgatcatagctcactgcagcctcgaattcctgggctcaagagatcctcttgcctcagcattcaaaagtgctgggattacagacgcctggcacctagctagccactaattcttgaatgtcatcaaataaccagtcttttcacattttaaattttctctcaaatgttataaacgtttgttggtttattatgtactgttttttgaattagggtccaaataacatccacacgttgtgactggttgatctctctccctctctcattctttctcattctctgtctctttcccttttacattttcatatttgttgcagaaactgcgttgtttgtcctgtagagttttttatagtctgaattttgcttatggcatcctaatggttttgtttcacgtggtcctctgtttatcccataaattggtatagtcggttctaagagcttgatgaaatgtcatgttcaattgttttggcaagactacttcatagctgggggtgtgtaactccgtcagagtacacataatatcaacataatatcatttgtgaatgtgtgggtgtgattttagcaaacattgaaccattaagtcaatagaagttgcaaattggtaacagtctaattctgttttcttcacaagctggagtgcttctataaagagaaacttcctatcatctactatttggtttcctggtggtagagtttgtatatgaaaagctggatgaatgcttgatcccttttcttcattcatcagttttcaaaataatgaatttgtttcctaccttcttccaatagtcaccaactagttgtgcatatgttttttgaaagtatcattatgatctcatggatttaaacagatttgatagatattagtccatttattatccattgatgttcaaattgtcccatctttggcatatgagaccagtggtgtgttggagctggctcatacccatttttgagagtgagttggcaaatgttgtttaatattcagtcagtttataggctggttgttaaacacagcctttatttaaaaaaatcatataaacttataattaaataaattatactagaagcaaaggtgctcaaactccatcactttctagttatcttatttttgaggttaagtttattgtagagttgggtgaaaatactatataactgtgcctctgaacacctcccaactccacatgtgggggcattacattggcggcttgaaattggccattgtaggagtgtttacatcacagcagtcagcaaatgctacagatcatggcatgatttattgtcttttttattgtctagacgtcaggaggtggtggtgaaaaatgtagattaaacttcaaaatgtatagtatctgtagctgttccattgtaagtagtaccaaaaatggtataaaaatgaggaaatattcttcaactgttatctgattcagcaaagaagttgctcacatcattgacacgtgaaattctcacataccccttccttgttttgctttagattaaactagaggtcagcaaactgcctggcctgcagcctgattctgtaaataaagttttattggaacacatctctttccatattatgggtgactgctttggcactacaatggcggagatgagatgtgacagagactgtatatcccaaaagcctaaaatagttaccatctggtcctttaagtgtgctcttctgtagtctaaaccaacattcatgccaaactgcattcatccatcagttgcaaccacaggttggccactgatagataagttttggaaatatcaataaaaacatctgtgagaatcaattggctgcatggaatttataataaagagtgttctttttatttgtaaattatgtgctgtgcctcctttatatcaacaaaacttagaagaaacacacacacaatcattcgccccactcagccagttgttaaacatttaccagcatatctctcaatacacttgcaatcggatccagtgaccgatgtcattactgaaatgattcaaccccttgaatgagatatttggaaattgaataagaagtaagaaccatcaggtttacagggataatatattcaaggctcatgagaatttagtactgcacaggaattctggtcagccaacacatatttgcaaacatgcatagagtttctattttaagttagttgttgacttctagcaatagcagcccccaaactgcctacgtaagataactggaaggaattatttgccccaaaacaatttctaggtccacactgttatgcgagccgcagcgagatacacacatggaagctctatgtgatttttggctcttaagaagttaacatgctaaagagacaaagctaacatatacaaagcactttcattactgcagtgagtataatatggattcagaatggggaaagacttctgtgaggtaaagcaactggaagaagcctggggaggaggtagatcttgacctgaacctggaccttgaaggataagatttaaatttcagtgaagagaactgaaaagagccctctaatgggggggcggggggaggggagcttcactaggaaatcaggaagctagggaagaaaatatgtgcatgtttctgtgtgtattcgaagggggcttcctggtttgtgaaggacagtaagtattcagatccatacgtagatcagtagtatgttacagtagcatggaagccatttggaacatttagattgtagtgtgaacttctgaaccactgagtgttgtggatgaacagaatgagacagcaaaagtggtatttgttaaacacttttgacttctggttgaagatggagaattaaatctatgtattcacctaagctcccttatgtcaccatgctaaaattacagtgaaggggttttaaggtgttgttgtagttgttaagtttgtaagtctaaaaaaatgaatagaatgggataaaaggcaagagtaacccattttttgaaactggaaagtcgagggtcaaatggtaaagaacttagcagacccagtacaactgaatcccaagccagcaatgcggaaacctaagacccatccagagccccaggctttgtggcttcaggtacttctggaagtgagggagagaaatggttgaaaatctgtttaagaagcaaatggatacatggatttcctccctggtttggtgcagctgagcagctgcctctacaaaagactgacttcaaagggccaaacaaagggaccgtgggttgaggcctgtgataacacaccagaccagaaggcagggatggcatcctgaaaacaagggggaattcatggaatgtgaatacaccggatgccgagatgtccagcctccttccatttgagatgctggcagccatttcttcatcctttggggaggagatttgagatttctctaggcattctgatcaaacctagataggatacccaaagatattgatggtaggcatttcccaaataaatagctcaatccgattcctctacagtggagtccccacttcccaagccctgagtcccactgacatactcaaagctcccagacagcttttttagttccattctaaaggcttaccagacaaaggaagaaaacatctgatatgaaagggagcaaaaccaactaaaaagcaacttagaggaaacagtcatgcaagaggaattaatttgaaatagttctttacactgggcgtggtggctcacacctgtaatcccagctctcagggaggtaagaggcgggaggatagcttgagcccaggagtttgagacctgcctggccaatatagcgagaccccattctccacaaaaaggaaaaaaaaaaagacaaaaaaaaaataagcgtaatagttctctactagtattctaagagaggacaagaaaagataaccaggaagcaagagcagggtgctattttaaaggaggaaatgggggaaaagaagaaggggaagccacagaagcagcattccaggccaaaagagctcttggaaatgggaaatcatggcagcagaaatttttttaaaatgcagtcgagaactagaaaataaaggtaaggaaatcctagaaaaagcagaatcagaaaagattttggctgggcgcagtggctcacgccagcactttgggaggccgaggcgggcggatcacttgaggtcaggagttcgagaccagcctggccagcatggtgaaaccccgtctctactaaaaatacaaaaattagccaggagtggtggtgcgtgtgtacctgtaatcccagctactcgggaggccgaggcaggagaatcgcttgaacccagtaggtggaggttgcagtgagccgagatcatgccactgcactccagcctgggcagatgacacaggacttcatctcaaaataaataaaaaaatagattttaaaagagaaaagattttttaaaaattatagaaccagtccaggaagcctaatatctgaacaacaaaagttcagagcagaagcctaggagcagtgaccatccgtgtgacactgaggaccaataaagccagattgttgccttgaatttatttccctctaaaaggaacaagggctccttcgaaaaatggctttttccaaatctagggcagaaaatctgcaaagtgacttggaacattttgttataccaagtagcaaggaagctaccaaagattagggttttatctaaaggactccgaagccaacttaaagacggtcccactcactggtgctctggtaaatgtttaacagctggttctcaaaaaaaaaaaaaaaaaaaaaagcagaaagaatgcttcacaagtttattttactaacataaaaatgtgtagtaaaacatttacaaatactaatgagataagcaatatccttgtagtaaattccatgtagccaactgattctcagagaatgcttttgttaattttcccaactttcatgtccgtaagcaaaccactgttacaactgacagatgaatatagttccaacgtgaatgttggttgatattttcctttatgttaatgaggaagacaaaagtgaaacaacacatacgaatgtcaaaacctccctccttgcttaatgatatgagtgacttttttgctgaattggatactagtttctgaatactggaagaatatttcctcagctgtttgtgttcttcacaatggaacagccacagctcacttataaatgtaatctacattttcaacatttctgaaactttgccttccctatcacaggtacatagttttatccgattagcaagttagagcagtttcttcccactgcccccttaaacagtctgtccgggagaaagttctctggagctggaggagaagttggcaggacgcctacagagtagccatgggtacccccagagaggaagggaattggtgccacacagtcttcggagtgtggaggtggacactgggtagtgtatcatttgtggatgtcacaagcctctactcagacttgttctaatgttttaaagggcattttgattttatgttgcttgcattcttcatcctgtttgtgagttatttcatgaaagggtaattgtattttgatttgagggaaataatgacttttttctttcacacgggtataaatatctaagaaaagctcttagctttctgtcagcttttttatgtgattatttacctcagtatcttaagtgatgtttttgttaagaaagaaaaaggcaggggaaaattagagaagttatgaaagtactattagctttctaaattcattgggaagaaactctcttgattttcagctatatcacaccccagggttcttttcaacatttctgattttttttttttttttctgctaaccttagggatttctcagaaactttgccagctgaattatctgggggaggtaggagtaggggagagtggaatttgaggatttatggagttgacagcttacaaagaggtttgaacggcctcagtagaatattaacatttgggctctgttttgttacaaatagggacatgaaatcatattgcttcctcttatatcccatagtaaaagaactatgggatgtagttcaaaatatataatcaaaataacgattggcctggctgttaagaatcactgtcttttcccagagaatttttgtgatagaatataagatcctcctctttattctaaagccactggtctgcaggtcatcaaagaagtgagtgatgttacaagcaattgccagtaatattgtatcatttggacttggattctggttctgttcctgaattgtatgtttagtttttcttcctggcgcttgatcctttagaacctcctggatgatacaatcgtttatgtcagctaggctacaattatgatcattagcaggggttgttcttgcatctatacttaactgttttttcactagttccggatcttactgattaggtactttctgaactgggaggcagaaaaatgtcattgattggcaagttcgtatctgtgtcatgttgaaaattgtcttagattattaactaagttcagtctttttgtgtgttctgcctgtcaatatatctactgttaatgagaacttattttaggattgcagtgagtttaatgtgtataacatgcttagaaccgtggccgggacatattcacatgcttagcacatgttagcagctatgaattattttaatgtcaacattatcatcatcagatttcactggtacattataggctctgtgtgtgtgtgtgtgtgtgtgcgcgcgcctgcatgtcactgaatgtacgtgtgagtgtgcgtgtgtgcatatgaacatgtgaatgtatcctcctccattactgctggcctcttcagcgtcttctgggctctattcatatgtcatcttgtcgaggcctttctagaacaccttattgaaaagtgtggtggctcacgcctgtaatcccagcactttgggaggctgaggcgggcagatcacgaggtcaggagatcgagaccatcctggctaacacggtgaaaccccgtctctactaaaaatacaaaaaattagctgggcgtgtggtgggcacctgtagtcccagttactcgggaggctgaggcaggagaatggcgtgaacccaggaggcggatcttgcagtgagctgagatcatgccattgcactccagcctgggcgacagagtgagactccatctcaataaataaataaataaataaataaataaataaataaataaataaataaataaataaaagagaagtgtgatgcctcttctacatatacacatcctgccttcagatcctgccatgtggattctgagtttcaggagggcagcggggatttctgaaatcatctgacatgggccttttcttcagtccattccagattgggggagaatagtagggacccatattccaacatcgccagttcctgaagtcaagtctgagatagggctgtccactgggcactggccgggtttcacctcctccattcctacctcatgtctttgctgttgataaagaaccttagacgccctccatttgccctccatttgagaatgaagtgagggaacaggatacggttcatctgcccattgtgttgtattccacttttccgccggggcattatggctgcactttattttactcatttagtttgttttcttcctctactagaatgtaatccatgagaagagatatttttgtcaattttattcactgtttcattcctagcacttataatggtgtacagtgcctagtaggcacttagtaaatgttggacaaatggccgtttcccagataacttattatttcataatgattattacgcatccttggttcatgcctctcaatccatctcatcctaaatatggctactaatggcagttacatatgttgaaattcaccttttgaaattctagtttggccaggagtggtggctcatgcctgtaatcccagcagtttgggaggccaaggtgggcagattgcttgagctcaggagttcaagaccagtgtgggcaacatggccaaaccctgtctctactaaaaaatacaaaaattagctgggtgtgatggtgcatgcctgtagtcccagctgcttgggaggctgaagtgggaggattgctgaagcctgggaggcagaggttgcagtgagccaagatcacaccactgcacttcagcctgggtaggtgacagagccagaccctgtctggaaaaaaaaaagaagaaaaaaaaaaagaaaaattcaagaaatgaattattaagcgtttgaaaattagtttttataaatggttggtatgataggagcatatgatctatgagagaataaagttgtacctttgccccatcccaatcacagcctcttctttcctccaaaagtaacccctacacttttagtgcacacattttatatgtattattttatgagtgtatttgtacattttatggaattatttcgagatacttcccctcatgtactacttggttgtccagaggtgtagttcatatagaaaaaaacaaaaaagataaatgcttgatttcttttatacattgttttcaacttaacagaatgactcattgtcacctacaaaaggtaccaattaaatttttatatcattctgaacttactgatttaaacatttttagtgggttttaatccatctcaattattgtccatattggagtccagttgcccagtctttagctaacaggagccttttctttctttctttctttctttctttttttttttttgaaatagagtctcgctctgtcacccaggctggaatgcagtggtgtgatctcgggtcgctgcaacctctgcctcctgggttcaagcaattctctgcttcagccttctgagtagctgggattacaggcacccaccaccatgcccagctaattttttttttttgtgagacggagtcttgctgtgtcgcctgggctggagtgcagtggcgccatctcggctcactgcaagctccgcctcatgggttcatgccattctcctgcctcagcctcccaagtagctgggactacaggcacctgccactatgcccggctaatttttttttgtatgtttagtagagattgggtttcactgtgttagccagggtggtctcgatctcctgacctcgtgatccgcccgtcttggcctctggagtgctgggattacaggcgtgagccaccgcatccggccctgcacggctaatttttgtatttttagtagagatggggtttcactatcttggccaggctggtcttgaactcctgaccttgtgatccacccaccttgtcctcccaaagtgctgggattacaagcatgagccaccgcacccagccaacaggagccttttcatctttgcatctattccttttgactagatcctagtgattgttgatataggttccttgttatctgatgggacaagtcaggttcatcttgtatatgtcatgactgagacgtgaaatcagccatttctcaaaaaagtccataaaaaatgattatataattctgtactgattttttttttcattttagcactttacagatatttttccaccatctcataacctccattgtttctgataagaagtcagacgtcatttgtcttactgttccatggatctcatgtgctgtttttctgttgctgctttcaggccttcctgtttatgtttggctttcaccaatttaactaggatgtgcctaggtgtggttttctttctttttttttctcaatgcttgggagttactgaacttctttaatgtgtatttatgtctttttccaaactggaaagtttttagctatttatttctttgaatattttttccctatcatctccttctgagacgccaattaaacttgtgttagaccttttgatattgttccatagagtcactgatgttctgctcatttttttcagtctttattctgtccgttcttccaatttgataatttatgttgatctattttcagggtcactgagctttctgctacacatgcagttaagtttgaatttcagatataatatttttcagttgtagagttaccatctggtttgtttttagagttccatttctctcctgagattgccagtgaatatattttcctttatgttcttgaacatagtaataatagcttcttgggctcctcttagtgatggtctcatttgattgcctttctcttcagtatggatcaaagttttctgttttttcacatgtctaataattttggattatgttcttgacattgtgagtgtagtttgtagagaaggtggattctgctgttttcctgatgtttgttttttgtttcagcaggaagttaccttagttcaactcaaactccaagctgtttttcctatgatgggcagcagcagaaatctctttaggttttgatttgtgtgtgtatatgtgtctgttttctggactattatctttatttttttctaccttaattgaggcataatttatgttcagtaaactgtacatgtttataacatttttaagttttgacatatgtatatacttgtgaaagcattgtcacagtcaaaattatgaagatatccatcaccctgaaaagttaccttaagccttttgcaatccatatctcctcttccctcctccccagggggatccccaggcaaccactgacctatttactgtcattgtagattattttgcatttttctagaattttatataagtgaaatcatggtatgtactgttttttggtctggccttttttcaccaatataattattttgagattcatccaaaattctggatattttgcaaatatccataagttactcctttttattgttgagtattgttccattacgtgtatatgccacaatttctttacccattcagctgttaattgacattgggattttttactgtcttggactatttcaaataacgttgatatgaacatttatgctttcatttatcttggataaatacccaggaatggaatggctgtgaacaataagctatgctttatctctgacctaggagtctgatgtcttctgtgaaaatccaggaaactgtggtggactaacttcttggaagtaggacagcatttcagaccctttatgattcttgacactgagttctttgcattttcatataaaatttcaaatcaatgtatcatctacaagaaagactgcagggttttgtactgggactgcatggaacccatagaccaatttggagagagttgagatcttcacaatattgaattttctgattaaagaatataaggctgggcatgacaggtcacacctgtaatcccagcactttgggaggttgaggcaggcaggtcacctgagttcaggagtttgagatcagcctggccaggatggtgaaaccccgtctctactgaaaatacaaaattagctgggtgtggtggtgcacacctgttatcccagctactcaggaggctaaggaaggagaatagcttgaacctcagaggcggaggttgcagcgagctgagatcgccccactgcactccagcctgatgaccagagcaaaactctgtctaaaaaaaaaaaaaaaaaaatatatatatatatatatatacacacacacatatatatatacacacatatatatatatacacacacatatatatatatacacatatatatatacacatatatatatacacatatatatatacacatatatatatacacacatggcacatgtctccattttttaaagatctttaatttttctcagtgatgttttatagttttcagtgcatctcttatacataatttataaactttatccgtaaatatttcatattttcaatgttttacatggcatacatagtttttttctttaacaatagacttaatatttttaagaacagttttagattcatagcaaaattgagcagaaagtacagagttcctaaattcatcctgctccttcatccccttatccttccccactgtcagtatcctaagccagtgtggtaggtacactgatgaacctgccttgacacattattattaccagagtctgtagttttccttaggttcactcttggtgttgtacattctctgtgttttgacaaatgtgtaatgacaaatacctgccattataacatcatacagagtagtttcactgccttagaatttttctgtgttctacctattcttccctcccttaccccaacctgtggcaactactgatcattttattgtctccatagttttacttttttcagaaattaattgacagatatcatcattatatgttattactgtgtacaacatggcattttgaagtatataggcactgtggaatggttaactctaacaaatgcattgtgtcacatagttaactctttgtggtaagggcacttaacatccactctctacattttaaaaaaatactacagtatattattcttaaccgtagtcacattgctatacaacagatctcttgaaatgtgttcctcctatctaagcgtaataatgtgtccttcatgtacaggtttctgtgtagactcgtgttttcatttttcttgggtaaatgtccaggagtagaatggtggggttatacggcttgtttgtctttttattattcagctgtgaaagttctttacctatcctggtcatcagttttttatcatctatttgttttccaaatatttcctctcagcctgtggtttgctttttcattttattaacattatctttcaagaagtaaatgtttcagttttaaggaaatatagtttatctttttttttttcctttttatgttttgtactctttgtgccctaagaaatctttgcctagcctaagatcacaaaggtttttgtcctgtgttatcttctagaagttttatagttttaggttttgggtggctggggtgggtggctgggagaatgaatgtcaaaggatccctgcaccatttgttgaattccattgctatgggagaagcttggtagaaatgccggtggatttgtggatagagtgatgggttgaggagggagtcctcaccagtggtgactcatgggaagcttcagagggaagtgagtggggcctgggggtcaggagcttcaggagtggagagggcagggaatagtggttcagaaagtaggggccgggcatggtggctcatgcctgtaatcccagcactctgggaggccgaggcgggcggatcatgaggtcaggagatcaagaccatcctggcttacacagtgaaaccctgtagagacagggtttctactaaaaaatacaaaaaattagccaggtatggtggcgggcgcctgtagtcccagctactcgggaggctgaggcaggagaatggtgtgaacccgggaggcggagcttgcagtgagccgagatcgcgcctctgcactccagcctgggggacagagtgagactccgtctcaaacaaacaaacaaacaaacaaacaaagaaacaaacagaaagtaggggagcaagctgcctagaaaccttggtgcgtgctgagctgtgtggggcctccctggaggtgggcgtagtaacaggcctgcgtgtcgctggctttagcagccccggcagggtggatgcagccacgtgcaaagtagcaactaggttcattcttagagttaggctttcacaggcaggggtgaaggaaaaatagaaagttgcttagtaaatgtgcttctcttgaatggacagtacttgagctgaggtcaaacctcgaacagcagcagaggatagacactgacaaggactctcccgtcacctcccctatccatttccttcctttctgctccttctagctgctccgttttatgtctcttgcatcttgtcagcgttgatttatgcagagaaaagcaactatgaccatacttcatcctccccatcgtgtgtaacagactggagcatgtggtgcaccatgttcggcaccttgactttcgttttacccaatagcatatcctgtagctctttcctgttggtgggaaagaatatttgagagtcatcttagtgatggataaaggaaacacttaatagcagttttttctggatcgtaaagtaatttctgaaactctcctgtgttttctaagttcctccagtatgcatatgttccttttatcattagcaaatggaatgaaattcccttctttcagcacatgtccactctgtgccgtcactcttccaggcacgggggatggagcagtcaataaataggcaggctctgcttccatggtgctcgcattctcatgtgggctaatcatccaaataagaagatgagagatgaggctgagtgcaatgcacaagagaatgaacgtaggggcctgtgatggtggctgaccacggaatttcagggcaggccttctctgagaagggagcacttaagctgatagctcagtgatgagagccagtcatcgtgaccagcaaagaagagtgtgctagacagagaagagtgagcgcaaaacctctgaagtgagagtcaacttgatgttttcaagaaacagcaataaggccaacatgcctagaatctactgagggagcgtggcgtaagatgaagcagaggtcagtgcttatctggtaatcagggagaagaatgaggattttgttttaactgcaatgggaaaccattgaagagttttaagttattagaaaggagagctatagaaaaagccaaagttgccaggtggaaaaagaccctagaaagcccaattagaggcgagtgttaggaaaaccctgcagtgttggacgcatcaggttaaataaagcttaggttgaaaacaaagagaagtggtttattaatttgtttttatggtgcgctctaaaaagtaatctccctgaaatgggaactccaaatttaaaagataaattttagatcaatgtgcaatttaaattccaaactgaggaaagcagtttttaaagatatgatttcggctgggcgtggtggctcacacctggaattctagcactttgggaggccgaggcaggcggatcacctgaggtcaggagtctgagacgagcctggtgaacatggcgaaaccccatctgcactaaaaatacaaaaattagccaggcatggtggcatgcccctgtcatcccagctactcaggaggctgaggcaggagaattgcttgaacccaggaggcagaagttgcagtgagccgagatcatgtcactgcactccagcctgggcaacagagtgagactgtcacacacacacacacacaaaaaacaaaaaacaaaaaccaccaaaaaaagatgtgatttttaagtatgcattttaaaattattttgtattttagaggaagaaattagtatttagtcatttgtttcttctagaattttaatgctgatgctgagattttaggaaacctagtgtttaaattacagctcgcaaatatttcctgattcatttaaaaattacaccctggctctgaaattagcccatttgtgtttgttttgcctttaggagatccacagtgtagttctggagggtgtgtagaatataaggaaggggcaccctcattctgtctgatgtctgaatatggaggagacaggtactcactcatcctgtatggtatttcaatattgtggagacaggatggctactggcagtttttgataaggaggatagtttgcgcagctttgaataggaagcaagattaatgtctttgttagccaaaatgaacagttagatttttattacaaagttgacccttgaacaatatgggagttgggggcacagacccctgtgcagaaattcatgtgtaacttttgactcccccaaaactttactaatagcttactgttgactgtaagccttaccaataatgtaaacggtcgattaacacgtatttcgtatattatatgtactatgtactgtattcttacaataaattaagttagagaaaagaaaatattattaagaaaatcataaggaagagaaaatgtatttcctggtcattgagtggaagtgggtcaccataaagttgttgatccttgtcatcttcatgttgagtaggctggttggggggttggtcttgctgtctcaggggtggcagaggtgggagaaaatccacatataagggggcatgtgtagttcaaagccatgttgttcaagggtcaactgtattgtttgacaagcgagatgttctgaaataagaataatagaaagtcatcatccaacaaaagtaatgacaagaagaagaacaagaacagcaagctctggtgaccattcaggagtggaggcagtgtgacatagtggtccagctctggtgattcaggagtggaggcagtgtgacatagtgtcaagctctagtaaccattcaggagtggaggtggtgtgacattagcggtcaagtctagtgaccatcaggagtggaggcagtgtgacatagcagccaagctctagtgaccatcaggagtggaggtggtgtgacatagcggccaagttctagtgaccatcaggagtggaggcagtgtgacatagtggctaatccatgtgccttgtaggcacacaatcttggattcacatcctggagcagcctgttagtagccatgttctattgggtgggttacttaaacattccaaatctcatttcctcttatggaaaatatagatcataaatagtacccacataacagggtagtagtgaagatgaagtgatcatctatataaagatcctagtgccatgtcttttggcacctagaaagtaccaagtaaacaagaacagtaatacatttaatataataattatgattttgttatctgttttacttataaggcaagtattcacatcaccatttttcagatgaaaaacatacttagagaactctaaatttcctaagatcacagagctaggaaatgcagtggcagggtttaaacttatgaaggtctgactccagaatttatgcttttaatcataactccatatttttttctagcaaggtccttccaagattggatcattggattcataattaattcagagtgtaaaacaatacatcgtagaacaattccctattttgcttgttaatctaaagatttcacattatattctacttattttaaaaataaaaaatattctagaagatagtaactttagaaaaattttaaaatgtagataaaaaatgtttacagataagataaaagaaagatgtcacatataatcccatgaagaataatccttcctgacttctaccgtgtgtgtgtgtgtctgtgtgtgtgtgtctgtgtgtgtgtggagtggaggcaggagtgtagagacgcacacacacatacacacacataaatacatacgtacatagatgttgatttctttttccaaaatgagatcacaccatatattctgtgctctgatttgggttttctccccagcttattttattgtgaaggtctttccatgtctgttaacttatcctcatgggagcatagtgttgcattacctgtgtgtgccatcatgaatttacatagttccctgttgtgacatttagattgtgtagaatttttcactattttaacagtgcttttattaacattcttaatcacacacatccatttgcgttttctcataatttccttaagagaaattcctggaagaactgctgtgttgattgtcacctttttaagcttttgatacatatttcagttgccctccagaaaggctgtcccagcatgcacccctgcagcagcacggactgcctccttccctgtgcctgcatctgcagtgcatattatcctttttgatctttggcagactggtgaaaaatagttctgtcttgcatgcctttgattaccaatgaatatatttatgtttataaactatttgtactttttccattataaattgctctttaaaaattctttgcctcttttatcacgcctgacccctgggttttggttggcccagagattactgaactactttcgaccccaagttttgcatatttaaatttatttttagggatttcaggtgagcatctttaaaaaaattagataattaggagaaatgaaaacggcttgtattagtatacaaatagtaatgtaggtattggcataaaacaaaacttgctttaaggactcgctctaaagacatgtctttcccattacattactgaatagaggtttaactttgaactcattcttatgagtagggaatcataaaactctgatcccaagtccatcattccttcttctttgagcatgaaattctcatcagtcattggttgtactttggaactactgtatattagaaaccaattctcacttttccgggagtatattgtttaaaaaacaaattcagatccatcaggatatgttctctccatttttacttatagttaattctctgctgctttcctaattacttttgtttcttttcttccagtggtcggttagaatataatttatttacgtgagtgttgcctgatggaagatactttctggtggttcattataaaatacattttttaatgtaaacttcatttttctattgatttccattgtacaattggaaactgtaactgttagtgaaaaatggcggtctgttgttgaagagttaggatggtaacttgttaaacttctacagactcctgacttgagtttttaggccttaacgagcggcagaactcgacacgcttctgagttcgccttccttcacttcttctctaagtcctttccttgagtgtcttaacactcatgcctgcccccacttaacatttttccctgacagtctcctgctggggccattttgttcttgatcccttcttctgccctgccacccccactccatatttaagatgctaaaagaatgtattctaagccttacctttcttgaagctcagagtttcttgtaatatgaaaaaaaattgtttcctataaagctattaagttcttatattgctttcagaagtataattttcatgacttagattgtatgtatctgtgatagaaattatttttgtataaggaaagacaacggaaaatttttagtctagacataacagtttatttttgctagaaattaaaaatagtaatacactgtagtcagtcgtttaatatacttgttcttaaactttattagttcacttaaaagtttcctatcatacaatataaaattcaaagattttaaaatacatgtagctggaagtcttgttatttcttgtaaatcagacttgcatatgtggtagaatttctacttcaaacaaaggaaatattagtaatgatggctatttcattattgagatctgtgtgctaagcatatattaattgttcctaaaaccagatattcttacagaaatatttattggattaaagaaatatttactggttaaaataaataaattgatagtaaattttctctgaatctaaattgatgacaaataactgctgctttttttttttttttttttttttttgagacggagttttgctcttgttgcccaggctagagtgcaatggtgtgatctctgctcattgcaatctccgcctcccaggttcaagtgattctgctgcctcagcctcacaagtagctgggattataggcatgtgccaccatgcctggctaatttttgtatttttagtagagacaggttttctccatattggtcaggctggtcttgaactcccaacctcaggtgatctgcccacctcagcctcccaaagtgctggaattacaggcgggagccaccgcgccaggccaacgattgctattttgacatgacattatatgcatgacagcctgagaagtaaaaattcatacatttaatgaattagattttaatttcttttactaaatatgtgaattttagattaagaaatattgattaactatccaaatatttctaatatttgttcatcacttaaaataaacatgatttgtcttttagccagatgatatatagtgggaaaccacgtttctgaaattcacagttatttcaaaactataaatttaatcgggacgcttttcacatgtcaagttaaatattgatttaggtttaaagtgacacaagttgaatttcattatttatattaaagaaagtcagcgaaatttccataattaaagtttgttcttcctggcattcttttctaatttttctttttttaacctgcaaagtttccagtttaccagtagagggcactgttgtaacatggtagaagtgttgggttgattttttttttttttttttttctttctttcccagtagctacccgctcctccgcctttgcagtttggaaagtgttttttaaaagcaatgttctctgtgtaattaaaatcagttccctgtataattagcaatggagccttattctttgtggcagagtttgtggatggcgttattatttaagtctgtgttcgtgtatagccaatgccagaactgttgcctattaaaatataggaagttatattgccgtttatcagcactaagcaatattgtagatggaaatatataaaattacagtatgtttcatttaggtgctctgagcaaattactcaatggggaacgtttaaaactcctggttctatcttgagaaatagcagagttaatgtgccatagttataatatcttgctttcaggtgccctgaataataatacaggacaactaattcttgcagggttttcaaaactatatctgcattagtgtactgcttaagaaagccactgatctacttagcaaattctttatataatttctttttcacgctgccttaaaatcatacaattttgatacagatatcaaactactaaaatagtattaaagcacaattaaagttatttctttctttcttaaaagacatatatgttatataaaataacattaaatgtgcattcattgcctggctgccttgggaaatatttgggggcagggagtttagagagaatccaagcctgaattttgagttgtcagaggtgtaattcatgaagttataatttatccataaatcccaaagtctctataagtagtttaaaaacaaacagaaatcttatttcaagactaaattatagattatttgctatacaattttttggaactgaaaaaattaaaagtaataatttaatatgtttataattaatttcattctgtgctttaatatttgtaaaatatttgagaatctggaatcttagggtttttaaatctttaatcgatagccatatcaaattagggaattagtattttcttcaagattttttttttctaactttatgaaatactctagctaaaaagttggctctgttgaaattgtgtttctctctaacagacctattttaaaaggtggaaaacggctttcattgacttactttgtatccacagacttaggaaagcaggtaatttaatgtttacttagtgatttactttgacaataaaaatgtagggtaaaatttgagagatgaacgagatggttgaggaacctgtcatgtaattttagaaaaacatttaggaatatcttttatgcattagtcactgcaggtgcaaatttagaatagtttagtagaactggaacaaaatgtcattttctaaatctaagtttctttggtgttatggatgtccccaagggaagacatccgagttctccccccccccccgtcaaaagggggtgtcgaatttgaggggagtcccccactcccttgtccttagggtacgtcataaagcagatgggaccaggtattttgaagaatcagccaaataacagaaggacatgacagaggctgtcctagttccttgattaaaatgtgtaaggttgattagagaaaagaacttaatgctgtttatagatagaaaactgttgctttctcatttcttattaccaaagtgagactgaaacaaatgttgattctgttggcacatttgtattgagcacttaggttccctgtatcatcttggtcatgattaccgctgtgtttcccctcgagaggccattgcaggttttagtctgggctatttgtattcagcaaggtcaagataagttttatcgttacagataagtcaagtgcattaggatcaataggtaatagtaagtgcattgaagatattattgccaagctcttaatgattttttaaagctgtgagcttgtcatataaaatatacctcttattgttttatctatctgaatggagctcaggagtccaattaattttgcggacatttcaagaaagagtaaagaaacttaagggcagattaaagcaatgtttttggaaatccttaattgctctgcatttaaacttgtactgatgaagttttagaggctaattatttttaaagaaatgcaaaaggacagctagtagacagcatttataaattacaaatattacttgagtttacttgttaagacaatcattttttgaagttatatatatcttacccctgggctttcctgcataaatcagatttctgcttcttcaggtggggaatagtgtggaaaaaaagaccttttatacttaccaagggatgatggtgagtatttcattattttagaatttctgttctggcctaaatatataaataagctctataagctctatatatttaaagccaaaaatatcctaaacattttcatgattttttttcttttttactgaaaggaatagtttttatggattatattaattaatatattaaaaatatggactctaacagatatgttttgtcttagttttttttttcagttaattttctgtggcccaaaacatgaccacaacattaggtgaaatgtagattgcatttcttttcttttctaggtgcagattacatggaaaacttttttcatcgatttcttagctgtatgtatcatgtaactgttcaaaacacataaactaaagaaattatgtattgagctcgggtttttttccttcttcagtacagccattttaaaaaatcctttctaaactttttagacttctagtttggaatgttgtggtgcctgcttgcatttgtgcttcttaatccttcaaaatgtgctgtttttcttttgatactcaattatagatagcagtttgtaggttttccttgttttaagtgaagctttcttatcttagctgataattgaaataaggagactgaaaccaatcttcatattgattttatgtattctttatcagtcactatttatatggtagtaaataatcaccattgctgtcataattgttcctcctcgatattttttttctgtctccatacattgtttatttatttaaccatttaagttgcaggtaatataagcatgtgacatcctttctggaaattgtaaactttttttttaaagtcctataaatgacgttctttgagcctttggcttattaatctttataatattggtctacatttccacctacttagccatttctctttctggctgaatagtgataatttttcctcaacattaggtcaatttattttattgctggattagattgattgtgttataagaaagagaaaaccaagaggtacagaaggatgtgtggaaacctccactgaaaacggatgctgtccttccagagccagcgggcacgaaggggttgttggcctccagttgaaaagtagcatgaaagagaagttgactgcctcttttcaaaagttatctttgtgtggtggtcctaatgcaatattaagaaaattagagctttaaaaaccagaacaatggtccttttaaaatatatctagtttagtgaatttaccccccaaagcctctggtgtctaattactcaaaaaggaaaagaaagaggagaaatctttactagcagaaaaataaattgcaaaaagtggcaagtttttacttttatggaaaacattttaattctgttttaatccagaaggcaataaaagcagcaaattttaagagtattcatttttttcttgtacgactaattttaccgacagaaaataattgaactccaaacaagtgatagtaatcttatattactattaaacttttattttatttatttttctctttaagtttttttatcatactattaaacttttaaatttatatttataaaaaggaagtttgttttcctcctttttacttataatttatcttgtctgtataataaagggagacgcttaatgaccaaaagaacaaatctgtacatagataaattaattttgtgcggtgttttatatttttcttttctttgttcccaaatagtgatgaaatcgactattttagtaagagaaagactggattattgtttagggttaattttctgaaatattgtgaagcagtttttaaatttaacaagattaattattacctgaaagcaatactttagcttcacatttagaggtcctcgtatttcagactgtgggcctggttttctctaaaattaattaggaacccttgtaaagaggtattttcaatgaaatgggccataagcaggtattttaaagtacatattgttttctaaaagttttcttgttggttttataagaatcgaatatgaaagaacaacttatttattgtagcaggagttcctgtaatgctgtttttggaaatgagtttattgtccacataggagaaagaggagagaggcagtcttacctattcctgtaggtgagcaccgtatacagaatcacgggggtcagtggttatgtgacagtttgtgtgtttactcagcttacttgaaaatacagctatattgtcctaaaagtcaggaaagttctttgacttaattatctttatctttggagcatagccaaagtcattatttccactgaagttgtcatctgtgctttacattttcttccatctattaaaactatttttcctcttcccccagcagattgttgaaactttgggaagtgcatgattcttcctccagactcttttcttgtactagaaataggacagtgccagacctatcacttgtactttgatttgctgcctttatctttagcaaatctaaataaaactgtcatcctgattttcagatctctctttgaacttcctttactcaaattgcccactttcctatctgctcactactttttttttttttcctaatggagattccacgtctgaggtttattttttacgctgttactgtcctttcttggatttttaaaatactttttactttataacttatctgttacttccttttggtaaacacaaatttaggtgataattacttagcttaagtgagaaaattgtcagtctccatgagtctttagaaataatttatactgatttcataatttctaaaaagctacctgactttgtgactttggggatcatcattaaggactgaggtggcaagaatggtggtatggaaatctgggaggtttttcttctttcatatttgagtgtatttcacataataatttctcaatattttacaaactgtgtaaaataagtagatacatttcttagcccagaatagcccacaaatatttaatgaaagttggaatttcttgttcagttctttaagacacatagaaaaaattgtcatagaaagcaccttgttatttaattcctaaatatttagaatatgaataagaatgtaatgagaatatggcatttattgttagaattttccaatattgctttgatataatgaataatataaatgctttccctttatcattatcttgtagtaagagaatttaagaattttagaggtaaagtgccctctgagattacaaccctactatttaaaaaataagacaactgagacccattgtgatgaagtgacttggccaagatcttaaaagctcattagtgacagacatatagagtgaggtttcttggttcttactccattttttttaaccacatgctcaattctgtgtccctctctctccttctagtaccgtttatacaccgtgtgtgttattttgagaagggactagttaatttctatactgtaacggcaattcagatctcaaatacattggagctaatgtttctgtcaccttacctgtcacagtgtcctttgagtagacgcgtactttgcaacttggcatttattcagtaaacattttttttaagtatgtaccatgtgcctctggcgtgcaaaataatagggaacgggtattatgcatctgaccttcctgtgttattaattctaaaacatgatttttaaaacaatacatttaatcatatagatgtacccaggagcagatcctgattttgtgaggcctaaagcttgtacaattttgggagcctttttaaagaaagtaatataaaatagcaaatgcaaaagcagattcaaaggcctgtcagtagtagactgggtaaatagattgtgaaatattatatagcaatgaataaaaggctctccaactgcacacagtgtgaaaaacatctctcctccattgaattgagtgaaagaatccaggccctcagagcacttctgctcttagaagactggctgtggttgccttggagtattgggcctgaggagggaggggtgacgggaggagtaagggtacaggtgatgttctctgtcttgatctgagtgtgttcagcttgtggaaagtcatcaggccacacacttagggtatattaactttgtatgtgtttattatactttaacaagggtatttaaatcagctatattggaagggagtcctgtaagtgagaaacccagaggccactagcttataggaaattccctctctagatgcactataattaattcaaccaatgtatgtatgtatgtatgtatgtatgtatgtatgtatgtatgtatgtatgtatatgagacagagtcttgctctgttgctcaggctggagtggagcggcatgattggggctcactgcaacctttgcctctggattcaagtgattatcctgtctcagcctcctaagtagctgggaccacaggcacacaccaccacacccagctaacttttgtatttttagtagagacagggtttccctatgttggccaggctggtccggaactcctgacctcaagcaatccgctcacctcagcttcccaaaatgctgggattacaggcataagtcaccgcgcctggcaaattcaaccaatttagtgttactacacatttaggctctttccaatacagatatctttttgaagctaagagtttaaaaatttataattttatgaaatgtttaatatggccatgtttagaggtttttttgaagtgttattttaaaatagtagattaataagacatttatatgttctatttgccctttttattttgagagattatacctttgtcataaaattactttcaccaattatagttaaactgtatggtagattattaattacaaacttacctatgaaagatttttggaactgtacactattaatgaaacgtaactatggtttcagttggtaacatactcatgcataattgattatatattttatctcataaggttttgagtcagaactatttttattatacatgaaatgaaataatgacacccaccctcatctttgtacaagattaaaaggaacaacagtgaactgtcttatttggaaaatgacatggcattattttagaaaacatttagaaatttattatactaataagccctaatatggactcctgaaatacaaagtgtaaacaccggctctttttgtaagacaattcagacagcatagaaatgacgggagatggtttttaggatatttagtatttcttctctacctattgggtaactcactttattcatctgatgggccatagttatttacctttctggatttatgggtggcttttaaaatattgttttgattttggccttgtttcttagtcttgtagacttgtatcattaaaaataatgatgcaattaaataaaatacatatttggatttttaacattcagtattcaaattccaagtatgtattttatttcctagtttgggagaaacaagacctagtaaatgaaataaaacctggctgggcacgatgggtcacaacagtaatcctggcaactctgggagtctgcagcaagaggagcacttgagcccagaagtttgagaccagcttgggcatatggcagaaccctgtctctacaaaaaatagaacaaattagctggccaccccaaaaatataacaaattagctggccttggtggcatgcacctgtaatctcagctactcaggaggctgaggtgggagaatcacctgagcccgggagttctaggctgcagtgagctatgatcactcactgctctccagcctgggtgacagagtgaaaccttgtctcggaaaaaataaaaaataaaactcaagtaacttactccttagactttttggggaaataactttgatttatcagagtgccttcatttgacagatttttgcacatctgaaaacaaaaactatttttgaattaatatgatcacttgttatgagatttaatatattaggtggtagtctggagggaattggtggatgtgagaaataagaaatatgcagctatcctgactagcaccctgagaaaacagtgtgccacagtattgaagagaagtgagccacagttaagtaacagaaacctgtattggaattttcttagactaccccactctctgcctgtatgatagacataatcctgctgacgttgtttcctttaagggccatttcttataaatgcatttatattcctagaataagctactctacacagtacatgttgtatctttccatgcctttaagtccctcatctaggtggatttttttttagtagtttctattctgaccaccaaggttatcagattcaactccttacctactcatcactaagccatttacattgtaatttggcaaagattagtcttgatgatgcgtgcaacagatgtatatttaaacgatatacctactaatattaccatatctaattttctgctaatccagcacatctgtgtttagaggaacaaacagaaataagagagaaatgattcacattacaaaaggattctcttagcccaagcatggtggctcatgcctgtaatcccagcactttgggaggctgaagctggaggctgatttgagctcaggaattggagaccagcctgggcaccatggggaagccccgtctctacaaaaaatacaaaaattagccaggtgtggtggtgcatatctgtagtcccagctacttgggaggctgaggcaggaggatcacttgagtccagcaggtcaagattgcagtgagccatgagtataactaacactgcactccagcctgggctacagaatgagaccctgtctcaaaaaaaaaaaacaaaaaaaaaacccacaagctcttttaatatactgttttcccaccatgtgtcgcaatactttactgtatcttgagaatcttcagttatatttcaatatcctaggttcctaaaccttaagatatgcctttaatgccgcctccaagtcagcagtatacgaaaacttcaaaattctctttaaaaggacaatagtttaatcaagtaaaagacatttgtctctcagacacacacatacacacaaacacacacacacacacacacacactagatagcaggtttagtataaaatttagcaatgaagctggaacgtaataagttttttatatcaaataggtatatgttttacaaataaaaagagcaagacaccttctatttctagggggccccttgaaatttgatagagtaacaatcatgcatttagatgtaatgaaaaaattgacctagaggaagcatgttagcattcagctggtagaagtgatgtgtagcagaaagagctgtgacagaagagctttccagcttgagttctccttccaactttcaatttcctttactgtgtaactttggaggagttgcttaccttctctgtgccctagttaacgcattaaaaagaaaaggataactgatttttgtgattcttgagcagagataatttcaccagagactttatatgttggtggacttccacactggctgttcttgtaaattcaccagcgtgtcctggaatcagtaatataaggaactagtaagtgcagttaaacaggtgtcgattgggcacctacagtgagttcaaaactgaactgagcagagttgatttgtctgtgagttttcatgaacacagctatttcctatactgatgcattataaattgtactgaattatgggaaaacaattataaatttcaagatgttttcttattcaaattttggaaggttttatctaatctgtggcttagtgcagagatcatcttattggagaccgtcaagcatcaatcttagcatgttagatttggaagttttggtcaatctaacgtgtattcctcatttacaacatgtttgtgcaagacatacatatacttcacagtccttgcctctgagaagtcagtctctcaataggatcttagaggtcatccagtccatctacctcattttataacagaggaaataattgttacagggatgagaaaaggaatcttcagaagtaagaaatgagagggagaagtttggtcgttaaaaaaaagaatgtgttacaattaaacctaggatgatggaaagcccttgaaaggttttagggaaataacattgtaaccacaggaaaagacacgtaggtttattggatgaaaattactcaggggtatacttggactcaacataaggaagaattctccaacagtcagtgtctaaaggtggagtgctcctatcagaaggcagtgagcagtaagatcactccctcaatgagcaagctttgcaaagtgatcacttgatgagggttttgtagaatgtagtacgtaaccactggggtaatacacctgggctttattttttcctttgtaataatttcagacttacagaaaagatacaagaatagcacaaagaattcctaagtattctttacgtagattccccaaatgctaacactttacatcgtttgctttttctgtgctgtttctatgtagatacatgttattttttgtttctgaactgtttgaaactaagttgcagacatcatgctcctttgtccttaaatatttcagtgggtactttctaaaagtgagtggcttctcatatgtaacagaacagttatcaaaataaggaaattaacattgatacaatactgtcatccaatccacaagctacactgagattacatcagttgtcccagtgataccctccgtagcaaaaggaaaggacagtttgtctggttgtgttcagttaggagtcccgtggtgcattcagtcagcctttctctttagttcttcaatctagaacagttcctcagcctgtctttgcctttcatgacctcaccactttggaagagaacaaactagttattttgttaaatgtctctccatttgggtttgtctgatattcctcatcaaattcagggtgattattttcatcagaaataccgtagacggtggtgtgttcttctaatgcctcatgtgatgagtcctgtgatactgatttgatggtaattttatttggctaaagtggtgacttccagatttctccattgtcaagttattactttctcctttgtcattgatagctatctggtggagagatactttgagactatgtaaatactctgtttctcatcaaacttttacctactagtttatcatccattggtgatctttactcatattaattattcctaatagttgctggatggtaaatttctaattccattcttccttctacatttatcagttggcattctactctatggaagattttcccctccttcccacttatttattcatgtattgatatccgcagacacttattttactcagtatattatactcttagtccattttctgttgcttagaatacctgggtaatttataaagaaaggaatttatctcttatggttatggcagttgggaagtacaaggtagaggggctacatctagtgagagccttcttgctggcggggagaggggactctcagagtcaccaggcaacgcagggcatcacatggcaaggggctgagcatgctaacatgcttgcccaggaccctcgtcttcttagaaagccaccagtcccactcccatgataacccatccatctgtgagtggattaacccagtgacaggagcagacccctcatgacccagtcacttgtcaactgccccgcctctcaatactgccacactggggactgggtttcgacatgagttttggaggaggcaaacattcaaaccgtagcatactcctttactgttattatttatttcactgcttcagctgtacccggtttggcccctgggagcccctcaagctccctcctatgtccttaggcatgttgtcattgttctttggacagtcccttactttctggcccaagaagatgatctaggctcttcttgtacttccagctttagccctggaagcagccgtttctccaaagagctctgcctcctttttttttttgagatggagttttgcttttgttgcccaggttggagtacagtggtgccatctcggctcactgcaacctctgcctcctgggttcaggcgattctcctgtctcagcctcccgagtagctaggattataggcgcccgccaccatgcctggctaatttttgtattttttagtagagatggggtttcatcgtgttggccgggctggtctcaaactcctgacctcaggtgatccacctgcctcggcctccaaaagtgctgggattacaggcgtgcgccgctgcgcctggcctgcctcctttttttgaagaatagagtctagaatccagggcactaggactggtcattgctattacaatgtcattgcttttagttcaccttagcagagctagggtgcatttatccatatccatacatacatctatgtctatttccataataatatttccatatgtattaaaagcatgatttcatattaataattccagttctgatttaatatcatacagctcactatctgtgtaattctagaatatacagaaaacagtttcagaattgctaacccataccaatatatctggagtttaatttttgttcagttttttttttttaatttgtagtttgaaagtatatagtcaaaactttgtgttcacaagatacttggaagggctgagggtggggaatggagtatggggagtaattgcttagtggctacagagtgtctgtttgggttgatgaaaagttctgaaaatagatagtggtgatggttgcatgacagtgtgaaaataatcaagccactgaattgcatacttaaaaatattttaaatagcaaattttatgttatataaattttgacacacacacacacacacacacacccccacacacacacaaagtgactaattccttcccctacccccagtgtagttagtgaggttatttatttgaaatatagttagattcgtttatttccatttatatttcttttttaggctttcctctcatgcttgagttttcttatgtaaaatattaatatggctccaaaaaagtcagaattatacaaaaaaggtatattcagagaagtgttgctcctgcattttgtctgccccatttccctcctcaccgaatcctttccacttggccccatccactgctgtaggcaaccagtctcattagtttctgctttatccttcctgtctctttcagatttattttctcctttgcatctatattcaattatccatgtttctaattcaaatgcttctttctgtgcctttttgttactttccacacagtcttcattatctcccaaataatcaacctttcttccttacagggataaacacacacatgttctctcctgtcagctaatgccttagtttcaccaccatcttttctctaaatggaggctccttgagctgacccatcactctttgtgggtgcttgccttcatgttattatttttgattacctgtttttagggttttaagtttggagaatcccatttgggccacatcttcctctgttgatacttttttttaattacgttttttgagacagtctcaatctgttccccaggctggtgtgtagtggcgcgacgatggctcactacagcctcaacctcctgggcccaagtgatcctcctgcgtcagcctcccaagtagctgggactacaggggtccaccaccatgtctggctaattgttttttgtagagatgtgggggggtctcactatgttgcctgggctggtctcaaactccttggttcaagtgatcctcctgctttggcctcccgaagtgctgggtttacaggtgtaagacaccacacctggccctgttgacactttgagatgagtcagccacattagacataaccagccgctccctaatgtttaccaagtgtttcattcccttctgaaggactggcatgacctggtccttctccaaacccccttctgcatgttcttcattttctttctttctctcacctctgtcctttattacaattcttccatatttgcctttattttttaatcatgaatatgtaactatttttttctttacacaaaatatataataaccaaagaaaagtttggtttttgcatttatagacctggcttaaaaattctagctttgccacgttgtggctatatgacattgtgaagacctgtgatctgaaatttctttatcagttagatgagggtaataatatctcatggggttagtgtaaaaactaagtgaaataacatatatacatcatagcacatagctgacatccagtaaatagtaagtcccttcccatttgcacaccttactcctaatacgcattttaacctcaacacttataacatgacctctgccttcaagagagatgcactttcgtatttctgtacttgtgtaagccttattcaggaagcaaaacttatgcttacaaaattaatagaaaaaatatagactaatcttgaattggaaaaattttaaataccatctctaagagtatctttaaattttatttgaaatgttatcttttatatttaagtgataagagctagttaagagggccaggcacggtggcttacacctgtaatcccagcactttgggaggctgaggcaggcggatcacgaggtcaggagcctgagaccatcctggctaacatggtgaaacctcgtctctactaaaaataaaaaaaattagccgggcgtggtggcaggcacctgtagtcccagctactcgggagacaggcagagaattgcttgaacccgggaggtggagcttgcagtgagccgagatcgcaccactgcactcctgcctgggtgacagagccagactctgtatttaaaaaaaaaaaaaaaagaaagaaagctggttaaggaaatgatgaggaaaactgaatctaaagcagtttatgaactgatgctgtagttgaaggggttgttgtgtacaatcgttgacctgtgaacccagcttgaaatgttgcttaggaaatttttgcaagtgtggaaagaactttttgtgattgcaaagagtcaagaaaggctttatccttaccatcgagagactccggatgtagctcttctctctttttctctgtttcttttctttttctttccccacttctgctgcttttagggaaaggaagccggagatgagagagcagagtagatgaaaatgcaacataagactttcctagtgataagtgtgaactgtttaggcaagatgaattgactgcctgggactaaaacagataagagccgctgggagtgttttgatgctgaatcatctgaagtctgagaacaaacctcaagaaaaggcttcaatccaagctaaaatcgggggggataaaggaaagttaaggatagagaagaagatccctggttataccttttggtttattaaaatcctttataattttaattggccacttaaaaaaaaaaacaccaaaacaaattatagaattggaaaagtgaagcattggaagcttttctgagctccaggccagggattccagctccaatccacagaccagcaatatcagaataagtcgaggaacttttttaatggaactttccaagcccttgaattcatatttaaagtgcccctgccaccaccgccattgtggtgaatgtcacccatctgtccagcttaggttcccttgctctgcagccagccgtcaactctcatccccagctctttctctccactggctcattcttgtcgcctgcaagcacactcagatctctcccatatgaaacgtttaaagtttttcctgaacgctgtcttcctctaggccaggatctacaccccttccttgttttacaaccaagcctcctaaaacactgtccaagcacatttttttgcttctttactccttaaccttcctaagctttcctcactctaaccttttcaacaatggtttccagagtgatgcacataatatgattcattgagacagtggagaaagtgtttaacttctatttatttttatctaaatttataaaaaaaaagtttcttgaatattttgatacattaattcatttacttttgatacatttaaacattgacaccccttaattagtaataggctcaggtcgtatcacaggcatgagatcttctaaagaagatgtggaggtctgcagtgtggagggttgacagggctcattcactcattggtttgctttcagtctacagtgatgtgtaacagtttatccatgcccagttaggtgcatttacaggttatgtaagtgccctcaccaaatggaaaagggtctttaaaagatgctagcctaaaagcttttggtcgaatatactatactaattataatgcaagacagttgaccaagaagacagtgacagagctttcgcatctgttcctggcccctgcttgtcattagccacgttgtgcttttaagatgactgtctcatctcacctaacaagaagttggcctgccagattcaaggctctaagtaaaactatttgaagtagagtttttcttctctactgttggtgtatgcacacttcctccggtgtatattgtgtcttgagagattagcccgtgattgcagcataggctataatttataaggatacatagacaggatggttgaggcactttttttttctacacgtgggatattggagctgctttttattaacatctccagttcccagttcgaatccacactttcagaactttatttacttcatatccttgtggacgtcgacattactgacttttcccttctctgaaactgcagacttgcttgccttccatgacagtactgttccttcttctgctccagcctttgcgttttcctcctcttaaatcttagtattgctagggttttgtctttgattctcttctcactctccacatttggggaatgatctcagctgtacagatatctttggttataacaaaagcaacaacaactaatattcagtaaaacatgctccatgccgggcactgttgtaaacacttcacatctactcatttaatcttcacaacaaccctgtaaggcaaatactattcacatctgtctgttacagatgaggaagcagaggcagaaagaaggtaaataattggcccttggtcacagaggtagtaaatggcagagactggattcacaaccactctgactccaggaaccttgattttaaccactcttgggcagggctaatgtatgcctcctgtcccttcctcaagccttgacctcttttgtgaggtccagactcatattcagtggcttactgggcaaattccacctcttagttattcttcccaagaaggaattaattatttcttccattggcctggtcctgtcctatatccctatcttgtgaaatagcctcgtcttgtgtcttgtttcttgtggtaaaagcctgggtggcctcttaattgtttctctttcacactcatctcatcagctgcctttaattcctgtcagttgtacctcctaaatattaaattcatattattttctaatgccacaggtcctgttctcatttggattttgaattttcagttacaccctcttccagtgtcgttttcctccctcctctagtttatcttccatcctgctgccagagcaacagttctgaaacagaaatctatttggttactgctgtatttataatttttccagttattttgacttccagataaaaatcaaacacttggccatggcaggtaagacctttcatgaaccggcttctgcccagtttcactctcagtcacttcgctgggacttttctctttttcaccagactgcagccagctgaaattcaccatggctctcacctgcctgcctttcttttctgtgcttggaaggaccatctcttcttatctgcctgctaaacttctgtatcccttttaagattcagttcatttcagattctccttagcctctcccaggtaccaagcctaattggatgctcttggtatagccctttatcatgctaaattgtcttgcccactgggtagtgagcagcttgtgtttgtagtctacgttccatcatagtagagtagaagcctcttatcctattagagttggttaatcgcagaaaagaagtttaagcatgcaattgtttaaagaagaaaagattcatattacgaaaactttatgcattttgttttaagatgtataaatatgtgcattcatctatcttttcagtacagtcaagactctttctgtgagtgttgattgtctgattagaatttaaccttgcttttcttgcataaaacacattctagcatatcatctatgatctccagtttcagtttcttttaagtgaaattagaactttaaaagcttacaaagcaatcagtgcagaattcttcaaattttaacttctaattcttttggtttatttttaagatacttcctcacacctacgtcatacatttttttcccaagtgattagtctatatcaactctttccaaagctttcgatttaggtttccttagaaataagtctctttttacattcatatttccttggttaatatttaattaagtaacacaattacagtaacaagtccagctgggaaaaactagtttgagaacagcgtaactgaattttgctaagcatgtagctgaacttgcggatgccagtacacatggaagcgttgaattggggccccgccctttgcatgtctgcagcaggcagtgagtgacagcagatgtgttttagagaaaaatggagaggacatttgttaatctagtaagtcaattgaacagaggctgcaggtttttgatataggttatctcccattggttgctggtataattattatttgttagctgattttacaatttacccattttgatataaaggagtaattttctgagtctgtttcagccttcatcttttattgatttatttgcttttaccttgaggtactttcaggaatgattaaggtgtacatagtaaaagacacagatacaagttaaattttgtgcatatagccactttttaaaaaaacctataaattatatcatttttaaaaaacttaatatgaaaaaggtagttatttttaaatgactatttgtgtgctaacttgcactatggtccaaactaagcaataaatgtattgaaaggcatggttaagtcctatggcataccacttacagcaaattttttgaaaacagttttttctgaagataccagtaaccttttaaaaaatgttttattttccctgttttctgtctttaccttcttatgtttttgttagaaacttttttcttaagatatttgattatggtataaggcagctaatttaagcatctgtttatcactgcctggctagactgaatgtaaaatttcaattgaattacctcccaggagagctttgagctcttagggtaaaacacatcattttctcttctctcctctgggattgtcagcagaaagaattcatctaaatagtttacatgcatcttgaaaatgttgtatctaccggacttagctttgttgtttgtggaacattgccaatataaatggagtatctactttgcttgttaactcaagtacaatagtgttatatagtattacaatatgtatataaattgtaacagtgaatgacttttgctgatagttaacttatgaccaattttcattaacagatagattttcttcttttaaaaatttaatttcaaaacccagatgtttaattattcatttattaaatatttattgagtaattagtgtatttacaactttatgcattacaaaattcagatgcatattatgaatgcttattttgctccttagcttctttctggaagagtttcaaattttctatgctcttttgtctatttcataaggacttggctaggaaatagattattgaactaactgaaaagatcaataagcagatttagcatgtgctgcctgttgggggctagaaagcatgctcagtgtgggtgagctgctgaggagctttcagcttcatggaatgtatgttcctttcttcaagtacagatttcataagaaagaaccataatgtacttttctttgttctacttgattacaaaattttgtaaacatagtcaaaaagcaattgaaaacttgctgggttgctctagtttttcttctgttacaataagatgtgatgattttttaaaaagcagcatatagcattttatatctttcaatatattaacatagtaaatcttaaactggtaaaatagaatatattgtcaaattataaaatgaaaatatttattatctctatcagttctgctgtaaagtttgggttggtttttgaaacacactgtttcttagaaaaattccaacagtatttttggttggtcagccagttagttggtcagttagtctatctatccatctttactttgaaatttccaagaatccgaaacagaactagtgattcattatttcaatatattttcttttctttttcttttttttttttttttgagacggagtttctctcttgtagcccaggctggagtgcaatggcgtgtgatcttggctcactgcaacctctgccttctgggttcaagtgattctcctgcctcagcctcctgagtagctgagattataggcatgcaccaccacaccccattaatttttgtatttttagtagagatggggtttctccatgttgatcaggctggtctccacctcctgacctccgttgatccaccccccttggcttcccaaagtgctgggattataggcgtgagccaccgtgcccagcttcaatatattttcttaaaatttattttataaaaagactttaacatacagtctttgagtatttgggatatatattgggaaaattgcagattacttctagaacttagtatcttttaaaagaatgatgtaaagccctagattcctgaaagaaagctttgttatttaataatcagttactaatgatgaattagtacaagcctaatagagaaacttttttttaaatctgtgcctttggatttggtaagtttatcacttaaaagatacgttgcttttaggatcagttaaacagagaagaagcagggaggagccatgcaatttgtaaatttctgcaagttctgtctacgtcgtgacccatcagaatcccttataagatttcctcttactgtaccaaacattcatatcctcaggtatttttctctctgtgctttgcctgtctgtggcttttgttgctgtagctagttgctccacctcatgttttgtcccatctttttcactcccgtagcgagatccgtccaagtgtcttctgccctgactcttgccagttccttcttatcatccctttgcttctagcgtaggcctggcctatctgtgtatgctcaccaaggttccctctttcccctgcccttccttcttcagcttttcacctctgttttgcccgtatcaatattttatcagctattttcttatctttattaggatccttcttacataaattgatcctcttaattaccacctcctttaatatttctatatacccatattcatttcatcatccttctcaaaagaccccttaagaaacacagaaagaggcagaaccagtctgtttctctcttctcccttctttaacttaatgttttcgccagcagagtaggtacaaaactcaagttactccagctgtagtcttctaccctgtatcatcaaaggaattgcacattttgttttattagtactaaaattatcctttttcttttcgccttttatattgtcttgcagtaagctctcagttgacagttagccattctaatggaagcaggggtttgtaatccaaagttagagtccctctctgtatttgacttaggaatgtggcacattttttccacttctcctacccctaagcaatacaaattctcccatgacggagttactgtcagcagggacagtcggccctcagggaacatagctggtcacagagcaaacgtgaaaaaaattaccacctaaggtagacaagtattatacagaacatcaaaatccatcaagtactcgttgcctgcattacgtctcagcgccatctggtttggagaagttaggtcactggtggagaggtggtatccatgtcttcatcctagcaagtgtagtgtgatgcgtcagtgacctgatcgattcctagatggtgactggacctaggtggttgaactgttaaaagtagaacaatgatttttaattggtcattgtttgaagttggaattcattttctgggaacctattttctgttcatttttttagccaattaatatttattgaacacttactataaatgccaaaatcatctatgaaaattttatatatgtttgttaaataaataaaatcaaatatttaacagaactaatggaactattttagtatgctttcccctgggctggagtgtaggctaagactttatttaaatacaggatggatggtgttttgactgaagatgcctccaacttttgctcttctgttttttatttgatgtgctcaagcttctaattcccttttttgttgttgttgttgtggatttttggtttttgagactctgccacccaggctggagtgcagtggcatggtcttggctcaccacaacctttgcctcctgggttcaaacaattcacctgcctcagcctcctcagaagctgggattacaagtgcccaccaccattcctggctaatttttgtatttttagtagagacagagtttcaccatgtttgccaggctcctgaccttgggtgatccgcctgcctcggcctcccaaagtgctgggattacagtctgcctctctttgaaaggtaaatcctaaatgaggggcaatttccttggtaacttgataacagctttagtgagtcctaaccccttgtttttattggcccattggacatctgcctagagcatgagtgccttctgtttcagtgatttcaacttttctggaaaatcctttgctgtatctgtacagcaatggcttcagtttcccattaaatttatattttgtgacaattatttctcttctgaagccagcagacagttcttatctcttccttagacatcccacggctctgtttttaagcattttgaagacagacaatgcttttcttgaaaccaatgcatcacactttcttactgacatcatggtcctggcacgaacaccttggcctgccacatctatgctgctgagttgtcagtaagacttttggtcataagtataagagtcttatttataatcacaaggaaatgggtaaaagcagagggctccaggttgagtcttgggaaattggggcatgattctaattgaaaagggcctgggctttggaatgagactttccattgcacacatttttttccactaattgtgtggcctctatctacagttatagaatttttgctttctcatctacaaaatgaggatgacagtatctgtttcttaggggtgaagtgaagataaagtgagaaaatgtgcgcagtttttctggcgttcagtaggcattcaccaatgtcagggctgctttctccccacccctgcgcctagttatcacgtgacaggaatcaagtgccttcagtgaacaccgaagctgaccatgcgggggtggaaattccaagttgggccagtgactgtaaatagtataaatagtaaaatatatatgagtagcaggagtgggaatggaataggagaattcagagaaggaaaaggagtgggttaccaatgatagttgaagtaactgcatcggttgctgctgataggtccctgggcctcagtttaccaagccctgaaatgaaatattggaaccttgttctattgtgtatgctagtaaggtaaaaacaactctgtttgaacctttcagttttctaataaaataataacccttctctatattctttttctcagatctttactcttgtgactccgtgaatggggggaaaacgtagaccaaaaccaattcttgccagaaccgttttcattctggggatggttgtaagttctaatgctgtcctgtgcaactactcccaggaacttggaggaggtcctacgacaagggagaaggacaggaggaggcttttcaactttgtctttgagaccaccacttgtcaccagccacttcctgccacccactcagccagctgggaatgtttgcttcatagatctctagttgccatagccccacacagcgtgcatgccacattctgtaacctctcattcgacagtcgcatttggggacagatttagctaagttgcagtaagtgggacagaggtctttcataaaatagatactttttccttcagtattgagcttttaggaaaagaggaacatatataatagcaaaatacttgattaataagtgtggtagttttctactaccacatgacaaattaccacaaatttagcagcttaacacaacactgagttattttcaacagtttctgtaggacagaaattcattgtggttcatctagattctctctttaaggtctaacaaggccaaagtcagatgtcagcccagtcgagcccagatgtcagcccagttggaaggcccttttccaaccttctttattggtagatttttgttccttgcatccgtaggactgaggtacctgttcctggctggccgtgagccagcagttgtgctcacctttcagaggctgccgacattcttgaccacatggtccctccatcctcaagccagcagtgacttgtcaaatcctcatgctttgaatccccaacttcttcttctgctaccagccagggaagactctgcacttaaaaggttcacgtgaagagatcaggcccgcttggcaagtctcgcttgtgcatcatcatcctgggagcaccaccttattgtctttgcagggtctacccacacccaaagaggacgggatcacacttaagccaggtcgccggggggtcacttttatcattctggctaccacagctcatttgactgaataaagaactttatgttgatatttactttccagtagaattttgagcaaattattccattatcttttagcattgagtagtatacttgagaaattctgatccgttctgaatcccaatcctatgtatactgtcagagttttctctctagcaaatttagattcttctctttatagccatgttttaaaatttcactgtgatttgccttcatgcgtgttttgtttttttcatggtaccgctaaggcaactgatgggctcttttaatctgataatccatacccttcggttcttagaagtttccctgttttattttcgcataacttcctttctcctagttcctattctctctctctctctctttctttctttctttcttttttttttttttgagactctcacccaggttgagtgcagtggtgcaaacacagctcactacagtctcaaactcctgggctcaagcgagcctcctgcctcagtttcccatgtagctgggaccataggcgtgtgccaccatgcccggctaactttttgatttatttgtagagacagggtctcactttggtgcccaggctggttttcaactgcagggccgagcgatcctcccatctccagcctcccaaagtgctgggattatgggcatgagccaccacacccggtccctattttctcttttggaattcttattggttggatgttgaatctcttgaacttttaatattcttatttttttctctttttattatgtctttgccttttattattcttttcaaaagcttttcttgattttatctatcaacccttctgtatcaactggtatgctttcaactccaagtaatagaatatggaagtacaaatggcttcaacagtaataattcattttttaaacgtaaataggactgaggaatttatgttcccaaaattgacacagggactcaacagtgtcatgaagaatctaactcttaggccgggtggggtggctcatgcttgtaatcccagcactttgggaggccaaggtgggtggatcacctgaggtcaggagttcgacaccagcctggccaacatggtgaaaccccgtctctacaaaaatacaaaaattagctgggcatgatggcgggtgcctgtaatcccagctacttgggaggctgaggcaggagaatcacttgaacccaggaggcagaggttgcagtgagcctagatcacgccactgcgctccagattgggcgacagaacaagactctgtctcaaaaaaaaaaaaaaaaaaaaaaaaatcgaactcttccatctttcttccttacttttcttggtgtgtgacagcctctctctccccctcagttgtaagatgtctgaagctcttcaagcactgggttcttataaaaccgctgtgcaaaagcagaaagaaagaggtagactctctttaagctcttcagacaattaatgttttttcctttcactctgagaatattgtgttgttttttgaaactgtcttattaaattgtctttgttttctttgagttttttttttctcttttggtggagatgatctcaaatgttgtggattgctgggtgtggtttcagacttgcgagtgaggcactcaaaaaccaagtgaaagtttcatgcgtactgtcagggatggcaagtggtgcgttgaacttcagggtgactgggaattggccttttctttaaaaaccattaatgtcagttcccataggttttttcttttattctaggtgagattcccccaatctacctggaagggagggattcttgtaaccggctgctagcatttttaagagagcatttaagagactggcattagaaggttgatatttttgttgatcagattgaagctttactcaatattgcgattttcgatcctgggcctcacctacatccttgcctgtgcgcagtctccctcgatctggagccgttctcattcggtccctccatccatctgttcctgcctccttcccttccccagatgtcttctgcccaagggaagaaggaatcgctgcctggctacttgaggttgtgatggtcatctgggtggctggcttccagcacacacattcagcaagtcccatgtccatcttcccagggacctggcgcctctgatccccagactcctccatgattctgtcctgaggagcagtttacttacacatttgcatttctctttgcagtgtttctttccctctacagttaaacccagccattcaccccttctccatcttctagaacattgctttctatttatattccatgtgcagctttgtgcttggtactggaaggttaagacagtctgtgctcaggaagcttccattcccgttgatactgaagaacacaaaggaagaaatcagaggaaaagcttagatgttcacagtaaacatattactaaataaaatgatttatgtatatgatagactattgagtgctcattaaataaatcatgtttttgaagatcacgttagggatgtgctctatagtatgttgtaaaaataaacaaaactgtttagtatgatttccattatgtagggaaatgaatatacacgtgcacagaaaaatactaagaaaatgtaaactgcaatattagtgacttttctagattatggggttatggtgatttttaaaggcaagtatcttttgaactacagtgaagattgcctttcccctcgttttcctcagtggacatgttaggcggcgtccactcatatccaactcccttcttatttgcctccccattacatgtctgttaaaatatattgaaaagatatccatcctgtgtaatggtgtaaagcttacaccgaatggtataaaatccactgactgctacaacttagaatagttataccagtacttttgccttttcctaaggctttgaacatcatagtttagccacttcctaccattttctctgttatttcttattgccaaaataagtcttctattctttaaaaaagtcaagaaatgaagaagaatacaaatagtgttttgtagcaattattgataaattatacttttaatggaggcatttgtttcaaaatcattcttataaggaaacatatgataatgtgttatttcttgggtttggaattgttttggtagcctgaaattggagataaaatgggtgacagctttgtacatgactgctactcctcggtggatggctggagagagctcagaggcccagctatccaaccactattgtgtggtcctgaaaggagccaagaaaacaagcacacaccaatgctggcatcattgaaaactcctgtgcccctataatgtggggcatgaaatcgaatctcaactaggaaaaggtagaaagttatgaaatgattcagattcttttaattactatagaaaaactatttttataaaaatttttatttctaaaacacatttaagtagcagtttccccagtttggggggaggttacataaggaaggtatagggtagggtagtgtttcactgttttactgaactttttgctctttaggcttcgtattaagaaggtaaagattttgattagaagcacatggattttctcctacattagcagatcataaaactttttaaaaatcataataaatttatcacaaaacaattcacgtttaggataccatattaatcttttaaattattttttaaatgggtgcttcttgaagtagcggtgtatgtagatatttataatttcttctggtgtgcttgtggtgatcatccaaaaattagttttctggttacacatttgaagctactaagatccactgcatttgattataatttatttttaaatgccctcatattataaacctgtatcttttatggggacttatctaggtgttggctgtcaatgattttattaaagctatttgtaattaagtttaactaacataaaactataatgcatatcctttggatgaagaaaatactttaaaaagaaaactttaaaatacataaatacattcttggaatgtttccaaacctctgcgtagtccatgccacagaagtaaagggtctttctcaaatgaagttaattacccacagggtgcatgttggtcactctttaaaattcttataaaaacaaagaaattaattatccagtatgaaaacaagttctactctttctggcaaacattcaattaactttttagtgcttgctatttaatgttgtttttgaccaaccaaccattgaaaactactttcctttgaaattgggcttgagtagaaaacagtattatgtgtggctgtttagatggccagttccatttggccatcagcttttttcccatgatctttgaattcaatggcttgttatattttagactcactgtgaggtgtgcattgagcacagttattttgtgtatttagtgttggaattaacatctaaaatgtgttgggaatacccagtaaacttcttaaattaatattttatattaagacgcttcagaaatacaatggtattaaaagcactttacagctgaatgactaaggctgtgacggtcacatttaaataactttgttttttcagaaaataggtattttcattgcctttctttctgatattttgtggatgtttccttcctatgttttggaaggtatattccaaatttgataatcttatcattttgccacattggctttcttccctttgaactgacagatttgtgtgtgcacgtggacgctcctccagactttatgttcggaaccactgagagtactggcagacactaactccgcaccccacgttcgtcagtgtgtgtgttttcttagaaccaggacatttcttctccataaccaccaattaacatatttagggactttaacattgatgtaacatcactgtccaatattcagtttggacatatccaatcccagcactttgggaggctgaggcaggcgaatcacttgaggtcgggagttcgagatcagcctgaccaacatggagaaaccctgtctctactaaaaatacaaaattagccaggcctggtggcacatgtctgtaatcccaactactcgggaggctgaggcaggagaatcacttgaacctgggaggtagaggtttctgtgagccgagattgcaccactgcactctagcctgggcaacaagagcgaaactctgtcttaaaaaaaaataataaaaaaagaatcttttcttaggagatgttattaagagtccgggccaatattgactgcgtgtggttgttttctcatgacgaaactcaggggaaaaacgtttctcagggttttcataggtgctgttgtttccttttcagtgtgttacatcaggaggcgtataatgtcaggctctctgggtgctgggggatgactgtgtagttcagatggtgtctatcggatgtttttcatgtaaaggtcactttctccctttataattaatgagtaataggctgagtgatactgtgagactttgcaaatgttctgatcctccgcgttcatttagcatttattgatgattcttgtcagttattatacttgtggctgtagaatgttgattttctatcacttctgtattgaaattcttccatttaagaaaaaaagaattgtctctcttccacttctgtacccttttttagtggttagaatagactcaggttttttttttatttaatgtttaaaaataataaagtcatgcttgtgctcacctatggtcccagctagttgggaagccgaggtaggaggattgcttgatcccaggagtttgaaaccagcctggacaacatagtaggaccccatctcttaaaagaaaagaaaaagttatcctggcatggtgacacacccgtgctcccagctacttaggagagtaaggtgggaggatcgcttgagcctagaaagtcgaggctgcagtgagtggtgattgtgccactgcactctcagcctgggcaacagagcaagactctatctcacaaaaatgtaataatccatttctgtcatcatgtatgctgctgctcaaattgtcccaaatttgacaaatgagaggcccctacaggtgacccctgtgtcctttgacaagtgtccatctcagcttttgaacattttcttactcttctggcacaagaagccccaggctcactgtgtacttcctttccttgtctcagccttggaagcaactctttctccaggaagctcacctccttttagtgaggaaatggtatttagcaaaatttaaaatttttaataaggacaacggtgtttaactgtattgtaagcctgtgatttaatatgtttttatcttaggaaataacttcttacctataaaacaaggaaatgttttgattagttcatctttggaattgcttagctgatgcagtttagcattgcaccatatatgaaaaattagaattatagaagcacgattttcaggagactacagttaaaggaaagatcaaagtgttggtcttctcctttgaatttaatcatcttttccaggcagacataaatatgttttatttagcccatgtttaagaaatatgtattattttgcttggaagttctgtggatattgaaatgactgggatatagatcctccccttcaggggcttacagtctctcgggggacataagggacataagacaagtattcagagatacataacgtgagataacctacagtaagtgtgagaatattttacggtattgtaggtatctggaaaacagagagcagatctgggtcagggtgtctgagaagtttcacggtgcgtctgagttggagcagagtccagtgtacttggaaacaagggccgcagagggaagcagcagtgctagaagtaagaagaagccagtttagagaggccgtgaacttcacactgaacttgttctgaattcagcggcagcgagagcctgttcagtctcgcatagtggggttgggacacgctcttccgaggcagtgggttatctcaaatagagactgtcttgggcagtatggtagtggcccacacagtagagttccagaggccctgaaatgttgcttctctgatgagccctccctaaccaagcaagactggttcctttctatttatgctttgtagccctaatacaactgaaatgaaatgatctttgatgtatttttttctttaaggcctgtcacccccattaactgttaatgccatgagaaagacgttgtctgtccagttcatcattgcatattctacacctagtagtctattagtgcctgatacacgcatttatctcatatttgttggataattaaatgactgagaaataataaatgagtgtgtaaattaatgagtgaaataacaaaggaaggaataaataaaggaagggaaagatttgctgatacgtagatagtagtgaaggggaaagttagaataaacaggagagaagggccccagcacacattgcaactggcaggtgggtgggctggaactgtgtagtgtgcacagcgttggctttcatgatatttagtagaaatttggaatagttaccagcatttgaaacttggggttttttccagattctctggaaaaactggaagatctggtgacacggggccgaccgtaactggctgagctcatggaagctggctgtgctccctttaggctgcacacatgaaccccaattccccgcacttcctccaccacccgctcctcctccacactgagctctccattgccctgcatcctttccctcacactgccctttttcttttgctagaggtgagaggaaaagtgaaacgtttcttgtatccgtgtctctttgagaagtggaaaaaccaaagatagactgaaaggctccaagtagtaggagggcattttctttgagaatgtgaagaatattcttagtctttaatatgcaaatagagtgtccctatggtaagaatacaactcaaggggggctatttatgaaatacaccctacgttagagtttgagaccccagaggtagaccgtacagaaaccgacaagtagagatgaagcggtaaacagaagagtgacacgcgctgccttgactataaatagcaaagtttagagaagcacctgtttcaggggaagccaatgattttgacattagagtttttcttaattttaattcaaataaattattaagtattttctctcttttagacaaaacctttgttttcatacacgatgaaaatgtaagtaattattgctattcaacttcattcacttttttagtttggataacgagttcagatggctggacatagctgtgttacagcccattttttgagtgtttttaatgaaatttgcaagtcatgggctaaaaacattgcaaagcaatatactcctttaaaaacttaagcagggccaggcgcggtggctcacacctgtaatcccagcactgtggaaagctgaggcgggcagattacgaggtcaggagttcgagaccagcctggccaacatagtgaaaccccgtctctactaaaaatacaaaaaaaattagtcgggcgtggtggcaggcacctgtaatcccagctactcgggagactgaggcaggagaattgcttgaacccgggaggtggaggttgcagtgagctgagattatgccactgcactccagcctgggtgatagtgcaagaatctgtctaaaaaaaaaaaaatttagcaaagattctgctttatgtatttgtactttatcaaatatatggtaaatgcaccaattttggtagaaagttatattcaaaagtttgttggcaactgctgatcaggcaaaaggaaatgtaatagaatgtgctttagtgtattgtgtcaggataattaaaagtgctcgtggataacacttgatgctatgaaaggagttttcttttattacttgagtattttagaatatatatgtgatatttcatctcttgtccaattcctctttctcctccaactcaactttcctttatttttcctactgaagttatagtttcagtgtcttatctttaatttcagtattggatggtaacatttctctcaagttattggcacctcttcctaaccaaagggtaaaacaaacaagatatctgataacgcccacatttaaatagagcaggactggattattcaatatccattgcttagtgacaaagctatcagaaacaggtggtaactacagctacatgattcttattcaaaggaaaaacctgctgctgcattggggaggggaacaatttgctgattaagattactattctaaacctctcttctttcggaggagaaaagccagaaaaatacaaaaagatttagggtggctgttttatgaaaccttagaggtttctgctaagacacaattaatttgctttatggacctgaacaaatgtgacactgacaaaggctccttatactttttttttctttccccaaacaggaaaatattgaaatttattcctacaaaagtaatgaaggaaccaaacgaattaaatagagcgcaagcagcatgtaagatttagttttgaaattctaccaataggcaccttatgcctttattttgtaaaggaggatcagttgagcccaggctggtctcaaactccagggctcaactgatcctcctgccttggcctcccgagaagctgggactgcaggcgtgcaccaccatgcccagcgtacaccttattcttctgttggtctctttttgcctcttgacattcctaacctaacagcgtgattcttatctaagactttgcatgtgaagtgtagcctttccctaaccccttactttctcccattcattttgggctgaaatttaggtgactgtcattgggtggacagtgttcgtagggccacctggcttagctttctgtaggattgaataacttacagcaatttttgtaaaatgtcaaagccaggtctggcacatatggagtagcagcagcacacgctggatctcctggagttgaaagtaggggcacagtcacacctgtgttggggtgcagttgcatcagagcttcgcaacaccctcggaatcacagcccttctgcagggctgtcattggtgcgacttagatcacagattgtgatgccagatgaggtctttgaaatccagcattgcccaaagtgtgctgttcctatccttgctggcagatgagataattttagataaaaaacaaatgggcatttagatttatttttttgtatttaatttatattagaaaaatacaattagcccaaggatccagtgagttcatggctattactgcttaggacaagggtaaagtgagtgttaaaaataagccaatttaagagaaataaagggataacaaagaattcagatgtcatgctgacattgcaaagaaattatgagggtaatacaatagccagaagtttgggcaatactgacttggtatgaaatggcttagatgggtgattcgtagcagagcctttaatgcctcatccattgccctgcccattttaatacatgcatctcccaggtaagctctttcttccaagggaggattctgtgtcttgaagtatgaaagctgctattataataatgtggagccatgaaaggtgtttggtgagtgggccaatgattagatctgtgttttagaaagactcctcttgaggcagcacagagggtgggttgaagctggaaaagccaagagggcaggagctagtgaagtgggctctgtgacaaccagcaggagtcgatggggactgaatctggagcggcagcagcaggaatagaaagaagaggctcagttcaggagatacgtagaagaagttggcagtggtgcagatttgctcagcagcgtatggaattcgccctgtgcccacagctctgggtcatctcccatcaagtcctttattccacatttccaacctgctttcattccactgctccctgccttctccattgccatttcctcttgtgtgtacatagacatgtacgtttgttccaaaacgagtcacaaactcagatgccttccagaaccaagcattcaggcattgattcagagggcctagtggtggggatctttgaactggagggggctttttctgcctgaaggccatggctactgcttagctcaggtgactcttcccatgcaggaatgcaagccctatgttgccaggtttttccattttaacattaaaaattggaaagtcatataattaatcaaaatctcctcaactttaagcattggcaactttaaattctaacaattgctatttcatgtgagcggctgtgaagattaaatgggttaataaatgaaaggccatagacctaacaccttataaatgtcatctggcattacccaacaccatcatggtcaccgtccccaccctcatacccacctcctcttctaaatctgggttaccgagcgcttctgaaggaaagtagcacagagctttatctgtataaagcatccagctaaccctatgccaccagagccacaaagcacataatgaggcagaagctgatctcaaacatttttcaagccacaaaaccctttcttcaacaaacgtttacagggaaacctgatatgtaagacagattagtttggatcttctgtgtttgaagtggttatgaagagctgcctgtctcccagagcagtgcttctcactgcatcagaagcctttagaggccttgtccaagcacaggtgcctgggcccagccccagaggttctgagtcagtggccctgggatggagcccagaacttgcatttctagcaagttcccaggtgatgctgctatgctgctaagggctgggagtccacagtgaagaatgttgtgctggtggcttagcaggtacaaaggtcaggagggagacatgtcccttaccagccgtcgctgggcctgtcacctctcccgtggaggcctgccaggggccattgctggaatgtgtttggtcgtctagaccaagtgtgggcctctgacctgcagtatcagcctcaactggagcttgtcataaatgcaggttcataacccattctaggcttactggatcagagcctctggggcccaggctctgggtttctgagagggctctagttgattcttgtacatgctgaagtttgagaactgttggtgtacatgcaccctagtcaggaggtggaggccagcttaagaaaccacctatggatagaaccatattcactacctcagcacttggcctccaccaccatctgcccctcagaacagcacttctgccaaattaaagacttgattctaccagaagcttccttggacttcactgtgccattggataaactagtgtcattggataaagtgctgcatctgttaacaacttaatttcaaaaagtgagtcaaagcaaagaaggccagaagatggaaggaagagccaaatatttagaaagggtgatgaattaaagtttagaaatattatttatgcttgatagcaatgaatccagggcaaaaggaaactatagtgcttaacagtctaatgtatggcagatactttcttaggcccatttgattctcatagcaaagtggagatttaccactttatatctttataaaggtatctttatttgcagaataggaatcaacagagccaggagttgagcctataacattgaaacctttattcttcctactcgctggtagtgatggttacagaagtcccttagtatctgtggagtactgattccaggacccctgcagatacccagctccacgactgctcaggtccctgatatggcatagtgattgcatataacctatgcatatcctcctgtatacttgaaatcgtctccaggttacttataattaatataacataaatgctatgtaaatagttgttatactgtatttttataggttttcattgttgtattgttacttttattggttttttcccctcaaatattttgtatttgcagttggttgagtccaaggatgcacagcctgtaggtagggtacagaggccagttgtttccctgaactcttagagttcctcagtccctccttatactgagcacttagtatttgtaaacactgacattttcctacttttatttaagtatgaagtgtctaataaagatgtatagtgtgacgtactgcaaatagaaaatactgctacaacatacaaacatctaaatatcaggacttttgaaattatttctactttataaattttattttattttatttattatttttgagacagaatcttgctccattgcctaggctggagtgcagtggtgcaatctcagctcactgcaacctccacctcccagattcaagtgattctcctgcttcagcctcccgagtagctgggactacaggtgcccgccatcacgcctggctaatatttgtatttttagtagaggcagggtttcaccatgttggccaggctggtctccaactcctgacctcaaatgatccacccacctcggcctcccaaagtgctgggattacaggtgtgagccaccgcacccagcctgctttataaattttaaacatgttgaattctgggtataaagctaaaattattttttcaaggatgttaacctggctactaactaaaagacaggaataattcggtgagctctaaactgaatttatttattgtatactgaatcacaaaccagactagattttttaaaaaatagatcaataagttcaagccagaaataatacatgctttcttaagttgtgaaataagaacaaaatgcaaacaaatagtatctgactgagagtgatatttcacctgtgatgtagagctctggacccgcttaaccttagcttctaagtgtctttgatattttatttgccacattcttagcactaaatgaaatgtatgtgttggggtgcagatggtattttgactttaattatatgatttttgagggagaagactcacacctgaaagtgtagtcttgctatctagatcttttaaagaaggtgctttaagaaaaaagtggtgttaattattgatatgatcaaaactcacttctttagaaaatagaaatggcaacaagcaaacatgaggaagggactgagtattcaaacccatgaggcattgtgattatatttagtcagtcagtgaaatctggcctaatctgggacagtaattattatcatttaagaaaacatatttagagttttaagagaaaatacttaagttactgaaattatttgcatagaaaagtgaacacttgcttctgagtttcatggaagattgcaagtcctctgccacatggcagagaagcagacccaaaggaaataaagtaatgcattttaagaaatggctggtgtacttggtatgatagtacatacctcgtgtcgtattattctgcaaaaatacttagggaatatcctcagctttgtttgatagatttcagtggctggcagcagcaggacgtttaccagaggttgcaaaggaggtgggttgtgggacacagttttcattcatcctgaacgtacgcttagtttgtctcatgttgtgtattttaaaattctgattttgttgccaacatttttaaatcagaaaaattttacgtaacaaataagcagtgtttacatctttctttagaaatttgaagatttgggaacattgagcttccattttggtcgacagccacagtgacctggggccaaaacttttttttctcttttcctttttcaggactcctttctgtaatgggcctagcttgctttactcgttcgcttcatttttctggttcctaaaggcacttaagtttaaagcccttactttaaatcatgcccaggctaccacaacgagtcatatgcactttcggatcatccagaattctgaaatcataatgattattcatgatttacttattgcttttatgtcattgtagtttgggagatattttttatgtagaataggaaacatattatcctcattatttcatcatccaggaaagatgtctttgaatagttgaaatgggaaaataaaagagccaacagttacaataaaatatgaagttgaagccgtctgtgttaactaaaccaaatacaagtaggagaaaaaaattgtaaaatgatggtttagtttttttattaaaaaaaagaaatggagacagggtcccacgatgttgcccaagctggtctcaaaatcctgggctcaagcgatcattctgcgttggccccgcaaagcgctggaattgcaagcatgagccactgagcctggccaaaaatgatagtttttatgggtaagaaacaacatggaatagtggaaaagataataatttaggatacttttttttttctgggaacagtcatgagactaactagttttacatttcagtaaccagtagatattggttttatctgtaaaagtaagactgaaaagcaagacctaacccttctggttataaaaaactatgattttcttaatttctgaaatacatggtaattctgaaggtagagacctttagaaatctttgggaatttgtaggtttactatttagagacttttgcagatatcagagttagtacaacaaatcatttaatatttccctacaaatccagatccagttcaatggttcattgccagtggcttaatccgtcagtccaggacctctgtggctgtagaaacgctgtttggcgaggcactggtgctttttttcctttctgaatcggaccccggaatcccttatgctggttaccttcacctgttaggttttttgtcggtgtctgctcgggctgccatcacaaaatgccacagactgggtggcttaagcaacagcagttgatttctcctagttctggagaatgggagtctaggaccgaggggtcagcaggtttggtttcccctgagacctctttcctcggcttgcaggtgggcgcctcacgcaagggtctttgtgggccctttcctctccgcacacacgcccgtgatgtctctcttcctcttcctctatggacaccagtgctgtcagatcagggccccactattctgacctcatgtaaccctgatgagctctttaaaggccctgtgtctacatacaggcacacagggggctagggattcaaggtatgaagtgttgggaggacatgggaggacatgattgagttcatagcagatggcagtgaaaaggaaaccagggtttctttgaaatgcaggatgtgcctgggaagcagcccaagtcacacagcagccactccagctctcattcgcccaggcttgatccaggcaatactttgcagcctttttctatgcccttttctcataagtaatagaaatagagaagtcagaagcttgatcctgcttttagaagattgccaacccatttattatgccacagtattttaagattaatttttaaaatccttttggatggggaactcaccacccaatctggcaaacctatctgtataaacttgtgttctccagcttgttggcatcctttgttccccagtagtccttgtctaagtcatgcaatgtggtcgctgtgccagggacactcttctgtcctctgcttacatcaacccattgatgaatcttgacatcactgaaagtgagacagcagatacttgtgcctctttagggatacagtaagaggtatactgcgtcacctataaactgttcttgccaaatacattgaacctgaagtgcagtcaagacttcagatctagctacatgcttataggaaacacagcagatagagattaagtgatacaggaggagggaaacaacttgatccagaatgtgatattctgccaaagcaatgacctggtttcttcaacaaatcagtggcatgaaaaaaagagagcaggggggaaccatgattgttcaaaaatgacttatgtgacatcaaccaattgcaatgtggtcctcttttagataccgattcaaagaaactgactttaaaaatgtcgggagtttttttttgcaattttttgaggaaatttgtatatagactgggtactaagattgtcattaatttgctaggtgtgatgatggcgatgtggttatacatattcttaaaataccttttctattagaaatacgtatggaattacttactggtgaaataatctgatgtccgagatttgtgttaaacgatgtcggggtaagaggaaaatggttggtttctcatccttcaagtattggcttatgttaaccccttgggggagatatttgaagcaggtgttttccccctcctatttcaatcatttcactctgttggtttgtttcacagcacttataatctgtcggtaagagtattttgtttatttattgtctttcttacctcagtctataaactccagaaggacaggagccatccctagttgcccactttgtactccgagcctggtatactgctgacctgtggcaggttctcagtaaatgcatctcaaaagagtgtatgagaagaaattttatttcatatgatgtttgcattttgatgtttctgtatttggacttttactgtaaattgttaataaaatctattataaatgtctagtttcttcgtatacctttttctgagggatggggtagtaagtgcttcctaagcttttattcttgagaactcaaatatgacccattttaaatagtagtttctttagtggttggcacttgtcattagtcttgcaggtagagtgaaaggtgtattgttaaatcactgacccattagccttttccttgtatatgataaacacatctgaccacatgtgcctgccacacctcatgcccctgaaagcctcggtgctcccagccttttttttttttttttttttttttttgagacagagtcttgctctgtcgcccaggctggagtgcagtggcgcaatcttggcttactgcaagctccgcctcctgggttcacgccattcttctgcctcagcctcctgagtagctgggactacaggtgcctgccaccacgcccagctacttttttgtatttttagtagagacggggtttcaccatgttagccaggatggtctcgatctcctgagcttgtgatctgcctgcctcggcctccccaagtgctgggattacgggcagggcatgagccactgcgcctggccgctccccagccttttatgaagaacctgcgctcttccctttgctcttcctgtgctgccggaggggcgaagtctcacttacagtataggtgagggctttttaggctcctaaagaatcatgggccgggcgcagtggctcacgcctgtaatcccagcactttgggaggccgagacgggtggatcacgaggtcaggagatcgagaccatcctggctaacacggtgaaaccccgtctctactaaaaatacaaaaattagccgggcatggtggtgcgcgcccgtagtcccagctacttgggaggctgaggcaggagaatggtgtgaacccgggaggcggatcttgcagtgagttgagatcgcgccactgcactccagcctgggcgacagagcgaaactccgtctcaaaaaaaaaaaaaaaaaaagaatcatggcaccctaggtttataataccatgtaggctgggcgcagtggctcacgcttgtaatcccggcacctttgggaggttgaggtgggcggatcacttgaggtcaggagtttgtgaccagcctcgccaacatggtgaaatctcgtctctactaaaaatacaaaaattagctggatttggtggtgggcacctgtaatccagctacttgggaggctgaggcaggataattgcttgaatctgggaggcagagagtgcagtgagctgaggttgcaccactgccctccagcctgggtgacagagtaagactgtctaaaaaaaaagaaaaaaaaaaaaccatgtagtttttaaagccccagtcttgttaggagtctaaacagtctgttgtatttattgtgtcagaggagtgaatggattgtaaatgttttagtgtagctccacctcttaacccaaagtgtttggtttggatgctacccaggagtgacttgttcaggttctttagaagatagaaaccttgctttcagtgagctagacagtttcctttgttaatggattattacattatgtctttgtctgaatctccttcaggtaattaatgtatgtatttctatttttgaccatgttttaagttgcatacatgcataaagctgtcttatacaaaagtagaatgaatcatgtaattagccttatgcaccatcaccctgctgtaactcatcagcgtcacatgtagattttagttagctatgaagttggataaatatgtctgttaattttaagaatgcaagaactgaattcattctaaaaatatgtcagtgtatctgctaatatacctatatgtctcccaattttattacactttgtttataataactaacatcatgtttaacacataattttctttttaatggaaatttcaaggcagttaaacttgcaaaagacatgtttttaataataggtgagcttttaaaaataaagtgtatatatatatatttaattttgtagatcaaatcccggcttaactgctttagcacaacttgatatttaagggaatctttttaaaaatcctttttatttttatgtataaatgtggatggttatatatcttgttgccttaactcaacccaggagtgtaagtaggtttcttctttcaacaatggtgcttttcaatttacttactatctgagccatattgtttatcttaatacataataattttgaagtaagttaattgacaaaaagaaatgtaattgggttcgtactcaattattttcttcagaaatatagactgtctgttgtgtgctcgaaagaacataggctttggattcatagggatctgggttcagagcctcaccactacttactaagtttattcattcagcgaatattcattgagaacatctctgtgctcaataagtcccagtaagtcctttgacatggcagatattccagtggatgaaacgaggttgcttatgtagtgccacccacattttagctggggagacagacaatataaaagtaaacatttgataaaatttcaggcggtaataagtgctgtgagaagaagcaaggagggaaaagagagcgaggatggagtgtcagagaggagttgcagttggtggagccatcaggatggcattgaagcaaatcgaagggaagaagtccacatggatagctcaggtgaaaacatttcaggcacgaggaacagcaagtatagatgctgtcacacagaaaccagctgtgcatgagagggagtgagctttgtggcaggactgaatctagagagaatggtgggaggtaactgtggaacggccgatggatttgagagggaggcaggggccagttcctatggggccttataggccatgatatggaatggacttgggatttttttctaatctaaaaggagttttggtcaaggatgcagcatggtctaatttctcttttaacaagtgcgcttggcctgctctctggagaataggtcgggttctgaggccgtcaccggttgggggaatgggggtttgccccaccaaggtggccgtgaaagcctaacaagcagttgtgctactggactagatacggggtgcgaggagaagagaggaaatgaggaaagatgggaatgaagaaggaaatacttttgaagttatataagatgaaaactgaaaatggaccattggatttggcaagagagaggccactgtggaccttgacaagagcaatttgagtgtatggttggggcaaaagtctgactggagaagaccgaggagaggagtggaaggtaggaaggagcaacaggtacaggcactttcagtgtttagacatgacaaagagcaaacacaggaaggtagctgggccggggcatttgttagttctgttttgtttttaggattcggatattatggcatatttgtatgctcatggatggttagtgtggggataagtggaagaacagaggccttgagtacattggctgacttgggaagaggtagttctggttgtttttactaatgaaatgcgtaaaacaagaaacagttaaggactgggagtggggaaaggagaaggggcgtgatgaaggtttgaagagagacgagaatgtatgaaatggtcttcatgaagagtgggagagagaatgatccagggaagaggtgggattgccaggcagtgctgtgggcccatttggaatgtatgtttctgtgtttaaagagggtccaatgcagtgccacatgtagacttagagtaagggaagagtgggatttgaccaggattgggactgggccaggtgactgtgatgttgaggaagaggcacatgggagggagagactgtgagctagttcaagttcagtctgtggcacagctaggaacaagagctgggagcatgacgggaatgtgggtcctggggtggagttgggcctgattctgtgcttgtcctcctattgctgatatagaagcggatgcaccagggggcaggcctccagacatcagtcaggaaggggcaagctgggacctccgacccaggcactcagcctgaagcttagctaggttttggatgtattatattccgtagaccgtatctctgccatatttctatctgttacctgggaacatttgggtagaagtggagagaacagtaaaccaggtactaaagtcttcaaaaaaggaagaggcataaccctttcattccaagatgtttactgcaaggagggatagcaggtggaaggaaggagggaaaatagtctagaagcaaaatgaagagcaaggaggcactcacctcacctccggacagcttgctgcgtggtatacagaagaagaaattgctaccagttgagggggctgtgatggaggtagactcctcagaggtttaacaggaaggtgaagggaacagttagaaaagcccctggacatagaggagattttgctaatgacagattgtgcatttcagagggtacagaatctgaaaaaaaatgggagattgagtgcgactaggggccagaaaaccgtgtaggaattagaatccagttggatgtcctaggaggcctagcttctggctaaggtaatgggggatgtaaaatgtgattatcggtcttgattatctcctaggggaaagtgatactcagttttctgcaggccccatctggggcttggtctcttaagcagtttgtgatggtgaagtggacagtattgagcccggggagggatggtcctaccaagtccttgctgaaatcttgcagggtgtactgtcctggtgttacttagggtcattgtacacgtgagcaaggtctgtggtcctcccaagcttgatgttttcacctgtagaattagaatgaatactagccttgcaggtatttaaatgataatatgcatacagagcaccagtgggaacggggttatagtacggtggtccctcataaccatggagcattggttccaggaccccccatagagaatcctcaaatgctcaagtcccttatgtaaaatggtatagtattttcatataacctacatataacctcccatatactttaaatcatctctagattatttataacagctaatacagtataaatgctgtagtctttatactgtttttattgctattattttttatttttttcaaatatttttgatccacggtaggttgaatccacagatgtggaacccacacatacggagggctgactgtgtatgcttaatgacattttttcccttgtatgtacatagaaaaatattgtatacattgttagtccccctcatattctgtaatgagtttttcatttgttgatgttagtgtcaaataatttaaaatttaggctgggtgtggtggctcatgctggtaatcccagtgttttaggagggtgaggcaggagaatcacttgagcgcaggagttcaagaccagcctgggcaacgtagggagacccattctacagaaaataaaaataaaataaaaattagccgggcatgttggcatgtggctgtattcccagctacttgggaggctgaaatgggaggatctcttgagtgcaggtgatcgaggctgcaagtgagatgtgatcacaccactgcactccggcctgcgcgacaaaatttatttcttgagtaaataaataattttttaattttaaaaattaaaaaatttaaacatacgtgtgtgtgtgtgtgtgtgtgtgtgtgtgtgtatgtgtgtgtgtgtgtgtaaatgcttggttcatttgttgagttttttcccctactagatgaatgctatgggtgcgttgtgtgatttcaatctcgttcctgaagttgagctttttatgctttgcattttgttctgcaatttaaatgataaaaacatttctggccatcttattccaaataaagtcatgttgatttttgtgtagcctataatgaaatagaaaataatcttctggtatctattctgtattattcacagaaacagtttctaaagaacaaatctgaatttgtacgatataaatcccttatctttacttgatataaactgccattttaaaagtcagaattgagatgaaaatcacagttaattgttgtcattctttaaaataatatggttaaatctgaaaagctttttgaattgtgggcaaaacattcttgaaataaagcttatcttaccaaatatttgaaggaaatttggtagcattgaaatagaatttttgtcaatttagaaagttaataatttttttaacagtgatttatactgtagctaaaaagctgttgctggtttcccaaatcttaaagctaactgaccttccatttgaacctagctttaatgtaaacattttcttgaggtggttaggggttgggccagccaatctggaggatattagtggcgttctgtttgagggaagttggaatccctagataattctcaggagctcttttctaggccagaagctgtctcagacattatatatttattttttaaggttttttttttactctttctttactgcaatgccatattatatatttcttaattcttccttggctttgttaataatgtctactatctgaaatctaattaataaaatacataattagctttactttgaagtagaaggaaagagcagttttatttggtagtttttctatcctttccactttagttgctgagaaatataatgtagtatgtaggctactgagagtgaggttattaccctactgcctttaaaaattctcactttttagtcatctattacttagccaaaatattgttgttcaaagctaaattaagtactttatcaactttctttgatacctcccctcccccgtttaaactttctgagcggtgtttttcaaacttcaggtcatgacccattaatggttgttaaatcagtttagtgagttgaaactagcattttaaaaaattaaataatacatagctcctagtaagacaaggtattatttcaacttttgttgcacttacacagatatatttgtgtgaatctatattgaaaaatgtaaaataccttttactgtgggtcaccaccaaagtttgaaaatgattactacagagaatatttcaggtaaggttgtatagtcttttttgcaagcatttgcatttttaaatcttgagatttcagccaaatggctgatattattgttagttgaatattgtagaagaaaatttggaagactgaatttttaagaaactacttattttaaaatgatttttcttttctaattctgacattgtcatatgatcaaaagcttaaatgccagagctaaggataaatcatatttctcttatttcagggaacatttattaagaatatgctagttaatagatatattgaaatataaatgtataattttccatctccaagaatcacaaatttttgttagacttgaattggaatagattatgttcgtatttgttttatgttacttccttaacagtgatggcctgtttacttaataaattcaactctcagtattcaaactcgaaggaatttttaaaagaaatatttgcctcttgaatcttgtcagatttctcaagccttattataatcgagtacttctgtctacttgaatttgtttttgctcattgaataagcaaactatcactgcactaatgttaattgtgaaaaggttttagactaggttttatttgggtcctaatgtggtagatttctttattgctgtttcatagaatcagaggaccagtttatgagttagaaacttgtgggacttttccattgtgaatgttgtactgtcttaatctcattcctcaatttctccaagcctctcttttctgtaaaacatagatgattatcaagtgatattccaaatagcaaacagatacctcaatatctttttaaatcccaagacattgcaaattacaacgtgctgattaataaagtaagttgttcttatgttaagtaacactatttgaataaaagcatgacatgttgagatgactgcctggtgactgagacttgattgttgactctgttgtaccctgtcctcatttaaataataggtttgtaaacagatggctggcaatcccttgatcatagtttattactaagttattggtgtttcataactaactgccagttttacatactggaacgtataaaaggtattctgttttcaagcgatgttagaatacaatgctacttcttgaaatatttagaaatcacttggagttcattttatctcagccttatcactttagagataacaaaagcagttaaaatgcataattggagcagtgtcttgatctgtcacaaataataggcttattagaaaacttgtatcttccagattctacacttaaaccgcttaataacattagtttctcttaatgtattataaatcatctatataggacttctggtctgcctaccaaacagttaattatctcatgctatcattattaaaagttttttctttctatatgaataaacaaaagtcattaaatataagcaactgtatttacattctactatgagtatgacagaactctccaatagcaaaaccatgcatgttggaggctaacattctatatcctcgattcctggtatgtgaacagaaatagagcggtgtctcattcaacttagtgtttaaaaaaatattttttaaaaaatagagtagtggtaagaacagggtgtcagatgtaatttaaaattgctttgtttcacatctgaaataatataaatgtgttttatatgtctgtttattaccttttgttataggttttgtgtgtgttatgaaaatggactcgtgtcctttggggtggggtggaactttaatatctgtattctgtaatattacatgaaaactaatgctaacttttattcttccagtatgtgccatatctttatgtttaaaatatctcagaaagagcttaatcacttttttctggctttattttagttttgaagtattgctgtatttgctgtatagcaaaaaaacaaaacaaaacaaaacaaaaaaacccctcccccaacagttgctttggttttcatcctgtattcaatagagtagcggatacctgatggcaaaacttttttgaaaagagtacctccctgcttttaaacacaaaaaaaaaggactcccccaattttttggataactatacaaatattgctatagttgatcatccattgtattagaataaatggggaaaaattgaatttttgcacataattgactttttaatacagaaagcaaggcaagatatcttaagaaatttgtataaagctaacatttgatatgaagttataatggaactgttgaatttcgatttggaaataaaggagtattccaaggtataaaggataatttgtacttgaatttttaaaaatttgatagaaacaaaatttcagacagttgaagtctgtagttgacagtatttaggccatcctttcattaagataaaattctctttgcgcacaccaatgccattcaaaagaatgcttccgaggtcttgactgttgacacgattacgtttgaatacatcattcttagacagtgtttgtgactgactattctaaatgtggtgccagggtatttgagaaagtgtgagggagaaatggaaagccaaaacttcttttttggtagagtacaccgagtttgttttattttgtgctaacccaatgagaaagcatattggtacaaaaccatgaaagaaagcggtggttctctgctagcatgttttgattttagaaggtcgtctgagtagtatgggctttttgttctgtaatgtagctgttttgacttagtaagtgtctatgcttgccttttcatttgggagtttgaaattccctgtgagctttgcttgttaagtccggggatctgcctatcaaataataacaaacatcaaagtcaagtgtgtaggtcatttgcacatctttatgtgggcatgtctcccattttctctttaacctttcctaacacggaacttatttcttttggtagaacttaagaatgcgctatcttggtagtgatcctgtgagtgaacaaatatcctttaaaaatctattcttttttatttttaaatatgtgtagcattacagaaaaattgaaaaagaaaaacgctcataatctcaccaccccaacagaacactatctgtgtttttttttttcttgtggtgagagagggacatgaattttaaacttaaagaaaaacccctagttctctggttgtcacatttgtttcactttatcatatcacacaaacatgttcatatctcacttaaaacgtaagttgtttagaaagtatagatggctaagggttctacttttggggtaattatgtcagtttagtttcctgataccttatcttactactgtttcatgctgttaaaagtgagaaatactctagatttgtaaggttcaaactatataaataattttttaattcactttttcaaatgtgtagggtaccaaatttcaacccttaggagaccacagaggtattaactaatactggcaacttaacgagttttctgtgaaccttgggataaaagtctatttttaaacttcaaaaatgtgtacttgactagaattgtagttctttgctgatcttttaaataactatgttcattacacatttactcatcaaatggaaccagaaagcttacattggtgtggacatgtgtgtggaccctctggcaggtcaggcgaggctctgccataatggctcagccttgacttaccaccttggctttgcactcaccttggcttagttgtaggcaacaagtaaatgcatgtgaatatgtttcgtcctgatgacaatggtaatatggaggtgttaacctcttttataaacatggagtgcttcttgtctgactttgattatttataacaaacttacatggtggtctttgaaaactaaaatttctggccaagcacagtggctcatgcctgtaatcccagcacttcgggaggccagggcaggtggatcacttgaggtcaggagctcgagaccagcctggccaacatggtgaaaccccgttgctactaaaaatacaaaaaattaggcatgatggtgtgcctgtattcccagctacttggtagactgaggcaggagaatcatttgaacctgggaggcagaggttgcagtgagccgagattgtgccactgcactccagcctgggcaacaaaaggaaactccatctcaaaaaaaaaaaaaagaaaagaaaagaaaagaaaaaggaaggaaggaaaagtaagatttttttacaatttcaataccttgattaatttaattgaagaatatgctgggattgtaataatctcttaagactggtaaggccaggtgcagtggctcatgcctgtaatcctagcactttaggaggccaaggccaaggtgggaggattgcttgagcccaggagttcaagagcagcttgggcaactgccttttataattatgtacaaagttttgcttttagaaaggattttgttgtttataaatattgaagatctctgatctttaaaaaaattaacttttgatgttactggtctgactgagaaagggtaaattaatttgtaggtgttttttgaatgacctaaataatcgtatgatattttcctcttttactttctccctcagtgggttattggttcatattttaatatatcaaactttttttttattacgccaaggaagaggtggattggccactacgatgttgtacattttgtgaatgttcagtaattcctgccatacttgattgagtaaaagttaaacttcattaattcataattttgatgattcatttgggctaaaaatcccttttcaagtatctgattaggaaaaagtattaccaggtccatatagtataaacagaattgcaaagtgcttgtattttacagtttaaaagaacaaaatgttcttataagactttatgagattagctttttatatgtgaacaattgttgctgcttcttccatgagttattgtctgttatggaggttcagcattacatctataataagttcttttaaaatctgtataattactctggtcaattgaaaattaaaacaaaatttgtctttaaaatttatccactaatatggttacttcagtaattctttttttcttcctttttagaatctgaatttgagcccattatatctaaaatgaaattttcagttctctttcaagtttaagattagtaagcaatagtttttaaactttgctgctatttaatcatgggtaaatttactttatcgtaacaactttttgtagcattttagtattaacaatgtcagagagaagagtattttactgtttggttcaacgtgtgtatatatattatcactagtggtattctaggggttgagaatccaaagatgaaagtggcctaccatggaaaatactacacatggggtgggggatgaacacagaaaacgataagatcatgacagtgggataactaggtgacttatcaaatgataaagaaacaagcactggtcatgcccaagtattgttggagggtcctcattcagagaacactttctgagttaatgttatatactcatctttcatgtccatgagtttaaaattaatttcaaatggttttgagtcattaaatttgcaaaggggaggataatgagcacaaattattttgtccatggtggccatgtaattgccattctcattcttctctccattctccactcacattgacctttttctacgtgtttttctgaacatcttccaacatgttggtggttggaagtcactcaagtagtcctttgctagttgtttaaatgtttaagaattgtcacctctaaagcctaggcttgaaaatgtggaagagaatttcccagctctgcctctcttttgttccctccactgtcttccccaaatgtcctttcttccctcctccaccagtatctcagtttctccatacttggttgtagataacgtggaatcagaatattttatgagttgcctaacaactaatctacaaaaatgattgctctatattttaacgtcagataatgcccagaatcttttcagaccctacttcataaaaatcacttataaccccttcctccttaaattgtgatgtttaattgtgatgaaataaatatgataatatatgtagttgataatacaataggtaccacccgaccagatttataaaagaaagtataaaaattatgttaataaaataagagttataatcatgttttgcttatgaagaggcactgtttccttttcttctcagcaacaaggaagttgcagaaataacgggctatgtttaaaagtgtcatcacccttggaattacagggtcaagattttcttctcaaaatctggacattgtttttttgctcccccacttttttttttggagttctggatgtttgatgaagaattatttgttttacggcctctaacattttattttgaaagggactagtctttaaaacttggctgtaaaacaaaggattaagagctcttccatttgtgcctattttagatctataaggtgggagtaacaacactgatttagagacctttgaccttccgcaatgaaaggacaaggaagtaaatactactcttactgttttgtatattccactaaaatataagtttcggtggtcaggcatttttgcctgtttaactcactgccgtgtcccagtacctgatacctagtgccacataggaagtacttaagtattttttgagtgagctaattgatattgttacactatagcggaattaccttaatcctgcacctttaggtaactgagtgggccacataaatgtgtttttcatgtagttttaccttttgtgtcaaaaaatgccattttaatgcatttatggaaatcttcaaattgtgtcatagtttttatgaatttcctaactagagtatttcaaacatattttgcctgttgactcaagggtgtcattatcaataataattactgtaattcctaggtgggccagtgaagcttgtaggattgcccttgtgttaataaccatgaactgttgtgttggcgatttagaacagataaggatgaatgttgtaatggtttttctattccttctggggttgtctgtcattctactcacgatgatctaggtaatggcctaagactggggccctttctcttatcaagtaatgcagtggacttgtagctgtcatttagcagcttttgttttcaggttcagagagctatattctgaaataccgagacttcttgaagactgacctctggagaagtaggcatattataaagtaggttacactgtgtagttgaaagcattgtgcttatgtcaaaattttcatctccacagaagaattttttttaagtgttctgcatttgcccctactgttagaactggagtcttgaagagaatatttattcttttgttgcaaagcaaaattagcagaaacttgaatttaatgtaataacagtattttaggtttggtttttaagggaggtttttgccttccagactgttctctatccacttagaaggatttaatttctaaatattagaaaatgttttatacaaagacaggtcttcaactatactgtactatagttatactataactagaattatgaaaatctcttcatttgtgttaattgagagaagtagtttattttttttgttgttttttttttggtaatagtcttctaaaatctattaatagactaccattatcaattcagttctttacagttaaggaatgattgtgtgaagtaagatacatacaaggaagtagtacctctggatggtaggattatggatgtttttgtttttgtttgttttttgagatagggtctggctttgtcaactaggctggagtgctcctgatcttggctcactgcagcctccatctcctggcttcaagtgatcttcctgtctcagcctccaggttagctgagactacaggcgtgtgccaccacacccggctaatttttgtgattttatagacaaactcctggactcaagtgacctactcacctcaacatcccaaagtgctgggattgcacgtgtgagccaccgtgcctggccctatatattttttaatgttcacattgcttatctgtataaaatataataaggttacattatttaatcaacattaccaataaataagaatatggagtactctttctgctcattttagatctaggctttaattttacagtggttctaaagtggtaagatggaaaaaaaaaatgtccaggcatgacaagaaaagagaacagtaagagtaggtccaagtaagaaattacatgtctgtataagtattcaagatacaggctagggccaggcgtggtggctcacacctataattccagcactttgggaggccaaggtggaaggattgtttgagcccaggacttcaagaccagcctgggcacgatagggaggccctgaccctaccaaaaacaaaatagcaaagtggggtggcacacacctgtggtctcagctacttaggagcctgaggcgggaggatcacttgagcccagggaagtcaagactgcagtgaaccgtgattgtggtactgcgctccaacctggcaacagagtagcaccctctcaaaacaaacaaacaaaaagatacagcctaagagaaatcctaaaaggccagcagttacataagcaagatacatatgtaggtaagaggtgggtgggtagaaagggaggaaaaagagaaatacttacttgaattatatataacaaattcttaatcatccatgaataggttattagtgagtaatgctaaatgtcagaccatttagtatatagactcgtacagccctatttctagagtagggagtacaaattgatttttctgctcctctaacacaatcttctggaacaaaaggtaaatgtatatgttcagtgcctttctaaagctataaggagtgcattaaactacagtacaattgcttctttttgtttagttaatgggaacttaattctatatagtagctggcagtcaaatttattttatgttggacactaagggaaaagtacctgagtacagtcatcaatatttttaagcgccatttgatcagagtaggtcatgtattccctaagaaatagaatccaggtgagaaaataattttgattaatttatagtcagcagttctatagatatactcgatactggtatccatttttttttctgttatcactacaaaagtagcagaggatattgctatctataatatatattttttatacttttgtatataaaaatataagggcttatatttttgtagcacctataagatgttactatctctagaaggaaaaggatctttataagtcccacaagtttgtctttccagaattgtttctaccaaatctgtgctgcacactataaatagaacaagaagaacttaatttgactctacagtaccagtgaagtctgttgccatctgatgccagtaaaagcatctaatactataataatagtaacattgcctggtgtttttaatttttgctttatttagatattatacttgattaatccacctgcatggtagtcaaaatgcatcgagtgtttaatatgtatcacattatctcatttaattcacccctcataataactcagagtcagttttgttattatcttcattttactgatgatgaatgaagtcaccgtgaagtcaggtaacttctgtgtgtgctactgctgatcaatggcaaacttggtccttgaaccccaagaaactctgttcctaaccactatgccatatttattttcctgctgaccctgaaattcattatgacagagtccccttactattttcccctgcgatagattttccatggatacttgaaattcttgttaattgtgacattgcatctcggggaatttcagcccatcatttaagtctggtagaccacagggacagattctcaatattctacacttctgacataatgaaactgtaaaataaacagaccacagattttcatgaaggttctaaaagcaagaaaatggtaattataccttgaagagtcttaaatggatttcttagataaaaagcccatgttatgttttcaaatctcattgtatgttctgcaattttattacgtaaattagttctgggtagtcaatcaggcaacaagtattaatactgagtgcttatttcatttaatccacaaacatttctgggcagttaactatatgtaaaggactagatatacaaatgactgacagttcctacctgctcaaagtattgttttgttgtctttggcctcatggataagacaaaaacagaaatgaattcattacaatgtaatgtggcagatgaaataatagaaatgtactgggtcttgaggagtacaaagtgctagagatacgcaaccagaatatattttcctataattacttttattcaagcaaattattataccaccctatatagagatacagaaatgcagagatcccctatggatttatgttttagttacttcttggaaaaactgagtcttagaaatttaactcggagcatattcaatactgggagtatagtcactgttttaaaaagtaaaaggaggtgaacatgctacctctatcagtcagtgtgacaattgatcctatttaaaatattataaggaatgacctgtgcactaaagggtagtgtcagttttcacctgggcagataattctcttttccccgcttcttggaaaacacaaaaatctcatggaatactgtgtgtacagtccaccacagagagggaatggcatctcaactagctagtgttccagcagatagcacacatgccggaagtactgattcagtgttttttacagcaaatatccaaaggtcaagagacagactgagagaaagagaagcagggtgtgagagagggaggagagagattgattatgagtctggggtcatgttttaaatgagtaaccagaatcaccagtcaaaacaaagcattcctgtattctctaacttgaagtactcccaatgtaaagatcagttgtgttaaccccattcttagtccaaaatacaagtgtgtagctgacgttgatttatgttccacttaatttttttttttttttttttttttttggagagagggtcttgctctgtcatccaggctagagtgcagtggcacagtcgtggctgactacagcctcgacctctcaggctgaagcagtcctcccacctcagcccctagagtagctggtaatacagatatgcactaccacaccgagctaattcttaaatttttttgtgtggacggggatctcaatatattgcccagcctggtcttgaactcctgggctcgagtgatcctcccgccttggcctcccaaagtgctagggttacaggcgtgaacctctgtgcccagcctgtgttccacttaatattaaatgagcaagactagaaggaaacccaattctgcctaaatccttatagttggatataatagcctactgccttaaaagaaggggggataagataaagcaaacaaaaaaaaaaatacctggctactttgaaataagtaggtattatattctcttcaagattacctttatatttcatgttattgaaacagttaacatgtacatagaaattcactgtaggaatgcaaacgctatggcattttgctttttaaaatgtcagctcactgaacatacaagtgtttacatgaattaaattccagatcagaggcacatagtggaaagagttagatcacatcttgctcactctgcatctccccagagcagtagcttcatgcatggcacccacctgaggaagggaaatatccagtgtggagccaaaggctgcacgacgagctctgatgcaaccattggtgacacttcacttgggctattggacagcagatgtgtgactgaaggtgactgtttcagttgtgataacatcttcaagggagtttctgtgctgggtttcctgtctctccttctcatcctgtctttccctcctccccaaatccaagtagaaagaaaagtaggacagtattcacagtggtgaagtgatagtgaaaatgtcctcaacgtttgcacatgcacatatacacatcagtgctgtctttcataggtctctagtgatgattctttctgctgtaatcctcaattctcaaaggggcagggaacaaaagaaaaaagcccatacagaaaaagaatgtacaatatatagactatgaaattatggaaatcatcttaagcctgttctttggctattataatattggagaagaaaacatgttttatggattcaaagatgcacgttttccccccgattttagcatttctgaaatccagatgcatctcacagtcactgcctggcagctgtcatgacatggtcgtcaccgcctgcacacatgcaccgaaacctgcagaatgagtgtcaatggcttgtaggaaaatcccagagatgctcattgagcacaaaatgccacctttctaacactctcgatagcgtagagattgatactgtgaggcaaggcatgaattctgacaactcaaggttgaaaaatcattcggaagaattagaaactgaaaggaaagaacttttaggactaccttaaccaacttacttcacttttttttaaatgtatggatgagcgatctattaagaaaatctaagtaagtgttcagttagtctaaaataaaatccctaagtgataaaaatgcattgtcagaatttaattggcaggagttttttcgttaatggcacgtaaaataagtgtgtcttataattgatgacatcttagattcaatgaaatgtggtaggcattccgtccttatataaaaatcttaatgtccttccattcttttatcttactgttatttatttatttatttatttatttgagacagagtcttgttctgtcacccaggctggagtgcagtggcacgatctcagctcattgcaacctttgctttccaagttcaagcgattctcctgcctcagcctcccaagtagctgggattacaagcacccgccaccacgcctggctaatttttgtatttttagtagggacggagtttcaccgtgttggccagactggtcttgaactcctgacctcaagtgatccacctgtcttggcctcccaaagtgctgggattacaggtgtgagccactgcaccccacctcccttcctttaatatttaaaagtactatgatatagagcagtaataattgcagttgtaaacatcaaatgcgatcagtttactaactaatctattcatttcaaaaatattcattgagcccctcccatgcggcaggcatgttctaggtgctgaaaatacatcagtgaataaaaccaaagtctgtaccgtcatgaagctttgtctgggggaaaaaacacataaaacaataaatattaataaatactaagaagaggctgggcacagtggctcatgcctgtaatgccagcacttctggaggccaaggacggtggatcacttgaggtcaggagttcaagaccagcctggccaacatggtgaaaccgcatttctattaaaaatacaaaaatcagctgtgcgtgctggtgcgcgcctgtaatcccagctactcaggagggtgagacatgagaatcgcttgaacctgggaggcagaggttgcagtgagccaagatcgtgccactgcactccagcctgggcaacagcaaaactctgtttctaaataaataaataaataaataaatagaagaaaaataaagcggccaggcgcggtggcttatgcctgtaatctcagcactttgggaggccgaggcgggcagatcacgaggtcaggagatcgagaccatggtgaaaccccgtcttgactaaaaatacaaaaaatagcctggcgtggtggcgggcgcctgtagtcccagctactcaggaggctgaggcaggagaatggcgtgaacccgggaggcggagcttgcagtgagccgagatcgcgccactgcactccagcctgagtgacagagagagacaacgtctcaaataaataaataaataaagcaagcaagctaaagctaagtagagggccagagaatactggggggttcatattttagatattcagggaagggggctctgataagtgagaattaaatagggacttacgggaatcagggagaggccctacaggtccactggggaagcacattccaaagagaggaagcgcagattccaggccttgaggctgaagacttctcattgattcaggagaaaagtgcaactggacctgaacgagggagagggagataaaaatggcctagtacagagggtgtttatagaccatgacgagggcttcaggtaggattgggagatgggaagctcggggaagccctgcgtggaggagtagagcactctcgagtctcatttgggctgccgattgtaggggctcacggagggaagcagcaagtcctgatggaggctgtggggataatctaagagacacggcggtgtcctggactagtgtgattgtatcgtaaaacagagagaagacgtgactctaaccacagtattcaaataacacgtgaacccaggggacaacaaggaagacgggccctgaagacagagcattagctgtgtgcgcgttgctttcaagactctgggaatgaaacaagcacagtaacaatattttcctgaagtaaaacaatccttgcttaattgaaatttttcatttctctttttcttttttgtaatttactaggcattgtggggtctgtcaaaagctataaaatgtcatccctgggagcttctagttggggagataagacggggatttctcttacagtttaaagcattatacgattaaggatcaaatgtcagcaaattcttttagagttaagaaaaagcagagatttctatggattggcatatcagaagagggtaggacctgagctgcatctttttttttttttcttaatagactttattatttagagcagttttgagttcccagtaaaattgaacagaaagtactgagggttcccattcacccactgcctgctccctccacagcctcccccactatcaacatcccccaccagagtggcacatttattataactgatgaaactacactggcacatcatagtcagcagagaccacagtttacattaggggttgctcttggtgttgtacattccatgggtttggacaaacgtataaagacatgtatctaccattgcagtatcatacagactagttgtactgctatcaacatcctctttgctgcttctcttcatccctccctccctgtacccgctggcatccattgatttttttttttggaaactgtattcataattttacctttcccagaatgccataattggaatcacacagtatgtggccttctcagtttgacttctttcacttaccaatatgcatttcagattcctctgtatctttttatggctttatacttcatttctttttagtgctgaataatattccgttgtctgaatgtagcacagtttattcattcaccaaatgagcgacctcttcattgtttccaagttttggcagttgaataaagctgctttaaatatctgtttgcaggtttttgtggggacataagttttcagttcatttgggtaaatgccagggagtgtgattgctggatcctatggtaagagtatgtttagttttgtaagaaactgccaaactgtcttcctaattggctgtatcattttgcatttccactggcaatgaatgagagttcctgtcactctgcattctttccaggatttggtgttggcagtgtttcggcttttggtcattctaataggtgtgtagtgggatattgttgttttaatttccattctcctaataacatataatgtggaacatcttttcatcttttcctgtgcctatttgccatctgtatatgtctttggtaaagtgtctgttcaggtcttttgcccatttttaaattgaatggttcatttttttgttgttgagttttaaaatttgtttgtatatttaggtgacagtcctttatcagatacgccttgtaaatatatttttctcatagtctgtggcttgtcttttcctcacagttgtgctccatcctgaaggatgagtaacaggtgagagggaatcacacacacaggtcacagggaatagtaatagtcacagcacctaacatttcaagagcacttactatgagtcaggccctgtgctcagcactcttacatgctttaacttgtttattcttagctagaaaaggggtactttttttatgctcttttgtagaagtgtcggcaaaggaacagtgaggttaaataaggtacgcaaggttgcataatttggaaggaacagaacccgcttttaagaccagtcagtggaacatcctgcttggaaatggggtttatattgagggccgcttagaggggattttgcaatagatggtggccagcttgtttagtgctttaaatcccagaataagatacctgtatttagatgtgaagtatgaatgtctttattaataaaacattttttcaacaaaataaaacttagagtcctatgatttaaaacaataaacatatatttttagataggttaaatcatctgtggcatccctgcctaaagattcatggagtttaaaaatccctaacttgaagcagtggagagccttgggagtttggtgtggctagggatggggaggtgtgtggggataagaagacagcattggcaggacatgggccccactgcgcaggaggacagggtggaggtggactcttgatggttatcaggctgttatattttagttcaggggcaatgtgatgggcgggcctcgcctaaggtagccaatgggaataataaagaaaatggtgattacaggagattttttgaagggaaatgaataatacttgtttagtgactagatatggatggtgagtgggaaggcttgaaaactcatgtctctagttgactgagagaatttgaacggccagtcagacaaaaaaaagaaaacgtgagcctcctttaacagagaaataatgaggccaatttatgacctgttgaatttgaaatgatagtgaaatagtcaagccaagatgcctagtaggaaatgaaagcaaatgaaactgagataagagaggaggaatcttgaagataaagatttaggagtcagcaacattaaagtgacagctaagctcatgagaagagatgaaactgccgaatgttaagtgttgaaagagactgcaagttgatcaataactgaacctcaggaacagtggagttaaatcctgagggagcggagatttctgtttgtcattgtggattgacccatgagttcatttgtgcttcttcctaaaccccactacaatgataggaagatactaaaaaatgtataaagccgtaaggataatagagcaagggaagagatggaaagtgggaactgacttagcagagtagaggaagctaaaacataccagcctgcagagaagattatgggaaacaagatgattgctctccaagagttcagaaacaggggtcatcaggaactccagaaggcagggatgtaaaagatataaaagtctgtttgtgcatgtttgtttattagcaaaaacatttgaatttttagtaaactcaacattttagtttattggctaaacattgagtgccaagtattgagttgggctcagtactgaaatgcagtctaggtgtcagtctccacactgaacaggtgagactttcctcccttttctccatcagactcctactgtgtaggaaattggaggattctctgaaaaaactgagctttcccagggaaaatacatactgacaataacattttagagctagattatcttacaatgtagcccgccagttagcaaagtcccaaacattttacatgtagagtgtccagcgactcacgcttaaacacccagtaactaccagaaatgaaaggtatcccacatgaaaagcagaagctgaaacctcagaaatagagacaatgtaggaaatagaagaaaactacacacacacacacacacacacacacacacacacacacacacacctctacctacaccccttccaagagacaagagcagaaaatgtcagaggaaccagctgtcaaagagccagagcaagttagaaattaaaaatataataaccaaaagaaaatgttctatagaggggtttttaagataaagtcaaggaaacctgaacagttagataaagagaggaacgataggagagaaaaaagtgtgagaaaactacagagttaattcatgaggtcctatagccaactaaaaggagtcctaagaagagagaacaatgaaactaaaggaaatgaaattatcaaagaaataacacaagaaaatttttcagaagaaaaacgtataaatctatattacaagagtctaaaaggtacccataacaatgactgaataaaaatgcataccaaggcacattattgcgaattagaggaaaccagagattaggaggaaattatatgtgcttgccagtcacatacaaaggactgcaattcataatggagtcagaatgaaggagcagtggtgtgaaggttagaagatggtagtacataccatcagaattttgagtgaaataatttcaaccttaaattctattttcaaccacgctgttaggtcagagggtagaatagggacattttagacatgtggagtctgaaaacatttacttcccatacatctcttatcaggaaactaccagatgattcagtctcaatttaattaaatctaatagatatttaagcacccagtatatttttagcatgatgccatgcatataataactatctgatgaatatttatagatttagattaaaaggttcagaagacaaaaatgatttaagacacagtccatgcctttgataagcttatagtttcctaatcctggataactccgataaacaactgtataaaaaacagtgtgcagttctcataaagttagaaacagccgtggagatttgaggaatggatagtgcaaatcagattgggagcagttttatgaagggaattattatttgagacagttcttgtaaagtagataagaaaaaaagcattccagttaagaaataacatagtggccaggcatggtggcttatgccagtaatcctagcactttgggaggctgagatgggaggatcatttgagcccaggagtttgagaccagcctgagcaacagagcaagaccctgtctctgcaaaaaattaaaaacagaaaaattagctgggtatgatggtgcatggctgttccagctacttgggagactgaggtaagaggatcacttggacccaggagtttgaggctgcagtgagctatgatcacaccactgcactccagcctggaagacagagcaagaccctgtctcaaaaaagaaaaaaaaaaagaagaaaagaaaaagaaaacaatataaaatacagaagtggaaagctcatgacctgttgaagtggtgcagtgctgctggaaggaagaaaagtcaaggaagataagagtaaaagttaggttggaaacatagagagccacaaatatgaagctgaaggtaaggcatgggaatcattgagagatttccactgggagagctgtctttcaggaggattaatccagcaagctgagtgaccacgtttagcctgctagatcaaatttgctgacaggtagaatgtctttcctctctagtatttctttactgtttggcatcgaataggcatacagtaaatatttgttgaattaaacttcaaatgaataacaaaataaaatttcaagaaagaggaaaagtgatcagcagttgttgctagatacaggtcagcagggtggggattatttgtaactgcacatgaggatgctacaggggaccatggggaaagtgtttccagtgaatggctggggcaggtcagagagtgaagagtttcagagttgagtgggccgtgtagtaatcaaggtaaatgtgctctttggcacaatctgacaaaggaggaagagccactgccctctgcttcgccactgcctcactgtatcctcatcatcctggacatccttgctgcgccgatgccttcgaggctgtgaaatcctttccttctgactgtgtctgttaggtcgggaaaatagtaagttctcatggggtcagtaaatacaagaacttatttacttgaactgggtggcagtgttgaggaaaagggcagggttgtggtagctgggtttttacactcgtgggtgcttggtcttagagagcctggagcatgtgtgtcagcaacagaggggagagacatccttgtgttggatctggctctggggtcctagtttcttaaagttagtaaaattttactttggaactctttttgtttttaataattatatattcaattacttctcatcattttctcccaaagtgtcaaatttactacagcttcaaggagtcaggaatatttgttttgaggtcagtttttttgcttcacaagtggggttgtatcatgtgcctccacttcagttatatctcaagaggtgacaagttgacatttttattaagttctgtaatgttctattagttatgttcttataattctgatttggaagacatccctctgtgagagccagggaaaaggagagtcagtctagcaatcacccgtgacgatgcataaattgcgttttgtcgatttcagtcgagcttcccatatagaatgagtatataaatattacttatctgaaaagatacttagggtaaatattttatcaaacatattttaagccatctgctttaattaaatttcattggcttatttatagaacttatctctggtagttcaggtttttttcagctgaaaattataatacatttttttcagccagaacatttcaaaatgtacttgtatgtttatatgacgttgctttatgtgagtaacagcagtgtaacacagtcttgctgatttacccataaaattataagctttgctttctgaaacaaaatccgctgggttttcctggagaaaacttgagggaatccaagcgagtcctaggacattgctgactgagaaaatcctgggctaggtccatctccagctctcttgttaggggttgcaaacacagatcccaagaagcgctggggaatgtggtgacagtgaaatccaggggccccatcccaagtgggcagccgaggcgtgtgggcacggagttctagatcttgtgatgttttagtaaaggcaggaaatttagttaaaaaaatttttttttgtcgtttttgggctcttaactcttagaagtgaatttaaaatgtttagaacattgtgcagcccacatacacaaaaatcacatttgcaggttggatttcagctgtaggctgtctgtgcaggtcttctgctcttaacaggaatttgaccttcgtcacagccctgactgtcccattcaaccacagtcatctctcctgagttgctacagttgccgtccagtccagtttctttctgtgtctgtgtttgtttactcccgaaagtctgtccttacttagcagcggttgtgatcctgctcagatcaaaggagtccaatcctgtggttccggttccctgtagctccgtgagactctgagaactccactcggcctccagcgctgcctttgccgttgccttgaatgaaacaggcgctcgatgttggcctcaccttgcttggtttcttggcttctgtcttctgattctggctcctacgcatcacgttctgcttgctccttagcattgcaaactctgacattttagatgatacgtttgtttcctagttcgtaagtttttcctgggtaaacatttggagggtgttttttgtatttgccttcttagcacccttgatacaccttgatagtaggtgtacaagatacacttgctgagtgggagcccctcttttgccagccttaaaaccatggcttccaaacctcacaccatgcttcattgtccttgccagttctgttctagctgccaggagtgcctgagagccaccaaacttgcacactgctagacacaaattaagatgggcttgaagaataaatacttgtcatttcctctgagctcaaggcatacagatggtaggtgctcagtacacattaaatgcatcatttgtgcctcttggctttttcacttctgtaccaaccaaatataattctacaaggagagaaaggtaagcaaaaattagttgtgtgtgttttcagctttttattaggatgtattccaaagcaaaatactaatgaatttggaattactgtcactatcatttccatctattaccacagatagtcaggaactgatataactgatttgctttatttggaggatgagcaatttctaaaaaatcattacccctagtaaaccaagatgagtcagctcattataatagggttctttatactttgaaaagggggtgggttttcttgttctttctgcaattgatatgcgtaagaggaagaatgcaaaaccatgaatccattcatgaaatgtacttttgaaattattcactgattttttaaaatgttcatgcttgtgtgtgtgtgtgtgtgtgtgtgtgtgtgtgtgtgtgtgtgttgtgggggggagggaaaaggtagatgaaaaactaccttgtttaggcatgattgtcaattttattttctgtctacttactgcgttggataaacatactggaatactgccaaaaattcaggtggctgaatgctaattttgctgaaattagatggaacagccatcccctgccaattttctgtctaaattatgcagaaatttgactcttgtaagacataaatctggtcaaaaatagagtcctaattttctagttagtcagtaagaccatcaacagactaattattcttgttttatcttttactttttattaagagaaagaaataaaaaatgaaacgcagtaaaagttactacgcatttttttcatgtaacccaaatgtagatttgcaacgttaaaggacatagcaggtctaactttgtctgagatagagcaggagtgagcctcagaaaacaattagtgcatctttcaaatgtaccatagttattgaataattactcaaataatggtcagtaatggaatacaaagggttatctcttagctaatcctcaagtaatggaattggtatatctgtgatttttctcttagccttccagggtatagaagaattagacaaaagtgattatgggaactagagggagccactggaggccacaaggaaagggagaccttatcttaagcaattaatcaagaaactcatattttgggacaattattcagagttaattctaaaatagctttagagccccaggtcttgagatatttttttccagaattttgtcaaggtcatttagagcactaggataatcttacattagaataaagatttggttaaaggtatatatattagtctctacctagaaatatgggcagcatgaaaacatagcatcggactacataactgtagttgtaattttttactctattttcattttttttggtagtaaactgcacaaaataggataaggctttgtcccagagatgggcagcctttcccgatgcacagtctgaagtgcactggcctctggcacccgtggcattagaggactggattgcagtttttggagttaggtcagtttgtctcaccttatgaaatgtgaacagagggatgctaatcctgtttgcctagtgagtttttgtttgtgtgccatttcacagaataactgatttcctattgggtgtggttgttttaaatctgaccagtcatcttatttacttattactgtggcattttttcccattagtggattaaaaaaactgttattttccaggtcttttgtttgtttgacttacctaatttatcttgtttacctgcatagtgagcattttaagacctttcctcagctttctctacctgccttccttggtatcttcccttcttctagttaagtggattccctttggccgcagacactctctagatgccgcagggaggccaggcctgccctcgcactgcagccccctacctcctcccacccctacagtaactacccacccggctacatcctgagaaggctgtcccagcagcaagggtgtgcccttgctcctctgcccctgaaatgcttgttcatgacatcatcacacagctggtcttcctcctgaatcagctctcagctgaaacatctcttctccatctttagacagtgactgtcctgtctaaagtcgccctttttctctccacacacattatcccattttactgtctccctagcacttactgtgaattttccttttgtatttgttgttgcctatctgccctgctagtaaaatctatgaatagagaaaccttgtcttttgtttgttaacctccgcattgccaggcggacacagatcttaacaaatatttgttgaatgaatggatggatgagattgccttgaccttgttatgcacacctgaccctgactgtcctcctgccttggcctcctctgtggggctgaagccaccctctcgggtcatccataacgtcactgcatcctctacacagctgctagagtcatctttctcgaaactagatcaaactattttaaaactaccggtgacttcctatacccttcaaataaaattcacactctttcccatgatccatgaagctctcttgacctacccaacccacctcctttcctcttgccttcacctgctccttcccatgcctcagacacaaaactcgttacgcagtatggctgtccacatgctgtccctgcacctggagtactttccctggcttgtctctgactggctgttttggttattcccatctcagtttcattaatcagtattcacatagttgcttcattctatttaagaaggtggtgggccaggcaccatggctcatgcctgtaatcccagcacattgggaggccgaggcaggcagattatttgagctcagaagtttgagaccagcctgggcgacgtggccaaacctcgtctgtatgaaaatacaaaaattatccaggcgtagtagcacatgtccttggtcccagctacttggaatgctgaggtgggaggatcacttggacccaggaggtggaggctgcagtgagccatgattgtgccactgcactccatcctgggtgacagagtaagaccctggtctcaaacgaaaaaaaaagaaggaaagtggcactctacatcactaccaccttcccagttgttattttccattcctttatcctgtttatttcaaagcatgtatcacaatgattataacaactttttttgtatatttgatgcttttctaatattggacacaatggaatacttaccctactcgttaaaacttttctttttttaaaaaaataattatttgtttgtttttggaggcggattctcgctacactgcccaggctggtctggaactcctggccttaagagatcctctcacctcagcctcccaaagtgctggcattacaggcatgagccacctcgcctggccacaacttttctttcttatacttgcttatactttctcttcattgttgttgttttaatcttttctgattttcctccaactcattggctgtcccatctccttctccggcccctcttctgctgttattgaaatgtcggcagccctagaatcctgcccttggttctctgctctgctgtgcaatctgcaggtcacctttcctgcatgcacggcccctccagcccccaccgcaggccggatagtgcggttaagagctttccatcagcagctgtgagggccttctctgggttaggcgctgtttagactctgggaatagtctaaaaggtgtagttccttccagcatgaagcttattgcattttggtgagggagacaaaaaatagctaagcaaacattctgtggtgttaggtaagggagtgcagtggcaatgaggccaggtaagaaagctactgggaggcgagttgattgcaatgtgcagtgatcagagacggcttcactgaggggtgacattagagagccaaataatacgagagaagcagccgtgagccgacctggaggaacagcactggggctgctgcgagagcgttggggagaagcttggtgagtttgagaagcatcgaagatgccagcatggcttgatgaaggcagctaagaaggaggatggggccagaccttccaagacctcagaggccatggcaaggagctggggctttattccagtggtgacaggaagcactggaggcttttgagcagggaaatgatctgatttgggattcggagttggagagtcaattccagcctcatccatcacatggctttatgtgaagaagcagcggtcatatttagcattttcttagccaacagtctaactgaaatcacccatgtacagacaggaaatgacgttcacaattctatgttgacgcactataacttcctgacataccttttattaaagaaagtttaaattgtctcaagtggttttattgttaaatatagtactttatgactctgattttttttttttttggagacagggtctcactctgttgccccggctggaacgcagtggtacgaacatagttcactgcgacctcgaactcttaggttcaagcaatcctctggccccagcctcccgagtagctgggtccacaggtgggcaccactgggccctactaattttttttttcttttcttttctttctttcttttttttttttttagagacaagatctttcttgttgcccaggctggtcttgaactcccagcttcaagcagtcctcctgcctcagcctcttaaagtgttgggattacaggcatgaaccagtgcgcccagccttcgtctgattttaagaatgtttattctgtatatgatggatgtgataactttctattattactcatagatggatgaactgttctgctgctctccctggttcctcatccaggccaggaaagagttgattgtaatttcatagcatttttctcataataatctttaaatcctgaattgcttgttttgtggcttttgcatatggatggtctcctagtgtgttgggtgttttgactcaccaaattttgagagactagcagcagattttacaggctgcctcctaaataggaagatgtttggagttgttggaatgagacagggatagatacataacaaccaaaagcttaaatactgatctttttccctatcaaatttatcactgggtactgaactaatgtttatcttaccagttcaaacttgagtcaccctaaatttgtttttctttcgaatcttgcttcctaacagtcattgtgtcattatactgagctttctttattaaatggttttgttaaaatctccaggattatacatgcatagttggggaaaagagggaaaaaagcaagtgtaggaacagcttcctcagagggactgacgcgcagaggtgctgggcgggtggggagcaagagctgtgcccggctgctgccgccgctgctgacagccgctctcgggtcaacagtgtcaggatgatttcccattacttttttatcgactgctcttgatgatcctgtgaagtaagtgggctcagcattattgtgtgagtgtctgtgcgtgcacagatgaagaaccttgtgctcaccatcacagagaaagaggaaggggctggttctgtaaatcagagtccacttgccctttgctgtttccactgtaacgaaatgctgccttaataataaagcacagccggaaataaagagtgggctgcttagcactgtccccaggacagaggccatgtggcaggcaagtcagcctcttcgacaggattgtgtaccaggcctactcatggatgcctgggtgtcttatatataagtggacacaagaagggagagaatggagcacttagggcaacagccaagcaggcccccacctgtcctagcctttccctttgcatcgcattatgtaagtcctcccttctttgacacttggattttagaatgtccactttcatgttgctttaataactagaacaatgtcttcattttacatagaaggaacacagtaagaatttaatagtaacttgaaacaactgtaaaattccgttgatcctgagatatcagttgtaagacacaccattcatttatgtaccactaaggtaaaaacaaacaaacaaaaccaaaacattgccaattagactgtgaagcaattctttcttctataaaacatttttttaactgcatagaccaaatacttcaaatttcttaaatggtttgttgactgaaacatagaagggttgcagtggccagtcattctaccaggagtaacagtcaagttcacccatcggcaggcagtgactgcgcatcaccactgcctgtccaataaagataggaagatactactggttagaaaagatggcccaatttcagagatgcacatttttgttttcacattttaataaattagagtcaatgatacatggtgaaatcgtttctctcatttttctaataatagcactgctggagaaagtacttattattagcctgtaatggtggtttagcagcagaaggcagatgtggttcccgtatcagtgaagctttgttggggaaacagacaagaaatgcatgaacagtcaaacagttataaattgcgactccttattttggggatgtagaatgaccagagaatatgtctttgaaaagacagtattactcttgagacttaaagggagagagatagagaaatatagaacgacccagggaagagtgttcccatgggaggggagcagaatatgtgggcatgaagaccctgtggagggaaagaccttggcaccttccagaagttcggagaataattgtgtgtctcgagcagaaagttcctcacgtggctagttctttgaattaaactcaaacatgtcctaatttggatttagagaaacgtcttaccagatacagtcatagtgttttagttcatgaagcatatttattcttttcatgaaatgcttctgaggatggaatcactttcaagcaaaatcttttcttttaagtcagtagtccgtaaaagtactggatgttgatgagtgtatatccatgtagttatatacagttatcctcattatgcacagattctgtttctcacaatcatttgaagacatgcagagcagcaaaaattcagtcgcatgcgttgcctgttcccagctgaggtcgagcaaggcagcactctgcctttggtgtcagctctcgcactataaggaagtgtggttttcaccatctcagtagtgccatgtttttctcattctgtgcttttgttggtgattttgtgtttaaaatggccccaaagcatagtgctgaagtcctgtctagtggtcccagtgccagaggctgtgatgtgcctcatagagaaaatgcatgtgttacataagcctcttctaggcatgagttacagtgctgtgcactgggagttcaatgttaatgcatcattaatatcttagataaggtgtctttaagcagaagcacatgtaaaacaagggtatgcatcgattagctgatgaaaatgttgtgaccagagacttataggaacctaaccgtgtatttctcttaagagcagtggttcagtatttgttagttcagtgttaccataactactgcaaataacaagtgacagtatgtgtacatatgaatacatagctaacatgctgttgtgtaacaagccacccccaaactttagcagcttaaaacagcaaccgtttactagcttacaattccatgagtttgcattttgggttggctcagccatgcggctcttctgctggacgaggctgggatcacccatacatttactgttggctggtggtcagtggctttgctcctatgcctggtgctttggctggggctctgggccacacacttcatcaccccgcaggctaacctgggctcattcctgtggcagtggttgcaggtttcccaagagcagcaggaaggcaagtccttagtgtgcagccgctttccatgcctctgcttctgtcacatttgcccattggccaaagcaagtcacacagccacccaaaatcatgtccacctcttgatgagaacagctgtagaagcccagtggaagggcatagatgcagggaggggaagaatgtctgttcatttttacagtctgactcgtacttctcatactaagtcgtttatatacaaactcattttttacatactttgtcttactgttactcaaaagccaaagaggtagtactttctgttaacccaaactggcattaagaggaaactgaagttcagaaggatgaaggaaccacatagcccaataattggcagaggcacatcatacatgtctctatgattgtagggtttttattctgtttctattgtttcactttctgatagataaatggctaatttgcctaatttgtcttattcctggggtggggaaaggaattgcaatgagattagtttcatccctacagaacaatactattgtctgtaaaataaactgtatcctatgcatagtcttactattttaagtctaggaaaatcatgatgatagtgatttgtgaatgtgtggtgtttgattataaatttgatttgcacaaagggcctacatcctggatatggaatcttagttgtaacagaatttatcctgaaagacttaaaggaagatgattaaaatattagagatattgacattgtctgaagagatctacttgtatttatttcttgcaaaaaaaaaatccaccatattaccatagccaggccctattatgctattgtaatcatagttgaaccaagaagagtgattaacgatagcaatttattgtatctgaggaggagagaaaataggagatgttgtcgttatcataaatcatatcataaataaccaaaaagaagcactcagaatgcttgtgtggtgtcagcagccagccctttcagacacgttagcccaggatgtagccatagaaaccccaaagtcatattgttatcttagtcttgctgcagttatgtgatacaacagtattaacatatagattaggccatttataatactaggtgtcatttcaggttggcttgcttatatagcattttagttttttattgtgcagaatgttagtgaaatagtacttttttacaggtcactgtgtatctaggaatttataatgcatcatattcactctactattaatttcttgtgttattgattggttgtaatgtatgaattgtcattgcctaattgtcttgtctttgctagtaatttcattttttaagtaaacaggtttattttaaaaatacatacccacttacacatgttgagttgtgttttaagggtctaatttctgttacattatagacaggacaattttaaaatattttataaggagatgtcaatggaattattttttagcctcatttagtactagaagatataatgatgaagtggattatgattgtttttgacgccatgcccttcttttccttcccagcatcgagtgcctgttttcctattatttcctgactgccccagcctcttctcctcagagtagcttcccagctgggcctgaccctgaccttcctggtagtaataccccgtgttctacactcacctaatcctcaacattccatcacgttgtttcacttcggttccattttcccagtcttctcacttcaaaaagtagggtagagttgttcatttgttagtttcatggtcttaaaaatattttcacagcaacattttaaagatactgcctttacccaaacacataaatcaagtggtagagtttcaggaactgttgcttgttggtcagtgagatatttaggggcaggagtagctctgtcctgccctttagatcatcccacacatggccaactacatgtagagatggccctaataataaagatcttcatctcttggaggaggtcagatgtcagtattcacactttacagatgagaaaacttaggtcttgggaggtgaaatgggctgtgctgggttgaacttggctctgtgaaccgatcccaggtgtcatttcagttaggttccctgcccagccaacatttccattcctgccttcatatcccttgatgtggctccgtgtgtaccttgtgcagattcctgcctaccgtgtgaactgatggccataaaatgtgtttgattaaggacagccaatcatgtcttatttgtctttgtagtcctagttaacacagaactttccatagtgagattcagagtgcacatcataggcaaatgaatgaattagtcctagttaacacagagctctccatagtgagactcaagagtgcacgccataggcaaatgagtggattagtcctagttaacacagagctctccatagtgagattcagagtgcactccataggtgaatgagcggattagtcctagttaacacagagctctccctagtgagattcagagtgcactccacaggtgaatgagtggattagtcctagttaacacagagctctccatagtgagattcagagtgcactccataggcgaatgagtgaattagttctagttaacatgagctctccatagtgagatttagagtgcactccataggtgaatgaatgaattagtcccagttaacacagagctctccatagtgagattcagagtgcactccatatatgaatgagtggattagtcctagttaacacagagctcttcctagtgagattcagagtgcactccataggtgaatgagtggattagtcctagttaacacagagctctccctagtgagattcagagtgcactccataggcgaatgagtgaattagttctagttaacacagagctctccatagtgagattcagagtgcactccataggcaaatgagtgaattagttctagttaacacgagctctccatagtgagatttagagtgcactccataggtgaatgaatgaattagtcccagttaacacagagctctccatagtgagattcagagtgcactccataggcgaatgagtgaattagttctagttaacacagagctctccatagtgagatttagagtgcactccataggtgaatgaatgaattagtcccagttaacacagagctctccatagtgagattcagagtgcactccatatgtgaatgagtggattagtcctagttaacacagagctctccctagtgagattcagagtgcactccataggtgaatgagtggattagtcctagttaacacagagctctccctagtgagattcagagtgccctccataggcgaatgagtgaattagttctagttaacacagagctctccatagtgagattcagagtgcactccataggtgaatgagtgaattagttctagttaacacagagctctccatagtgagattcagagtgcactccataggcgaatgagtgaattagttctagttaacacgagctctccatagtgagatttagagtgcactccataggtgaatgaatgaattagtcccagttaacacagagctctccatagtgagattcagagtgcactccatatgtgaatgaatgaattttagtggcattgagtcacttcaaggaactggttacaataaatatacctaaattcagacgaatagaaaggtattttttgaaaaaagtatgcttttttgtttttcaacctctctgccccacctctcccgtgctgtctaagcattcatttaaatgatcctttcatttgctagtaaaagaggaatctattataaaaacagtgacatgtatggactaataggaaagtttgtgcatcattgtagaaattaatttctacatctgcatacatttttcatttacagattctgacacaagattgtgtgtacacttttaaccaatcataagaagtctagctttaaatacgtttaatttttgatgaaatatatgcagatagcattttgttgttcctttgcttaaagtttaagaatacaagcatattttctgcttagttggagaacatgccactgaattttaaagttgcatgcgtctgtgtagttagtcagataaaaagcttctatgccatgtgcaaacaatttccctttatttcctaatgtctatgaactttttagattatagtgtttctttaaaggcatttactattctagttaaaaagatattttgttctaagtcaatatttatagtagcttagaattaacctcccaaaaatccttttggtgtgtcagaccttattgccttgttctgtttttgtctgagaagtttagaaaagaagcatgtttttctcattattcctcaggagaatgtagggagtgtggattatttgtttgtgttattaatgaaggaaaattgaaatggagtttgtggtgtcctgctcccatcaacatttgtaaagcttttgaaagatagggattaatatggatacattttgttgcttttatgtgattaaaaggaatttgacaattgttctgcagtcacactctgatgcttttagggtaaaggatcgtgatgtctacaacttattctcaaagtttcccaaaattatactataattaggtaattatattaatagatgtagttatataatacatatgttaattagtgcatcgggttatagggtattcatgaattctttgtagtattcttacaacttttctacgtttgaaattatttcaaatttaaaaattaaaaaataggccgggcgcggtgtctcacgcctgtaatcccagcactttgaggggccgaggtgggcagatcacgaggtcaggagtttgagaccagcctgccagcatagtgaaatctcatctctactaaaaacaaaaaagttagccagacatagtggcacgtgcctataatcccagctactcgggaggctgaggcaggagaatcgcttgaccccgggaggtggaggttgcagtgaaccggaatcatgccactgcactccagcctgggcaacagagtgagactccatctcaaaaaataataataattttaaaataattttacagtcaaatgttgacctggaaccattgattgtttaaacaagaagatatcttagaaagcatctctgtctccctatttttgtatacattatgatcagatacccagctaccaattaaatatctgtctaaaagtgaatctctagctgtggtgatgaatttgtgctgagtcattcatgatttcacatcatttccctttttggactggtgaaaaaagcataccagacatgcaaaacatttggcagaatgaggagttccttcttactgtggccatttcttatttgaagtatagcattcacattttagtgactgtgtgaaaaacatgaaaaaatagggttgttaagaggggacatgaattttagttaagatttttttgaaaataggtattaccacactgttttaggtgtgattcttcatgtctttaatttttttttgttgttagtgtcttttttctactagaactataggggttatataataatttatgggattctttgatgaatgagagtttaatcaattataacacataattttcaatacattctcacacgtgggaaaagcaaatcaaaagtcatatcactatcaactttaaccaaactttagcacaagcggaaaaggtgacatcacttttgggaataatccttactatgcctttagggacatgagcattaatacctatccagaactacctttccttagttaaatacccactgtccttcaaagcttccccaacagccctcaattgctttcatggagcgatggggagattagggcagacgatggggagattagggcagacggctgaggtgaattcacatcacccacagatactaactctggatgtgtgctgctattggttttacagagatcacggggaggagaattgttttttgtttttttaatcttctcaaaagggttacaaggttaactttccaaggcatatctctattattgatgggtattattatttagcagtttgaatacttacctttagtaattaattttcagaatactctcaagataaatggtgttaaagaactggtcttattgatcaaggaactaatgcgccaagaagatgaacttgtgtgaaaacttacaactaacaatcaattttttaaatttttttttcaatatttgtttctcacatatgtacagaagagtccttttctcccgtttcagaacactaaaataacagaaaatgagttcttagttctttggaaataaaaatctttgaaatatttcatatatacacatgctgtctgtctcacgctctctctagcgcgctctctctctctctctctctctctctctctctcgatgttggaacacagctattattattattatgtctatatttgtgttaaagtagaaagggcctgtgacccaaatttttttttattatttttgcaataacatatcaagattagatatcttgtaatattaagcttatgctgaccaaattttgcagttttataatacacaggcttccacagattagtgtaggaaaatatttttaagacatttgtaggatattttacagattattagtaaatgatgatcattatacacatgcatgcaaagaatactttgttgccattcaattattatgaaactgaaattcacctttaccagtggtagaggctaaacagttcaatagccattacacatgtatcttattccaaacacttaaaacatagaattaaaattattcatgtagtaaaaagccagatactcattatgtgtaaccatcaaccaagtctgcatttgagcaggcagaagctagatcaactgtatttatttgttttaattttaaaaattctaatatttttaaaataaaatatattcactcaagtcgaaaacttttttaccaggagaatggattagctaccattggacatttctgcagcagtgaaaataagtgaactacagctgcctgcatcaatctgggtgaatctcagaaacataatgttgggtaaaaattaaaaaaaaaaattatagtatcatactatttatgtaaagttcaaaaacaagcaaactacctacaaatatggtaaaactacaaaggaaacagattgaagatcaagatagtagttccctgggggctggggtaggagtggagaaagcaggggtggatgggaaaggagccacaggattgggagggccctgctcatgctcttctgaagcaggcgatggcctcgcaggtgttcactgattattatgcttcataacttccacgcgcgttacttattcctgctggtaggtatcagatcatttctaattttaaaaattgtttaagtatcttcacactttttccttttcttattaaaagttttaggcttttggccgggcacggtggctcacgcctgtaatcccagcactttgggaggctgaggtgggcggatcacaaggtcaggacatcgagaccatcctggctaacatggtaaaaccccgtctctactaaaaatacacacacacaaaattagccgggcgtggtgacgggcgcctgtagtctcagctacttgggaggctgaggcaggagaatgccgtgaacccaggaggcggagcttgcagtgagctgagaccgtgccattgcaccctagcctgggtgacagaacgagattctgtctcacacacacacacacacacacacacaaaaaaagtttcaggcttttttttctgacgaagtcctttgttcattttaattgattttgatgctgcaattgaagctttcttataaaatcttaagtaaataagaaagtgtaaattaaacaaataaaaataagaaacctttgtttgttctaaaaaaaatctattttaaaacgtttgtatttttaagtattcctaaaaccaacacttgaagtgatttagttttataattcatttctattcctttaaataacataaaggaatgaatacaagtttttgcagtattaagtaacataaaggaatgaatataaatttttgcagtaggaacttgaaaaacaaaagtgaaaataaacaataaaaacaaaataacaaaaacagaataaacctagcttgtggagtcttactttaaatcaagcttaatgttaagttttttttactgaaacacaaacaaccatcattaatttttgataccgttatgagttatttgagctctaaattcaaagtaaaccaatatattttctaaagtagttgtatgaaaccatcccagttttcctagccaagcctcacattcttccttcattcaaaggcctatcttgtagccattttgccagttctaatctgatagaattgcacattagtaaaataatatatcttactatacagaaaaatccaaattttcaagttattgtaactataaagcagaccttacatccataagacttgaaactgtcttactagtagtcctgggtatcccctgtagtccctttctagggaatgcttggagtagagcagtttccctctggtctcccagtatccataaggccttccctggagaacacacactgttagagctgagctatatccagattagtccccagagttagaagagcaggatgcaccataacatactctaaagacccgttatcctgcctaagccaaacctttatcattctgttttggcatcattgggatttatgaacctctgtggagtaggaggaggttctttgaaatttagaaatgtaatattaataagtgaatgttcattcactttcagaataccctaaagctgtcttctttctgattttctcatgtttatctgttggcagttgagcagatctgaagtccgccttgtcattctgatagcaaaagcgagggagggagggaaaagtttagatgagctgaatgtggtaggtctaggacaggggtcagcaaacgtttttttgtaaagagctggatagtaaatattctaggctttctttgttgcatgtataactggaacacagtagaccccaaagggagtacgtggttatttctagttgctaagagaaggcattacagaataggtaatacttgagagccttagaagtcgccaacatgttaggaaggaaaagacatttcaggcacggggaatcgcatgtgcagaggtacaggagtgtgaccacatatttggggattgcagataagttagcatggctggaatgggtagagcacgcaggggctcactgtgaatgatgaggttacttccctagcttagagggagcaccttgtcagtcatactggagaaattggatttttatattttattttttcctccaatttcccagatggagaggatttttgtattttagaatagtgattttcaaacatgttttagcctcacaacaaaagcttttgtggaagctctgcatgtaaaatagataaccccaggcataactcttccgtgtaataaagaacagccgtttctactgtgcagtagcctcagaaggggttctacaaaccctcaatttccaagggatgccttttacaaactgcttctgaaggaagcaatgaaaggtttttaagatgaggaaccacaagctcagatttgcgtgttcggaagatcaccgtaagacgacgtgagagatggttctgagaaagctgcactggaggccgagactaggtagaaggtccttgcagccatacagagaagaggtgctgaatattgatattaacaagacagaagcagggggaaagcacatgaaagcaaacagagttgaaaacttgtgctgtcaattcagatctggcggagaagatgggagagaatctagaatgaccccaggttcctgacttgggacctggtgggtgatgccatcattatcgcgaatcggtagcataattgatgaggttgtgatgttctttatgatttactaagtacttccccatgcatcatctcacgcgttctccatctgtgcatccttcatgcttttgcagcatggcttctgctgttggcctcatcctcgttgacctcttaagcatttggctttgttcacctgccttctgcataaaactcttgctcccttgatctctttgacatctgaccctccatgtatttctttagttcttcttccttttctttttatatataggtattcctcaaaatacctgaacctgtttcctcttgtttcttccttgttcatatcatccatcatggtgactttagttatctcaacaacactctttctctcatgcactctgtcctgttttctgatcatctgtattatatttcagctgccgagtaggcattgcagactaaatgttcatcaaactctgtgtctagggattgagctaataatcattgtccttttctatttccttatttcctgtttctgttcatcactacatttatcactcaccaaggctcaaagctttctttcccttttttttttctttaaaaatagggtctcgctctgtcgcccaggctggagtgcagtggcgcaatcatggctcattgcagcctcaaccttctgggctcaggtgacccttgcacctcagtctcccaggtagctgggactacaggcacgcaccacaacacccagctaatttttgtattttttagtaaagatggggtctcactatgttgcccaggctggtttcaaactcctgggctcaggtaatcctactccctcggcctcccaagatgttggcattacaggcatgagccaccatgcctgaccaggctcaaagctttgaaattgtgtttgagtccttgctcaagtcttataccctaatcatttatcagattctatccattctatcctcagaatatccttcacctctgctgcttcctgatcatttccactgttctagctctgacccttactgcctctcacatcacttcagtaatccatgttattgctctccttcagtacccatcacctcccaccctcatccatcctgcgtgttcctgccagtgtgacttttcccaacacataccccacacgtttttctctgttgtctaaaatccttctaggtccaaactaccagtagaataaagattatgtttctttttctggaattcaaaagtcctaggatctggatgcaattttactaaacctgcttcctactgctccccaccttgcactctactttccagacaaataattttctgtttctcttacactccccgtgtttcaccttcatctatttgtcatctgaccctttgtcctggacttcaccacttccagtctccaactatcccaaacgctgcataattaatcaagcctcctccgcatgattgacctcgctgagatctgtctctcctttgacctgctgtagcactttatctgtctgtggcactgatcactttctgtgggctagacatatctgttattgctgcactaaactgtgagctcttttagttgtgatttatttctgatttatttcagtggctcttttagactttatcattgtacattatatgcttagttaaaatgtgttgggagaaataatctgatcttagaaaaactcagccaagtaggcagggcaagtaacatcggctcctttttgaaagattaggaaacaggctcagagaggttgagagagtccctaaggctggttgctctctagtgccgtaactctagccgaaaaaccatttgtcaagtgcctaaaccaagtgtatttcattgcaccatactccctctccaagtggctcacatcaagcaagcaaaatagaagacataagtagtatatgaatttgtcataaaagtcctaaaaatacctgtcattcctgataataataataatccatactaagtcctataataatccatctcttgattttttagagggtgtgtgggtgcgcacgtgtgcttctatgtgcatgagagagagatagagaaagatggcatttactggttaggaaaataattaattcaggaaacaacagaaggccaactggaaataccgagcaatttccagatcctgaggttagggccagaccatgtgaaaggacaatgatcaatttgtacatctgctgttactgactgccactcttttaagaatgatggcacacatgtttggaagatccttgaaaactaacttactttttaaacactgtcaataatttccttttttttttagaaatcatgtttgaacgccgcatgttctcactcataagtgggagttgaacagtgagaacacatggacacagagggaggggaacatcacacatcggcacctgttgggaggtcgggggctgggggagggatagcgttaggagaaatacctaatgtaaatgatgagttgatgggtgcagcaaattaacagggcacatgtatacctgtgtaacaaacctgcatgttgtgcccatgtaccctagaacttaaagtataataataaaaaagaaagaaaaaagaaatcatatttgaagcattgtttttatttcttaggttttgttacattccaataatatttatttttttcttcctttttcttcctttaccagaagaagaagaagagcaggtgcccactgatggaggcacatcagcagaagccatgcaggttcccttggaagaagatgatgaattggaggaggaagaaattattaatgatgagaatttcctgggcaagagaccactggatagtcctgaagctgaagaactgccagccatgaagcggcctcggctattaagcactaaaggggacacgctagatgttgtgttattggaagctcgagagccactcagctcaataaatactcaaaagatcccaccaatgctttctccagtccatgtacaggacagtacagacttggcacctccctcacccgagccgccaatgttggctccagttgcaaaatcacaaatgccaactgcaaaaccattagaaacaaagtcatttacacctaaaacaaagactaaaactagctctccaggacagaagactaaatcacctaaaaccgcccagtcaccagcaatggtcggaagtcctattcgatcaccaaaaactgtatccaaagaaaagaaatcacctggacgttccaagagccccaagagtcccaagagccccaaggtcacgactcacattccccaaacacctgtgagacctgaaacgcccaacaggactccttcagctacactcagtgaaaaaatcagtaaagagactatccaggtaaaacaaatacagacaccccctgatgctgggaaactgaacagtgagaatcagccgaaaaaggctgtggtagcagataaaacgattgaggcctctatcgatgctgtgattgcacgagcctgtgctgagcgagagccagatcctttcgaattttcttctggatcggaatctgaaggagacatttttactagccctaagagaatttcaggcccggagtgtactactcccaaagcttccacttccgcgaacaatttcacaaagtcaggatccactcctctgcctctttccggtggaacctcaagttccgataactcatggacaatggatgcctccattgatgaggttgtacgtaaagcaaaactgggaacaccttcaaatatgccccccaactttccttatatctcttctccgtcagtgtctcctcccactcccgaacctctccacaaggtgtatgaggagaaaaccaagctgccttcctccgtggaggtaaagaagaagttgaaaaaggaactaaagactaaaatgaaaaagaaagaaaagcagagagatagggagagggaaaaagacaagaacaaggacaaaagtaaggagaaggataaagtgaaagagaaagagaaagacaaggaaactggcagggaaacaaagtatccctggaaggaatttcttaaagaggaagaggcagatccctacaagtttaaaatcaaagaatttgaagatgttgatcccaaagtgaaattgaaagatggacttgtgaggaaggagaaagagaagcataaagataagaagaaagatagagagaaaggcaagaaagataaagataagagagagaaagaaaaagtgaaagataaaggcagagaagataagatgaaagccccagcacccccactggtgttgcccccaaaagagttggccctgcccttgttcagccctgccacagcctccagggtcccagccatgctgccatctttgttgccagtgcttccggaaaaactgtttgaggagaaagagaaggtgaaggagaaagaaaagaaaaaggacaaaaaggagaagaagaaaaagaaggaaaaagagaaggagaagaaggagaaggaaagagagaaagagaagagagagcgagagaagagagaaaaagagaaggagaaacacaagcatgaaaaagtaagcagtttctcatttttggccctatctgaacagagtcctagtgagaaacacaggtaaacaaagcccacaattatatctgtattctgggtgtaaatcacccatcacttaagtggaaatatgtttataatgaggttacaaaatttgattttaattctaaaacccataaacctgtaatcaagccctcaacacactagcagatgttaaaaattcatagcctaagaggcatctaatcacagactataaactctctattagctatagtgatctctggcagcttaaaaaaaacaaatctgggttcttaaattgtgaataatatttatgtgaattatcaagtgtactgcattatattttgcacccatatattgagaaaggcagcatccatgtttctaaaagcatgcaaaaccacggcactattttaagaggacagcaaggcccgtggaaggaccactgccttggttttctttttggtgcgccattttggcatgtgtttaggattatgcctgtctacagaactttccgtagcatcttttattccttccgttttctgctttaataagataagggcacatttctgagtatctaggctgatctggcagcctggtgagtgggcagaaagtaatcccacatggcagaaatgtttgaccatctcagtaagtcagacttcatttcatagcatacagcccgacaaactgatagaaaccccgcagttttgtaggcattggggcctcagtcctcaggctgtgacctctgcttacccagctttgcttttcagtctgtggtttcttggattacagcagccggctgggttatttgaaaatttctcataaactttccgaaaaagtatctcttcatagtgccaccccagagctcctgatgatcctttccctgccctctaaaagttatcttctttgagcttggccacaaaataatacccagtagttttgttcatatgataaaatttgatgtatttgacctgcagcagatatattaccaataaattcggagtatttttaacttcaaacttacctagaaaactgagtgtatttgacagcagtaatggcaactcccatttttcgcctaccttgatttgttctttgttctctttggctatcctaaaatataaaaaagtgaaatgggaattctgatatcaataactgaacattgacaagttaacaagacacagaaatccaactcttatttccatttaaaaaatcattttatttattattatgcaatttctatatagtagttgtcaggttttaaagcagatccatacaccttgttttctcctcctaacacacctgtgacataggtccagcaggtattatcatcgatatttatggaagagaaactgagcctgagagagtgacttgtccaagatcaggatgacacagctagcaagagccaggtcagttacactgcagagagacttcacgtggtgaggggtttgttgttagagatactgcctgacagcagttagtcatttatcccttgtgtacctagtaagttggcagctgagccctcagtaaatcaaacaggggactgttcctgtcaccaccatcttcactttggaaagtcagtggagttgtttcaacagccattatgaatttgagtgaagccatcagattaggtttgtaacagcagtcccatgcctttctacagcatctacctgactttagggaagaaaagtcccccagaccaccttggtggaaggcaaaggctcagtccctcgaagcacagagtccacctgagagaaagatacatgttcttggatcagttttgctgggctatggagcaggtacatggcaaaagataaaaatgtagaaaattcagctatcttataagacctttataaataataaatagtaatgtctatagaattagacctgagttcagatcctgacttttgtaaaatgggtaagtcatttatataaggattaaatgagaacatacaaggtgtgcttagtaccgtatctgacgcataaatgtcagtagatggagagagtgttccattctgaatcaaactataaaatgtaggaacctggagattgctgctccattggaccatatcagctagcctgtgttaatatgggcaggtcagctattaataggttttaaaaattattctacttccttggcattctttggaatattagcccttgatacaaataggaaaggataaaggttaggacaacccagggaaatgccattgataaggagtagaaattgggatagtaacataaatgttaagacttccctttcttcaaccccgtttaaatcccccaagcaccacagcatatgagtaaacaaaaatacacctgaaatgcggttccatatggtccgagaattttcctacaaatctacagaagtaaggcaccaaaggttaaactaaagtgagacatatctgctcactttatgtgagcagctttatgtaaggcaccaaaggttaaactaaagtgagacaagctgccccaagaaaatgttttcagccaaaagaatgaaggccacaatctcattttcccttctcatcatcctgaccaagagcaactctcccagacactgacccagatcggcaagcaagagcatttgtttaaatttttcaatctccacatttattttacctgcttataaagctgataccaagaaccaataaagatgtgattaattaaaacggaatttgcatggtaggtagaaggagctttgggctttggaatccagcagacctggaataagatccaggacaagttttttagcttctttaatccttaagtatttcatctttagaaataatgataagaacactaaaaacagcaaaacagtcatagttaacagtgagtaattactatgtgccaaacaccatgctaagcactttaattccttaccacaaccctctaagatagatgctgtaattattatcactttaagatgagaaactaaggcttagagagattagtagacttgcccaagatcacacatctagtaagtgattgaacaggagccaaaatttcaatccaggctgtcagatgctataatttatggtcctcactaccacacttttctatattatgttaaaatgggataagtgaaatcacttggttggtaactcaccataagaagttcaaattgtttttctattagtgatgataaatccagagagtggtgagttgtgcaagcttttagttccccttcgtgggcagtcagacacctagtcagggttgggactctagactgtcacttatttaaaatagaaccacattaactttttataaaacacatgttaatggccaggtgcagtggctcatgctcccaatagtttaggaggccaaggcaggaggattacttgaggccaggaatttgagaccagcccaggcaacatagtgagactgtctctccaaaacaaacaaacaaacaaacaaacaaacaaaaacctattttttaaattaactaggcatggtgttgcacatctggagtctcagctgcttgggaggctaaggcgggaggatagcaccactgcacttcagcttgggcaacagagtgagaccctgtcttaaaaaaaaaagacatgttaagagcacttatattatccaattgcagtcacagccataatagttgtagcagtgataaatctaacattacatttcagaacagtttaaaattgctattaatactgtcacatttgggattaagtacaatttttaaaaatgttttattaaaattttggtttctgtgtgggttggtgtatatattgcatggatctttggggtttagatgagtatacaggattactttaattacaattccctcttgttcttttaagtgatttttggagggaggatcattttgaaaaaataaatgcatttttaaatttatgttagtggaactggatggttatacctatattcttaaatagaaagtaagccaaaatccatctgtcaaagtgggggatctgtttttacattcgaatatgatctggaaaggcacagtagagtttcaccccaaaaatgctgacatcacccaccatctgtagataagtaagtccagtgctggctgagggagcatggctttggcagccacactgaccggggtggaaattccagctctgccacttactcgttattcaccaacctcccatcctcgcagaccctctgcttccttcctccgtctccttcctcccattcaaaactaggaagagacagcagcattctaaagtttaacttatctctgcttaaaaacagtagtttcataccttctcgaagaatattctggcttcagaggctttctcttctgccttctcttagaaaacaataaatgaagagcagtttgtgtcatttaattaagataagtagaggactacaacagttcctgaattttcatacacatatccaatagtgttgatgatcaacccctgcataattgggagttgtcgacaatggaaagcccataaattctagaaaggattctcaacattttttatcctgttgattgaggaattgttttatttgaactttggctactgaataaactaactcgatagtcaacagtgttagcatctaccacctcttgagtgcctacaggttccaggccttgccagaattcaatgatttaattctcccaacagctctgagggtttggtatagtggttcctgttttacagttgagaaaactgcacagaaaggtcgagtaccttgctgtagccagtgaggggagggggcccaggcctgtctgcccgaggcctgtgttgtttactgcccagaatggccttctcagccacttacctcagtctgctttggtgacctaagtgacaaatgcaaatgagggggataggaatggtttgatgcttgatggcaagggcacatcatgattttataaaatgttagttcctggagataccttagagagcacctgtttaaccgccatattttaaagagcaggaaagggatatcctttacactttgatgactttagcaatcagaacaattaaaaattttaatgtttctttatccccaagtcctgtaggatttgcccccaaataatcttttattaaatttaaacggtttgttctttagagaatgataaatcatctaattggtttgtacctttaaggaagggttttcatccttttcctcttttgtttaaagtaatgtagtctcattccaagtcttttctcatcagctattgtaattaattcgtgaaatgaagggttttttttgtaaataaacccaataaaggggagggaaatgtttccttcctgtttctcataactgtatgttccaagagaaaacaagaaacttaatgtttaaatgagtatatttaaatttgtagttcacccaaggccagctcccagcctttctgactctacactctgagcacggacgggaaagctcatattctgtctcagctgtctacatggggtggcacttgttatacttaaccacaactgcacatcttctgactctctgtttaatattttaaatagttatcagagtttacttagactgtgtttctaaatggaaataatgtaaagaccttaattgctgagaaatacaagatggttacagccatagttcagcatccaaatgttaggttattctgttgagctttcatcagtactatttgtgagtttttttctaacataccggcatagatgggaatctgaactagcgcttgctaaatttgctgctaccctagctagtatacatatatggtgtttttttttttttttaatgaaaggagtttaacattaaaagaataaaaaaataaaaaaccttggacagattatattgacaaagctgcccattacctttgcagaaagtccctgtcaaaagataaactttaaagctggaatgcatgaaagagttccaagatagaatttaaatttgaactgattctttatagataagctttttaaaaatccacctctttgcttcaagtcaggattttaaaaataaatttcccctttaaatctcttgagcgattttcattttttgcaaggccgcactgctggtgtcctggaaaaatggagagttagagctttatcagttggtgccctgaggtgtgtggcgaagaagctaaatccttgaagattaacaaaaaaaatgcagcacatggcaataaggggcttatatgactactagtattagttcaggtgaaagaagtattgcttctacataaaactggacaaatccactgacaatgtatttttagttacctacaaaggagtcttatattgctggactttacctctttggtgaattgggaagcttagtaatccactgtaaatgctcttctgtgtgccccaattctcagcattactccaaagtgctgttcttttattttaacccttaaaagctcatcgtggccccagattttggcttgatgccattaaaagatggcattagtcatgttgtctaagtgattgaagtcatccttttgtttgttgtttttggtaagtgcatgtgagaaattattttatgattgtaggaaatgcctctgtttttattttggtgagcacacagataaagttaatggaaacaaaaatccgggaagaaattttaatttcgaaattgtactttctgtatgtatattattagcatcctcattaatctttttctacaatcccttgaattttctcaagttaaatctaatttaacttgtttttaggaatgaaataaaagtatttaagtagtttttagatatatcctggtttgcctgggacaatcccagttatgtggtataattaatagctccctcttttcctgtcagaggcatctgtgtttagatgatacaaacactgtaattacagatgaaactttgagccgagatagcaggttgtgaatcattcattaattcaaccagttgactgaatacctgttgccttccgggcacatttataccattttaaatctcacttatgtgtttccacttttgtttacttaatttttacatattgtattatttagggtttttttatagtagataataaacagaccatttcttgattcctttgtcctgccaagccatttaagacagcgttgaaaacccagctagtttggttgagtgaaggtggggccaaggttaatgtcagtttccatataaactagttagcctcccatggagaacaaaatttacaactaaccccagccatctcacaaatatttatcataagagatattgacaaataaagtgaatagctccatgtaagccatcaatattaccagaaaaaggactcacaatgtgcgtcagagagttaaggagcagtagggtgaacaggggatgaatttggtgtcaggagacctggatttaggccatttacttactaactttgtaactctaggtaaagcacttactccttctgagctcttacatgggaataacaccatccacacctaccctatagagttgtgaagatagagttgaataatgtaaataggacacagttcaccaagtgctatacaagtgtaagttatcattattgggtgttatggtaataaaaatgggccaaacacacaactcaataatagtagagcagaatttttttaaaggtaggtcaaacagctttattttaaaatcgagcttaagaaaaggttattggaatgcgtacatgctagtgttgtcagttgaagaaataagaaatatcacttctaatacctcatcactgatgactgtgtaaccctaaaattgttagagttgaagaatataagaacttcatataatttttcattctctgaatcaaaaagactgcattccgtctcagttttgctatttgtgtgacctcagaagagaaaaggaaaacaaaatggaaaagaaaggaaaaatggtttctccatatatgatcagtttacctgtaaaatgaaacccacattatctaccctacatgtttgttttttaaaaaccttaatgagcacattgggaatataaccaagcacaatgcctggcaaattataggtagcttgtaaatgtttgtttatttttgttatatttgtttattcttccacagataacacagaaagatgaggaagtcttaaatagttcataagactggaccatttgttttcagatttgtttagatataaaactcttcatttaaaaaatatattggagacagccaggcacggtggctcacgcctgttatcccagcactttgggaggctgaggcaggcagatcacgagatcaggagtttgagaccaccctagccagcatggtgaaaccctgtctctaatacaaatacaaaaagtagccgggcatggtggcatgcacctgtaatcccagctactcgggaggctgaggcaggagaatcacttaaacccaggaggtgtaggttgtggtgagccaagaacgtgccactgatctccagcctgggcgacagagtgagattccttctgaaacatacacacacacacacacacacacacacacacacacacacaaacacacacacgagacttgaatgctaactagttatgcaagggtcttgctccacccgccacccatccccctcatgacccttgaccctggaccatactgtctgcaggaccaggtaaatgaaggagacatcagccaagagtgatgttggctagggggaaggggcggtttgtgggcaagttgatacgttaagatttcagtgtgatgagatgaaatacttataggttatttagttgaaaatgttgaataggcatcttcatattttggccttagtgtcaatcagtgctaatccagaccaaaattttgaagacgtattttaaacttactttcgaaactgtgggcagggatgagatcactaaagaaactgtagcatgacaagaggagagggccaagtaaggttgggtgaaagaagaggagtttgtaaaggagaaggaaggagcatgagaagacctataatgggaaaactgggacatgaggacattggcaagggttgaggaatgaagaagaagtgagaaaacagacaatgaagtgaagattgaaatgtgtgagaaattgttagctagaggttgaagagaagttaagaaaatgtttaagatggagtggagcacatttaaaagtgagatgaaggccgggcacagtggctcacacccgtaatcccagcactttgggaggtcgaggcgggcggatcacgaggtcaggagatcgagaccaccctggccaacacggtgaaaccccgtctctactaaaaatacaaaaattagccaggcatggtggcagctgcctgtaatcccagctactctggaggctgaggcaggagaatctcttgaacctgggagttggaggttgcagtgagccaagattgccactgcactccagcctggcaacagaacaagactctgtctcaaaaaaaaaaaaaaaaaaaaaagagtgagatgaaaataattcgtggaacagaaagactgaagatactgtaaataagcagatgatagagaaagcttctttagaagacagcaggagacagatgctagtgtaattgtgggcacagagaagtttgtagggaattgacagagctctccttcaatactggtggcctcaccggtatttcctgtggagttagatgtgtagaaggggaaagaaggtcatgggaagagtcttgaaagtgctaaagattgaaatcattgcttcatattcatgctttacacttatcttaagacttactagggtcagatcctgaaacaggcactagaaaatagcagtaagcaaaacgcgcatggtccctgcccttagctgggttagctggtaaacagctagtattggaggcatacatgaagctggaattaaaaatgttctttggcatcactcggtgctctaggggatggttttaggttggtcctggatgtatggtggaataactaagaggtaaaagggttggggcaagataagttgataattcaacaaatgtctgccgagcatctcctgcatgcaggcatcatgcaagggagctgtcgaagcagtagatcttgatgggctgagggatttgaaaaacaactctaggaagagacagataaatacatgagagaaaataatagatttgatctacatgtactatattaactttatgatatgttgatcattattttatgtgttcccctttagaaccactatactgttcaattatgatgtaattcatgagcttgaaatacataaattaatgttgcagctagtcagtgactaacagtaaaccagtgacattaaacatctggcagtgcttgggacagtgccttacaacaaagaaccatcccaccaaaaataccaatcctacagccccaccgaaagacttggagatagacagtaatttggaaatgcagagcttttgtttagcttgttaattcaaaatgttgattatatgatctgcaaaccaacaattgtgaagagaccctttaacatcagacttagtttctgtgttctcttctgacgaacaggtcagatctttctgaggtctttatcttatttggcagccattgccttcaccacaaatccattccaaaagagaatatctgttttcgttttctttcttttttctttttttttttttttaagatggagtcttgctctgtcacccagggtggagtgcagtggcacaatctcagctcactgcaacctccacctcctgagttcaagcgattctcctgcctcagcctcttgagtagatgggactacaggcacccgccaccatgactggctaatttttttttttttttttttgagacggagtctcgctgtgttgcccaggctggagtgcactggcatgatctcggctcactgtaagctccgcctcccgggttcacaccattttcctgcctcagcctcctgagtagctgggactacaggcgcccgccaccacgcccagctaattttttgtatttttagtttcaccatgttggccaaactgatctcgaattcctgacctcatgacgcctgcctcaggcctcccaaggtgctgagattacagacatgagccaccacaccctgcttgtttttgttttcttttacagcatttcagattgttttacccctagccaaaaattgaacagttgaatggtacaattacacttagtatttcaactttctcatttgataacgcaaacttaagatgagtttaatgtttgtcaagttccataaacagatgcttttatcttatagggaagacatcatcgcagttttttctatttatattaagtctggtaattatttaaatgctccaccagaaatgatctaggtaacaatttttgtttaaaaattttaacaatataattaagtccaaaagttaacccaaacaaatagaaataactaccatatttatatagcatgattaaagtttgcagaatttctcatgatgccaggtagccttcagttgtacagaatggcccagattgtctttctgtctaaattttagccatatttaaggcttcaactttttaactcagtttgtgagagtgggagagtaggagaagtggtaggaggtacttttgttgaaaaaccatattgaactttaatgtgctaacttccacagataaaagtggaaccagtcgctctggccccgagtccagttatccccagattaactctccgagtcggtgctggccaagacaagatgtaagtataaacgttttgaatcagggtgaaacaaatgaaatttaaccttctctactctttcctaagggacttagaattccacaagcttctcccaggtatgaacctgtagggtcaagctttatttttagaactcttcgttttcaagtttttattggtttctttcacagagtaaatgctttttgctttatttgacgtaaaggattttttttttcttgttctttttctcttttttaaagactagcacctgacattatttctgcatagtctttaaggtcccacttatctgaaaaataagaaactctgtactgaatggacttactgccacattacacccaggtggatgcaatgttacactttcccaagtacatagtatctgtcaccatgacaaagaacaaagattctctttttgctcagatggcacatggttttattctgtacctgtaaaacaaagaaatgccaaaggcttggagagacagtatgtaatagtcacaactgatgacttagtccacttttttttaaggaagccctagaaatgcaaaccccacgtttgctgtttatttgtcttaattttcatggaatcatcatatcaacccactcgtctttacagttaatctgttggatatttttcttttattcattttttggggaagcattaaggcctacagtactcttacctgatcctaataagataatgaaacattgatttttttttttggaactcatgttgaaaatcattccccttgttctaaaagcatattatgcatcatttaaataaaatacacaagataaaaattctacaaccttacttttcccattaagcctgaaaatgcagtttacattgcaatcaaatattgtgttgaaaataggcttacaaggcattccatttacattcaatttttagccataaaagtgagagtaggagccatgaatttatttagtagagaggacagaaaatttgctttgtattctcagtggttcatttcatcttaaaagttacatgtattgatactgttgcttctgtcagttccacgtgtagtgcaaagaaaaagtccagcatgattctgatgaatgtgagcagagaggcaacttggttttccaggggagtgtatacccctctgaagatttaaaggagaaaatctgatggcttctgtttttctcacctaaattctctggataatttccacattactcttttcggttgtgccagtagagacctaggaaatgcagcaaaaatcctgtggattcagtgcttttgaaaccagctatctggtatacctaatgcccctatcttacctacagaagcatgaagaatgtcctcatcccttaaccagtagagcttagagaagacccaaccaaagtaaatcttccatctccatgcaaattctgcatatgggctcatttctctaagaggaagatgttgttatccatcattcaacaagtacttttctcctgcagtttatatttattcccatgtctcagtaactcaccattacttaatcttgactcccacacagaagtttggcttgctcataccctttagaggaataagatttgttaaaaggcattgaaaagccaggtatggtaggccatgcctgtagtcccagttacttgggaggctgaggcaggaagatcacttgaggccaggagttcaaggctgcagtgagctatgatcgtgcccactgcactccagcctgggcaacagagccagatcctgtctctaaaaataaaaaataaaaggcagccagatgcggtggctcacgcctgtaatcccagcactttgggaggccgaggcaggtggatcacaaggtcaggagatcgagaccatcctgtctaacacggtgaaaccccttctctactaaaaatacaaaaaattagccaggtgtggtggcaggtgcctgtagtcccagctacttgggaggctgaggcaggagaatggcatgaacctgggaggcggagctttctgtgagctgagatcgcgccactgaactccagcctgggcaacagaacaagtctctgtctcaaaaaatgaaaaaaaaatgaaaaaaaaaaaaaaggcattgatagttatattcaactcacctgcctttaagcatctttcagtcattctgttgattatttattctgttttccccctcaataaatcactcatacacctgagatattgaaagatatgagaaatcctatttggaacagaatgtctagtatcacggaaattataacacccaggtattctagacaaattgcccttgaaagcatattatatatcatgtaaactttcagatatgtaggtaatgactgccatgttatatgaaggattaatcatttgaccaaaggcagatgcaagaaaatccttataatgaacaaagagataaatgaagtgaaatagattacattttaaattaaaatagagcgagaaagaaagaggactaaatctaatagtaatagaattttatgtaaaataaaacttattcagtaaagtgctttttgtggggtggggtggtggggtggggggtggttctaaatcaggggtcagcaaattatgggccaaatccaggccactgcctgttttctgtgacctgaaagttaagaatgtgttttatatttcttagtggctggaaaaaaattaaaagaagaatgtattatgacacatgaaaatatgtaacattcaaatttcagtgatcctccgtggttgtagcatgatacatggcttagtccatggtgataatggggagggaggtgacagattcctgtcactgtgcctgtggttacccagtttgcacacaccttgggggggaataatactcttttgaagtgaaattaatgagcagactgggattcaaaagggggagtttgaatagtccaggggggtatttattgctgaagaacaggcagaatcatcttttgaaattaggaaaaacgaaaaagctttacagggttcaaattataccttctagttggaagatctttaagacagtatttactttctgagtcttaaataaagcagttatgtcttctgcccttgatccagaaaagtactttgagcttggattgtttcctgtgttccctattattgttccttgaagcaagacaggaataacttgtttttcccttgatttaacattcctggaaactgtattctaaaggagtcaatggtgagtccaggacctcctcctgatagtgttaaaattcaagatgactttccaaggacctcagattcctttaacagatcttccagtaatgggtgtccagagttccctgtagtctatattgaagataaaaccaaaacctaaccctgaaattacagtctcaacacctagagacaacatatccaagtgaattgctgaaatatctggtccagcctagcagaagccttgccttgatgctgggatagcaagtaagtttcagcttgcctcagagccactgcctgcaactctgttgatgggatcctgaggtcccacttggacttggggctgggagcagggtgagtgtgacagccaccatggaggccagggcaggtggcaaagcaggcaccaggttatttgtcctccccatcttactgtgtattgagtttggtcattttgagcaaatgtaggtagaattggctaacttacagtgttcatccttttcctcatttctgtcaagaaaataggagcaaggtaatgtgatggattttagggacaggggctgtttggatggaactgtcaagaaagacttggcagaatagggcctgcaactcttctataaagctcaaattcaggtaaaggagctttgtgagaaaaaggtgaaacactggtaaagtattaacaaaaaatacaaatttgcataaagatttggggctgaatatagggtagaggaataagcattcttcccctcagatttctcaaacgtctcttttgctgctgtcttctcccaaggactgaagaggaagcctcctccctcttccatctattcacccacccttgccctcgggcagtgggtcccccatgcccaggtccatggtgagcagctcctcctcctcctgctttcagagcactcctgcctttatcagcaagcaccagagaaggggtgactggttgggcccctctagacatcccatcatgcatggtcatgttttctctaataaatatctcataatatattggatcaggtgatattggaaccatttgagatgcctttcagagaacaatattattatcaatggtaattctaaattccctttgagagttcacagtaggtattctgtttaacaaatataactcctttttcaaaatatacaaattatgtcaagatatttttcagaaaccactttacctctggcattagttttctttctgctgacattttgatttctggtggcaagtggattgatttcttacaattcagtaacttcatcatcagccctcgtcctaacaaaggtgctgagaatgtgatgctttcctttacatgtcatttacttttttttgttgcatttcacagagtttaacttaagccttgtgggggctttttaatacttgtaatgtctaaattttttctatatataatgaaaatgagagctaaagctttgcttgttaatctttaaaatcaatatgtatagacacttgtctttgagtgatctaaacttttccagttaatgctttttgacaatagtagtgaagaataatcatgggcagttacaaaaataatcatttaaaatatttttaaggaaaataagcattttatattttaaaatatagccagatttagccaaatgacattcaacagagtgaagcttgcagtggtattttagtgaaacattctttagagaaataatagtaaatgttttttatctcactttctgaattttcctttctatacttgaagtgctttttattcatatataacttttttcctagtctaaacaaatttaggggaaagtaaagagagtatatatagtacagtcggaaatagaaatagatcttcttccctaagatcaagggaagaaaaaagaagcaaatgattgtaggtcaaatatgatcataccttcctagcagtaagggcaaaaaaatacatttttaaaattaatttgtttttatttatttatcttttttttgagacagagcctccctcactctgttgcccaggccggagtgcagtggtgtgatctcagctcactgcaacctccacctcccgggttcaagtgattctccggcctaagcctcccaggtagctaggatttcaggcatgtgccaccatgcccggctaattttttgtagttttagtagagatggggtttcaccatgttgcccagactggtctcaaactcctaacctccggtgatccacctgccttggcttcccaaagtgctgggattacaggtgtgagcaatcttgcttgactgaaatacatttttttttaaaggaaggtgtttcactttctcaggagagagtttttcaaggcagtaaatttaaaaattaacttctatgtgggagcagatgacaaagatggtgtcctccacagcggtttttataggtgacccaaaggcattttttgttgacttttgcacactttccaagaggaaagcatgaaagaacagctcagtgctgacagctcttaagcacctcttcatctctagtggaaacactcctatttccttttctgaactgtgttaatcaagactcttggtggcaagtaacagaaatccaaatcaaaccgtcttagaggggaaaacagcaggggtggatgtgacttcggcggggccacctgcaggcttgccaagtatcctagggctctgcccaccctcctcttctcatctggcctctgcggtggcagaggtggtcctggccactcaggctgttgtgattcttggtgctcacagtccctggcgaagccccgcttcccgggcctccgttatcagcccccgtgaaggacttcgcttcagcagcccctgtggtagggaggctgccctgtcagaaggggaagtggtaggttccagaaggaaaggagggctcacaccagaataaggggcaagaggcaggcaaaggcgatttatatgttttattgtagttaggaaaaggctgtcagttttgcatttttataaaagtgtcctggggaggcagggcaaagaacctggttggtgtacaaaaggatactttagatgtaacgtttgggaacatttcagaacgtcatcctgtcagacttggaaggccttttgcttttctgtttttaatattttcttcctaacaaaactgtctgcttttgatttaaaaacaacaacaacaacacaaaaaaagattaaagaatgttggagttttatttttccctgattaacttgctacagaaactgaaacatttcataggtattttgcctacgttaaaagctaaacatcatgagctggacgtagtggcgtgcacctatactcccagctacttgggaggctgaggcaagaggattgattgagcctgggaactcaaggctacagtgagctgtcattgcactgctgcactccagcctgggggacagagtgagaccctgtctctaaaacaataaataaataaataaataaataaatttttaaaaagcaaaataacaacaatgacaaaaagaattttaagaatgactggtgaagttcacaagtgacatttaacatttttaaatgactgtatttaaaattttcaaatgacctatttttaatgctagggaaagatgctaacattaccagtgaaattcctaggctctgaacaactgcaacaaaggttgtgagtttgatacgtcattcttgctaccttcctgtacttacaaattcagcagtcccaaacccatagatcttcatcccttttctgatttttccagaaaaggagtttttgacttccttatattactgtcttatttttaccacctagaacaatgatatagtctctaaatttagtttttaccccggcacaatactgtttattcattaacaccaaagatgcaatatgtttactagaaaaaaatagtaaactgtcagaaaaactggctttaggttttcagaaatacttttactgcacagtaaaacaagtggagagattataatcaaagcatttccatcttacttgtaaacaattacagcagttcttacatagatgccgcattagaagactcaggaaaatttactggattccattctaatgcaattagagctaattttgttctttaaatgaataaaaggtcagctagtaaatctagcttatcttgagtccagacttcaataaattgttttatttaatttgttgtaaaagatcttatccttaatgggtccaggtcttattagttcccttaggttttaaaatatttatgaccacctctttagatatgatttgaatgatagttggaaactttctctccgcagtgttatcaaggtccacgatcactaattgagtgaatataggaaagtacttaagattcattatctagaaaaagctgatgtggacttccagaatttaaatgttccttaacctgtgacaggcagagataatttagctgtatcatggaaaccttttggatgctatctgattataatttctcctaaagatcaaactactcacacttctggcatttaaaaaaagaatatgtttcctacagatgaaaacacttaggcactctttattaccaagaacatggaacgtttcaatcctttgcattctgttatttcctgttatgttatgggcctatactgtgttcagatacttacataaagattgcagctgcatggtgcaacatctcttcgcttttcccacgcctgcctgcatagcttctagagtgaatatccacgtcactgcaggactgctgtcatttagaatatgcacagtcttttttaatgtggtagccacaagtctcagcatgtggaactgcctcgccatgttaccccagctgattagacttgccttttgggttccaaaccttcttacatcccccacggcttgtcgtccaggctctaggaaagagtatgtgtctatggtcagccctcctcagctgctggcctccattcctaccttgcctgccccggctggaacttcgttccctctcttagctcctctcctctgtgtcttcctcttcttttttctcatttttgtccagcctttcattctcccatgctaaccctcctcaccttcatcaagccttccctctgtatgagaaaaaggctatgtaacatctgcttttcatgctgcttctcaaaacttattctttagttttactttcttctaattgttcactcctaaaccttctgtattctggtttctgccctagaaacttttctacagcttcttgttaagaccattagatgcttcccaattcccagttccagagaacatgcagcagctcttattgtacaaacccggtctgccgtttggacactgtcccctaagccctttcagaaacttcctgttcctttgatttttgtggtactacgctagactcagtctctcattctctctctctttttttttttttttttttttgagacggaatctcactctgtggcccaggctgaagtgcagtggtgtgatcttggctcactgcagcctccgcctcctgggttcaagtgattctcctgccttggcctcccgagtagctgggactatgggcacccgcccccacacccagctaatttttgtatttttagtagagacagggtttcgccttgttggccaggctggcctcaaactcctgacctcatgtgatccacccacctcggcctcccagagtgctgggattacaggcatgagcccccatgcccagcctttcattctctcttaccatggattccttttgtttttcttttatggacttattttttttcccccttcttttctttttgcccttggtacagtaactctgtttcttcttcgtaaatgttctcattttctctttaggtttgttatgcaatgatgattcccatttctttattactagctcatatttctccttcaagagtcagactaatctgccaagttactggaaagttctgcctgggtgaaccagcagcacctcaaaaatagcatttccaaaactgaacccagcattatttccgccagtgtggttcttcttctttttcgtatatgttggtgatgagaccagtgcctccattttcaagccattttgggcattagggtaacttgaatggaggcaaaaactatctaatagaattgggagattttctttatgtcataatgtcagactgggtgtcctgaaaacaaagataaatgtcttcttagctccaaaagtttcccaagctgaacaaaaccaaggaaaggccttgtcctagaagtctcctttgatattcacttggactctcagcatcttgtaacttccgctcagcatcttcaagcttggctgtctcctccttgtctagacacaaatggtcaggtcagtagcagccaatgagagaaagaagtccatatccttattcacagggatccataactcaccccaagcaaagataccttcagctaagaaacaggggaaaaaaggatatgtagctaggattttaataaatgaagattacataagaagatctgagaagcaaaacacttaaaagtctgatcaggacataataggctttcaaagaacagattaactgcttcaaaatatgtaacctagaaagcagaagtttcccccacatctcacccttcccccaggttaatcactgctgactgtgccgtgtgtatttcagcaatttttataaaaacaaattaggggctggacatgatgactcacacctataatcctagcactttgggaggccaaggcaggcagatcacttgagcccaggagttcaagaccagcctgggcaacgtgacaagatcctgtctctacaaaaaatagaaaaattagccaggtatggtggcatgtgcctttagtcccacgtactcaggaggctgaggcttcacttgagcctgggaaatcgaggctacagtgagtcgtgatcatgccactgcacaccagcttgggcaataggagtgagaacctgtctcaaaaaaaaataaaaaaagaacttagaattatcttacacatactgttcagcagcttatcccctcccctctaacagatcatgaacatttttccatgtctgtatgacatggtatttcattttactgttgtatcatcatttatcttgccagtcaccagttttcaaacatttaagttgtcaaaggttttgctataacaaataaagaaacaacatcctcatatatagatttttgtttattcagtgttactaggtcaaagaatgtaaacatttaaaatgtttaagagattattatgccaaattatcttctaaaaggctataccaattaaaattctcaccagccgtacatgaggatgaaatgaccctatatttaagaagaattagtgaaatcctattgttctaaaattgagcaagactctgggcaactagtagtgaatttatatgaaaagctagatccattcttctccctcgtgggcctgtgagttcatttcatagaaatcctttcttctttgggggaagctattggttgaagaatagttaacatctttattcaggctattcccagatctcttctgaaatctgtaggtccttggtgctggctccgtctcaggtgagtttttcttcattaagtgcactactcatgtgaacataatactacagagaattgccttctctgtgatagtgtttgtgctttggagtacatgtatcaaattcatctgtgaaggaacctgggaaatattatgaatttagtcataatatttataagtaacttatgtttgtaagtaatgtttataagtaaccaatttttaaaaacagtttttaaggccaatatatttgatgttgttactgctattaaatcaaggttatcagggctgggtagggtagctcatgcctataatcccagcactgcgggaggatcgcttgaggctgggagtttgagaatagtctggacaacatagcaagatcgtgtctctacaaaatattaaaaagatatccggggctgggcacagtggctcacgcttataatcctaacactttgggaggccaaggcaaacagatgagttgaaatcaggagttcgagaccagcctggccaacatggtgaaaccctgtttctactaaaaatacagaaattacacctgttatcccagctactcaggaggttgaggcaggagaatcacttgaacccaggaggtagaggttgcagtgagccaagattgtgccactacatttcagacctgggcaacagagtgagaccctgtctcaaaaaaaaaaaaaaaaaaaaaaaaaaaaagaagccagatataatggtgtgcacctgtagtcccagccatttggaaagctaaggcaggaggaccacttgagcccaggagtttgaggctacagtgagctgtgatcaccactgcactccagcctggacaatagagtgagattctgtctctcagaaaaaaaaaaaaaaaaaaatcaagattatcaagtaggcattttctttgttttttattttatttatttatttttttatagtacccctctgttttggaaataagtatctattataaatccctgtgtaaaatggtacattgtttgtactttgcacttaaaagtttatttttatataaatatcacagtaaaaattttttctgtaaaaaaaatgtgtgtcctatttgttgcctgttttttagtcattttatagattctttcctggtgttttataaaatatgttttatcagacttagctttgccccaagtggtggcagggctggtctattgtgaattcaaagcatgtgatctaccaagatttcaacccagaggaaatgggcctggaagtcccagagcaagctctcagtgggccagctgagatcacgtgaccagcctgaaccaatcactgtgcctgtggagacacggtggctctgattggcctggcttatatgtgttgcttggatctagaggtaggataaagcccactcaggccacatggacagaaagaaggaagagagagagggctgaaggcaggggcaaggcaaatgggtgctgtgtagagacaggcaaacccagcagatgccctgagcctagacctctggtatgctgaatgctggaagccattgggtttacttatatatatttcacggtgctgagaaacatctgtttgcattatttatttgtgaatcattcctaatataaattgtgttgctgttttaaatttcctatgaaatacgtttttaagtatcacgatattgcgtagtcaaatgtaatattgtttttgcacatggttctgtatacatcatagattctaaattaaaacttttgatagaaattacaaaatttgtgttaccttactgtatgggcatatttaaaagctaacatcctagtttctggagattctgatctaccaatatttcccatgctgaatcataagcttcagcatttctttaacaatatctcggcgtttggtataaaaccctttgaccccagatgcagagaatgattgttagttaggtaaaaatgagatggtgactggtactggtccattggccaaagtttggagcataatgttcctggtatatgtatgtcaactctggctgtgatatcatatacttacctggttttatttttataactttgtacatgcatcttgaatataatatttttctaaagtttattataattagaagatctttaaaattccctttaaaattatattttttctaagagacccagttaaaattaactgtatctatttttaagagattgttttagtttctagtttagattaactagtagagcacttctggctaatgtttgatattagcctggttttgaatatatctctaatgtgtgttataacccaactgagaaatgctgcttgatctgtatatgaatacgtgagttctgctaaaacactgaggaaccttgagagtcgctaatgccattagggttatttgttctgaacggaatgaacagaatgagtaaatcacaattgtgagtggtaaatggccatgttctagttttttttctcatcaaaccatttaaagccaagtgagcaaggcagaatggctggctacctttttattgtttttgtcattttgtttatttagcttataatttaatacaaggaaatttgtatctgctttatatggaggctgccttcaaagtacgtggtcagggtaaattttgaatgaccgctacatcttttttctcgccttgctagcatgaactgtttttctgtatgcatgcatacatctgtaaatcagtacatgtgctctactgttattatatagttttaaagaaaatacattaaaagaagaaaaatggctcttaaataagaaatgcattttagattgtctggcatttggctgttctgcttatttgtgctccctttacatctaaattaaaacaattcagagattccccatcagttcaaaggtctctgtagggcctgtattgttgacatgggtgggagtggagtgaagaggaagaggagcacaggaggtgcgttagagagtcctgctctgagcccttatcccatagacctcctcacagaagacaccaggctgactcactgtcctgcctgcttgtcatgtccctgcagctgaggctggaaacttctcgagcccctctccgtagtcctagatgttaggggcagaacctggaggagacagagggctgggacccaaagcagctctcagatgccttcaacccttttaagaccttcaaggttaggagctgcagtgaccttctcttttcttttttttctcttttgtaatgatctttcatgtgaatctgaagtcagtgtaataatttcagtcgtctcgtcttgcctcagagaaaattttggaaactttcttatgtacatagatacatacatatatatgtatagatacacacacacacatatacatacatacacatccgtatgcatgtatatataataagtgtgtatgtgtgtgtgtggttttgcttcaaactcccttggacacctttttttaaaattaatcttcataaaaattatttaaattctaaagcaactcaaatgattattcattaaataatttattaatgtttttgtaactaatttatttctttgcagtatggaaaaacacattattttatttcatcttatattttacagttactattgcaccattgttttttttcccaaacaaattgttaaaatcctcttcattctcattttggaagatcatttgtttattaacagagatataatattaaacaggcaatctcagagcagaatgacagcacaaaggtcaggagtgtgatatagatttatacacatacacacatgcatacataaacatatatagtcacttcttagcccacacagatgaatatatgtatatgtatgtgtgtgtctatatcacatgctctaaataagtatatatacactatattttttccatcctatttacaaagtacaataagaattcatataaagcatggtgattttggtgaagacctagcagcttttttgaattttaatatattttgaagtggtaatgttggattttccaagcatgacttcagtaataactgaattttataactctccagtgagatacaaatcttaatcacaatcttgttcatttttcaagttcactgcatatcatcttattacctttaatgttttcaaataacttgggatgtcatttgatcctaaaaataaaaagtaaaggtgtatcttttatggctaacttacaaattcattttcatgtgaaagcatcttttactaaataattacccatcctcctctatagactgtaggctcagggactacagaaagtaaagtttcatccatgttgaatgttcaatttcatttggctttgctttttcatagtaaaagcaccctcttgtttgctgcagagcagcaaaagcctttctgaaatcacaaaatcttttagaagttctgactccagagaatttggttttgaaaggaaccctcaaagtaccccagacaacactctctgggtttacattttgaaaagttgatctgcatttaacacatactgattttgattacatacataatgtaaccatgtcaaaggtagtagacttgaaaatagtgaatttggatcagatgttaattctctcaggagcataagtaaatatcacagtagacggtaggaagtgttaaaggctggaagagatacatctaaaattataaagaagttcaaggtgattactcccaactaggaagggctaaagaggtttggggaaagtagaatttgagtagagccctttagagtgagtaaaatttagaaatggagaaatgtgaagaaaaaaataaaagcaaagatgtatggagtgaaataatgaatgcacattttcccctaagaaatttccgtagtattctgttgacctagtagttcatatgtgccctagttttatgattaatgatctgaaatcattctggattgaacgcatattaccaacttctaaaaaagtttttattaatattttcaaacataaaagagtaaaatgatacactttcatctgctggcaacttggatagatttaacagttatcaaaatgttgccatacttgattctttttgtctttttattcccaacgcatttccaaacaaattcaaaacttaatatcatttcacctctatattcttcagtatgcaactctaaaaatatggttattttctcatataatcacaacgttattatcatacataaaatatacagacattttccttgttaccatctaatacctggtccatattcagatatctttatttgtctcaaaaatatcttcaacagtttaaccaggatccaaaccagacttatatctcataaggacttgtaatctagacctgttatttttaatccacactcctacgctcctcctccttttttgcaggggaaggggatgagttcttactctgtcgcccaggctggaatgcagtggtacgatcataactcactgcagccttgaacttctgagctcaagccatcctcccacctcagcctcccaagtagctgcaactacaggcacatgccactacacccagctaatttttttattttttgtagagatggggtcttgctgtgttgcccaggatggtctcaaactcctgggctcaagcaatccttctgcctcagcctcccgaattgctgagattataggcgtgagccaccatgcccagccgcttcctttttgccatgcaattgatttgtttaagaaaccagatcttttgttcagcagaatatctcactttctggatttgtctgtttacttcttcgtagtgtcatttaaattattgttctatccctgtaactggcatttagtcctaagtgcttgattagatttaagttcattctttttttcttaaagggtattttgctgctatatacttcttattacttcagatcagtaggcatggaatgtctgattgtcacattcttagtgatactgaatgatttcattgggaaattattttttaatctagtcattcctttcacatgtattagctgaaattcatccctaaaggtgaacctcagcgaccctgaaatacacctcatacaggagaggcaggataaatatacaatcttttttttttttttttttttttttacttgccagtcttcagtgaaaagagttgatggagttgatatagttatctccagtgatgagcatagggttttggaaaggggaagggttctgtctctctctgtctctttttctcccccatccctccccctctctctttctctgctccccctaccccttcttctctctcccacttcccctcttcctttgtcccccttcttctttctctttctcttttgttttcatgttcatattgtaccatcttgaccaacgtgaattccttcatgttgcctactgggtttcgacacaacctcatttgtgttggatagctttcttactttctggtaaaaaaaaattccaggtttatcttgcatatttcctgtatattcttgtgtatttccacagatctggaattagcaatttctccaaggaacattggttccttctgatgatgaatggtgtttaggaatcataatctgtcactagagatgcccattgctactgggatgtcattattctaggcctttacaagggacagaaataggaaatagatgggtttgaaaagaaaagaaaaaaaactatgagtttatactgtttccagttcagatttaatattactgttacgtatttatttattgttatttaaaaaatagagatgaggtctcactgtgttgcccaggctggtctcaaactcctgggctcaagcgattctcccacctcagcctcccaaagtgctgggattacagactgaaccactgcgcccagccacatattttctttcacattagaaatcctgagtcttggccaggcacagtggcccacgcctgtgatcccagcactttgggaggctgaggcaggcagatcacaaggtcaggagatcgagaccatcctggccaacatggtgaaaccctgtctctactaaaaataccaaaaaaaaaaaaaaaaatagctgggtgtggtggcgcatgcctgtaatcccagctactcgggaggctgaggcatgagaatcacttgaacccaggaggtggaggttgcagtgagccgagatcacaccactgcactccaggcgacagagcaagactccgtctcaaaaaaagaaaaaaaaaaaaaaaaaagaaaaaagaaatcctgagtcttaagagcattattataattatttgagttattcaacaagaattatataaaatagcctaaaagtaatagtaccactatcactactaccaccaagattattaaatgaagttaaagactaaggtttttttcagcatttgctcttaaaatacatttcactatggatatgcttacaaaatgctgtcctagagtcacttgtaattatttttgtttctacatggttatgtcatcagcttgatatacattgaggttcattcatttcatctagttttgattcataaggaatttttctaaaacttaactttctgaatatgtggaccatttacctaactccaaagtggaagctgtataacaaaatacattcagagaagtcttgctttcatgcctttttccctatgacctttatactccttattctataggttgccattttggtttcctttttattattatctttctagtgtatctcattgcaaatatgaggaaatgtggattatatatttcttacctgaatattaatgcccttttagagattttatgattcggaacatttgacaatagaagtgtaatcatttaagcatctcccttggaaatggagattctataatggctatattttcccctaattacttcatgcaatttgtttcatttttcaaataggtcatgcctgcattaaaagataaaatgtttgctacttgatatgtacttgagttatgacaagataaaataaccattttatgagatgatgtaaatattaaagaggcaggccacgagcttcaggaattaaatccatttatagttgtgttataattatatgaatgttaaaatttgagctgtgaggatcaagaagaataaggaataacgattgacttgaagaatcaacataaaaccgattctcataattgtctttgggtatttggtgttttttgatccaatctgaaatatggaaatgactgtgttacagtttggcgtcttaaggactggtactctaaatataatttcttccaacttctgaatatttatttacatacctaagttagaaaaatcgaacacctggtgtgttagttttctatttccacataataattgaccctgaaacttagtgatttgaagcaataaacatcagttgcttcctagtttcttgtggttggggatttgggtggttctggctcaggtctgtctgcaagctggtgactgggaccataggcatccagaggcttctgtgagggtagagaagccgcttcaagctcacgcacagctgtcggcaggaggctccggggacctcttcataaggcagcttcagcatcctccccacagtgtagctggctgtccccatagaagccacagcctgttttatgacctatccttggaggtgacgtggttattttcaccatgtgctgccagccatccagctcagcctgtccagtccgtgagggaactgtgccagtgtgtgaatgccaggaggccaaccaccacacttgggcttagtatttctggggcttttcataaaaatcagaaagcaaaaatatggagattatgtgtatgtgtgtatcactgatccagatatgaggttttatagtaatatgattgtgacatttcaatgtcttttttttttgtatttgttgtgaggggggttttttttgtgttatctgtattcttacgttgaggcagggtctcactctgggattttttttgagacagggtctcagccagactggagtacaatagtgcagtctcagctcactgcaacctccacctcctgggctcaagctatcctcccttctcagtctcctaagtagctgggactacaggcacgcaccaccacactctattttttttttttttttgtatttttgtatttttgtagagacgaggtttccctatgttgcccaggctggtgtcaaactcctgagctcacacagtctgcctgcctcagcctcccaaagtgctgggattataagcatgagccactgggcccagccgaggagagggttagtttaaaatacaacatgggaatctgtttctcaaggtggttggtatttctgagattgatcaaaaactgaaatctgaagaagaaaagtaagttttggtgtaaacaatatgttttttcatcgacctgattttcctcccaaatgttgaacttcctgttcaaaagtttctataaaattcatggaagtggttgcgatagtttttacctgtggcatcattttgttaccatttaataatggccgttcacttttagaagtaaataagtaagccattgtaagggaacttaggaactttgtgtgcagtttagtagccagctattcagactttgataatttggattactggtttcatcgtgtttgcacacaatagctgaataatgaggatcattaaacttcttgtgcagacatatccaacttgtgtttgctgctaaccctggaggctctgtgcagctggggaggtgaggacgggctctttattgacttgacaagctgtgagtttgcattacaggccaagcagctcatgacccattctatttatgtcactggtttgtggtggggaaacaggtaaagaaatcctgctgaaaatccctccttctgcacgtttttatgaataacgccagtgtttatagcagtgagggcactgtgatcaaatcctccaaaagctgtaatgctggcagcatggagccattgtgggaccagctgtgggcggtattggtttctctgtgagacattgcttattcaacagaaagctctggacgagaacttactatgcaattaaacaggagagaaaaagggatacttcagagagaaaaatatagagaagcaaagcaccgtctagaagtatgaaacaaataatggttggcaataaaggccagcaggaattcaaaattatttttacaacgatcaatttagattaagtgatgatagtttatctcacaagtgatgaaaaattatatcatgttatactgttaaatgtttttctgttttgtttaaaattaaaaggattgtttttaaaactgttttcggtcatcacaaaaataaccttagcttaagtcaaactttcaaactccagtgaattttctcttgaatttcaaaagagttgggaaaaatgggttactttagtgcctctacaccagtctaaccccttgaaaacaaaaagttaggataaaagtttgtcttgtcaacactgagtagccactttaatgttttttcttttactactcagaaaatctgagtgagaactatatatatatatatatatatatgtatatatatatatatatataaatttaaaaggggtaatgtaattgaactgggaatgttaggcatttttgaaggattatcttattattacaaagttatttttagcaaaatgtcatttctctaaattgaaaaaaatgagaacatatgcacaagcagacatttctgagattttaactattaacccataaaattggtcaacaatctgtttctatctgttggccacactgctaattttaagccattctaatgggcgccattatcaggccttataggtaagggagaaatgtaggaaacatagggagaggtggggcatggtggttcacacctgtaatcccagcactttgggaggccaaatcacctgaagtcaggagttcgagaccagcctggccaacatggtgaaaccccgtctctactaaaaatacagaaatcagccgggtgtggtgatgcatgccctcaatcccagctactcaggaggctgaggcaggagaattgcttgaacccaggaggtggaggttgcagtgagccgggatcgcgccactgcactccagcctgggcaacagagtgagactccatctcaaaaaaaaaaagaaaaaaaaagaaagaaatgtagggagaaaattaaagggcactggaaaagagtcaggtaaggcaaataatattcattatgtgtttggtatagctgaaaacaatgtaaaaccatttccggaaaacagaacaaagccttcaggatctgattgtacctggtgttgggaatgactaggtggctgaggaagtggaatctgtgttggcaaacagaaatctcagtggtcctgtgactcattaagcagatggaaggaaggtaggcagggaggaaagaacagaggaaatggtcttgtattttaaaatattttaaacaggcaaaaataattcttttacagaagtgttctcactgcagtagtaggtattctatttaaagctgattaatatttcttgagctgctgtgtttaatactgcaagtaatccaaagacaagatacaaatcttactcttaggaaattgactgtctaatgtggatgagagagacagatctgcacacaactgggacacaaagcaactatgggcaatgtatttctttgaaaaggcaagacccaaaactacgtaccaaccttaatgtctaaaggctgttaaaaaaaaaaaagaaagaaagaaagaaagaagttttttttttttttttgagatggagtctcgctttgtttcccaggctggagtgcaaaggtgtgatcttggctcactgcaacctccgcctcccaggttcaagcagttctcccgccccagcatctcaagtagctgggattataagtggataccaccatgcccggctaatttttgtatttttaggagaactggggtttcaccatgttggccaggctggtctcaaactcctgacctcaggcagtcctcctgccttggcctgccaaagtgctgggattacaggcgtgagccaccgtgcccagcccaaatgtattactttatgtacgaaaataccatcattgtaggaggttttctcttccccctcctttgaccctgtccttgttggtctgctatggatgatgcactcaacttagacgcactcgattgtgcagctccttgatctcactcagagctttgaatttcacaaaatcatagtaggactagactatggtcaacatttgcctggaaggctttttaaccaagctatcattttttccccagtaaattaataaagtgtaacatacacacagaaaagtgaattaattttaagtgtataactcaagccatccttaaaaattcctagcaacagtttagacgtatacattgtaacaggcattttcatctttttcgttgttttgctttgttttttgttttttgagacggggtctcactttgttgcccaggctagagtgcagtggcactatctcagctcactcctgggttcaagcgattctctagcctcagcctcctgagtagctaggattacaggcatgcaccaccacgcccagctaatttttgtatttttagtagagacagggtttcactatgttggccaggctggtctcgaactcccaacctcaggtgatccgcctgtgttggcctcccaaagtgctgggattacaagtgtgagccactgcacccggcctttttcttttttttatgcaagttatgtttgttaattatggataaatcaaaaggagaaaaaaggcatccacccagcacagtggcttaatgcctgcaatctcagcactttgggaggccgagatgggaggatcacttgagtccaggagttccagaccagcctgggcaacatagcaaaaccccgtctctacacacaaaaaaatacgtatacaaaaaattagccaggcatggtggcacgcacctgtagtcccagctactctggaggctgaggtgggaggatcaaataagcctgggaggcagaggttgcagtgagccaagattgcaccagcacactttagcctgggcagcagagtgagaccctgcctcaaataataaataaatagataaaacatctataattttcatgtaaaggcaattgctggacattttagtatatattctttcaaacttttttctaagtatacactcataccttcttgtttgctttttttattttcttagaaaaattccatcttacacctccctttttcttggatagacatatcatttgtgtgtgtgcacacatgtgtatcaccacttcagataacaacatggtgtttgttcatcatctatgtaaccgatctcctattctagggtattttaaattgcagttattctagtttttatttttttattttattttttgcagccatagacagtgctacaaatcatattctttaccccagacctttacacagctgtctaatgttgcctcaggatacatttctagaagtggaattgctggtaaagagcttgcacgtttttaagttttccataatcattccaaatactggaccaaccatctctccctttcccctagcctgacagtaccaggtgttgtcaatctttttcatctttaccaaagaagccttagattgtcatgtttatatctttgattactatgaaaatggaacatttttttcttgtctagtggctggttttggtttttttattctattttctacttgctgtttcctttgctcatgtttgaataagaacattaattcttttttattcacaacagctgtttatataagaaggcgtaatgctttattgttgcaagtagtttgcttcactttgtcttttgccttttaactttgctgaggttattttatgccatataaaattgtcgtgcagtcaaatcagcatttccctttatggtttcagcttttggtgagatactagaaattgtgtcctaccccaagactaaaaacatctatatttacttacttttctgggaatttttatggttttgttttcttttacctaatttttaagacgtttagaatttatggtttgtgatacagctccaattttgagggatttttttaattaactataccatccaacaagtcataattgagctaattctcaattgcacatgcgtaattattgcatagtaaagcacatgaacatctgaaaattattgtagacaatagcttcagtctctacctccaacaaacattttccactataacagccggcaaacagtaaagttaaaacgaagtgacaaccaaattctttgcaagcagttttctaaggccccatccgtcgatcctgtgaatggctattgtaagatagaagatgtttcccttgaataacctcctcttgttgataacttacattttcaggcttatttttgcctgcagtcatatttattgatcacaactctcttcttcctatcatcctctgttctctctctttcctgcccctgaaattaactccattaaccaacaactgaaaacgcctgggttgtcctcacacttcctgacctaaaattgtaattctttcacttgctctgtttcttctcttttctttttttctgttttcattgatatcccgtatttctctcacctgtgctttatcccgtcgcacatcgtaaagcatattattatgctttttggcgggagctataattttgaatggatagaaaaatacactaaaagtatcatgtcatctggaaaattactactttctggatcagcttttgtttcttagtttgaattctaacacattttattttaataaccatcatgttaaaagctgaggacatagaaattagaaaggctttttgttcctttgaggaactactgatagagcaggggtaacaaatctgtgtacaaactattcaaattgttttttagccttaagaaattgggtcagtttctttcattgttcagtatattttagaaaagaatgaatattccgcactgattgaagacagattttttttaaatgtccatagagtcaatttcattattcttattcaaacctatatctttgctggttttttgactgcttattctgtcagttatgcagggagataaatatgcttacatctgtggctatgattgcagattcatctgtttcttactgttctgtcagtttttgctttatatgttttgcagatgttattaggtacatacaaattttaaactgttatagcttcctggcaaattggaaccttttatcatcaggaagtagcctttattatcactgatggttcttgccttaaagtcttttttgtgtggtattacttttctttgtatttgtatacatctttttatagcctctcactttcagcccttctattgctagatgttcctctgggcattagaatatattgggtttcactgtttatacagcctgacaactgaatcacttagaccttttatgtgatataatcattgatattttgagtttgaaatctaccttattattttgtgctacttctttagtgttcagtggttttttttctctctctctcttttcttttatcagaccaaggttttttttttatcgttccttttttcctcatattatacgttgtttgtaatttttgtgtggttaccctagaaattaccatactttattcactacctttacactacagtttatataatagagggacattaaaatactttagctctgtttacccattactggcttacatatcattatgttgtgtaatgaattatgtaaacacttggaagatctttataagtcagtgaaccagtattttccaaatgaccaatgtatgacattataaaattatgcatgggtaaattttgtgttcatagtgctaaacagagcaataaattttaatgtaacagaatatgaatgtctgttgatatgatttcagattacacattgcaaccaacttataagaaactatcatttgttgcatttaatgcagcattaaagaagaacttacaccattatccaaaaaatcttttaaaatactcctcccttctctagttacatatgcctacattaaagagatttgcaaaaatttaaaacattgccagtcttggccaggcacagtggcatgcgcctgtaatcccagctattaggtaggctgaggcaggaggattgcttgagcccaggagttcaagaccaccctgggcaacagagcaagacgccattatcaaagaaaaaacaaccaaaacattgccagtcattaccaagttttttgtcttggaaaatatagttattttcataaaaaaaaatgttatctgttaacatataatgggttcattgtcgttacttttaaatgaattactaaatatttttaaacttttcagttttatttttattttattttatttattttttttgagaccgattcttgctctgtcacccaggctggagtgcagtggcatgatcacggcccactgcaacctctgcctcccaggtttgagtgattctcctgcctcctcctctggagtagctgggattacaggtctgcgccatcacacccagctaatttttgtatttttaatagaaatggggtttcaccatgttggccatggtgaatcactcctggcctcaagcgatccacccacctcggcctcccaaagtgctgggattacgggcatgagccaatgtgcctggtccagttttatttttaatatggtaaatattgacagatatagtgcacattttttaagttcttaataatttttaggaatttaaaggggccctaggacgaaaaatttgagaattgttgctttagaatttttttttttaaatgtgctggtggcaaattcttagcttttgcctgcctgtaaatgtttttgtttcatctttattccttaaagatgttttcaaagacataatttatttttctttagcacattgaagatgttattccactatcttctagatttcatcattgctaattaagaagtcagctgtcacctgtttcttctttgagaggaattgttcttttttccctctagctgcctttcagatttttcctctctatctatgatattttatagcttcactttgatgtgcctagatatagatttatttttatttatcttgcctagggtgtgttgggcttcataaatctgtggattggtatctttcgtcagttctgtaaaagtctcaggtactctttgttaacattcgtctctgccccatttttcttctagaattatgatcaaacatgcactaattagaccttttattgtattctctttgcttcttaggctatgctctgaaaatttattttgtcctaatactcagtttatagttctgtcttgtttccaatctgttgttaaatccctcctttcaattttaaatctcagttactgtattttttaatttctagaaggtctgtttggttcttttcaaatccactagatcaagtcactctctgtgacttcctacgacctatatttctagcctttgccttttattatttttttaacattgtaagcaaagttgttttatagttgataattcttgtatctgtggtctttgtctcttcatactagctgttatttcttaacagttttccctgatcccaccttacttcctcatagatttgattatctttgattatgtgctgcttattttttttaaagataattatctgtattaatatgagacctagattttaagatacttcccctcaggattgtgctgtgtgcctgggcacattgcaagtccaaattactttaaagtatcctagaacaccagaggtgaaaattcatgccattctcgtgcatctttaccttatgggtatagcccattgggaatccttagtgtcgggagggagttctattacaccttccacttcgggcagatcctgggctttgacattcgtcctcttcatcataaccaaatatcagacttgcctaatgcgtaaatgcccttggggtaaagcatctgtgttctgcttacctctcagggttcctgcttttccctttagctttggttccatcacttgtgtgttcaaccagtatgggaaactgcctctagaagcagtgttttaaaattttagtctaaccataaaaatagagaatgcttaccctctggatataaatgccatagcgataactttgaactcctacattacatgccttttatgtaaggcaaacctcagtacacattgagagacagtgtcatatacttattaagatcacaggctctaaaatcagactgccttgtttaaatcctggccctgccatgtagtagtaacctgtgttaatttatgcaagatacgtaatctctctgtgccttggtttcttcgtttaaaaagcagaataatagcttgcctcatgtggtcattatgaaaaacaaacaaggccgggcaccgtggcttacgcctgtaatctcagcactttgggaggctgaggtgggcagatgacctgaagtcgggagtttgagaccagcctgcccaacatggagaaaccccgtctctactgaaaaaaaaaatacacacacacacacacacacacacacacacacacacacacacacaaattagctgggcgtggtggtgcatgcctgtaatcccagctacttgggaggctaaggcgggagaatcacttgaacccaggaggcggaggttgcagtgagtcaagactgcgccattacactccagcctaggcaacaagagtgaaactccatctcaaaaaaaaaaaacctagataaggcaaggcaagtaaatatttaacacagtggtgcctggcccacaattggctttcaagtgcttaggacagtcagacatatagaaagtgctcaataaatattcatcggttatgatgttaagcatttatgaagtgtctgctgcaccaacaagcctgtgctaaagtctcttgatctttggctgtatccaagttaggaagatgatcacccttgcaggaaacaaatagagaacaattcgacagcagtaatgaagttacttgctgaaataatggtgaagtttttgaagtaacttaatgttttatgaatttatgatcagaatagcaaagagtcagtgccttttggtgaaagtggtttctaaactaggactatgaggaagtggaaccgtgaaggctggcagcaatgaggccagaggctgtcgtgagcaacagccgtgaacatggcacggggccggcagttcccatctggatgcagtttttgaagtgtttctccacattgaggttctcactacaaccctctgaggccactgcatttcttttcactttgttgctgagaaaaacaaggcctaaagaattgtgtggaatagtagaaagagacaagctgggacagtccacaggctggcaattcctggtgaggtgaggatggccatattccatggcccagaaacttcatttctagggatggggcttggagaagtccttgaacagttctatttatgagtcagtgtgtaagtttacaagtgaatgtctcctactttcagtaggatgatggacaaaaacctttggcttactaataccatggaatacaatatagtaattagaataaataatatagatctctatgtgtcagcatggataaatcaggagacataaaactaagtgggaaaagctagttgcagaggacaactggagtgtgacattgtgtgtataaaagttaaaagacagcaaacagtaatgcagtatgtattgtttatggacacctacaaaggcaggaaaggtacagagaaaaaaacaaagtaccaagaacaataaacaaaaacatacctgtcttagggcagtggttgctctggggcagggaaggaagttcatctgaaacaaatatggcaaaggctaacatattttatctctgattattacctaactgtctgttatattgttttctctgtgtgtgaaattatatatatatatatatatatatatatatatatatatatatatatataccttttttttttaataaagaagcttaaaaacaagctttggaatcaagtagactttggttcaaaagctgccacccgtttactcaaattcctttctcttgctgatcttcagtttcctcatctacaaaatggggtaatcattacttctttgatgttctcataaggactggatgagatgatgtttgtaaagtgcctagtataacctctaacttcttataggtcctcaataaatagtgctttttataataaattgagtaatccaaggccacaggtctagtctctggcggctgtagaatttgaactcagatgtcctggccccaagtccagagctgcttccactggcgagagttgtgtgaagaggatgctgttagtggaggagcagggtcacagtaccacagctctagcgacctgcggcagcatcaccaggacagaagctgccgctgcattacctcctccttacctctgcagcccgtctgggaacaatcttttttttttttttttttttttgagacgaagtctcactctgtagcccaagctagagtgcagtggcgagatctcggctcactgtaacctctgcctcctgggttcaagcgattctcctgcctcagcctcctgagtagctggaattacaggtgcacgccactgcacccggctaattttttgtattttttagtagagacggtgtttcaccatgttggccaggctggtcttgaactctcgacctcaggtaatccacccacctcggcctcccagagtgctaggattacaggggtgagccaccttgcccagcctgaacggtcaatctttaaaacctggcaatcaaagccaaacccagaagtgagaaagtcttcacagttttattgacaatggcattgagagtattaagaagaaacattggaattaagaagagagaaatagaaactttttctttttaagctgctctgtccagcagcttaggccaggttaggtttatggtaattaacaacccaaaaatctcaagggcttccaacagcaaatgtgtctttcttgcccatctccagtgtggagcacaggctgctccaggtcctctccagctggagccacagtggaaggagcagcccctgtcaggcccccccgaggactcagcagaggtgggggtggggagcgccacctctgaagccgtcagagcttctgccccagcacaggaacaggcaattgaagtcatatttctgtgaacaatgcatgtgtattggttgctagaaatttctaactgtctggccattgaggggaagtttggaaaatgaaaaattcgtctgagtaagtggagaggccacttcatgcagggcctggaactcagttcttgagctgcctctagacgttgaagtatttcgctactggaagaaaagctattttacgatcatgtttttaagcacgggtttggttcgatgatgatcctgttttgacttttaccttctcttcttttgttgacagtgtcatcagcaaggtggtccctgcccccgaggccaagccggcgccctcgcagaacaggccgaagaccccaccgccggcccccgcgcccgcccccggccccatgctcgtcagccctgcgcccgtgccgctgccgctgctcgcccaggccgccgcgggccctgccctgctgccctccccgggtcccgccgcctccggggccagtgccaaagcccccgtgcgcagcgtggtgactgagacggtcagcacctacgtggtgcgtacctgccgcccgcgcggttagcatggagacgttttcagatcgagacaagtgtgtgctctgaatcactatcgaatttcagacgcatttctcttcaaaattttattatttacttaattatttttgagacagggtctccctgtgtggctcaggctggagtacagtggcccaatcatagctcactgcaacctcaaactcctgggcccaagcgatcctcctgcattagcttctcaaagtggtggggttacaggcctgagccactgcccctggccagacacgtttctttttttttcttttttttttttgagacagagtttcgctcttattgcccaacctggaatgcggtggtgagatctcagctcactgcaacctccacctcccaggttcaagcgattctcctgcctcagcctcctgagtagctgggattacaggcacgtgccaccacacctggccaattttttgtatttttagtagaaacggtttcaccgtgttagccaggctggtctcaaactcctgacctaaggtgatccacccgcctcggcctcccaaagtgtgggattacaggcatgagccaccgtgcccggctttttttttttgaaaggggatttcactctgtcaccgaggctggagtgcagtggtacgatctcggctcactgcagcccctgcctcccaggctcaagcgatcctcccacctcttgagtagctgggatcacaggcagtcaccaccactctcgattagttttttgtatttttggtggagacagggtttcactatgttgcccaggctggtcttgagctcctgagctccagcaatccacccatttctgcctcccaacgtgctgagatgacaggcatgaacaaccatgcccagccaagatgcatttcttcattgcagtttttcactgcattttcaagcttttggctgaaaagttacatcacaatgttcacatagtcagcctccataaatcatatcaaagcttgtttttatattgttttgggatatgactatatgcatatatacagtaatatcaatctgtaaatgtagagacgcatggtggtactgaaatctcacattgaatttcttgatcaagcaattcagttattcacttaagagtataatttatagaatgtacactgatattatgagccaggtagtgtttctgaataatagcactaattatattttattggctatgatccagaatatgccagggcttgcatattaaatggaaatgaactttgagaccacagaactcctgagtatccaagcatgatttcaaattgtaaaaccagctggacgcagtggcttacgcctgtaatcccagcactttgggaggctgaggcagatggatcacttgaggtcaggagttcgagaccagcctggccaacatggtgaaaccccatctctactaaaaatacaaacaaaattagctgggcatggtggcacgtgcctgtaatcccagctactcgggaggctcaggcacaagaattgcttgaacgggaggcagagcttgcagtgagccaagatcgtaccactgctctctagcctgagggacaagagcgaaactccatctcaagaaaaaaaaaaattgtaaatcccaccatgtccactgagtccacattgttctgggactgttttttagtttcttactccctgaatacactctggcagtaaagtgtttatacagattacgttctttggatactatagaattaaacacacaaacacacaacgaaatatttaaggtgtgtggagccattgccattgctgtgactaccaactctgcagactgtgatgtgttagcctactggtggccctgaccttgtaactagctaggtactaatatgattggaaagtggctgggtaggactcatggtatttgttgttataaactgtacaatattacatttcttttttttatgttttctttttttcttttgaggtagtctcactcttcttgtccatactggaatgcagtggcacaataccactcactgcagcctcgacctcctgggccccagtgatcccctcacctcagcctcccgagtagctgggaccacaggcgtctgccaccacaactggctgtttcttggctgtttttgtttgtttgtttttggtttttgtggagatgatgtctctctgtgttgcccaggctggtctcaaactcctgggctcaagcagtccttccaccttggcctcccaaagtgctgggattacaggcatgagcaaccacgcctggcctattattaaatttccttaaaggagttttggaaggaacttctaaaagtgtgatcatcaaattggtccattcggggaccaatcattgtaggtgtttaattagaggcaacatcacccccaaatgggttgatcaggaaagattttgtacttaacctccttgaccttcgtgtcttcatctgtaattaaggagtttgtgttaaacttggtaatctctgtggcatgttctagctctaaaagttctggttttccagtagatctttgagctaactcacttcctggagatgagtccaactggaatagacaatgtagatggaaagcttactggctgtgcatggtgtctcacgcctataatcccagcactttgggaggccaaggcagctgtatcacatgagcccaggagttgagactagtctgggcaacatagtgagaccccatctctgcagaaaatacaaaaattggctgggcagggtgacatgtgcctgtagtctcaactactcaggaggctgagctgggaagatcacctgagcctaccgaggtcaaggctacagtgagccatgatcacaccactgcactccagcctgggtgacagagtgaaaccctgtctttaaaataaaaatgaaaatttaaaaaaagctttctacctcatgaagagagacgctttgtggttagaggacaaaatttatgatttagatgacatacaaaggctagagagcaaaaaggcaaattttgtcactgcctaatggtgtgatgttggaaatgccacttaaattcccttagctccggtttccccattcataagctacccagaggttgttttacagggattaaatgaaatgagatgtttagaagaatttagtaagctatgaggtatttggtattagttgctgtggatgccgtggtgaagttcttgtgcggcacacagagtcacggccttctgacttcaagcaaggtcagccagcagcaggactggccacacgtgggagcttcagggcataggatgttccaccagccttggcctctagacagcaggtacgggtgactgctggttctcaccccttgttactttttctcctggaattacggagggtcagagatgtagttgcccacagatttctttaggaagttttcctgtcaatgtagtttgcctttgtagagttgccttaaaggaagcccatcactacagtgaaacatatatggacccccaatgcacctgtcacacacaaagaaagcctttctaaaagcatgtctagtcagtgtggtatttgaaagtctgggaagaactatcccttacaaaataaaccggatgcaataatgtgctctgttattgtaaacactttggaagttacctttttcttattgctggtgttgaatgcccatcagtgaattaattcttccaggttggctctgttcatgtgaagtttgaggaagtggtgaataggatgttccctctttagaactgctaagttaaataaagtcaactctagagtacacaatatttgtagcaaaataatgttgaaccttgtagctctgtggcctccctatccccttatttcatttgccctttagttgattgtactttactaaaaatgtcataaagggaatggaaagttacttagtaacaactcttttatatccttgatcttatcagctccttcaggagaagggcttggctaataagtaataaggtggtgcatgcacatttggctgtctatattaattccatgcctatgaatgcgattgagaaaaccacatataaagtggagctctataactttcaaaaaatcagttgttaccacccttataaagacccaaatcattaagaatttacatagttatagtttttttttttatgaaaggggttacaggtcatattgttcacagagatgattataaaatgctttttatgacttacaaaagaaagcttagaatattcgttagaaatgccttatcattgaacacttagcgtttttctgtttcttgattctaaaacagtgatgacgctgatcatggcattaatgaagtgctgatctactatattttttagtttaatatgcctgtttattcggttaacagtataaagtaatcattctgatctggcctctttttgttttttttcccattccctccatttttgccgcttccgctttgcaaacatcagatccgagatgagtggggcaatcagatctggatctgccctgggtgtaacaagcctgacgatgggagtcccatgattgggtgtgacgactgcgatgactggtaccactggtgagtgcccagggcgccctgccggccacactcattaggcagcatcagccgctcctgagatgaagcatccactgagtagattcctgcctttggactgacccagggctgtcctagggacagtacatggagtcaaatcactgagcctgtgaagtgcaattaactgcaaaacccaagagtgcttagactattgttattcaccctaaattctgaatattctgcttagcttatctatccttcttattaaaaataataatactaaaaggagatccaggggcttccctggccttcctttccagtaatgttctgtaggagctgtagcactggccaggaccacgaagaggcagcgcctttgtaaaggtggtacaaactgcaggactaaagactgcttatctgttttttagacctcttcagcggttcctaaaaactgaaaagctcaaccagaatttatgcagataatctcgtgttatctttaaaatgtcagatacaaaaaagatagcaacctgttcagttatgatagacgatatctgtgagataaagacaaagccgtggctcggaagacttctattcctggctgagaggatgaatgaacggatgagtctctgcagggggcctgtaaagggagcatctgtgatctcatagtccgcatgcccaacaatagtgctacacacaagttagtgctgcttgactttgatttcgggtaaacatgtcatagactctaaaaaattactttaaaacatggaagggagaagaatagatgtctgtataaaagttgcttatctgagcttgttttcacgtgcaggccctgtgttggaatcatgactgcacccccagaagagatgcagtggttctgccccaagtgtgcgaacaagaagaaggacaaaaagcacaagaagaggaagcatcgagcccactgacgactcccgaggggctggaccaagcggggtcagcccgggcttcttccctggcgcctctggaagggagctggtgcaagtctgccgtcacatccacccccagatgcctgtggataaagaacccaggaggactgaggctggaacacaccgcgcacctggattgttcactcccgagccgccttggcctgtggctccgtggcagtgcgacagaaggaaactcaagcagaggcgtggcctgggggctgcccctcctccacttctctaataccagtgacaagtattattaataaagagcgtacatcttcccttttgatttcctttattctctccagggccttttcattgaggtattagatgagaagataatgtacaaactgcctcaactgtaatttaaggatgatagagtctgtatacagttttcagcccctttccctctatagtaagataatcagaataacataaaagaaaactccagttggagtaccggtaaatatttttgtgataagaatatatgaagcttccctccttcccccgtttttagtactaacatgtaaaatgttcaggcttttgtgaaataccttatattttttaagaaaaaggtttctatcatgtcctgtttgcttttgtgcaaattatttttgtttaatgtattttatatcttcgttgcattctaattttgcccttctttaaactgctggagtctcttctcactgcttgtacatttcatcaacttgtataaaaactcttcagactaaaagattgcccctaatgtaaataataaatatttatgaagtagttattttttaaatttttatcgtgtttaattctggctttctctgaaatccactgtgatttcagccaggtctgtaatgacgctggacagaaacaaggctagagaaaaagccatcgttcaaagaaatttcccttgagctcagcctgcgcagtgcccggaaacatggtggggaaagggcccgagcagttggaaggaaaacaaggcaatttaaatttagagtttatgacttgaagttgttttgtttgttgtctattttgtttttgtaaatttctttgacagacttttactaaaaggacatgtagtttccatgaaagtaaaaaaaaaaaacaacaaaaaacccacatatactgtagcattttgtctttatattgttttatttctacaaatctgttcattaatattgtgctttaaggctgaaatgaagtatattatgaatttttttaagaaaactcatcaaatttcagggtatcacaaaactttattatattattatactgcccactatttattatatgttatagatgtctgagaggtaaaccaaatattttatttttaatgttaaaaaaacatcaaatttaactttattagcatattttagcaactttgggataaatacggacttttacttgattttgaaataatcccagtgtaggcccatgtgctggatctgttggatgctagaatatgggctttgaacctaatacaaatatattactagaaaatgtgatttttttaaatgccaagtaaattgatattagtgtatgaattagtcatattttaaaacattatgtggttagagaaatgcggttttctgccatgaatgttaagttgcaaatcagtggaaatggagtcgacctcttcggagcacagggtgtcattgccctcgttgttcaagaggccagaatttttctatccccgctaagaaacaaagcatctatgttgagatatgtgtttttttgtttgattaatttgagatcattctaaatactttatacaatattttcacatgcacaaaaatgcgcgttagtggtttttggagaggggtgaggggtgggggaagtgcaaaataaagattattggctatttcata

SEQ ID NO: 32 - DNA, 23064 bp, Homo Sapiens
gatttggctccgaggaggcggaagtgcagcacagaaagggggtccgtgggggacggtagaagcctggaggaggagcttgagtccagccactgtctgggtactgccagccatcgggcccaggtctctggggttgtcttaccgcagtgagtaccacgcggtactacagagaccggctgcccgtgtgcccggcaggtggagccgcccgcatcagcggcctcggggaatggaagcggagaacgcgggcaggtaataccggggccagcgccgcccctcccttgcgcccctcactgctgggcaggctggctggcgcgcgcgcgcgcacgcaggggtcttttaaatcccggccggaatacaaaggccggggccgcgcgtgcgcactgtggcctggtcggcctttccttccctggctgcggcggtggtggtggaggtcggggctgctctgagggttacctggtgcacctggacccttctttggttccccgcgataaccagttgactataaaatatattagtaagcattcagcagtctttggttaatgtgtctttctggatgccattcttggctagaagggttttccgtcaccctccattaccacgcagagagctgtaaagatgagtgtcgaacatttccagctccaggagttttcattttaaagttggttgatttgttgcggcttccccccaccccaaaggcctactgaaagcaactttaagggtcacgggttagataattttgttgtgggcatatgtatacactctcgagtagtcaatctaaaaatgacctttgagttttccagtggccttggggacgatcttaagaatccgtttttaaaaagtcctttgggggagtcaagagaaaaatttgcaaaagcaggagatttagggacttgaactcctggcggaagactaaatttttaaaaaatggatatggtgacagttttttaaaagataaagagtgatgatttacattgaaattaaaaggaaaaaaacctatgcctaatgaagaattatcctgactctcagtggctaatgggagctgaatttaggcaatacaagggacttatatgggcctgttcatgtctgtaaagttggcatgtctggaatctgattctgacatgccgagaattggtgttacatgaaagggcacactaaccaaaataaattagagcttaggaaaagagatatatgtagacaaagtgtggactttatcttgactttgtggatcaagtcctggaataaattactccacttctttcccagaagaactttacaaataagagaattcaccagaatttgtggaaatctctctctcataacctcacttaagagcagaattgaaacttgggccaagaataaattacacattgtaagactttattcagggtcttacagcaaaatagtaggacttcaatacactgtttagctcaaagctgtgatatgtcggcctgacttcatccaaaaggctatagaccagattttattttgccttgaaaagctttcaccttcaggaactgtggaaaattctgtgtaatcttctgaaatgactcagaccccaggtaatccttaagagagtagttctctgtcacccttgactgtgctaatcaagaaatgtaatgtgggatgtgaaaaaaaataaatttactttttttttttttttttttgagacagagccttgctctgttgcccaggctggagtgcagtggcggatcttggctcactgcaacctccatcacccgggttcaagcgattctcccgctgcagcctcccaagtagctgggattacaggcacctgccaccaggcctggctaatttttgtatttttagtagagacagggtttcaccatgttggccaggctggtcttgaactcttgccctcaagtgatccacctgcctcggcctcccaaagtgctaggattacaaatgtgagccaccgggcccagccgacttttttagaagactaatttcagatattcaaagaagaaaattcaaattccatgaatacagacttttttttttgtttttttttttttttgagacagagtttcactctgttgcccaagatggagtacagtggtgcgatcaccgttcactgcaacctctgcttcccgagtttaagcgattctcatgcctcagcctcccaagcatctgggactacaggtacccaacaccacgcccagctaattttttgtatatttagcagagacgaggtttcaccattttggccaggcgggtcttgaactcctggcttcaagtgatcactttggcctcccaaagtgctgggattacaagcatgagccaaagcgcccagcctagactttatttcaatggcaaaatagttcaggagtcttagaaagtgcttacagtcaatcaaccagagaggaataaaggaggaattttctaagggtactggggagtttcccgtgacctcaggcgtgaaaaagacatttaccgaagatggaaaataggatgccaaatcaaaagtaactggaagagagtagcatggaccactaagaataccaacaggaaagattaacccttgcatgagagtagactttatagaaatgttaaggagaccaggaaggactgttttggttagatgttgacaacaagaagaataaaaaagatttgggttttctccccagtctactggcatggtggcagcagacaacagaacacctaagtactttgttctgatttggattttacatctcctatgttagcaaaatgattgtctgactggaaatggcagaatgaatatctgtaagacttaaagctcaagaccagtgaaggcatttaggagaagtttcaggtgttctaacagaatcatatgccttggcctgcgtgtgttgtgtttcaagggagaggccagattaaagcagtgttagaggatttgtagcaaatgtaagggacctggaaataaacacgtgggttcctgttcttccagaggtggagtctgtcctctgttgacattgatcctgaacaaaatttttacttaatcaatggttactgagcatttttaaaagaaactaattgaccgggcacagtggctgacgcctgtaatcccagcactttgggaggccaaggcaagtggatcacctgaagtcaggagttcaagaccagcctggccaatatggtgaaaccccgtctctactaaaaatacaaaattagctgggcatggtggcataactagtgaccactacactacagtatcagttcagaaagaaagcaagacctatactagacaggcagcatcagaaggatgctggcaggaggtacctacagtagtcattattatagcaaatttattatataccaggtactgttttggatgttttacataggccaactagcttaatgctcctaaccaattattaggtactattcccattttacagatgtggaagcatgggcataaagagattaaggaacttgcccacagagctagtaaatgggagagctgaaatttgaatccagatgacctagcttcaaagtctgcttctctagctagcaaatgtgctttactgcctctcttagtgagcaagatggagatggactgatggcaatccagttaggtgaaataaaaacctgacttactactgaaagaatcaggcagactgaagagaggtctgtacttatatgccatgtatctctatccctaactttgttcctttcagtaccttaacgtcagggtgctgatggcatggtgataaaatttgtgagtgacccaagcctgggaggaatttgtggaattaactgattgatttaatcagagtccagataaatcctgactgactggaatggtgaatcatcttttacaaagaagaggcacaatcctatactcagctgcagaaaaatcagtgataaagtgtggaatgagggagaagtgatacaaggacagtgttcgttgatgggaaactcagtgtgaatcaacagtataatgtgggtgccagtatagctagtgtcatgggttctgcagtttgtctccaaaatgagcaagttggtagccctgctcattttcgggctgatgaggctttatctggagttttgtttgattccgagcaccaaaaaatgaagaaatttgaaatcatactacatgaggaattatactatttgaggaatactgtatgaggactggcttattctaaatctttatatttacagtttctagtagactgtacatatggtgaatacacagacctccatctagcaataccaaatggaataatagttatggtgctatcgcatcataatttacataaccagacccctttagttgagcatttggattatttagccttgttcattattttgtaagtattcagtatggtatatgctttttttaagtgaagataataaaatgtatttagaaaatagcaacttaggctgggtgcagtggctcacacctgtaatcccagcactttgggaggccaaggtgggaggatcacttgagaccagaagttcaagactagcctgggcaacatagtgaagccccatctctacaaaaaatttaaaatttagccaggcatagatgcatgtacctgtagtcccagctgctcaggagactgaggtgagaggattgtctgagcccaggtgtgtgtggttactgtgagctatgatagcaccactgcactccagcctgggtggcagccagaccctgtctcttaaaaaagaaaaaagcaacttaaatccctaaaatagtgtaaaataattgaagataaaagaagttggagtcattaattttagagaaaaccttaaaaatttagttttttgaaatacagcaaatctagctaggcatggtggtgtgtgcctgtagtcctagctactcaggaggctgaggcaggaggatcacttgagcccaggagttggaggctgcagccaactatgatcatgccactgcactccagcatgggtgacagagtgagaccccatctcttaaaaaaaaaataattaaaaaaataaaaaaatagcaaatctgaattaactggacttcttaatgaactctatgcgtggagtgtgtgtatgtgtgttttgagaaagactatcagaaaatatagtcgaccttccatatctatggattctgcatctaagaattcaaccaactgtggattgaaattatttgggaaaaaaaaagacaaataacaacattaaaaaatgatacagataaaaagaatgcaggatgacagctacttacatagcatttacattgtattaggtattataaataatgtaaagattatctaaagtatatgggaggatctgcataggttatatacaaatactatgccattttatatcaagcgacttgagcatccttagatattggtgtctgtgaggggttctacaaccagtcccccatgtatgcaaaactaggtacataccacagtccatttttagaaagattgattagtaactaaaggatgactgtacacaattcatcagttccaggcagctataagaaaacaatctagccggacacagtggctcacacctgtaatcccagcactttggggaagctaaggcgggcagatcgtgaggtcaggagtttgacaccagcctgaccaacatggtgaaaccctgtctctactaaaaatacaaaaattagcccggtgtaggtgcctgtaatcccagctactcaggaggctgaggcaggagaatcacttgaacccaggaggcagaggttgcagtgagccgagatcatgccattgcactccagcctgggtgacagagcgagactctgtctcaaaaaccaaacaaacaaaaaacaacagaaaaacaatctatgagcgctgcagttcaacagaaggtaagtgcaaatggaggctagcagagaaaaaggggtaaacaggaaaatgagggagagtgagaggtagtgaagaatatttgagactaagataaatgatgggggaagaaaagtgaacgaagagaaataaaatcaatcgtgcttgtaagtttaacatcaggaagttatacaaagtagaaagtctttggggtctgttttgagtctagacagatctagtcctatttcctatacattgtccacatatgtagaaatcactgaatctaattcctcattttcatggtgagggaatggataccccgagaggataaatgactaaatgctctttgttactgtccttctcatagagttattgctcagaaacattgcagagttctggattataaagtagcaacgatcattatgcatacacaaatgtatttaagaaatatcctcacactgaggttgaaacaggtttatgctgcttatacatttagttgttattataatagaagataaaattatccagaaccccccttttttttttagacagagtcttgctctgtcgcccaggctggagtacagtggtacgatcttggcttactgcagcctccgcctccctagttcaagcaattctcctgcctcagccttccctgtatttaggattacaggcgcatgccacgacgcctgactaagttttgtatttttagtagagatggggtttcaccatgttggccaggccggtctcgaactcctaacctcgtgatccaaccccctcggcctcccaaagtgctgggattacaggcgtgagccactgtttccggccagttatccagaactgtttagttaactagcattcaagtttatgaagatttttgtgtagatgtaatgcttgcttctgccaaggaataagaatgttgtaatccaccatcttttattctggcttttaggcagctgttgaggtaaacaaactaagtttaatgctcgaagatagtgtattcctcagaactaacacatttgattttccataggtttattttcctttacctgttctaatttaactttttgtaaaatgccacagtccatttttagaaagattaagggatatttcattattatagataagtttctaggtttctttcaaacttgatatacctaatataaaagttcagattatttttcctctttatttttcactttttattcagccaactgtgatttctagaattttgattttcagcttctgaaccccagaatttctgaagatgattaatgacctccgactatactaaaagttttgaaaaatttttttaaagtaaagaatcctgttgtaatgtgaacggtgtctccctaatttatgtattttcagtttgcattttcatgaagtgctcaaaatgggacatgtgaaattctgagagtagtagtaagaaacatgggagagtggtaggtagattgccttcctgaccatgtgacagagtaaaaacacgtttcatacatttttttttttttttgagacggagtttcgctcttgttgtccaggctggagtgcaatggcatcatctcggctcaccacaacctccacctcctgggttcaagcgattctcctacctcagcatcctgaactagctgggattacaggcatgcgccaccacacccagctaattttgtgtttttagtagagacagggtttctgcatgttggtcgggctggtcttgaactcctgacctcaggtgatccgcccgccttgacctcccaaagcgccgagattacaggcgtgagccactgcacccagccacatctcatgcattcttttgctcgctcatttattgtcaccatatgcctttgtttctatatattcaagctaaatcaaggtgctattagaatctcgggaagctgccgctgaccacagtcagaacttgcagtttctttagttagaattgccataggaccactgctcaagacttccagatctaacctagccatatccaactcatcattagaatatttaaatcatgaatgttgaacaaccaatattttaacaatttattgcatagagctactaataatattaaataaaactatggaaaaaaaggacattttactttgtgccaggtatgcttctaagcatagttctacatcttaacttctagtccctgtctacatattttcccttatgtgtagccttagttatactattttgtattcttttctgttttaaaatatatataaactctttcctgttcttttacataagataaataaacttaattttttagctgcatagtattttctcatgttaatgtattgtagtttactaagtcataactttatttttatttaatttgtgaacaataaaagaaataaaactcttatgatacaggttaatctctttctcactcattcttaatctttgctttaccaacctacccttaaagatagctggaagtggaaatgcctctccagtggtttgtccattgggattgggcttctgtttatcttgagctgccaacatttagcccagccgctgggggtggtctgttatcctttgtttccccaggccatttaagcttatccaggaaatgctttagtttgccttttttttttcctgttaaccattttattgagatatgatttacatactacatagttcatccatttaaagtgtactcatttgccctcttttgttgttgttgttgttgttattgaggcagagtctcgttctgtcccccaggctggggtgcagcagtgtgatcatcgctcactgtaaccttgaactcctagactcaggcaatcctcctgcctcaccctcctgagcagctggggctgtcagcatgtaccaccatgcccagctaatgttttaaaatttttttgtggaggtggcgatcttgctatattgccccggccactcttgaattcctggcctcaagtgatcctcccgccttgccctcccaaagcactaggattacagacataagccaccgtgcctggcctcatttccctttttaatctgctttctgagcttcctgttctctttcaatgaatatcatagagaatgaaaactgattagtatagtatcttgcagtagaaaacatgactttcgctgggcgcggtggctcatgcctataatcccagcactttgggaggctgaggcgggtggatcgcgaggtcaggagattgagaccatcctggctaacacggtgaaaccctgtctctactaaaaatataaaaaaaaattagctgggtgtggtggtgggggcgcctgtagtcccagctactcgggaggctgaggcaggagaatggcgtgaacccgggaggcggagcttgcagtgagccaagatcgcgccaccacactccagcctgggcgacagggcgagactccgtctcaaaaaaaaaaaaaaaaaaagaaaaagaaaaagaaaacatgactttcctctccaaatagtaaagcaaacttttccattttattttctactgtttttcttctcctgcctatttaatggcattatttggcatttgctgtaacttgagtttcatcaaatatgtgtttacttctctggttttatgctaacagcaacaccatgagatagtggtttaaggccatgagaagtattttttttaattgttttctttgaaagcccacattgtttcctttgaacagaatactttgaacaaaatttaaatcgtgttcagaagagaggtttagaggttttttccttcataaattcaacacatgtttacaaaatatccatttcatgtttctctttagtgactgaatctattttgtgttgctgtttcagaatgccatagactgggcaattaataaacagtagaggtttttttggctcctacttctggagcctgggaagtccaagatggaggggctacatctgatgaggggcttcttgctgcgtcataaaatggcagaaggaatcacacagtgaggcagcacttgtgacagagagataggaaagggagttgaactcatccactcatcgtgttatcaggaaccctctcctgtgataatagcattaacccactcctgaaggcagagccctcctcttgacctaatcaccattttttttttcttttgagacagaatcttgctctgtcacccaggctggagtgcagtggtacaatctcagctcacttaaacctccaccttccaggctcaaacagttctcctgcctcagcctcccaagtatctgggacttcaggtgcatgccactgtgcccggctaatttttatatttttagtagaggcggggttttgccatgttggtcaggctggttataaactcctgacctcaggtgatctaccctcctcggcctcccaaagtgctgggtttacaggtgtgagccactgtgcccggccttgtcacctcataaaggtcctacctctcaacacttgcattggggatttagttttcaacacgtgaactttgggggacacattcaaaccatagcagtggcaaaaaaaaaaagccctagccccaacaaaacaaaaataccaccatcaataaaaatcaaatataggcctgggtgcagtggctcacatctgtaatcctagcacttggggaaactgagatgggcagatctcttgagctcagaagttcaagaccagcctggccaacatggcaaaaccctgtctagacaaaaattacaaaaattagccaggcattggggctcgctcctgtagtcccagctacttgggaggctgaggtgggaggatcacttgagatctcccacctcagaagtaacagtgaaccaagatcacactactgcactccaacctgggtgacagagggagaccctgtctccccacacacacacacacacacacacacacaaactaatgaaaaaataagtaaacaggcaaataaaaataaactaaaagagaatcttaattagattggaggggatcttcaggtgattaaatactgaaggaaagtaggggcacaaattgtatttggggacatcttaaccctgtatgggttgatagacctttcaagtctgtctactagaaaactccctcaaatcttatttcagagaaagtatgggctgacttgacaggactgatcagttttatcagtgacacatcttatcatttaaacagtgcaagagttaatggttggttattaagcactcagtaaaggttggtgaacatgtacatacaggactagatctctcctctgtaatccactctaaataaatacttcagtctggttacaaaatacttaatactgtactgaagatttttgtacagctgatcatttggatttacatttgggtaattttatcattacatctcatgcttcattattctttcagctattcccttcagcaagctcaagctttttatacgtttccatttcaacaactgatggctgaagctcctaatatggcagttgtgaatgaacagcaaatgccagaagaagttccagccccagctcctgctcaggaaccagtgcaaggtagtttcaccatgagagcttagaaagttcaacatcggatcagccagcttatttgagaaagggtttcatggtgaattttagctctattttagtgttaaaaagtcaaatccactttttaagtacttagtatgtgctaagcactgataggttctggggaataaaagaacatgggtcctgcccaaaaatatctcataatctagtagagaaaagtaataagtaaatacacgttacagctcagcacagtttgtagtgaagaggggcatagaatgaatgccctgaaagcttatggggttggcttctaactcagactgatggctcagaggctgcttcccagagcagagaaataacaccagggctctgaaactccaacaatgtggaggcttcatcccgataaagatcagagtagggacatgtccaggctgagggagctatacaggctgggtacagacacacacaagcatggcatggccagaaacagagcaattctgtgtccttggagtctgggatataacaaggaaatggtgagaggtgaggctggatggggacagttgaaacttgttttttaatcccaaagaatttatattctatcatgaaggcaatagggagctgttgagagaatgtaagcaagggatgacttacttgactggtgctttacaaattagcctggaaatattagagaagatagattggttggtagacaacaagtcggaacttggaggcaggccgggcacagtggctcatacctgtaatccctgcactttggaaggctgaggcgggtagatcacctgaggtcaggagttcatgaccagcctggcgaacatggcaaaaccctgcctcacacaaattagccgggcatggtggcgcacacctgtgattccagctactggggaggctgaggcacgagaattgcttgaatcctggaggcggaggctgagaggctgcagtgagccaagattgcaccactgcactccagctgggcaatagtgcgagactctgtctcaaaaacaaaaacaaaaacaaaaacaaaaacaaaacttggagtcaaggagtggattagatggattagagacactgtttgaataatctaggggagcactgaggaggacctgaaggggtggagaaagaattaggaaacacttaggaggtagaattacctagccatggctaatgggtttcatgtgtttggggggagcatggcaggatagtgggggagaaaggggagtccagaagtaactaccaggtttctggcattggcatttggttggaggaggtgccactcaccaagacagagaattagaagaaaataataggttccaggggtgggagagtggttggagagaagttaatgattttctccagtgtaacagtattttatgagaaatgtgctcagggttttggtttatgattgcaggaacacatctaataactctgcctccgcattaggacttccccagctacatgccagtgatggtggatctgttggcatagggagtggctaagacaatgtgaggcagaagagaggagggactgactgcctgtatcctgcgaggcttgattggggaaacgccaaagaggagtagaatagggtagaagcctgagtagttaggagaaatgttaaataattaagggtaagaaaatcagggcttcctgttgggtaactataggtcagtggttttcaatcaagggtgattttgccctcccaagggacatttgacattgtctgaagacacttttgatgatcaagactggcaggttactactggcatctagtgggtagagatcaggggtgctattaaacattctgtaatgtgcagtacagccacccacaacaaaaaattatgcaacctaaaatgtcaatagtgtggaggctgagaaactgctttacgtcctgaggttggatccctcctcttgccttttgaaaaatactgccagcccagagatgtcatcctgggcacccctaaattcccctcttcaactatgtatggaacagaatatacacctcatctctaaaacaagcccacaagccattgtgtttttcttttttctttcttttttttttttggacagagtcttgctctgttgcccaggctggaatgcagaggcatgatctcagctcactgcaacctccacctcttgggttcaagcaattctcctgcctcagcttcccgagtagttggaattacaggtgcacgacaccatgcctggctaatttttgtatttttagtaaagacgggggtttcaccatgttggccaggctggtcttgaactcctgacgtcaggtgatctgcctgccttggcctcccaaagtgctgggattacagacatgagccaccatacctggcccatttgtggttttctactggggaagttgagttaaaatgtttcccttccttcctgtttctctatttttctgttcttatttaattatttatgtatttacatttagaatttatataaaatgatatgtagatactttgtatccttgaggaggttaagatgccaagtaatactgtgtcgaaaataatagtctatgattattcttcccacgaacagctagcaggggaaggagagtggcatggggggttgcacgaacccagttctagggagaaagaaagggaagatattgcagaggagactcatgttgggactgtaagagcttaattttggggagacaggtacaaaaggtgctagttgggtaacttttctgggaaagctgctaaagtttctaagttaagattttctgcatttctggaaattatttgtatttcagaggctccaaaaggaagaaaaagaaaacccagaacaacagaaccaaaacaaccagtggaacccaaaaaacctgttgagtcaaaaaaatctggcaagtctgcaaaatcaaaagaaaaacaagaaaaaattacagacacatttaaagtaaaaagaaaagtagaccgttttaatggtgtttcagaagctgaacttctgaccaagactctccccgatattttgaccttcaatctggacattgtcattgtaagatctttgtcctcgttggattttataagtagtattgggggatcagctttacttaacagttgtccttgcaaatagcattttgctgaaaaggaccatttctaagaatccttttggtggtaaatggtgtcagcttcatgaggttgtgttatatgagagtgtttaagagggtgggctccaaatttagactgtctgggttcaaatcctgtcacaagtataatcttggataagtcttattaacctttctaaacaccggttttctcattgataaaccaggggtgataataccaccccccgatagggttgcaagtaaatgagagaatccatgtgaatcacttcaactgaatgatgcctgtggagacctgatacatggcagcactaattttaagctcttatttttctcagtaactgtaagaaacatcagcatgtgaacaattgtgtaggtgatgtggagcgagcttcttgttgaaagttgagaatcagaattgtggctggacatgggctcagattgattgttccaggacctgtctttccagactcaaagcagcccagttggtgagggtgcgaggcctgggatcataaaggagtcaaactggttttttaaaataacagcaaaacttttaaaataaagaaaatctctttcccatatatgaaatactttgttcagatcaagagtagtaattgataaatgatattgcttatgatgctgaattaaatttgtattttaatcaactcaattttgtccaccactcctccatagaaacgctaaggcttaggtcctgctttttaagatgaaatgtctaattgttttgttttatagattggcataaacccgggactaatggctgcttacaaagggcatcattaccctggacctggaaaccatttttgtaagtggttaccttttaaattaatttacttttaaattaggtatctttgttaacaggttttttcagaaaaaccaattgtgtttttaaaaagaaagagactgtaaatacacattcgtgtttcatgttctgtgtgtgtgtctgtacgtgaaaataagagagtttgaaatgatatgttactgttaacattttagtctatgagaatggagggatgtgaataagagtactttctcttttgtttgaattgtttctaatgagttgtactacttttttttttttttttttttttttttgagatggagtttcgctctttttgcgcagactggagtgcaatggcgcgatctcggctcaccacaatctccacctcccaggttcaagtgattctcctgcctcagcctccctagtagctgggattacaggcatgtaccaccacgcctggttaattttgtatttttagtagagacggggtgtctccatgttggtcaggctggtctcgaactcccggcctcaggtgatctgcccacctcagcctcccaaagtgctgggattacaggcgtgagctacaacgcccagccaagttgtattactttttaaaaatgattttttaaaagttgttatctataggcatagtaacgatagtatagtacatctttgtggcagtgcagacataatactaactttcccagatttctggtgattattttctagcagagcataaaatagtagtaaagactcatatttttagagtaagttttaaaaccaagtgttggctggatctggtggctcacacctgtaatcccaacactttgggaggccaaagcaggaggatcacttgaggccaggagtttgagactagcctgtacaacataccaagatctcatttctacaaaaaaataaataaaaaattagctgagtgctgtggtgcacacctgtagttccagctactacggaggctgggttgggaaaattgcttgagcctgagaggttgaggctgcagttagccataattactccactgcactccagcctaggtgacagaactagaccctgtatcacaaaaacaaacaagaaaacaaacaaaaaacaagcgtaactactgttgcattgccttctctatataagttgtcttgtatataaatcatcttattttatactgcctaatagatcagtgtatgcagtatacgctcaggaaattgattatctaatagtaacattcaaaacatttagggcaactgatagtaatgtggttttggaactaataataacatattgtccctattattttaaaaaattcctttttaagggaagtttggacttttgactttcttcactgtcaaggtgtttgaatgttgttagtctagtgctgtatgtttacgtgtgaggtggtggtatcaccaattgtaaagcaaaatagtctcaaagtttcctaaactgagttgctatatattcttgggcaggcatttgcctcaaccccctgtgaaaaggagataataatagtatcttgcaagataattatgatgattaaatccaagcgctgtggctcacacctgtaatcccagcaattttggaggctgaggtgggaagatcacttgagcccaggaattcaagaccagcctgggcaacatggtgaaaccctgtctacaaacaatacaaaaattagctgggcgtggtggtgtgcatctggggttccagccactcaggaggctgaagtgggaggattgcttgagcctcggtggtcgaggctgcactgagccatgatcgtgccactacactctagcctgggtgacagagcgagaccctgtctaaaaaaaaataaataactgaattttcattttacagggaagtgtttgtttatgtcagggctcagtgaggtccagctgaaccatatggatgatcacactctaccagggaagtatggtattggatttaccaacatggtggaaaggaccacgcccggcagcaaagatctctccaggtaagtacacagcatttgcttttatgggttggaaccttgagtatgctggtgccccaaatattctaggaacatcatatgtatctagttcaagctgagctcaacaaatgtacaatatgctctttcattgaaagctgtctgaatttagcatattataaatattgtcatatttatatttttgactactttttaattcaattttagtaaagaatttcgtgaaggaggacgtattctagtacagaaattacagaaatatcagccacgaatagcagtgtttaatggaaaatgtaagatttacttttaaattttttttttctttgctaacattatgggcaatgtaaatatgtttgtatttcattttaggtatttatgaaatttttagtaaagaagtttttggagtaaaggttaagaacttggaatttgggcttcagccccataagattccagacacagaaactgtaagtccctaaaattgaatttgtaaatcagctaaatgtgaatttttttctagataatttccttatttgtcctatccattgtgatttataccatgcaaaacaattacactgtattttgttgaataatacctatacatcagctttaactaatagttgtaaattaattcaaatactattagggtttattagaaagaaaaacatttgtcagctaaatgtcttgatgttgttattcagtgaaaatattgagaggaactggctcatatactacattcagaatacatttaatggcatgtagttgtcaaattcaaatggtttagccctcgtactgttgtgaaacaaacatggaaacacagacatgatcctgattaggaaaaccagttgccccatttatatatcttagctcaacttcattttagagccatataaataatacaacccagacaagcctccagccaacctaactggcattcaatactgttgtcttatacacaaagtcatcatgaaataacagtgtttttcaaattgtcctctctacagagcttctgcaggcatttggttccaattttgcttcttagttttaggttttatttacaacttttaaagaacaacacagtgcacagatttacatgttgtatatacaacatcttaactgatggagaagctaatttgctgccaggtttttgtggaaacctaaaaatgtttctgccacctaaatatatttaaatttctcctttaaaattgtttttgttcataatttcttataaatatgcaattgatgagttttattatagcattggtttttgcttaaataaaggcccacctttgtctgcttggttaaaatggtacaaattcactacctgtagtgaattgtagagaaattcctgtagagtactgtgtcattctctgttacatgccatttggaggccgggcgtggtggctcatgcctataatcccagcactttgggaggccgaggcaggcggatcacctgaggttaggagttcgagaccagcctggccaacatggtgaaaccccatctccactaaaaaatacaaaaattagccaggcatggtggcatgcgctgtaatcccagctacgtaggaggctgaggcagaagaatcgcttgaacccaggaggcagctcattaggcggaggctcattatttttcacttcctgacttggtaataagtcagtattacaaattcaaccttaaaagcaactacttttattgatttttacatatatttatatgtagttaagtatcaagttattaacccaaataaagacaaatattctaatctcaatgagtgaattcaatagaattataagatttctgaaattataaaatgttgtgattctagctctgctatgttatgccatcatccagtgcaagatgtgctcagtttcctcgagcccaagacaaagttcattactacataaaactgaaggacttaagagatcagttgaaaggcattgaacgaaatatggacgttcaagaggtgcaatatacatttgacctacagcttgcccaaggtatgttactgtcctcattccttttattcattttgtgtgtgtatatatacacatatatacttacatatatatacacatatacatatatacatatacacatatacatatgtgtgcacatatatgcacacgtgtatatatacatgtgtatatatacatatatacacataagtatgtatgtctatatacatatatgtgtgtatacacttgtgtgcgtatacatatgtgtgtgtctatatatagacacatacacacacacacacacacacacacacacacacacacacacacattacagaaagtatcttatggatttaaaagcaggaaaaaagaaaacaattatattcgcagccagagtgctctgataatgaatattagtcactgttaaaatctccttttaccaaggtcttccctctactctggcacttctgcagataattcacctgcagagtgccagagcagagggatgtaagaaatattgtaccctacgtaaagttgaatgtaagcggtttttacagttcttatgtgtttatttagtacatgctataagtttaaaagattaatagagatgtatctcagtgtatatgaatattcaagaaaaagaattgttcatgatttctgaataaagctacttttaaaattgttgtacaaaatcagatttaaatcctttttaccttcctcacagaggatgcaaagaagatggctgttaaggaagaaaaatatgatccaggttatgaggcagcatatggtggtgcttacggagaaaatccatgcagcagtgaaccttgtggcttctcttcaaatgggctaagtatggttccctccacatgtgtattcctttcaaagacggtttggtcaggattggggggaaaattttaatagaaggagagtaaattattgaagaatgggaatgataatatgaaattttatttagtgactaatagtgaaaaattgatggttatttcacgttgaattacacagacttttacagtacattttcttttttgtttgtttgtttttgagacagattctcgctgtgtcacccaggctagagtgcagtggctcgatcttggctcactgcaagctccccctcctgggttcacaccattctcctgcctcagcctcccgagtagctgggactacaggcatccgccacgatgcctggctaattttttttgtatttttaatagagacagggtttcaccgtgttagccaggttggtctcgatctcctgacctcgtgatctgcccaccttggcctccaaaagtgctgggattacaggcatgagccaccgcacccggcctacagtgcattttctttaagtcatgaactctaggccatcctagttgcattttcctcctttaataacaaatgagtcctgtatctgaagaacagaaacttaacagttgtattccggaagcttgcttaactattttaataataattctccttcactagactgttaaaatctcctactttgatcatttaaaacttccaggccgggcatggtggttcacgcctgtaatcccagcagtttgagaggctgaggtgggtggatcatttgaggtcaggagttcgagaccagcctggccaacatggtgaaaccccatctctactaaaatatacaaaaattagcatggtggcaggtataatcctagctacttgggaggctgaggcaggagtatcattatatataatatatatgcctctcctcgatcccgggaggcagaggctgtagtgagccgaaatcacaccactggactccagcctgggtgacagaatgagacaccgtctcaaaaagaaaaaaaaaaacttcaaataagctgatacggtggctcacacctgtaatcccagtgctttgagaggctaggatgggaggatcactcaagcccaggagtttgaggctgcaaagagctgtgatcatgccactgcattccagcctgggcgatagagtaagacccagtctctactttaaaaaaagcaaatatttctaaatggcataaactaactttgtttttcttttctggcagttgagagcgtggagttaagaggagaatcagctttcagtggcattcctaatgggcagtggatgacccagtcatttacagaccaaattccttcctttagtaatcactgtggaacacaagaacaggaagaagaaagccatgcttaagaatggtgcttctcagctctgcttaaatgctgcagttttaatgcagttgtcaacaagtagaacctcagtttgctaactgaagtgttttattagtattttactctagtggtgtaattgtaatgtagaacagttgtgtggtagtgtgaaccgtatgaacctaagtagtttggaagaaaaagtagggtttttgtatactagcttttgtatttgaattaattatcattccagctttttatatactatatttcatttatgaagaaattgattttcttttgggagtcacttttaatctgtaattttaaaatacaagtctgaatatttatagttgattcttaactgcataaacctagatataccattatcccttttatacctaagaagggcatgctaataattaccactgtcaaagaggcaaaggtgttgatttttgtatatgaagttaagcctcagtggagtctcatttgttagtttttagtggtaactaagggtaaactcagggttccctgagctatatgcacactcagacctctttgctttaccagtggtgtttgtgagttgctcagtagtaaaaactggcccttacctgacagagccctggctttgacctgctcagccctgtgtgttaatcctctagtagccaattaactactctggggtggcaggttccagagaatgcagtagaccttttgccactcatctgtgttttacttgagacatgtaaatatgatagggaaggaactgaatttctccattcatatttataaccattctagttttatcttccttggctttaagagtgtgccatggaaagtgataagaaatgaacttctaggctaagcaaaaagatgctggagatatttgatactctcatttaaactggtgctttatgtacatgagatgtactaaaataagtaatatagaatttttcttgctaggtaaatccagtaagccaataattttaaagattctttatctgcatcattgctgtttgttactataaattaaatgaacctcatggaaaggttgaggtgtatacctttgtgattttctaatgagttttccatggtgctacaaataatccagactaccaggtctggtagatattaaagctgggtactaagaaatgttatttgcatcctctcagttactcctgaatattctgatttcatacgtacccagggagcatgctgttttgtcaatcaatataaaatatttatgaggtctcccccacccccaggaggttatatgattgctcttctctttataataagagaaacaaattcttattgtgaatcttaacatgctttttagctgtggctatgatggattttattttttcctaggtcaagctgtgtaaaagtcatttatgttatttaaatgatgtactgtactgctgtttacatggacgttttgtgcgggtgctttgaagtgccttgcatcagggattaggagcaattaaattattttttcacgggactgtgtaaagcatgtaactaggtattgctttggtatataactattgtagctttacaagagattgttttatttgaatggggaaaataccctttaaattatgacggacatccactagagatgggtttgaggattttccaagcgtgtaataatgatgtttttcctaacatgacagatgagtagtaaatgttgatatatcctatacatgacagtgtgagactttttcattaaataatattgaaagattttaaaattcatttgaaagtctgatggcttttacaataaaagatattaagaattgttatccttaactta

SEQ ID NO: 33 - DNA, 81080 bp, Homo Sapiens
caccagaaacccaagttggaactaattctttctttcggaaggtgcaactcccctcccgcgagctccgcggtgccgggccgagattgccgagaggaagcggcgcagcgctgccgccaaggctcctcctgtcgccggtgcggccgggactacctggcggcgcggcgcgtgcagcgcgcagagtcccgggagcccacgcctccgcctccgcccccgccccctccgcctcccagtccacctcgcccgcccgccctctcgcccggcggagagcacagcccactccctcccacctgcggccgccgggccgccctccacccacacctctgccgcaggccggacccagtgcgcccgcccgtcggtcagtccaggccaggcgcccggcgggccgcgctcacgcagttggcgcaggaggccttacgctggcggcgcagtgcccgccccctgcgctctccccgccccctccctccctcgcaggggccgagcgaatgtagcccgcgagagaaaatggcggcggcggcggggaatcgcgcctcgtcgtcgggattcccgggcgccagggctacgagccctgaggcaggcggcggcggaggagccctcaaggcgagcagcgcgcccgcggctgccgcgggactgctgcgggaggcgggcagcgggggccgcgagcgggcggactggcggcggcggcagctgcgcaaagtgcggagtgtggagctggaccagctgcctgagcagccgctcttccttgccgcctcaccgccggcctcctcgacttccccgtcgccggagcccgcggacgcagcggggagtgggaccggcttccagcctgtggcggtgccgccgccccacggagccgcgagccgcggcggcgcccaccttaccgagtcggtggcggcgccggacagcggcgcctcgagtcccgcagcggccgagcccggggagaagcgggcgcccgccgccgagccgtctcctgcagcggcccccgccgggtgagcagcacggccggggtcgcggcggggacttggagagcgggcagagggcaatgaatgaaccccgggcaccatgcacggcgtcccggggttcagcgcagcgaggctacgcgccgctcgccgggacctacgcccctgagcaccccccgaccccttcggagtcgggcggcgccccggacccagcctgggggaccggacggggacgtgcggaagagtttgttattgtttgcagacatgtgacaggcgtgcgagcctctctgcggggaaccgttgcgaaaaggtgtagggggccacggctggctttgtgggactcctggaatcggggctctccgaggagcccgggggcggggcacggccctgcggcggcgcccccggacgggtgtccccggggcaaaggcactggggggcgaggcccgagcctgaggcgggcggtggtcggaagaggggcggggtgggtgagaagcccgaggtcgggtgggagactgagaggaccgaagagaaagtagcaggtcccagcggccgtgacaggcagagcccctcggcccgcccgggactcgagtccctaggcagataccgcgggctgggcccggacgcaggcggcgcgcccccagcgccggccgcagggctccaggaggacggctcggtaacgcctgtcaaagccgtgcggcgggaggctgcacactcgcggaggcttgcagtcttttaggaagtgcggtttgtctaattgcagcccccaaggggctttgagtgttcctgggaatgcgaactgcactgctaagtcacttgagtgacttctgtttggagtttgaatttggcctttgaagtttgcatttggcggagtggtgtaagagccaggaccggatgtgtcagccattcagtttcaaagcagtggtgactgctccccgcagcccctccggcttggcccggggactgcggcgcgggtgcagtgcttcctgctcggtgccctggcgcgggccgcccgctgaattccaggggccgcagtgcggtgggcttcggctcagatgcgtcttctggtgcatatgaagtacagtatgtgtaaggtaatttagaccagcggtttattggcctcgcccatttttggctactggaaatttttatgttaaaggaaattcttttaagtgtgacagctacatccttgtttgtttgttttttaaaaacctgattaacgtatgcaaagtacaaagtcttgatgggtattttgagttgctggaaatgtttttgtgatagtccctcgtggccctgtagaattccctgacctttattatgagaagaaagcgtgtcattttgtgagacgaatttgacagtaggagtccttggtttggattcattatctaaagtgatctggcattttttgtgcatttgattatttgcttaaaatcacgatccatttagtatttggaagtccccttcctctccccaagaactaaaaaatatgcttcgcactgtaccatggcactactgagaccaaaggagatttgtgactgatacagttttgtgtgcacttgtacatgtaatttattcttacaagagttatgtacctctatagttttcccatttctgtgcagattgtattaaaacttaactggaataattctttgaaggcaacttctactttaaatgaattccagataaaaatttttaaccccaaatttaagaaattgtatctattgagacctaactttttggatacaataaataatttagcaaacgtcagcattctagtactcttaatgagctgtgaatatagtagaagagcatccactgtaaaaataatgtactgaaattgtttaatgttgtctcttgacacaaaataagaggactaaggtggaggcagatagaatttagggactaagtaatccatgcttagtatttgcgttttgtaaccgaggttttttcccctttgcttaaggtgtagattataattgcacagtataagaaaataatgggcttgtaaggataatcttttttaaagaaattatttttacgagtcagaatgctgttggtttatcccaaatgtcatacgtaaagatttcatttatagtaaaatgttgattccctaaccttatgaaatatagtgaatttttttttcttaacaattgggttgaaattcatttgaatctgttcgtataaaactttgtggggaaagggcttgtatcttatttgagtgtgtatattttgtattgcatgttggttatgctacactattacttaccatttaaagttttaggaaaaaaaacccttaattatagccaactcaataaaatatcaattgaactttatgttttacttttttttgacagttaagttacattcatacttccaagaggaaaatctaagattttgaaatatttgagagttctgtgatcttttttttaattttagaatttccttctgatctttgaatgtagaaaatatactttgaattagaatttatataaataaataatactcgtatttaaatagaagattttaagtttgtccctctttttcagggtgatagctgaaatcagtgaaagtgcctgtaagtggcgcccaagggtttggaatttttccttatattacagaatttaggggctttttcttcctatttactgtctttgaagaaaaattacagtgttactctccattgaacagcctattgtgagtttggtagatataattaccccatcctatttttgtaacttaaaaaaccaaactatcaatttgctggccccgtgaaagaacaagatatgctgtacttgttaatgttagtttttgtttaaaactaaaggtatttcacaggctgcttttatatcctcatatagccctcagatttcacttcctttttaaagctattaggctaaaaatatgatttagtgaccttttactaaagaggaggtataagagcattattacctaaaaattactcttaaaatattaagtgggtgactttataaaaataaaggtagtcacataagttagtcttccgtgaatttgtaagtttttagttaagaatggtgtcagtttcattttaaatcagataagaaaattaatgcattcttcaaagatgaaccttaatataattctggaagagaaatataagagctagaattgttgccaacttttattttcttttcatatctgattttggcaagagtgactggttaaccaacattccttaatatacgatttccaatgcactaaaactccattttgttagatacgaaaaacaggaagtagccctgttcattgatattcatttacaacttccatagcacctcgagcataatatgttgcatattttagaaatggccactgacttgtcaacttgcagatttcaaaatgtgggaagaaaggagtgtttttttgctttcaacaagagcaaaaaaaaaaccagctacagcttgcctaggctgagtcggctaatcagtccttgacactggctgtgtgcatcccaaaggaagaaatgagggggtggcaaggtagttaatggggaatggattaccatgaggaaaaatatggggcattcagaaatgctctcaggtagaaagcacctcttttgcattttgtactccagtcatcttcttgggttgagggctgtctgttacacagaaggcgatgggaaaatgtgtcatggaaaagtagtagtctctagaggctgcttaggaactgcgtgtatattacacctctaatcttggaattctttgcttctatcaaatatatcaagtatagacttggttgttttccttagtccttgcctctttctatatcctaagttaaaagctaaagcaacttaaacatgtaaatggtagactattaatgtgaggaaatgtgtaagattaggagtaacccaaagttgtctttaagaaattatttaagaacatgtttaatcatgaaagaaataatcagggccggaattagtaaatggttcattgcaaagcatgagattagtcagatactcttttcagtttgcaaaaatatattaggattttatctgtggcttaaaacatactcattgagcatatagatatgcctagataccttttacataatcaactcttttgccttctgtgtgtgtgtatgatatctattatatgtattatatatatgtttatatataatctcatttgatcatcactgcagccccctaagatagtgtaatttctgttttctgtaggtgcaaactcatctgagatggtaaaacctcatgattacacaactagaagacagctaggattcaatcccaagtcagactgactccacagtccatttctttccactactctgcttcttccattttcttttttcaaattaataatcaaattaattgattatttttaaggagaaatttgttttgcaggcattctaatagaccatgagctaggtctctaccctgtgctaagtttgcctgttaatgtatataataggtatgtttctgtaacctggccttgtatatgtaatacaagtaaactgtatttggatcaccctatcatgtcagccaaagagggttagtcattagtgttgaatgtttcttagatttattgatttgtgctgtattaaatcataagtgaaaggagataagctgaaattaatatggttcattcatggtaatcacacaggaagagaaacttttactattgctagaccctacccctttgttattgttttagatttcatccattcaacatttatgaacttctgcaaggtggtggtcttgagtggtggagaaaaagatcatgagtgcacaagctgtttctgtcggtaggttgtagtatgaacatgtttcacaataccgtgttaagtgctataagagagatggggatacagaggggatacaacatattagtttcaaactatttctgcctattttctgataagaatatatacaacactgcatgttcaggcatgtttttttttcttccaagggaaaattaaaaaggagatacggggagcaagaaattcaacatctgctactgctagttctgaaattctgtctttattattagtaacagcaactctactagttacgaaaacaacatggagaaatataaaatattctttagggcataagatgatcaagaagatagccttgtctttatttactctatggcatgtcattggtgattgagttatgtttggtatggaagggagttctgtattgttagtgattgagtcctttggaataccaggctggtttgatgcagatgttaatttgatcgagatgtggagatgttgtagcatactaaggggaattgttaaaactcaccaagtgtataattctgcaagtacacatctgtcacctgggaattactaagccaccagacctcttgaagcctggagaaagtgcttggagccacatgggacagcctacacagtactgtagttagtacgttaactaagttcatcacttgtaagcataatgatggatagacatggagtgagaacagggtcagtactggggtgtaggtggaagctttgctcttgacagatgttatcattacttttctttttttatttttaaattagaaatgggttctcactatgttgcccaggctggaatcgaactcctgggctcaggtgatctttccacatagctggaactatgggtgcaagccactgtgtctggctttacttttcttcattgcctaaacaataatttaagttatatgttaacacataatcttcaaactggtcttatggtattctgaatactaaacatcagttgttaacagaccaggaactttatctgattctttgcaccatctcccagcatctagactagtgtctggcacccatgaatattaggtacccagaaatgttaacatgaattaattttccaaaagtggttaaattagtatatctgaagattaacttactgtagtgagattttaatcatgatctagcttaagacgagttttgaaggcaagaactgtctttttttaggagtttttgtatatcgtttggtatttatttatttatttttgagacggagtcttgctctgttgcccaggctggagtgcagtggcgcaatctttgctcactgcagcctctgcctcctaggttcaagcaattctcctgcctagcctcccgagtagcttgctgggattacaggcatgccccactatgcccagttaatttttgtatttttttgtagagacagggtttcaccatgttggccaggctggtcttgaactcctgacctcaagtgatccacccaccttggcctcccaaagtgctgggattacagaaatgagccactgcggccagaccattgcttgatgtttaatagcagtagttggcatttagcaagcagtcattgataatattgaccaattttatgtaatgtgagccttctaataattagtgtagttacaaaataattggagccatgctcaaactgtcaaatattgagaaaactgaattcctggtatttgaaagtgtctaattatttgcgttaattggtaagcccctcctgattttctacttaaccatgacacttcttccgtggcgcccatcttcattctcttgaacattgatactggaagattcccagggtggtcctaggccttctctcattctgtcttgtcgatccccaccccagtcttattaatgcccttagatcagttatggaccatttacaaatgattgcagagtttattgtcctaaccatgatctctcctaaagtccagacctacacctggctacatgacttctgcgcagtcagatgtctaaaaccaaattaaagatcttccctaaaccttctcctaacatgttccctgctcattaaatggcagaaccagaacccaggagtcacccttgacacctcctcctctcacctcgtcagattcagaccatccttaggtgctggcagtttgacctgttatcacacccctagccaggtgcccattgtctctcatttccactaacttagtggcctccttgcctgatccctgtgtcctttctcctttgctgtccgttccaatctgtattaggtggccagagtgatcatttccaaatgtaaatctgatcataacttcctccctccagaaaagtaaatgtaatttaattttaagatgttcagatggcttccatttggataaagaccaggaaatctttaacatgcctgaccgagtccctgcccggttgggcccctgtctgcttctccaggcccatctcagctcacacttgcccttgttccgtggcagggttgcgtgctttcatttcctcagactcactcactgccttcttctatagggccctcacatgctccctctgccaggaacactgtttttccataaagtcagctcctcgttgttaaaatcttaactcattgacacttcctcagggaagctttccctcatccacccagactggctttgtagcagggtgtccctactgtcagtgttgtgcttttacatttgttacctcatttgatgaatgactgccttccccctagcacctagcaggatgcctggcatagggtagacactgcataaatatttattgaataaatgaatgagagggataatggcatggcatgttcaaattagtggatccactgtttttcctgtttagtcagacgtagtttaggacatagctgaaaaggtgttaaatggcaaaagtctagactatggtgtttcaacactgtagatttgtgatagactcattcagaggtacctggacttgtagacgtgcctggtggctcgagtgaaataggacagcttaatgtagtagagagcaaatagctatactgcatgacaactttataggtaagaagagtctgctatgtgtatataattattctgtacttaatagggagttaagagtgcgtgtgtgtatatatatgcatttatatattcacacatacatctgtgaataaatatacacataaaggtgtcatgcattaatataattattcttatttttaaagttctcagaatgtcatctaaacttaagatatcatttttagaattcttatctgataaccctacttcatccaaaattcattaatttgatcataattcaacttgggataaataaaagttcacatttccattgaagaaaatatttgttaggcaagtactccatgagattgcagaagccaagaacccatgtaacaaaacatttcaaagtttactgttggtaagtaaacccagcagcctctcttatctagaacatgggttagcactaagaagtaagaaaaaatactctaagcagccaaaggacctgtaacaaaatatgtgctttgaagcactttgattttacacttagtagagttcccagggcatttgctcaggattgatacttatttcagatgttgttcatgcagtgttgttcatgtggtgttcctaacatgcagcaattagaagcagccagttagaaggggtggcggtgtgagtcctgcaagaggcaggttccccaaaggcagcagtgttggcacacctgacagtgagaggagagagggagaataggactcaaaacattgcagtcgggggccacctagcattggtacaattagttccatctagggcagcctctgccatttaaaaatatactcagtgaagtgaagttggaaagcttgtaatatagattaaggaaaattactatccaagatagttatagaaagtgtcttgatctttgaagtggtaaacctctaactgttctgtaagatgtatttctgtagccttgatgatactgaataaatatgtactttagaattacataaaaatggatgctgcttaccgaatgtcttatctattatctgtgtggagaaatcttttttgttattgttgacctgagtcattttataccttgcagtttctttaaaatgcataataatcaccactaccactaatatactgatcttttccggttttttaaaaaaaatttttatttttttttttgagacggagtcttaaagatatttttcttgctccaagggtctagattcttctttttttgttgttgttgagatggagtttcgctcttgttgcccaggctggagtgcaatggcacaatcttggttcaccacaacctccgcctcccaggttcaggcaattctcctgcctcagcctcttgagtagctgggattacaggcgcctgccaccacttccaactttttaaatttttgtatttttagtagagacagggtttcaccatgttggccaggctggtcttgaactcctgacctcaggtaatccacccgcctcagcttcccaaagtgctgagattacaggtgtgagccaccatgcccggccaggtctagattcttaaataaccaaatttcaagttttgtacaaagattgaaggaaagctagtctttaaccaggaagaaaaggatttgttaagagattatcagccgtatctttgctgactcattgatactgtggtgcctaagacatcttggcttttgtgacagaatcctgcatacaactttctccaggatagttcctccaggagggacccctctgccaggcactgtggcagtcacatgtccaggctgcatctctgccctgctcagcctcttcatccttgcattcagatctccatgtggtttagggtgcccatcagggtaaacactgccattgtctctttaattgctgtgctcttactcttctggctttcacaccttcagcttccaatcagtcaccagttcttgttattgccactctcctagtagcctgagaatccatccaacttcctccactgccatgactgctaacccagggtcaggccactgtcaacccactgtcaaccttttcttcaccctcagaatgaagtccagactccataatgcagttcagaaacccttaggactcaggcttctgctcactttcagcagcccctcagaatggtctgctcccgtcatttcagcatcgtgctcagttttagtccctcaactgaccgttcttcttttttttttttaaagaaaacaatttttatttaaaaatttattttataagaagtattggcatgaatacatagataaggcatttgaaatggcttctctggttggactgttgaccagctgaattccagctctgtcctgcagctgatcacccttctttctcggcgtgcccaatgctcttacctctatctagaatactctttccagctccgtggtgaggttttgtttgttttgtttttattctctttgcaataaagaattattggtattccactaaaaaataaatgtggctttgtagaaatcagtgctgtactgtgaattctgccgagctctggtttaacaagttcctcgatatctgagttagatttgctacttttaagcctttttagtttttttctctatcattgtacatgtagtcaggtctttctgaacgacagtgttcacaaagagatgtttgtaaagcacacattattgtaaagtgaatcagattttcttattttgtgttaaaagctcagagatgtggtctcagggaaaaaatgttgctgccaacctacatattactgtccttgagaataatccgagaccttcacaggtcagacaacagatgtgctcagatacttcaagcagagagcttgatgacgatgtaagcatcacaagatttatgtcagctgctggacctccacagacagggtcccagcaagctgacaggttgtaggtgagcaagcacgttagatgtgcaggtcactcacatccctttttgtgggatcaatggatgttctttcctgagaaatgaaagggcagatgagtaagcatgctagagcatgtgtcttcagtcctgctgtcactcctgaggagatgtccatgccttcaagaaacactcagagctgccagccaggcaccaaggtgctggggacacagcaggagggaagtctccatcacttgcctgtggaggagcttacctgatgacagacagtgcaggcccccgtccactgtgagtcggggaggcatcaggaggcttttttgggaaatgtgaggtggagcaccaagccaagtcccgataaacgtggaggaatgaaccaggtgaaaggaacttgcaaggaggttttgtggcctaggggtgggtggagaacacacaggcccagaaatcagcagtcttaggatggcatggaggactgcaagtgtagttcaggtaactcggccagagtggaggcagggtccagggaccaagctgggacacgatttctggctctggccagagagagagccacgcagagctctctgcctcgtattgcccccactggccaatccttgaatctcagcgcttaggacaaaataaaaaagcctttgtaatttgacaggtaaccacagagtgttaggaagtgggtcaggaggccccaagaaggatttacatcagagctgggacaagacagtctggggtcacaaatctgggagctgtggcttttgtacttcagtagctccatgtagtttcagaggttcacagattgggaagtgttctcatggcaaaatgaattccatccactgtggtcctgaatgtggttttggaactacatgtttccatttcagagaccatgcactgtagtgattaagaacctgggccttgctgggtgccgtggctcacgcccgtaatcccagtactttgggaggctgaggcgggtggatcacctgaagtcaggagttcgagaccagccaggccaacatggtgaaaccccgtctctactaaaaatacaaaaattagccgggcttggtggtgtgtgcctgtaatcccagcttcttgggaggctgaggcaggagaatcacttgaaactggaaggcagaggttgcagtgagctgagatcgcgccactgctctccagcctgggtgacatgacgaaaactccatctcaaaaaaaaaaaagaacctgggccctaggaattagacctgttagctacttggaccccagggaagtcacttctctgaaccttgaatttcttgtctctaaaatggggtcgttggtggtataatgaagcaccattcttgatccagaaaagtattcagttaatactaactgtagataatactcttgcaagtaactgtctatgctcactacttaaacctttaaccttttagaatgaggttaagagcctcccccaaggttgctgtgctacttatcactaggttagcaaaggcggtttgtgtagataatacatcatcttgataacaatacattttcccctgttattttgaaatgatttactagaaaaatagaaaatggcaactttcaaaattctgtgatatgggataaagcatctcctcagggttcttatctctgtgacctaatgcaggtttcttggtcttcttttctcatctgtgaaaagaaaaggttggtttacataatctctcagttccattcaagctctagcaactctccaaaaatttaacttggaaattacttcttgtggctaaatttagctgtaattattgaaacaacaattagttttttgaacttagaaactcttggaattttaaacctgggtaacaactataaagagaaatgcaaatgaaaagcaacaaaagcttagaaaaaagaaatcatgtttgtcaagcaacattaagtgatgagaaaatctgttttttaaaaagcgtaataactgctaggagaatattattttgcaaattggagaaaataaattaggtcaaagtcattagcatgtttgtgtttagcaaatactaccttagggggcagtttttaaagtaactttaattttttgacaactttgctattaaaagctatctttttcttcttaatgttaattgtataaagaagggacatttttggatataacctctaaaaaagcttcttctttgacttcttcttgtgtttatttataaagacctttttgtaaataaacatgtatgcatcttttttttttaagttaaaaatgcatcgcttggtaacaatcatattgcttcctaattgtgaaaatttacatttaattatattttgggggttttttcatgtaatttggatagagttgacagctactagaaaatgcaactgcatttcactattctattattttgggctcaagttctaaaaaattatgactttcaaatagacttggaataagactgtttaactgatttaatcattgtaattgcaccaacttgaatcgtattcacagaaaccaccttgcctattgctgtttttcttctttttttttttttcctcttttttctgagacagggtctcactccttcacccaggctgaagtgcagtgacatgatcatgactcactgcagcgtcaaccttagcgggctcagtgtatcctttcacttcagcctcctgcgtagctgggaccacaggtgcatgccactgtgcccggcaaatttttttttttttttttttgtagtgacagagtttcgccatgttgcctaagccggtctccaactcctgggctcaagcagtccacccgccttggcctcccagaatgccaggcttacaggtgtgagccaccatgccgagcccgcattgctgttttttatacactgaactgaaactgttcataattcattgcagagcacacggacattcagcagtaattattttttgtcttggattcctggtagtaaagaatgcttgatccttcctgcttctgccccaacccatgctagttcttactgttgtgatcagttattagatatttatttggggcacttactctgtgctgctagcacgtgatttccagataaggctgtgatcaggaatagagcaaagtcttgaatcttggtcacctcagcaccattctctaggtagttgtgactgatggtgataactggctgtaggttttgttaccagtaaataaggcagctaagctgtcatctgcacaatgcaaactgaaatcatcctgcagttttttaagtggatagtaggacattccctccattgcaagatgatttgctaggagagttttaaatagtgctgaagacacacgagaacaaagccttccctttttgagctcaggtccaaaaaagcagttttggcattaaagagaaaaggtttatgctcaagaacttcttgctttttcttctccctcttacttcttggactaagtgttggtgataagatacaaaaccgttggtgtctgaagtacctctgaatccagcagccttctaaagaaatgttatcagaattatattgtgtaatataatgctttcttcttgttgaggatgccccagaataccgatagatgtcacagattttgcagattataattgtgaatttaaaatttaaaatgtcatatattttaattactaaaaacaaattagtagacatttcttatctgagtagaagatactgttggccataacctaatccaaaatgaaattttttttccccaagttccgtctctgtttcttgttttactttccctctctctttcttaaacacatacatatactacctaccccacccccatgcatatacaggtctttctaaattactgccttttcactccacatgaccaagttgttttgggacttggtgttccaggttcagtaagcctcttacactgggttctgtgctatagaaaagttgctatagtgctggtacacacacattttcctgtaaatttctcagttctttatttaaaaataaatattttataaatcatttattgagcattgatagggtttgtgtgtgtaatcagatgctgtccttctgctttatactttggattacctgtactgtactttttacacctagtctgacttcctgtccttatactattgggttacttctgccccagctgtatcattttgtgtgtatttagagcacatgagctaaatcttatattggttaaagagtttaaaaatctgtcacaaaattttgcccaaagacagaaaattttatgttgtcatttactgttttttttttaaatacctagtctaggattgattttttttttttgtaatgcactatgagagattgcctacattaaaagcattggtaacagcacgtaaatgttttgtaagaagtttctgcgtaaggaatataatatatttaaaatgttaattcattcccatatgcttaagtagtcatgtgtgtcagatcttttcaagtacagtgttcttgcattaaaatagcctagaaattttatttctgcattccagttctgtcttctataacttttttttaacccgtgaaaatgggataaaatgttgggttttttttttttttttttaggatcatgtgtgtgaatttgaggttcagagactgcagtcactgcagagacctgaaagccattactgtctgtcctctgtgattatatgtgtcccctgtgattcccacctgcaggattaggaatgggagggagagcagggggtagaaaagggaaggtggcagaatccatcgcaaaccagtgaactccaaaacctaatcaggcttctttctaggcagattctatgagagacgaagacagaccacaaaaaacctagccctaatttttttttaacccatgatttctaatgtttatctatttgttcattttgtaattcgagtttaatcagaccaactatcaggcaggcatttagtttgcactttcaaaaattgaaacttacacatttattaaatgatatccagaatcatttcctttttcttttagaacattaaacattaatccttttgagtattctcatgtatttcaaggtacttatgattgcttatgtaggactaatgcaaaaattaaatgaattccatgagaattcttttttgacctcacaagagttaaggagacctactttatgtgaaagtgagatttttatagataatactttgaaaacctaaattactctgatactaaacagtttactgtgtctgttaaagtaaaaaacctaattgaattgcagttgaaattcaagagtctagacattccttgtgggcatatttgatttcctctttccccttttagctgttggagagggaattgccaggtgtctttagtggaaagatatttaacctgctgtctgactgcttattgtggtagatgaagtgttagcactggctcaggcttgtgagaccgttccccattactgtcctaacactttggcaggattttgagtaaagttactttatttaacctcttttgagtttgacctcatctatgaattagaaataatgatacccttcatacttagagaatttgggaagagcaaatgagatgatgaatataaaaacctaccctttcagaagggtaaaaataaaatactaggatttatggtcatagcattttagaattcggaaggacaacctcctgactctaagcagtaaaagtggcaagcaaagggggttcagccattgttgagagatttcctacttcagtacagtgctgggtctgggatccagcctcaatcatcctagttcactgtcactctcctactgtacttatctgaaatggcaataatagttaacttcctctgtgcttggtacactggatgccttatataaattgtctcatttaagtcttacatcatccttgtgaattttgattcccattttacatatgagaaatcagagactgtgagaggtgaggtatcctggcaaggtggtagcacagctagtgggtggcaaagcctgaaactgaaccttagcagtttgacttcaagcctgcgttcttaacctttatgattatctttgcatattttttttaaatcaagaggtaagtttgtttaatcagagcacaaattttattatcttggaaaaattattcatttctttgtcttagcttttattcattcttcacatagtgtattatgaagtcaaaatcatatgtagtgatgactttttaaattaaattatctatttaggtcttccaaaaatacagaaaacattagtgaagcattttaagtttttgttttgttttgtttttgttttgagacggagtctcgctctgtcaccaggctggagtgcagtggggctatctcagctcactgaaacctccacctcctgggttcaagtgattctcctgcctcagcctccctagtagctgggattacaggcatgcatcaccgcacccagataatttttgtgtttttagtagagatggggtttcaccatgttggctaggatggtcttgatctcctgaccttgtgatccgcctgcctcagcctcccaaagtgctgggattacaggcgtgagccaccatgctctgccatgatttttttgtttttatatgaagttcttctaaaataaagcaagttataaacacaaatacatttaaatttcagtgtttttacaaggccagggaagagacgcggcttcagggaaaaatatggttgaactttgttaatacatacatttttttgccagcaaaattggagatatgcttggtgtgcacatacattaaaagcagtaattgttaacacttttggagtacttcacagagtgcctgcccagactgtctgacatgcttctcatttggtgcctacgcagccttgcacagtagtaaggggagagtgaacactcatgacctcctgctgtctatgcacacactccctcccccacagtgcctcagctcacacctgagtatctctctgcatgctcccagggagcttcctgcagtaccttaggcattctgaaacgtgtgtctttacaacaagacacacttgttaaagctgtttacaaatgagccttggcgggggcggggaaagctggttttcatttccagttattttaaatttaggcttatttcacacttcagcattcttttaattaatgtgttttaattaaaagaattaattattcttggttggtaatgccctttaatttgagtaaagatgatatctaaggccagcatctagtattaagttatgcctagatggacttctgttcatttattctgttactggtggttgttctttactagtgaaataagttaacgaatgcctgcctgtcacatgtggggcctttattttgtgttcagcaggcaccttctttgataattataagagcttagtgactgagagaattcagtaatcttcctgacccctatgccttcccaacaaaggagattatcttttagtttatagaaaggtcactcaggtaaaactgaaatctccttcaaggcaagataaatatctttatccttaactgtgtctctgacatgccattattttttcttcagtagtagtttgctggcccataagtcttttatgtgaactgcttatggttggaaacttaaacactgtcactttagctcagcacttgtttattgacatactttcctatgtgtatgtactgtgctaggaactgagtgagccctaggtaaatgctggagccaggggagataaaaagagagtttaattcttgtgttctctagctagttattgattacttgtagctaatttcataagaaactcttggaggaaactgaagagtagttgtaggttctacctggatgtgacaggattctatgtgtatgcctggatatgaggacagcttgttgaatactgcctgttaatttgcttttgggtggatcatgaggtcaggagttcgagaccagcctggccaacatggtaaaaccccgtctgtactgtacaaaaaattagctgggcatggtggcaggtgcctgtaatcccagctactcgggaagctgaggcaggataatcacttgaacccgagaggcggatgttgcagtgagctgagatgatgccactgcactccagcctgggcaacagagcaagactccatctcaaaacaaagaaagaaaaaagatgagagaaatattgttgtgctttaagaaagccttttaaattaaaatgtgagttgacaccccagccagaataagggtgatggtgtcaggctcctgaaaatgattttgttgtgtatattttacttatatacagcttttaagagaataacttgtataaaataagatacttaattttagatattattataataagtcttaacaagtaataagatataaaattaagtatcttattttatacaagttaattacttattagtggtaattccacctgcaggcttgaagtttcatggcctccagtgtttctctccaatggaacctttgctccgttgaaccttggatggcttagaatctggcacagatgctaagggttgagaagtgaatgatagttctgttggcaatcttaattccttgatgggcaggcccaggatcacatccataccttagaaagggtagcagggaaatactagctcagcttcctccctgaagaatgccagtatttcctggaaaagagctgaagaggatcctatggaggagcctgagaccactgcaggttaggagacaggaaggcagggaagaggagacaggaaggcagggaagaggagacaaggaggcagggaagagttgacaggaaggcagggaagaggagacaggaaggcagggaagaggagacaaggaggcagggaagagttgacaggaaggcagggaagaggagacaggaaggcagggaagaggagacaggaaggtaggaagaggactttttccaaggagccagtggtccgcagtagggatgctgctggttgagggctacagaggacgtgggttaatggagtgatgggagtgggacgtactttactgagggatgaaggagaggtgcggaatcttaggctactctggagaaacctggagaaggagggagatgggagagaaatagaagctagaatgtttgcaaagatgaagcattttggggtttggtggttttttgttttaagataaaaagggggggaattttacaagctgaagagatggcacagagaggaaaaagttttatttgtggttaaagtagtgagcatgcttttctgaaatgtcatttctcaaggagatggcggcttggagggggtcaattgatggttaataggaagccagtctaatgaaaagctagctatacctttgaaataggaaatttgtagttagaaatgtttgtgttctctttgtttaaattgtagcttgtggtataacaaaacattcactcatcaaattttgtaaagaattggctgtatgcagatactaggaagatggcagtaatgaaacagacacaaatccctgctctcagagagataatattctaacaaaaacgtgtttgtaagtgtgcgcagaacccatttcatgatttctgcttggtttgtggactcgactgaggttgatgtgagcagttcctgtaaaggaccatccctatcccaggttgttcagagaattgttttccgtccaagccctctgagtggctcttgtgtttgtctaccctcttcctaattgtcgcttttaaatacctcatagaaatactctctctccatatttcaacttggtcagcatgtgtacctgactacagccagtcaaattttggtgctggtgacatgggtgtggcagtgcacgtgggaaggtaattcaggaattaccttttttttggtaataatgtcagagtgttaaagtgattagtttttagagagttaatttcggacctatttagaaatacccatatagatattacttattctcttgcatactgataggctttcttggatggggaaagtggtagagatgtgattaacgctttgggcatttgtgcggtttatcttgtctctgcttcgggtcgggagtgacttgttactgtttacatgaggctagttgtgtggcactccctaaacagtttattgaagttttgtcttgtgtatgtgactgtcatattatgatggcagagttgttgagaacagctgcttcagcctattgtcaaacattttggccctatccatccagcatacttcttttaggggactgaaggaaagggacccaggagtgtctgtgcagactgtcatcctagtaatgcttacttggaacagtgaacacaatcgattcaagtctcaagtcttttgatttaccttaatccatttgaattttgtattttagccacctttgtatctttgacataaaaccatcacagggtactcctctcagaaatcttggaataaaattgacactctagaaaacagatgctccattttttatgcttatgctgtggttttaaatgtatcctgccagcagtatccccccaccttaagctaggagaatctaggtgtgagaaatttggattcggaattccagcactgccccccagacatgcccattcactgaccccctgagctagttccctttcttcctcttgggttgcttccctaataggatgcacttcatggcttttgcatctcccctcccagccacaagatctttgaatctctgagggttttcttcaaggcattttattcctacttaccacaggaaaaattaacagccattaacaaaattatagacatgggtaagttcctaagttaggttttcactgaaatatatatgagtctagactcatggttcttagcttctttactgaccatctcttagtcttttcctggggttgaaagctgtcatttttcccaagagtggtgtgggagctcttccctctttctgcagtgccccaggactaacagtggatacttggcatacacaaaggcctcagtgaagcttatttacatcttggagatctttctggcgtagaagttcatattggaaaggcattgcttcctcacagcttcctatgtacaaatactgggcatttgggagtctggatgaaagatgagtaagacaaaggctttgttctcaagtaaaagtccaaggggaaaagattaatccattattttattaagtacatatttattgactaccacccttgtgccaggctttctgctggggcaggagacataagcttgagacccatttccgtcctcacggatctcaaagtcaagagtgggaaacagataagaggccattatagcagtgctctttgctgagtgaggactgaggaagatttcttcacactgagttttaggggacgtggccagtgggggaggctgaaggcagcacctgggatggtttctccaaggggaccctagagcttcagttaatgaggtgaaccctacagagtactgacaccaggaaatatgcctaaggaaaactagataaactagggttttatttttattttttgcttcttctgtatgctaggcaaactcacattttattagctgtcagtctgttttcatttttcagtttaaaagttttcaggttgataactttggtccggtatcagtcagagtgatgatgaattgagtcaaagctgttgttttaaaaagaatattcatatgcatgcctatgaaaaagagctgtcttgttttaaaatggagtaatacaatttgtgttacaagtacagttctttgccccatttccattcaaattgtcatttatatctgaaatcattaaaattagaaaacagttatgatgaatgtcttttgaagcatatagcaggaaaagtcataagtcaaaacctgccagtttaaagtaaatgcaattatttggttctatgaaattgtagcttttgctatagtgaaaagaaattggcatatttatgaacaactccaggatctcattgaaatgaggaagacattatttaggaagacagtaatgattcagactatatttaggacaggatgttagagttaatgtgccttctctttcaagtgattagtgggcagatgacatctttggtattaatgattgcctgagttaacatttttaaggaaagagtgccacctactgaatgaagagcttttgttttcttccattcaattcgaagaatcttgtttcactttgaatccttagtgggtggcatttgctgggcagtgatcccgtcttccagtggattgactagggtagctaggattcttagagggagtttatgcccccaaaaccaggtgtagaaacaaaacctaagcataaacatgattcagcacttggcaagtctcaaaaccttaccatcatgttaatgtactcactggcccagaaggttttttgttttgttttgttttgagctaggagcaaatggctgggaggaaatgaactattccaaaaaataattgaaggggattgaagagcatatgacattggtcgagatcttctggggagacttcgttttcctagggaataatattagtgcagagattgcttgatcacaacttggccataggtcagtggagggattcctgaggtcaagttgcgaatccaaaggcctacttcagagtaatccatatggtgctctttttgtagttcctaacaatagtatctcattagtgaaaggttgagtacatgaacagcagcaaacacaccagtatccgaattaaaggacatcatttgagaatttcgcatagtcattatttttagtatattgggacatttttgatgttgtggcttaattgactactaggcatcagccatctccagctttttccacttgtcgattggattatgcaagtcatgagtggtatttaaaagaggtggactgtatgctaaattgatttatccttgcttatgtgtacagattaatggtataatccatgaggggtgatagattaagatcctgaagtgaaaaaatacatatatagtgtcaggtatattaaccaatggttagttgccttttatttttccagtgtaaagtatagcagatccttcaataatgtcatttagttgaacattttggacaattttgctaaaaagttgatgaggataaaaatctcttctggcagaggctactgtctgtatggagtttgcatactccccccatctctgggtggattttctctcagtactctggtttccccctgacaccccaaagatgtgcacgttaggttcattgtcatgtctgcaaggacccagactgagagaatgtgggtgtttgttaatgcaccctgcaacgggatgacatcctacccagggctagttcaagtctggcaccctgaattgttgggacaggctctggccacctgtgaccctgaactggaataagtgggtaaataatcatcttattaatgtttcttaaatgtatgttacagctcacattttttcagtgtttagtgttagaagtgtttggggtctctagaagtttggtgatgtttttgtgaccagaaatatgccatagaaactttcccacttgtttacatcaattggcctatggtaaagttggttttaaagtcaaagtttctcttattgtgtaacttgccattgacatctactcatgttacttaaataagcgttttgtttgtttgtttgttttttgtttttttgagatggagccttgctctgtcacccaggccggagtacagtgccctgatctcggctcactgcaacctccgcctcccaagttcaaacgattctcctgcctcagcctcccagttagccgggattacaggcacatgccaccacacctggctaatttttgtatttttagtagaggcagggtttcaccatgttggccaggctggtcttgaactccagacttgaggtgttctacccgcctcggcctcctaaagtgctgggattacaggcatgagccactgcgtccagccaaataatgagtattaattggctgaatagcaagtattctctgaaaacattatttaataatacaaaacttgtaaatattttagcaataactgtgttttcagatttgcactcagaaaactagtatgacttttaatattgtatcccagcttttctccttttaaaaaacagaaaaccctaacttctgtaacttgactgagattaagcgtatctgataccattattccagattatgagaaaagtcagctgtgtggctacagagagctctggcctgaagtagttattaatagaattcacattgggacgtaaaaacaactggaactgaaacttggtctgagagccgccatgtttcatgtctcatttcaggctactactttgcatctttttgacttacagcacttaaatatgcaaatgcaaaattgttaaggttttttttttttttttttaaagatggagtcttgttctgtctgtcacccaggctggagtgcagtggcacgttctcagctcactgtaacctccgcttcccgagttcaagcgattctcctgcctcagcctcctgagtagctgggattacaggcatgcaccaccacgcccagctaatttgtgtgtgtgtttagtagagatggggttttgccatattggctgggcaaggtgtttcacacctgtaatcccagccctttgggaggccaaggcaggcagatcatctgaggtcaaaattgttaagccttttaaggaagagaaatgtatggcttattgatttaaaaaaaaaaaaaactagacaggttaatatttttcatgtaaaacgatcttaaaatctttgtgctctctactttctcgaatgttctgcttgacagttgtctgaactttctgagagctttgatagagtcttatacataatacgtgcctctcttagtaataaagtttgaattgctatgatagtgaatattggaggagtctaaaagttcgtaacagtatgtcacccatactgatatactgcctgagttagtacaaggggtctgcagatccacttagctaccacgtagatggtgatgataccttaagaaaggattttcacattcaaaaacatggagagccactggattatagaatgacaaagaatattttactcaaaaaaattttgggaagtactctccagatttaacgattaaaaggaatttgtggtcctattgagctttctatcttctgatggtgtctatctgcctgacaggaataatattgatgtggcagtggcgataaatgaattgtatgttcacactgaatgaccctaagctatcatcttgtagtctgatgtgatttcataggttcttaagttccaaaaaggttgtgaatttcttaagagcatgtcatggctaatggcacagtcaggacttgattatgaatttccagacccctgaatcctgtcattttcctttagttccgtgaagcttcccacagtgtggagtagtagttcagtggtgcatgtttatttttaaggaaatatttcaagcatacagaaagatacagatggaatacattagataatagtataataaacagccagaaaaccttcacctgtatttaataaatgttaatattttattgtacttgctgcagtgcagttggatgtgtattttttaaaggaactaatattaaacagttgaagcctcctttgtcttctggctagagcttcttctctccctcaataccagcagaagcagccttgtacagcagtcttcatattctagatgttgctagtcaacattgttaccttctgaaaccagaaaaaaagttttattttgctactgtcatctgtttttcaaataacttgttaaaagaagttataataacagcatagtggaggaggacaggactttaaagtcgtagagagctggttttgaaactcagaattgtcactgactatggagagttaatcaaactacttaatctttctgcaggtttcttcatctgcccaatgaagatgaggactcttaccttgtagctttggtgagatgtaaagccactgtatggacaatacctagagtagtacttagaacagaggaggcactgcagaggctagctttaatagtagtagtagtgatagtagtaattcagtttattgtgggctaccatgcacttggtgccattgcaagtacttcatccatgttcatttaaaaagtgaggtaagaattaactatatgtaaaagacttagaacaaggtgtggcgggtagtaggtgggtcataagtattagctattattattatccccatttataggagaataatgggaggaactctaagaagttaactttcttctaagtactttacatatatattaatttatttaatcctggtcgctactttatatggtagatactattatccccattttatagtgaggaaattgaggcacaaagaagcacttctaccaagattgcacaggtagtgtcagagcttatatcttaacccaggcagtctcgctccagaactcatgcccctgatcgctgtgccatacttcttctgtatgtggtatggcttcttaccttatctatccagtcctaggaacatatctttcaggtggtatgatctctattgactaagaagtccttcctggttttgttgtagatgcaacacgtttcctcatgtgaccccagcctgttaaaatggggtcattttgatagaagctacctggatttgattcgtttgggtggctgttgctccataagtacctttaacagtctcttcaccccccacccaccagttcttcctgaagtccccagtgtgggtcttacatgtgctgaatttggccagtgacccagtagccgtctctggtcagcactgctttctggccattgccatcacctccttcagccacattggcctcgccccctcggacctgcttcacccaccagtcctgccagtaacaccaccatcagtgctgaagatgcacaatgttcccactgtgcagagttccagggtctttacaatgaaatgagaaccattccccaggcccatttattttattttgtattctgggacttacttgtaaccatatagagacctttagagaaaataaattaccaaggttttttggtttggtttggtttggtttctcatggcttttttgctttcaccccagacctaagagcttggcagagaatgagtggactggaccaggggcaaatctttgtgacagactctggcctctgctagtggttggattgggccaggcttgaatttctgatgcccccttctcttagggtgggttcatacaacgagactacccatctcgctggctgtctaaataatcttttctccccatattcattttgaattattggagccttaattgcactacagacatgctaaattttgtgatagcttaagtagtattaagacattaagattcctggtgttagttttttctctgcaattttcttagaaatattgacttactggagccagagggtctgtagagatgagccagtacaggtttcttagagtatgttccaaggaacactgcgctatcaaagatgctctgcataaaaggacttccatggcaagtgaatgtgaggaatgctacataccttctttttccccttggagattaatgacacatgtaggtcttattagaggctctgtgctgtcctgtgataaataaagccaactaacttgtttttatcaagtgttccctgatttgcagaatcattagatgtttagtattataggattgttttttttggttttttttttttttttttttttttgagacagagtctcgctctgtcgcccaggctggagggatctcagctcactgcaagctccgcctcctgggttcatgccattctccagcctcagcctcccgagtagctgggactacaggtgcccgccaccatgcccggctatttttttgtatttttagtagagacggggtttcaccgtgttagccaggatggtctcgatctcctgacctcgtgatccgcccgccttggcctcccaaagtgctgggattacaggtgtgagccaccgtgcccggcctaggatattattttgccaaagctatgtcttctgtttggaacatcttttggccttcaccaactctctcttccagttctgttctttaaaattattcaggcatcacctcctctgtggatcttttcaggactctcctagataaaattaaggatggagatcactccaccttcgcaactgtttatgggatgttaaatacttttattacagcagagttgacattgtgttttcttgcttctgtgagacagaatgattggaggaacacagaccctgttttatttatctttcgttttttaatttttcttctttgctgcctggccagtgcttatctgtggtaggtgtgccagcattcattgaacggagtggtttgctagcattcaaagcataaagaagaaaagctgcatttgtcaggaagtcattcttcctcattctgagcatcccagttaacatgcctttttaccaggtggaaggaaatagtatagtactagctgttctgtagaattttgaaagaaatccttctcctagcaaagactgtaagagggctttgtatgctaattcggggttatcccctcttctcctttaatctcagagcattaaaaacagttaagggcttttttaaaatagaaggtattcactcaaaatattacatatctataacttcttaaaatacagaagctttaaattttgttagtggggtaagaattatagtaagttgtattatgccataacctacatatactaacagaccactttcgtaagtatgtactagccctgttgagttgaccacttagaagtatactcaaactgcactgccacatttccccaaaggtaacaagtaaacataggagaaaacatacactgcagccttcatgtaacactgacttgggatctttttaatgaacacccaaatggtgaaggaacagaggttttcatttcactgtgccatgcattctgtaccagtgcccccagataagggcaggatgcatggccttgctgagaacacccctccccccacagtagtagtgtaggaagttccaacctacttctctagtgtaacgtctctctaggtttatgcatcagttgtcttgtagacattcccagccctagatttgtcaagtagcaaggggggattcttaaaaggaaaaacacgtttagccaaaaactgttttgttttgtttttaaaaacatccttcttacttactgatctgtgttcaacaattagggaagaggatactcacaatgtttcatttttccccaaaggtttctaaaggtttttcctcaagtaccaaggacacaacaaaggaaagaataaacagtggaatttttagcgcagaatgtcaaaagaatacaaggttttatgggtttttgttggaaaggaacaagtgggaaatgggaccatattaattttaaactccctctgttgggtgctcagaacatagtttaccttaagcctgatggatgttctgagtttctccccgcagggagataggtgaaagagtcctagtatttagaagtactgttacaaagctgattactctgatgagtgatataagtgttttaaagcaatatttagtctaagtagtaaatattcctaagacagacagtaactttacaattcatttgttttgttgtcttaaatggcagaacaatgttgtttttctgtcactaacgtttttatatgttttctaagatgatgaatcatacagaatcaccaaactcatatttctgttcaggtctgaccatttttacaattttcatttgcctatgtaaatattacccacatattatagttcataatttgtgatatgtcagcagatttcattgaacttgagtcttaggtcacaatagaactaacaacatattggcttcattctagtccaatttgttttcttttatgcctacacaccaagggtgttcgcttgaaaacaagtcttccttcacctcctgctttttctcctcacctgctctttaaaaaataattgtacctgactcaaattgatagtcttctaggattttcattcgctaactcaaattgctagtcttctagagttttcatttgctaccaagttaacttgcttactaacttgatttgtcttatctcttttagatttatttaaaatccctaccaattttaagagtcactgcatattcttgattacttctgcatggctatatctccatgtccccctctccgaattctgatgtgtatttgacttgtttggattatatttcctcctggcaagttttgacttcgttgcagtttgacgttttcttgacctgtcagtgctcatgattgtttccgtggcttaacaaagtgtacatatttagtttcattattgtataaatttgttgatttttctgttcatctattaacacatttagaagaaagaacttttctttttccaaatttgaacagaacatctcaattctattagtgatgtgcttagtaatgtgtattggattgatttattgtggtacattaataacttgaatgtggtagtttttaatggaatctgccagctacatttctgagagacatgagtgtgccaaagaaacaccataaccaagcttttacactactgccttattttctttctggaactaggcaggtgtaaagagatgatttagaaaacctttttgcattttatctttttcttagtgtttatctgggtttcagctgcaaggaatatagcccctttcgtttgatgatgtttatccatatttaaacatggccacctgaaagtttagccttagtgttttatcttaaatatgtcagtgactttggagactgttgaagtacatccataatgtttgtatgttagtttaaaagtaaaaaagacttggtcgggcgtggtggctcatgcctgtaatcccagtacttcgggaggccgaagtgggtggatcacttgaggtcaggagtttgagaccagcctggccaacatggtgaaaccccatctctactaaaaatacaaaaattagctgggcgttgtgttgggcgtctgtaatcccagctactagggaggcgaggctgcagaattgcttgaacctgggaggtggaggctgcagtgagctgagatcctgccactgtactccagcctgggtgacagagtaacactggatctcaacaaaaaaagtaacacttttcctgcaaggcagttttctcaaattcatatttgaatattcttatgactatttgtggtcaagaaagatgccttttaatcataaaataatcttgaatagagtttttaaaaaatgtacttcatgcaagaagacaaatgagaatcttttccttcacttaataatgtattctctgctcataataatgccctggtctacagttgtcagtattttatgcagacgttattttatatgttccagtggtgtctgaaatttatagcacactgagtttgagttaccagtaataatttacttagaaatcccttcaagtttattcagtattcaatagaggatcagttgctttaaatatattcatacattttgagcatgtaagaacatttagtataggagaactgtacagttaatatacatttttctttttgattcacttttcttctctaaagggagatttgggcatgtactttatagactgagtcaaaggtaattgactgcaaaaaaaaaattgatacagagttgccacttttaagaatgatttgatactgactagtagctctctgtcttttgtaaattccctcttattatagttagttgcctgatgattgttacaaatttactaatttggaagtaataaaaactttcgaatattcttccttttctcattgaagttctttaccttttctctttgaagttacttacatatccctagaggcactagtttatggtagaagttgttaagggctatgtttgtccatcatgaatgatggtgtaacatctgcatggtgttacttcttagatctttgttgattagaagtgataatcagctactctgactctgaatcagggagtgtttatcaagcccatgacatctgttgttctgggtgctttgttcctagctgcaggacaaggaaaaggccctgccctcaaagaatttaccctttccttgtctagttcagccagtgattgtgtgtttacagtatgattatctattaatacattgtcttattttaattttggttaattttatatatattttatgtttctatactgtgttctggttttcaaaatcctgtaattgtgctggagaatacttttaattttaaaactcaaatggagtggtgttttgatggaaactaatccatgatttagggtaaatggagttattgtgcatgaccatgtggaatatgttatcaatatgagtcaatcagaatcactaaggtggtattaaactgcttatatgtcttgtttataattagttgtgttattgtctttgttacttgacttccatattacttaactgttgatgtggttaatcagaacatgagctttttgagggtgaattctatgcccatatctctcaaaggcctaaataggaatgtttgcacacaatacttaaaatagtttttccactaataaagatttctgatacagattcaacatactataaaactgatttcaaccgggtgcagtggctcatgcctgtaattctagcactttgggaggccagggcgggcagagtgctttgagctcaggagttcaaggccagcccggacaacatggagaaaccccatctgtacaaaaagtacaaaaaaatgagtcaggtatggtggcttgtgcctgtggtcccagctactcgggaggctgacgctggaggattgcttgaattgggaagtggaggttgcagtgagccaagattgcgccactgcactccagcctgggcgtcagagccaaaccctctctgtctttaaaaaaaaaaaaaaaaagaatcaatcctttgttgtgctaaagagaggatatttaccctatggggggataaaagtagtagtgcctgtttcttgttataaataaatagcagttgtgccgtctttagtcctcagggtcaaactttactgaataaaatctggaataaaatcttgtgggaactaattttcagaatgtgagccatttttatacattgttacttcttatgtaaacctacctatgttataaatgttgtatcatataaagatggaagattcgcccttccaatggtttatttaatcttccttgcttagaaggaataggccaacagttggcaaagacagtatgtctctggagaaactatcttactggaaaatagaattgtcctagtattgagataaagatggtttggttttggttttggttttgtttgcagatgcctcagatctaggtcaacagattaaaagtacttgtaaatattcattttccttttgttcttggaagacacagactgtgaaatcactctcatctgagtgtaagtcatagtgttttttacatatagactttatcaccttgaacatgtaactgaacctcccatatcctttgtctcatctgtaaaatggagtagtaagagccgcgtctcaagagaattgactgagtaacccatgtgactgttagccctatccttgggaaggaattgtcagcctttctgtttcattatgctctccctatcctcagtttaagtcattcctgctcttgtcctttacctggaaccttacactttaagtgtcccacaatggactaggattgttttggaaggtcgttcctcccttgctgtcctcttcctcagtaatatggcttatgagtttggtagtgtgtgaatttcttctgctaggaaggcttcacaggtggaccttaattagttagctctgaattgtgcctatcccaaataatgtattttctagggttccttgaagttccttggacaccaagagaatcaagatacggaaatcttaatttatacctaaggttaaatctcattaatttccagaaaggttttctacgatcgttatagtcttagttgcctctattgcagtgaaatgctctaataatgaagagaattaatatgcttctttaattattataattaatcaaatcgtcactgttgtaaaaacttacaaaacttgtttggattattatcaaataggtatcagcacaggtgctgacttcttgtaaaaacaaacttagactgggcagtgaacactcatagcagcagagagtacagctcttgaatcaaacctgtgggggtttgaatctggccctgccactcacttacaaactgtgttaccctgggcataacccagcctccccaagcctccgatggaaaagacctcacagggttgctggaagggtgcagtaaattcatacatgtaaagcacctaatccattgtctggcatgtaatataatttttctgtgatgacactctggcagttatttctccatatcgctggttgttgacaaacataatatttccttcctaaggatgagccatttaataaataacttaaaaattacagtagactggtaggattctttttgtttgtttatttttttggacatggagttttgctcttgttgcccaggctggagtgcaatggcgcaatctcagctcaccgcaacctcagcctcctgggttcaagtgattctcctgcctcaacttccctactagctgggattacaggcatgcgccactatgcccggctaattttgtatttttagtagagatggggtttctccatgttggtcaggctggtctcgaactcccaacctcagttgatctgcctgcctcggcctctcaaagtgctgggattacaggcatgagccaccgtgcccggccaggattctatttttgagtgtttatgaaatgtcccctgtgtgccaggcattgtgcagaactagtgttttagtcagactatttgaggttgcagggaacagagatgggttaaaatttatttcattccaaattaaagaatccaccaagaagtttcctccattgcagcatgtacacttggcccgtggagaactagtcattcattatccaggggtggtataaaagtggctgtcatcatctaacagcttatcaggggacccgtgtacaacttgttaggttgacttttgttgcttctgcatccctgtctttcttctaatttctctctcttctcccttatttctgtctcagtgtttctacttattaccttgctctgtttccgtgttaagtgccactcttcctgcagtaacactatttgtgtgttttactttcaaactctcagggagagagctgactcaggcgtacaataccgttcagtacagaaggtcattggaccaaggaacattcctggaccaggcagctgtggaagctgggatggattcagatgtataaagcaccttaagcattagccaccacccttaggactgggcagacccttcgcttcccagaaaggggcagtatgtcaggtcactgggcagtgtgatagaacaatgaataagagggaacttgtcctggaagagctcacaatgtggagagggaagcagatacttaaacatatacttaattttatgatatattgtagttaatatttaccatgcagcgggagagcagctaactgccgtagaatggtggtaggaaattcttcattgaagccatattgagatggcaaagggtattcctggcagggaaaaaaaaaaaaaagtcatctgcagagacgggagtaaaatatcatggtatatttatgaagtttttttgtgctatgagaagagggccatagttggtatttaaggggctccaggaagaaggtctaatttatggtactgatgaagatgattagacatagaaccaggagaaaaagacctcatagaagagtagaggagagacctacaagagagttagcacaatcaacagtggctgacaccacattataaggggaggactgactacagtttccctgagaagggacccttgaagcatcttggtttttaacaggtgagttttgtaggtctaggaagagtctagcactagaaacctaacctcagggagtaagcgttcttgaagttctgtgtcaggtcacaaattcattcttaggaatgtctagaaaccaaaaccaagaaacctcatgtttcctaaataaacaggaaatgaagataaagcttgatctgtaatagtgcttaagtttctcttatttttctgaccacaattttatttatttttaagtcttcaaggtagtttctcaaaacacattgtttagctgaaatctgttatttttttaaggtcaaaagtgtatacactattatttaaaataggtatgtttctgggtaatgtttggcaaaaataactccccgaaacattcacgtttaaccaacatgagttggagatggctctcatctcccagtgacttcacagctatctgtttagattagctttggttaaaaaaagatttttttcctgctatggctgtgatatcttaattggatgataaatcactgctatatacatacatacatacacacacacactcatctagtaaaaatgaaaaccctatatatgcctggcttatggaagattatatgttaggattataacaaaaacaatacaagtatgtaaaaaaatttttcacagtttggttctgtttcagagagaaattaaacagagtagatgtgatttattcgtggcaaatacaataggatttactatatatttcattgattcaaagatcccagtggttgtaagttgtaccattattttatatactatgaaggaaataacacctgccagttaaattataataacttttgattgcaagaggcattcatatttcagatattaaaatgtgaaaaaatacacattttaaaattaatgacatgtaattattacaaagagactaggaaaaacactttggtttatatttgcagattaatttaggaacagtgaaaattgttctgaacaacatctaaattgcaaatttagtcttaattaaatacagaattataaaaaaagttaataagaatagtcattaaaatttaaaactgggaaggctgtaggactgccagagttaataagtgatcattcacttaatatatgttcatacttattatgagccagacatgcttagatgttaggtgtatagatggcgataacacgtggtcccctcactcatggagcttacagttcataagagaggaacagtttgcaaactgcattaaccatgttaaaggaaaaatacaagtgctgtgaaagaatggaactgggagttcttaattgaaattgggaaagtctctgaggagttgaggaaaatctagagagtgggtagaaattaggtaaaaagtagacagagaaggaagcagcctgtccagaagccctgagtaggaaagatcttggggttattgaggcagtgaagaaggggggttgcaggtctgatgacaggaattgaggtgagaccacgaggtgcagggccacttaggttgggctaaacattttggattttagtctaagcccggggggaaccactagagcattttaatggaggaagtaaccctggctgcactgtgaaatctgggtaagattcaaagttaaagaagcctcgttaggagcctgttgctagttcagagcaggtttaagagcagcttgacctggatgggcgtgtgaatggaagacatattttttagaagattatttgacaatattatcaaaagtcttcatttgtgtacatttttaacccagcatttccatttctaggtgtttattctaaagaaataatttaggccaaatgtggtgtaatcccagcactttgggaggccgaggtgggtggatcacctgaggtcaggagttcgagaccagcctgaccaacatggtgaaacctcatctctactaaaaacacaaaattagccaggcgtggtggcacatgcctgtaatactagctacttggaaggctgaggcaggagaatcacttgaacctgggaggcggaggttgccagtgagcctattgcaccattgcactccagtctgggcaacaagagctaaactccatctcaaaaaaaaaaaaaaaaaagaaagaaaaaagaaaaaaataatctcatagtccttaaacataaataaggtaaaacgaaatttaaaaaagaatctcagatgtgtgtaaaagttcagctactagaatgctcatccctattatttatgataaaagaaattggtctaaaagatgacagtattttcaaacaagtggaaaggaaagagacacattagactttaaggaggccatgccatccagaaagatttgtttagacaaggaacatcctttgtgtgtttgactcagggccaggaacagaaactgaaaatccatagcagagaagagatactcctgaaacagatttgggggaagagagatagctaggaccagaggaaagactatcaagcaccttggtctaggagtgcaggagtttctggtataaaaatgcactgcagttccactgtgaggcttattttttggaactagcctgggaaccaaaccacctcttgcaacattgttactggagggggaaagcgcttttaatactaaagacttggaagtgaatttttattatgcagtcaccacataaattcagttgcctacaaagctgagcctcctggaataccaactgagcaggatggacttttttggaagacactttatcccctgtgttcttcacccctacctctctttctctgccttcctctccctcctcctttttctcctcctcctttcttctctgccttcttcccttctctccatccccccttcctctttccttctttctcctccctccctctcttactttcttctacacatcccctaatatttatattttataatcagcataaaaagcagccaagcacatataagtaaattagataatcctccttttttcatactttttgaaagtctcatattgcttctatataacagtatttgtgtgtgtatgtgtgtgtaaggaaatattttacgctgtggtcttaatgcctatttgcaagtttcaaaccaaatgttatgtattctttgtatttctaaaaatgtctaggccagttgctgatacaaagatgtttaatatgttgccttctactttcctcacagtcttgatgcttcagtgaaacgggttaaccgtttcctttctagtgaatatttttttttaagtagtttcttcttcctttggctgattctctgaagatcgtacttcatagttgtgattagctggaaaattcctagaggagtttgaatttgtctttgtagtaaacttgaggttcttgtttttggtatttccttgagtatttccttttcctatcagtgtagaaaaactgttctctagctttaaagacttttcaaaatagttactgaaattagcttagtatttttaaagttgttactaatcccaaggtgcagttgctttaactgcatccttataaatcaggttttcaaatctatgcatatcgtgtatgcatgtatgctcatgtggatatgggtatattttaaaattagtgattttcgtgagcttgatgctttgcctgttaggctttgtagagttaattctcaaacgttcttagtttagagattgttttattctggtaaatccacaccattttatggagtaaagatcaaatgtttgtactggataatttttattctttatagagtaccccaagtgctttgttatgaagtcactgttctatgaaaataaaaatttaatcatgtaggctatgaaaaattgttttggggtcatagatgatgtagttaagtttcacttcacttattaaatatttattgagcttatttcagataaatcagcatatccaccagattctatctgtattgacttaatttattggaaatcctgggataaaagtgtagtaatacacccttctaaatatttgttatttgggtggtagaattaaaaacaatgcagtcttagtgaatatatttgttaatatagtgcttaatgtcttgggattcattttgttaactacagtggaacataggtctgcatgatatatgtcagtagtatataattcagaatcttttcaagctttaagtcatttggggtttttagcagttatcttttttattacatgtccgttggaagtataaaatagaaccatccattctgtttgttcttggaaattatttttcatatatacatttctcattttatttgtttctgcctgcattttagtcgtgagatggagaataaagaaactctcaaagggttgcacaagatggatgatcgtccagaggaacgaatgatcagggagaaactgaaggcaacctgtatgccagcctggaagcacgaatggttggaaaggagaaataggcgagggcctgtggtaagtggctatgggttaccagttataaggaagaaagcataggaggaaatggaaaagtaagcataaatagatcctcttgtaagcttttcttcttcattttaaatgtagtagttttctttacttgatattgtggtcatttggaagaaaccataattaaaactgtgctcattaaacaacttaaactattctgggaacttaactgttgtgtttggtggaggggtaaatgcttaaaccaagactgccctctcatgtcagtatctaaaatcctttcattggagttttatactgtacttgtaaattttaaaaagaatttttccagtttattttagatgttttatctctaagacaggatccaaggatcttaatttcagaaatcttctaggaaagaaaacatttaattgcagtaattcataagtgtaatgattgggttttcacatgcatgcataagatgtgcgtttctccaactttgttacagtgtcagcatgttatcctcatttgacatgaaaaaatgtttaatagacctatggggattaagataaattaaaaatgtgtggggtttgatgaaagaaaatctagagtcctagattttaaaaagcagggatactctgtcctttgctataggtataagaatatatattcttataagaataccatcatgaaatgtgtgtcttcattcttacaaaggaagaagtattacagtatcctagcactaatctctctcagcaagtttttattttgttcttttaaaacagatatggcaacttaaaattcatctaagctttgacaagggtctaaatacacccctgccaagtgattgtctgccctacattcatcccatatgcctatttaagtttacatttaaattaattagatgtaaataaaagtaaaaatttagttcctcagtctcaccaactacatttcaaatgctcagtaaccacatgtggccaatggctaccttttaggcagtgcagttttagcacattttcactgcctcagaaagctctcttagatgtgtagtactgactcgtgtctgacttaaataactcaataatccctgtggctttcgatatcctcatcactgagctgcagtctgtcaggaatattttacccactggttctcattctaaccgatggaattatacagaataaatctaattgttcctttccataccagcacttggtaagttattatgggcccgtgagtccttgtctttacagctaagtttctacatttcttccatttattactcacgtgaggtggtatggtgggaacccctcaccattttagctattcgtgccagaaggtgaatatgaagaaattaaggatttatcttagagaagagaaagtgctattgaaacatcttgtagaatgttggcagttaaaagggcatattactactcaatcaatataaagaacttttgaacaagcagagccatctgaagtttgaatgtgctgctttctgagctcctttagatggaggtgttcaaacagcctaaatcttttgagaataccgtagggcataaatcacaactttttaaaaatgagccagctatttgttctttattatacatgaactaagaatatccagttctctaaaacaaaattttggtttttatactgttcactttctagcaagtaccaaagtaccttgtctgtatataagacatgagtgaagagggaggagatgtgtggaataagatgcataacacatagtccttaagcttaattatgccaccctacattttatgatttacggatttcgtattatccttaggaagtttactgtttacttgggaggtctgattttgtttgtttttatactttaagtaagttgtgtcaaatcattcttgaaacataaagggtaaatatctccaaatgggaaaattagacttatacataataaatagagtaatacatgaaatatcacaaagcaacttgtgactaggtgccaaatgtgtgggatgggcagaagagcaatagggacttaggaaagagaaggaatgtcttgctggtagacttcagggaagtttcataaaaggaagaattttaactcagcgtagaaagatgggtaaattttcctcatgtgaaggtgtactgcctggggtgctgcaggctggagatgagtattaaaataggaggagagtgagtgaaagcacaggaggaggaagggtcaggcaagtttggtgaacacagcaactggctatagaacaggagcagtgggagaaagtccagaaaggtctgctgagcttcagttgtacaaagctgtggagtttggcctttggtcatggctagattaggtctgaaagccttaattaaaaaaaaaaaaaaaaaaaggcaggtcttgtaaactgcatttctgcttgagaaattgatctttaaacttctagtctcttttggttttctgagatacacatctaacctattattgtaatataacattgtaaagaaacacacacacaaagcagggaaaatgattgcatagtgatcaaactatttgaaattatgcccagtgttgtttcaaggtcctacattttgtaaaaacaaataaaaacgtacctagatctttgatctagtagttgaataagttgactgtagaagttatgagtgcttatttttcacatttgtttaatcacctttgattgttgcttttgagtgttaaatgagttagggtatataataacaaataataccatttctacagttttgtatgcattacaaaattgtaagggaggaggttgcgttttaactagtgttaaatcctaaatgactgaaatttgtgcaggtaaaaataatcttttacattaatagcttaaagtaataataaaagttgatatattgtctggtatactggtataatatttcataacaaaaactcattaagtgtatttcctagtctatgatatttacatttacttaccttttatatttttaagtaatcaaaatattggaatactttgattcaggtggtaaaaccaatcccagttaaaggagatggatctgaaatgaatcacttagcagctgagtctccaggagaggtccaggcaagtgcggcttcaccagcttccaaaggccgacgcagtccttctcctggcaactccccatcaggtcgcacagtgaaatcagaatctccaggagtaaggagaaaaagagtttccccagtgcctgtaagttaatgttacaacaaatatgttagtttttataatttttagcttcatttataacaaagaaaagactggccagccatctgttagaacatcagttttcaaaatatgatctgcagacccctgaggatggggggggtggttcctgagaccctttctggggtctattaggtcaaaactaattttgtgataaaactgggatgttgtttgcctctttccctgcattgatatttgcagtggtgggtaaagctactggtgccttttcccaatttaaggctacaactgtagaaactatattcattattgctatgtatcagccattaaagaaaaaaatgccagttacacttgataatgcctttgacaaggaaatataaattaattttattaaatcttgactcttagtaaatacgtgcctttgtaatattgtgtgtgatgaaatgggatgcatgcataaagcacttctacataccaaaatccagtagtttctaaaggagaagtatttgtgcggttgttagagttgcaagctgaactagttatttctttcatggaacatgaaatgagtgaccaacaaactatgattatttagatttgggtatttggaagacatttttcttaaggtgaattaaatgagactgtcacttcaaggaaagcaacttaaggctgggagcggtggctcacatctataatcccaccactttgggagggcgaagtgggcggatcacctgaggtcaggagttcgagaccagcttggccaacatggtgaaacctcatctctactaaaaatacagaaattagccaggcatggtggcagatgcctgtaatcccagctactcggggggctgaggcaggagaatcgcttgaacccaggaggcagaggttgcagtgagcctagattacaccattgcactccagcctgggcgacaacagcgaaactccatctcaaaaaaaaaagaaaaaaagaaaagcaacttaagtattttttcactagtgttaaaagttgagatgtcgaaacaaaaattagaattttagaaagctactatccaccactatgagcttgacagcctcccagtgcttagacttttctgataagattggtgataacaaatgtgattattttcatgctgtataatgaaatatgtgaacatttggaagatctgcgtaacttaaggaaccaatattttccacgtgatcagtgtatgataataacaaaattattcataggtaaaagatacattcaaagtgtaaaatacaccatttggatttttaatgtgccagtaggaaaagtttgttgatgtggtttcagattccacattacaactgcctttaagaaaccattttttgagctttggtatagtaccaaagaatattcatcattatttgaacaggcagtggctcacacctataatcctagcactttgggaggccaaggtgggcggatcactggaggtcaggagttcaagatcagcctggccaacgtggtgaaaccccgtctctactaaaaatacaaaaattagccaggcgtggtggcaggcacctgtaatcccagctactttggaggctgaggcagagagaatggcttgaacccgggaggcagaggttgcagtgagccgagatcacgccactgctctccagcctgggcgacagagtgagactcctaaaaaaaaaaaaaaaaaaaaaaggggctattaaaatactccttccttttacatctacgtatctgcatgaggccaaactttctttcatatactttaatcaaaacatcatatcacagcagattgaatgcagaagcagctatgagaatcttagctgtcttgtatattaagctaaacatcaaagaaatttgcaaaaagataggtggtaaattcatgtgagagagagacttctagtagtggaaatgcatgttaagactcactttctaactttgaagaacaaatgattgaatggaaaaatggttgagatagtgaccacaagaggagtttgggtttttttttaagatctggagttattaaggtacataaattcgttaaaaagtacatttaaagcaaaaacattttacagtaaaacctgatgcccaacagtagttgttggctctatgttaaaatacctttaaattaactattaatttttgttaacttaaaacaataatcagttactagctcacgaatctgcagattgggcagggctcagcaggggtggcttatctctgttccttgtgacattctctgaagatgaaaggtccaagactgcttcttcactcacatgcctattgcttcagctgggatactggaacacttggggggctgttggcatctcttcctcctagcacgaagactgggttgcaaagagtattgtttcgagaggcaagtctcaacatgcaggctcttctcaagcctccacttcattgtgtttgctaatgccttattgtccaaagctagttgcatgcccaaacccagaattgatgtgatagggaactacacaagaatgtaaatactgggaggtatggttcatgggggccatcaaaatgaaagtttacaacaagtataaacagaactgtcttccttccccacaccccacccccaaaacccactttgggcatatatgctagacaaagttacccctcattctttttaacagttacatagcctttcattagctggataaatcatggtttatttaatgaatgatatactaatgaacatttataatctttttaaccttttgttactgaaaacagtgcttcaaaagtatttttatacgtatgtcatcttgtacatctgtgagcatgtatctgtgaacatatccataggctggatacctagcaggtcaaaatgacgtgtgcatgcataattggctttttttgtttgtttttactttttagtaactgcttttttaaaaataatggctttattgatgtgtaattcatctactgtacaattcacctgtttagattgtacaattcagtgttttatagtatattcacagggttgtgtagccattattacggtcggtttttaaacatctttattaccccaataagatatcctagacctattagcagtattaaagcaaaataggtagtaggtagcctggggttgtttctacacctggaaatgaaaccaacctttagccaatcacaaacagccagccagcctatttgttatataactagggactttgcataatgccatgcccaagtaaggcaaacacctagctgtagccaatcagctgattcctttgctttgctttgctttgtgttcagcctgtaaaagctggctgttcaaggtgctagatcagagatctctgaacttgcggttttgagtaccacttggttcatgaatcattctttgctcaaataaactctgttaaatttattttgtctaaagttttccatttaacaacagtctctcccaaccctaggcaaccactaatctattttctctatatatataatttgcctattctggacatttcatataaatgggatcacttaataggtgatcttttatgactggcttctttcacttagtatcatattttcaaggttcatccatgctatagcatgtgttagtactccatttttaattgcagagcaatattgtatggatataccacattttgtttatctattagttgatggacatttgagctgctcctgtttggtggctattatgaataatgctactgtgaacatttgtgtacaagttttcaggtggacatatattctcatttctcttgagtttatacctaggaatggaattgctgggtaatacgtttaacattttgaggaactgctatactgttttccaaaccagctgcacattttacattctgccagcactatatgagaattctaattgctttgtggtcttgccaacatttattacccttaactatttaattagggatccaaaaaactggaatttccactggacattgatggaaagaccaagttctaggaaagttagtatagtgagagtgttatatattatcctcaccctaggagcgtttttgtcagcttccactaatttgtttttattgaggaagagtctgcagagtgtatgttgggaggcattccatggcagcgtttgtaaatttcctgttaaagaagattaataaagccttcaatagatcccaggaagttggatttttagtttttactactagacacagcattctgcctgcttatgatatatactttctatgctttttgttttggtttatattagatgtttcaaagaactcaaatgttaatagaataatttataaaattaccacatggttgtctctctcagccagatatttatcaacatttatggggatgactgagattttaaaagttcacctgagatgagtatgtcagacaaaatcatttagcctttgttccataatattttaaatctgacattttttcagactataatctgccacatgactgtcttgtatgatcttctttggataatagtttctttttttttttttttttgagatggagcctcgctctgttgcccaggctggagtgcagtggcacaatctcggcttactgcaacctccatcccaggttcaagtgattctcctgcctcagcctcagagtagctgggattacaggcatgtgccatcacacccagctgattttttgtatttttagtagagatgggtttcaccatgttaacccggatggtctggatctcctgacctcatgatccgccctcctcggcctcccaaagtgctgggattacaggcgtgagccaccatgcctgaccggataatagtttcttaattaagaaatgagaaacgtacctaataaaaaaaaatgttgtgaagtttcagagtggcagaatcacaccaccccgaagagccccttcaccagatggcttctcaccatatagccctgaggaaacaaaccgccgtgttaacaaagtgatgcgggccagactgtacttactgcagcagatagggcctaactctttcctgattggaggagacagcccagacaataaataccgggtgtttattgggcctcaggtaggattcgtcaccattttatactttattagtagtagtatatggtactacctcaaatttatatactataatgttcttaaatttagatcaattaattccctatagtaaacaaagttaaacttaaaatgtattttaggctaatatttttctttaatgtatttatgaggttttactatcttaatataccatagaatagaaatttgatctatttaataaattcagtgaaaatgaaagattaaatcatggaaatagctgtagatttttcttatatacaaagataatgaagaatatgaattaatagaaactttagtataaaaagttggaaatattgtaaaagtgataaatttagaagttcttgtgaaccacagatgtattaacctataggttttctttttaactctttagaactgcagctgtgcacgtggaacattctgtattcatctgctatttgtgatgctccgggtgtttcaactagaaccttcagacccaatgttatggagaaaaactttaaagaattttgaggtagtttttaataaatgcttagagtaaaattgttagcatattcttaggatatattcttaaaatttatccttcactaaatttaggcagtgaccattttaaaggtgtgaaggtatgtaagaattagttgatgcttataaatagttctcatgagatatttactaaactttttcttctagcttgaaaaaaacaaacactgacctgctgtaagaatgttgtccttagtaaaaactataatgtgttcttatttttgaagctcttaaatcaactttatgaaaaacatgcaaattaaagataaataattcagcctctagaactcttcatatgtataattatggcacaaatatcattgttactgtctttttccaatgttaggttgagagtttgttccagaaatatcacagtaggcgtagctcaaggatcaaagctccatctcgtaacaccatccagaagtttgtttcacgcatgtcaaattctcatacattgtcatcatctagtacttctacgtctagttcagaaaacaggttagtactttttaaggatttcaaacattaatccagtgttacttttaattttaggggtaattttttatatctacttgttaagttgctctaaaatgatttaattattgaatcttggctttcaagttaaaatcaagggtgaagatactaaaagttcgctgggcatggtggctcgtgcctgtaatcccagcaccttgggagactaaggcagaaggattgcttgagcccaggagttcaagaccagcctgggcaacatagggataccccaactctacagaagtaaaataattagctgggagtggtgatacctgtagtcccagttactcgagaggccaaggcaggaggatcgcttgaacccaggagttcaagtctccagtgacctatgatcgcaccactgcctaggtgacagaacaagaccctgtctcttaaaaaatatgtgggtgtgtgtatgtatgtatgtctgtatgtatgtatgtatgttaaaggtcatgtgagtgtgtgtgtgtatatagacgttttgtgctaaaaactacagcattcatgtgaatcttctttctgttctgtatattgctttattggttttagtgtaaaaattagatttttaaaaattaatccacaaaggagtgctgcttctcttaccagggcaccttctatgttattcccgaagtgcccagtttgagaagcattgttctgagtggttaaatcctgtcttcatcctattaatctgttaagtattgtaactacctcaaaattcatgaagaatgaaaaagtgacagggtcgtaacaagggtgcagtgaagagaagagaggttttcttcatctgtggaaaaagtaaatgtttgaagaattttcttaattttgattaaatgaaataattttagaatcctagagttttacgagtttttagacattgaagattttctagttggcatgtctcagtgacacagcgataagtgaagccaagaggttatgcagctcatttgaggaaaggtatagccagaacctgggtatctttgttttacccctcatctcttctaaataaaatgaaaaaaatgagctttatttctccagcctcctgaactcctagccccaagcattcctcccacctcagcgtcccaaagtgctgggattacaagtgtgaaccaccacacccagctcctttttccttttgagtgacatttctgtaactttttactgtggagaaaaataacagatgcttaaaaccaagtagtcaaaatagaaagtttctctctgaggttaaatatatatatttggatttgcatatccatggggggaatcacaaaagttatcttggttactgagattgtactgtacatacatagatagatttttgtttcgtataaccactatttttatatctaagatcaataaaaagaaaatacagaggaaatttatctggaggtctgattacatacaattttaaatgttatgcccaaaacaataataaaagaattaggataaacaaatttaaaattcaattgaaaatgaagggcataaagagaatatccaccaaaaaagaattttaaggggctaagaaacacaaaaactgttcagtcaacctaataaccgaagaaatgttcattttttaaaaaaagataccagtttttatttaccgaaataatgaagactttttaaatgatgtaattcagttattgtaagcatgtgcttgatcgtatgtaaagccgtatagccttttgaagaaaaaaggaatatggcttttaaaaacatttatattcattgatccagtaaatgttcttcttaagtaaaagtttaatctgagaaatgcaaaagcctcacatatatcatatatgactgtttctcatagtattatggtgaaaaagtagaaacagtttaaatatccaacagcaattgaatgattaaattagcatatgcccatgttacaaatgtcatgtaggcattaaaattatgcttttggagaacgttgaatggcctgggaaaatgtcgataagtaaaaccaaatctaggttataataatatattatgcatgaacccagttttatatagaaaaggtattacaagtatgtaaaaatcggaaggaataaaaacttcactggttattaataggaggtgctattatgggtaactttttttaaactttaaatattttgtggtccatttggtctcttttaaaactactcagctctgcccttatatcctgaaaatagccaaagacgatatataaatgaacgggatggctatgttcagtaaaactgtatttacacaagtagtccacaggctgatttgttttccttataagttcattactccctgctctatacttgtaattttgcttcagaaaaaactatgctaaaaaaaatctgaaacgtcaaaaaaaaatgagtacaaagatgtttgtaatggtttctttctttcttttctctttttttagacggagtctctctctgtcacccaggctggagtgcagtggcgtgatcttggctcactgcaagctctgcctcccgggttcatgccattctcctgcctcagcctcccgagtagctgggattacaggcgcctgccaccatgcccagctaattttttgtatttttagtagtgacagggtttcaccatgttaaccaggatagtctcgatctcctgacctcatgatctgcccgtctcagcctcccaaagtgctgggattacaggcgtgagccaccgcgcccggccgtaatggtttcttaaaatgtaaaaatatggaaacagcttatatgtccaacattaatggatacttaaaacaggatctatctagtcagtggaaaattatgatggcattaaaaattatgtggtggaagcaacccaggtgtccatcaataaatgaatggataaaatgtggtatatacacatagtggaatattactcagctttacaaaggaaggaagtgtgctacaacatggatgaacctttaggacattattctaagcaaaataagccagtcacaaaaagacaaatattgtataattgcacttacatgagatacttagtcaaaaccatagagacagaaagtagaatgagcctaggtgggaggatatgttgaccagcctgggcaacatagtgtgaccctgtctgtaccaaaaaaaaaaaagagaaaagaaagaaaagaaaaattagccaggcatgggtggcatgcccctgtggtcccagctactcaggaggctgaggcaggaggatctcttgagcccagaagttcaaggctgcagtgagctatacttgtgccgctgtactacagtctgggtgacagagcaagaacctgtctcaaaaaaatgtagaatggtggttgccagaggctggaggaaggagatcatggaaaatggtgtttaatgggtatagggtttcagttttacaagatgaaaaggatactggagacacatagtggtgatggttgcacagcgtgaaggcatttaataccactcacgtgtacacttaaaaatggttaagatggtaaattttatgttttgcatatgttgccacaacaaaaaaaagaattatgtatatgaagagtttaagtgcaattttataataaaaatttttaaaatatgaaatagtgcatatatatacataaatgatctgaacaatgcttacaaaatatgtacttggaaaaaagatgggcaggaaataccccggaatggtattctttttgttgtcagagaagtatttaataagttgcacttataatttgactaaattgtgaaactttattttcctctatgaataagcttaattttggtataattatttgaagggttagttgaccttggattatttttgccatgaatatttttattataggtagttgtatacatcatttctgtaatgctgctgttaattctttgttactaatgcatgcatagtcttgacagtttttccccatcctaagtagctccataattaggaaaagagatgggcaggtacatcaggagggacagactagtaagtgtgccttcatcacaggaatcacgcattatgactttgctgacttgtttgactagctttttggaaagctttttgtgcatttggggaactggttattttgctggtagttactcagatctgtttttcagggaaaagtagttactgtttttgccattacttctaatggcaaaattagaattaaaaaaattagaagtaatggcaaaaaccgcaattacttttgcaccaacctaatagtttaagatagtagaagtgcaatattgggcctagcttagcagactctgaaatttatagatgttgtaagtttatggcatattcttctcagataaaagtgtaatgatagatctgccacaaactgattttatgatttgaggcaacttatttaacatcccagagccttgtctttatattataatgaaaatacggctattgattttaaaagccatccctcacatcatgaaggtttaaataaaaacatttatgaaatagaaaactaaagccctctttagcctggctgcacacaaaataactactgttaactatttcatacaacttttaaaaattacataaatcaaggaatgaaactcttctttgcacacttcgtacttcagcaaacacatgcacgcacgttcccccatccatgtttctctcaactttcttactgtttttaaacaaatacaaagtcatgccatatgttctggtgtgcagttttcttttacttttactttatatatcaagaatatttttccacatcatcaccaaattacatacttttttcttttcatggctgtataagattatgttggtacaccataatttatttagccattgccttaattaatgtacattaagtacatctccactttttggtttacatacttaaaatatgtagcgataacatcctagaaaataggatttttaggtcatgaatatataccatgtagtattttaagaaatactaacaaaatttccttccagagattttagtttttactcctaccagcagtctatatgagaacctggttttctgtgccattatcagggccagatgttaccaatctattattttttattccaattgcctttttatttcctttgtccattgtactatttattagtatttttctaactgatttttaaaagtactttgtatgttagaaatactcaagtatatgcaatataattaaccattatgttgcgattttgccataaatggaatcatcctatacatggtagttttattttgacctcatttatggatttctctgttcctttttaaaggcttcaaggtgtctgggtttgccataatttgtttagcctctttttggcattcatttggttgttttgatttcttttcgttattctaaataatattgcagtggacattttcatacatatatctctatatatttatctttttattttcttacgatacattcctagaagtctaggtgaaagattgtgtacacttaaaatgtgatgtgttcctagattcatttctgggaaagttggatcagttcatactgccaccagaaatttctgaaataggcatttaaatttaggatgtggaatctttgagctctaaggtccgccagtacttaaaatcttgaaactggtaccatgtagtgtatttttatacatagtcaaacctgttggtctattcaaaaggtacagtagcagaatttgggggatacaaatgtttctttctaagattgcagtctgtgtattgaattgttttcatagcaaagaaggttaactcacacctacaatctataaatactcgtgtgttaatctgattttaaattactgtatattaatagtgtaaatatgtatctcttagttatataagatgctcttaagaatttctaatgtatttatattctaagcaagcagaaagtgtttttagcatatccgttctactttatattcttttatgcttaatactttttcttccccttttctatagcataaaggatgaagaggaacagatgtgtcctatttgcttgttgggcatgcttgatgaagaaagtcttacagtgtgtgaagacggctgcaggaacaagctgcaccaccactgcatgtcaatttgtatgtggctctttttctccctatgcttactcaacacagttgctctctgagctaactatgttatttaagagtgtaacatggcttgaggggaaattggtgagagaataaaaaaagtatatctaagtcctaagtcctatgtgaaaagttttcaacaaatgggaatgtaggatctttaggagatgacctgtgtgagcaaagaaatgcaataaagtgtgtgtgacatatgtgataatggaagaagtgcacagaattagaaacaatttcaatctggaaggtatacatgaagggaaggaggtggaagaagacctgggcaggcattacagaaaggctagcatcaaagtaaggtttggaaggactttacctggtagtcaaacagggcagaatgttttgaaaaatagtaagcagagtacatgttatcagaatgaataaaatagcatttgcaaatcaaaatcatttaacctgctgtgtttacttgctttcagataaacatttaattagattatttttgaggttccttctatataaattctataattataaacagttatgaaataaaaataatgttaaacatttacatttttgtaagattttgtttctgtaatttttcaggggcagaagagtgtagaagaaatagagaacctttaatatgtcccctttgtagatctaagtggagatctcatgatttctacaggtaataattttgaaatgatacggatatgtttaatttttaaaaatttctcagtgtggtttgtcttaatttttttaaagcaagttttgttatttttcattttagccacgagttgtcaagtcctgtggattccccttcttccctcagagctgcacagcagcaaaccgtacagcagcagcctttggctggatcacgaaggaatcaagagagcaattttaaccttactcattatggaactcagcaaatccctcctgcttacaaagatttagctgagccatggattcaggtaagtagttctttgtttttcatttctcaaagaaatatttatagatcaattaatgtatttgtctccttccctcagttgttcataatttaaaaaaacacttttacttgcctccatcatgaccttcattccactggaaattttaatgttacttttggtattaatactatactgcttattgtacagcttcaacttcaaaacttcttgtggtttcacttcacatatctagaaacatctcttcctgaactaacggacatacggggttattcaaggatagaaggatagaaaccagaacccttcaatgctaacttttcccaatgtttaatccccgtgcctgccaagaatttttatcatgtttcttatttgctgccatttaaaattaatttctcttttcatatcctaatggcatacaatgggtgcttaataattgcagaggagatgaataagaaaaaaatatgtgatggttaccttgagttcatcatttttatttgtaagaacagtttcccatccctttaccatctcttctgattgaatgttttttcatcctcagtaagtagggcttttttgtcagttggtttgtaatgattttcttggttgttgaatgctcagtctattattttttaaatgtaggatctaaaaccagacgggtctccagtagacaataataaagtaaaataattattttcaataatctgttaaattctgttgaattaaatttgtgaacaggtgcattaacacattgagcttatatatcattaggatttgttacatttttcttttgtgaccattacagtcctgcagctttggaattctcttagcatattagcaacccatttatgaatctaataaaatctgcaaaaatattaaacacattcttgtacctagttcattaatgaaatttaatgaactattaatgaacataggccctcacctgccctttcatgacccatcaaagaactctcaagttgattctgagctgttagagttcattctttcaagcatatggtctagtttgttttgcctaagctttaggtcagactaggctctacattcctagctttttattaagcatgttaggtaagacagttaaaacataggtagtggtacactacttaacagtaccagaagctcactatattctagttggttcattctcccataatatccctttataacaaaacatatgtaaataagtatgttatgatctgtttttcaaaagttgtgtttattcatctttaatatttaggcatttttcacataatgaattatcttaggtattaagcttacttttagctaattggcccataatgtcaagaccattcaccctttcctcactgtagggactctggcttttggggcatggtattgacgacgataacagcatatactataattctacgtctacatttatcctttgcttactcgaacacaagcattttttcttcagttgtttgatttgtccactccattcgttttacagtcctacctgttttgtctagttttttaaacctttttatacagacaaaaaccaattaaatgtgttttgcttattgctcttgtctgtaagagaaatactctatatctcttgaaaccttctcctggtgctttttttgatttgttttttgtttgtttgtttgttttcttaatcttgctccagtttttctctttaaactaccttaatatgaatacagagttgaggttttcacagttttttggcgttttggtaagcatgtgggacagtagaggcatagaatgtatgtatagccatctagtgacttaatggagcttattattaattttacctgagctaataaatattaatgactttggataattatcagttaaacttgagtataaaattcttccttatgatgcttaagtggctggatatatttgaagttgtgaaggatggtaaagatttcagaaatgtccagtttttacgtagtaatcaaaaatgatgctaaactcaaaatgctctgggtccataagcttttctttacattgaattcatcgtgtgtgtttgatacaggtgtttggaatggaactcgttggctgcttattttctagaaactggaatgtgagagagatggccctcaggcgtctttcccatgatgtcagtggggccctgctgttggcaaatggggagagcactggaaattctgggggcagcagtggaagcagcccgagtgggggagccaccagtgggtcttcccagaccagtatctcaggagatgtggtggaggcatgctgcagcgttctgtcaatggtctgtgctgaccctgtctacaaagtgtacgttgctgctttagtaagtagctttattccataatcatatcattatgggtttggggttttttgatggttcgtagatagtgtttttaagatacaataaagctactttacctaattttggaaaatccaaattttatttttattccataattccaggaaattacagcttttgttttgtttatttgaattttactgatttttatgatgtccaaggtttcttatataactgttttactttttagtttcattgttttaaaggctttgcaggggtatccaagggagagaatatagtcatggtttcttagtttctgtttgggccagtaaagctccttcctcatcctccttttccacttaccactagagacagactaaaaaccatggcttcaggctgctaaagcctaaaacaaaacaaaacaaaacagaacaacaacaaatagggtgagctagacaagcttgctaatttttaaagatttttttaatgtcttgctgttcatatctgtacatttttctgagcagataccttatacatgaccaaattaaaaatgctttttgggatggcagagtcatcaacgttattctgattttttaaaaaatttatcagatattaaggaagatatgtttttaataaacattttgattgatttttaataaacattgtcatgtggagattcaaaagccttttcaaagaaaagggttccatgacatagatcattgagttgttttccagtttaacctgttaaaagttctttcatgggtggaatagagtgacaaggaggtaatttaggagactaactggactttctccattctgcgtatatgtctctttagggcttctcagcctcagtactattaacatttgttagataattatttgttggagggtggggggagggccagggatgttgtcatgtgtgtactgtggcagcatctctggcctctacccattagataccaggagcaaacccacccccacccgatcatgcccccagttatgacaaccaagaatgtctccaggcattgccaaatgtctccagtggtcaaaactgcccccaattcagaatcactactttaattcttatctagtctgttcttaaaattcatgagcagtctgtaggcttcctccctcagtctttttctaatgcatcctctaccgattgggcctaatgaatcttcttgacaggtaatacagcatgacagttacgaacatgggtttggagtcacaattgagtgatctcataatttatcattccaaccacaatgcttgcataatgtgctggttaaagttggactagcctaggcaatctgaacacatgatcaagatcatagagacagacctggattcaaattctggttctcccttttactagcacgatggctttatgaaggttacttaacctctcttaaataaacttcagttttctcacccataaaataatgaaaataccttttaggtttgaaattagattatgtagaaactttcaaccatatgcctggcacattgtaagaacatttaatattatataatagttatcattatttcttaaacacaacttggattatcccccaaatcatttagaaacctttagaggtttctgtttctttgacattcctaaagcatattctgtggaagtttggcagggttgtgaaaagttccctgaagaaagaatcccgtattcagttaagattggtgaacactggattacacaaggataactaggtctgttgactgaaaggcttctaggatccttcagtaagctaatgtacattgtgaacctaaaggatcaaaggatagaatgcattgtttcccagagttattttgctacaccttgttttttcatgtagcatctggagggaccagcatactatagaataaagaccaattggcccaatattttgcctcttacttagtattttccaacacaaaccttcaggcatacttgactaaataaaatcctctttttgctagttccttttctgcaaagcctttgctgtgttactctttttgtacacaccgtaactgccttactgttgtggttgtttcttcttaagttcagactgtttcccaactagcttatgagatcctagagcacaaagattgtataaaggataccaggctccatggaggcagaaatggctcctgctgttaaggctcaccctttccctttctcttatctccccttcctctgtctcttcctttttttcctctccctccctctgcatatataatttttttttttttttttgctgaatcgtttgagagttttttgcagcatcatgacacttaaatatgtgtctcttaaaaccaaatacataattccatttattcttccatatacagtcagcacattaacattaatcacaatactgttttgtactataaagttcatactcaaatctcttcagttgcccaacagtgcccttcatagctaaactgcagactttattcagatttcaccagtttttctgctgttgtcttttttctgttccaggatccaatccaggatcccacagtgcatttagtcaccatgtccccttaatgtcttctcatccatgacagttcctcagcctttcctggtttttaatgaccttgacagatactttcaaagtttactggccagttattttgtagaatatccctcaatttgggtttatctgatgttttctcatgattagatggaagttacgtatttttcacaagaacgccacagaggtgacaggcctttcttagtgcatcatatcagtgggtacatatgcccatggcttttattattggtgatgctgtcagttaaggtaatgtctaccaagtttccctgctgtaaagttaatattcctaaatatcttgtgagagttactttgagattatgcaaataccctatttcacctcaaaattttgtccactgattttaaaagcatttgtggatcttgcctatagcagttattactacaccattaaaaatggtgctctcttgggcacagggaggggagcatcacacactggagtctgtcgggggtcgggaggtagaggagggatagcattacaagaaatacctaatgtagatgacgggtcgatggatgcagcaaaccaccatggcatgtgtgtacctatgtaacaaacctgcacgttctgcacatgtaccccacaactaaagtataatttaaaaaatggtgttctagtggtgattttctattttcctcattccttctacattaattaattggaattattctataaagaagagcttctctgtttatatacctattcaatttttaatttgtattggtgtaggctcctgggtattcattttgttctgtgggttgcaacccagtactaccatcatttgttttgttgctctaattattccagccttgaccattgggagctctttcaggttggcgcctgttctcattttcttttttaaaataattttttttaacttttcatcttgaaatgaattcagacttttaaaaattgcagagaaaagagttcagaaaattccttcctgccccattcatttattttgttagttagttgtattattacagaagcatggaattcttattttattctatgggttataatccattcctgtctacttattttgttgctcaaattgtctcaaattaggccattatctctgatgctttttaagtgtacataaactgaccttcagatttttttccttagaaaacattgagagccatgctggtatatactccttgccacagtttagcggaaagaatcaaacttcagagacttctccagccagttgtagacaccatcctagtcaaatgtgcagatgccaataggtaaggctttattgatgaatcacttcaaaccctcttgtcttaaaagtgcctcgcagcaagcctcacacctagtgtgaatatctgatacattttattaaatgagtctttgaacattgtcttttaatgtgagatttaaaatgaaaatgcagcataaagctcttaaggactggcggaaagaactactggcaagtaaaagccaggcaaacaaactgcatggatctccacattattgtattgtgatttactctctttagtaacattcataatctgaagaccagtcgataagaacagtagttgacatttatatctataagttataatctcatattagagtatgggttacacagaataggaaccagtaagatcattacacctgcatatgccttattatcaggataaaaaattaacaaatccatctcattttcagtgtagtggaattttactctacttatgacagttttgtcaaaaaatttttagattttttatattcctgcaatatccttaaaaattgacagggaacaagaataaccctaactggaaagaaaaatatgaagtagagaattgaggtacaatgacagtaaagatgagtacaagccatgcttttttcagaccaatggttctcttttattttccccttccataaaataggaggaaaagatcaattttcatttaataatcacagctactgtgaacagttatttggtagttcctatttctttctatcccagcagatcttggttagcaagaagtgttgaatctcccttctgttgcctcttccatttcacccatttagagttctctcagtacaacctttctcttcctctgcaagtcataatgacttagtttgcacaggatctcaaaaattaggtacctacctttaacgaatttctcatatcatgaagtctgtcttttgcctctattgttttctctatagattgaaaatattggatgtttccttgttgcttagagaaaacattgtatatctgtaaaatattgcaaattaacaagtaatttgcaaaatgcataggaaaaatgtcatttttaaatattagaataggtatatttctgagaattcagtgttctcatggtatttgttatgctgctcactttttgaaactccaaacttaggttgtttacctggtcacctgaatgactgaacataagaaatactgtagagagattttataatattcagacctcattttggctatgtaaggaaatggagggtttttggataggaaggttttgtttttaattcaagagcttcttagtgaaagttcagaaatcaaaatatcaaggtccttgttttttcttttaacaaaatataagacttttatctgatttggtatttaaatcagtacttgcaaagagccattgttgaaaattctgtgcttaacataggggatatgttaaatttacgaaattagacctaataaatgaatattactacttatggtgacattgttaatatgattttagtggtggaaaagtaaacactcctgaaaacattatttctccactttttcacaaggcattacattactcctctaatattgtatagtgttttagccaagatccaggattgatgttgcttttcctttgtttttagccgcacaagtcagctgtccatatcaacactgttggaactgtgcaaaggccaagcaggagagttggcagttggcagagaaatactaaaagctggtaataacttttcacttaaaaggaatatagcatattttatcatgttcctgagcagccttgtctaatctcataatctctcatgaggcagtttacaggattttgaagtaattttataaattgattcactgtgttacagttagaaatgtgaattactctgagagagaaattctttaaaatagttcagaatatttttgttggccttacaccatttaatcatgtcttgttttagattttaatatcactattttttaatcatttatttttactttcctttttgtaggatccattggtattggtggtgttgattatgtcttaaattgtattcttggaaaccaaactgaatcaaacaattggcaagaacttcttggccgcctttgtcttatagatagactgttgttggaatttcctgctgaattttatcctcatattgtcagtactgatgtttcacaagctgagcctgttgaaatcaggtaatttttcttctgaaaatgtattacttgtatcttcctaccctccctacaccctcctcaagaatgacacattttagatttttgaaagactcagagcatgaataggttgctgataccttaatatttgattgacatatgaaaacccaaagtctgggctctttaattaaaaattcatagatactttatgctgaaatggtttttgaagtatacatgctgtaaattactaccattttttaagtttccatgtatttttcagtaattggaacttatatggtaatgaatgtttttttctttcaggtataagaagctgctgtccctcttaacctttgctttgcagtccattgataattcccactcaatggttggcaaactttccagaaggatctacttgagttctgcaagaatggttactacagtaccccatgtgttttcaaaactgttagaaatgctgagtgtttccagttccactcacttcaccaggatgcgtcgccgtttgatggctattgcagatgaggtggaaattgccgaagccatccagttgggcgtagaagacactttggatggtcaacaggacagcttcttgcaggcatctgttcccaacaactatctggaaaccacagagaacagttcccctgagtgcacagtccatttagagaaaactggaaaaggattatgtgctacaaaattgagtgccagttcagaggacatttctgagagactggccagcatttcagtaggaccttctagttcaacaacaacaacaacaacaacaacagagcaaccaaagccaatggttcaaacaaaaggcagaccccacagtcagtgtttgaactcctctcctttatctcatcattcccaattaatgtttccagccttgtcaaccccttcttcttctaccccatctgtaccagctggcactgcaacagatgtctctaagcatagacttcagggattcattccctgcagaataccttctgcatctcctcaaacacagcgcaagttttctctacaattccacagaaactgtcctgaaaacaaagactcagataaactttccccagtctttactcagtcaagacccttgccctccagtaacatacacaggccaaagccatctagacctaccccaggtaatacaagtaaacagggagatccctcaaaaaatagcatgacacttgatctgaacagtagttccaaatgtgatgacagctttggctgtagcagcaatagtagtaatgctgttatacccagtgacgagacagtgttcaccccagtagaggagaaatgcagattagatgtcaatacagagctcaactccagtattgaggaccttcttgaagcatctatgccttcaagtgatacaacagtaacttttaagtcagaagttgctgtcctgtctcctgaaaaggctgaaaatgatgatacctacaaagatgatgtgaatcataatcaaaagtgcaaagagaagatggaagctgaagaagaagaagctttagcaattgccatggcaatgtcagcgtctcaggatgccctccccatagttcctcagctgcaggttgaaaatggagaagatatcatcattattcaacaggatgtaagtatagattctttaagaggttagaaaacttccttggggctgggcacagtgactcatacctggaattccagcacttggggaggctgaggccgaaggattgcttgagcacaggagttcgaaactagcctggtcaacaaagcaagaccctgtctctacaaaaaattttaaaaattagccaggcatgatagtgtacacctggggtcccagctactcaggaagctgaggtggggagggtcacttgaacctgggagtttgaggctacagtgagctgtgattacaccattgtactctagcctgaatgacagagcaagacactgtctcacagagagcttccttggaccatactaaaataaacctaattcagaaatgctgcttctaacattcagaagcagagttttccacataaaattattacttatacaacaataatgtttgtactgtttaaacagcaataattcttgcctatgggcatttccggttaattgtataatggtgattacttttgcatttgctgtcggtcacaaataccttccattcagaggtcacatttataggtggtttgggaagccagactgaataagaataatatcttgcagactaatttcacaaaatcttactcctttaacagtaaaaagattgctttcgtttaatatgtagacaccagagactctaccaggacataccaaagcaaaacaaccgtatagagaagacactgaatggctgaaaggtcaacagataggccttggagcattttcttcttgttatcaggctcaagatgtgggaactggaactttaatggctgttaaacaggtaaatatctagtgagcatataaatgaaatgactcaaatcacaaaatgaagcatgttcagtaaaaagaataaaggatatgtccacgtgtgtgtactttagttctttaaactttgagaaacttagtttcaaagtagatgtttctaaagcaccagaaacatcatgaattctgttattgttaaaagttgaggccacgcgtggtggctcacacctgtaatcccagcactttgggaggccaaggtggttggatcatttgaggccaggagttcaagaccagcctggccagcatggtgaaaccctacctctactaaaaatacaaaaatcggccgggcagggtggtaggcacctgtagtcccagctactcaggaggctgagacagaagaattgcttgaactcaggaggtagaggttgcagtgagccgagatcgcaccactgtactccagcctgagcaacagagcaagactgtctcaaaaaaaaataaataaaagttgaagtatgattattgtaagactacaatatcaagatgggccttacaaaggtttttttggttttgctttttgtaggtagtagaggtggttttcaggtacttctttcaacagtgtacttgtgcggtgccatcttggggtttcagtggtttactttttattataacgagcatacttaatcaggataggaaaattattaaactttcatttttaaatcatgttgattcttctcccatatttgggcttttctcatctttactctgagactattggaatattgactatatcccaatatttttgtcatttttctgatgtttactgctgcttaagctagattcttagtgtttaaaagagtttgacttgggtttgtttaaagtacattgcatccataagcataaatgccatctgttgctaataaagtgctagtttgcatttgttcattttagatcagattgctagtgaaaatatgcaaaactttgtgaacgtgtttatttgaaacaggtgacttatgtcagaaacacatcttctgagcaagaagaagtagtagaagcactaagagaagagataagaatgatgagccatctgaatcatccaaacatcattaggatgttgggagccacgtgtgagaagagcaattacaatctcttcattgaatggatggcaggtatgttaatgttttaaattacaaaatagtagtacgtggatttaactttctgcaatttaggaaaaaccagtttaattaaaatttatttctatcaaatagtttgggtttctaaaaacaaatcaccccaatatattagtatgaaccacaaatacttcgttttgtatttcatttactataaatgaaatattgactacctctaccttttaaatttttccagtgtgtttttaaatgattgtgtagcattgttgtttttaatacttgatatgtataagatatgtatatttccaggtagccatgataaattggacagatgaggaagtgttttaacataacaatatacaaacaaaattaacatataacttgaaaacttactacaagtaaactagcactgaagcataaagttgaaccttgtcatctgctgaaataaatgaagactgagttttattttgtattatacaatgtatacaataaaattaatgacctgatgtgatgaacagattgtttggtttaacttcttagatttgtgtgtgtatttaagagtgcatttctctttaccagtcagttcttaagtatgttatctgttggttggtcttaataaagatttacactacagtagataggttgactactataaacacttttaaaagcggctaaatttgagacatgttccaggtcagagctagtaaatggtagaatatgacgcctaactctgggttttctgttcctcctcccattctttccaccttttactacataatatgttaacattgtttactttagtcattaataaagttgttttgtgtattttgagaagacagagaattgaattgtacatttcagaaatagtttaatccgaaattgttaacttttacagctttctgaaatcttgactctccaataaactggtttccctgtgggttctgtgaaaatgtctcctaattagtaggtttttgagatgatacaggaatatgttagttttgaaatgtttttcttctgtttcagatgtgaatgtgagttcatgcagtgaaaactttagaaaccaaagtgtaataaatacttttaattctgtcttaagtttatgataattatttctattgtcttatagggggatcggtggctcatttgctgagtaaatatggagccttcaaagaatcagtagttattaactacactgaacagttactccgtggcctttcgtatctccatgaaaaccaaatcattcacagagatgtcaaaggtgagaattcttctaattattatctagtgacaataaaaaaattaattttaaaatttggggccaggcacagtggctcacacctgtaatcccagtactttgggaggtgaaggcaggtggatcacttgaggtcaggagctcgagaccagccaggccaacatggtgaaaccctgtctctactaaaaatacaaaaattaacagggtaaggtggcgcatgcctgtaatcctggctatttgggaggctgagacaggagaattgcttgaacccggaaggcagaggttgaagtgagctgagatcacaccactgcactctagcctgggtgacagagtgagactctgtctcaaagaagaacaaaaaaatggacctttgttgatagtttctaacagtgggatttttttctctgagtaattcagaatattagaactgaaatgagccttagggatcatttaatctgccttcctcgtttaatagaaaagtacattgaatacaagagaggctgtgccttttctacagttttattgctagttaatggcagaaagtatacaacacaggtctccagattccctgtcttggcctcatgatacgctgactcccagaaagttccttttcctggttttattttgaataattgggatattgggatatcatcaacttcttttaagaaaaattccttcaaatcctttgtaggtcccattattttccttatccttttcttttttttggagacaggttctctgtcactcaggctggagtgtagtgttgcaaacttggcacactgtaactcatttcctgggctcaagtgatcctcccacctcagcctcccaagtagctaggacaacaggtgtgcaccaccatgcctggctaattttttatattttttgtagagatggggttttgccatgttgcccccaggctggtcttgaactcctgggctcaagcgacccgcttgcctcagcctcccacagtgctgagattacaggcgtcagccaccgtacctggcctcagtttatttttctcaagagcaaatttggttttctgtcattagtctttttagctagtatttgacataatgtgttgaagtaattttataactttttaaattaagctctaattatgaatttagcgtacgctagagagagctgtgtgcctttagcaagaatgaagtgaaaggaaaagagaataactgtttgcacctctgacatgtagttcacttctttcttttgtcattgtcctagttcattagtattgtactgggcttttatctgtccttatttttgtttttaacatacaaggtcatttgctgtgtttgttgacaggtgccaatttgctaattgacagcactggtcagagactaagaattgcagattttggagctgcagccaggttggcatcaaaaggaactggtgcaggagagtttcagggacaattactggggacaattgcatttatggcacctgaggtgagaagcatctttgagtgtgatgacagaaaatattttggaattctgtgtaacagcattatactaaattatcttgcagtggtatccagtatgtacttaccaactagaagtccgtggcccttaaaatacggttttaataatatctttcagacccttattctcgacctttctttgccttggcaatattcaaaaaacaggttttaatagatttacttaacggctgttactaataaagaattctggggtaatttatagcagttgttttgtaataaactcaaagtgcacataagaaatttttaaaaatattctctctctattctaaaaggagatgagcatacagaggcagctcctgtctgtagtggaaggagtttaagcattgttcttctgactcagcttcttctgtcgtgttcataattcttcatgttcatatgtagtaatgatctgttgtcctcttgccacatagtttgctaagagcaaaattctgtgatgggactctgcttcagaatctcacaattctccaaaatatttttgtgctacctggaaaattaagctcattaatgaaataaattagatattaggtagtccacagaattcctgtttgtaccagttttctccctaaagtaaggaagtagaatctataactacaaaatggccttctctttttcaaatgagtcctatttccaaattaactctgatttattttaggtactaagaggtcaacagtatggaaggagctgtgatgtatggagtgttggctgtgctattatagaaatggcttgtgcaaaaccaccatggaatgcagaaaaacactccaatcatcttgctttgatatttaaggtaattgtgagataaaaattacttctttgtgctaaaaggagtacagcagaatttggcaggaggcaaattttgatgggttctccctaacaatctagcatgaaggtaaataaatagtctgtatatttattcagagaggatttgatatacaagttttttactttaagatggtgcaaaagcaatacaaatttggtaaaaaccatactttgaattttgatttttgtctgagctagcaatatgtgctatgatacactggtgatgctaggcagtggcagcgagtcacagctcccagtcagccacacaatcacgagagtgaacaaccaatactctatagtggactgtgttgtcagatgattttgcggaacagtaggctaatgtaggtattataagcacattcaaggtaggccagactaagctataatgtttggcaggttaggtgtattaactgcattttcaacttaaaaaaatatcatcaacttaaaaggggtttatcacgacataacctcagcgtaagttgaagagcatctgtgtatgtgtgtatttccaggagttgatattgtcaatggtgttgtcaatgttagtgacatacatagtcacttcttgttatttgaggtagttatgctctgttaagttgctacaaatattgaattagcaaatactaaaacactgcttctagaagaaatatgtagtgtgtttatatgtatatgtatgtgtgtatatatatccatccatcactttaaaaacgtgaaattcatgcattttacataattcaaaaatcttaaaatctaatttaccattttcttttgttcgtttgttttttgtttttgtttttgagacagagtctcgctgcagtgcccaggctggagtgcagtggcacgatctcagctcactatagcctccgcttcccaggttcaggcagttctcctgcctcagcctcccaggtagctgagactacaggcacgcgccaccatgcccagctaatttttgtatttttagtagagatggagtttcaccatattggccaggctggtctcgaactcctgacctcaagcccacctcagcctcccaaagtactgggattacaggcgtgagccaccactcctggcctaatttactattttgtatattttaaaaattcacacccaagtcagttcagtcctgtctgcctttcctacttttttataactcacaaatccattctctccttttccaccatagaataagtaatggttgatattcttagcttttcagtagatgtgatggttgaaatcatgggctttggagtcacactgacctagttttaaaccctggctctaccccttaatggccatgtaatcataggaaaattattttttgtgtctaccctccattttctcacatgtaaaattggtgcaagaaccccatgaagcatgtacttcgtgggattactatgaagataaacaaaattatacctaggccttagtcaagcactcagcccacacagtcagctccacctgccataacctcctccagtgctccccacacttattatataacctcctcagtcacctctctgacaatacctgttttgtattatcacctcatttcctctattctttcagacgtcccatgtccgttctctacgtggttcaaattcttattctctttaaggcccccattttgtgcttctcctgcttgggcaccccctttttactcattccagattctcatagcattttagtacatacttgtttctgacactttgtttcttgtttgctagttatgttcctatcttgctgcctctttcaaactaattctccttgaggtccattcatgtctgattcattttcttcttcccagagtcttatacagaagttgctcaataaatactcatggctaggatcaatttgaaagtttgatgttattttaagagttttgatgagaccctggaaacaattgtaaataattttcaaattggcacagttcatattttaacagatttcattgcattctccttcctaggtagagtttaaagagaattgtactgtaacattttcagtttccttaatttggagtaaatactttgaggtttttggaagcaccccaaagctttctcaaacacttccataccctgtttatggtagtataaattgccatagcacgtttttttagagagtgatttggcaatatctgccagaatttttaatgcacttattctttgactcagctatgcccattgttaggaatttactcaagattacctctagaagtaccaagtgccaagttcaggattattcactctactcaagaaagtaattaaattatccacactatacagaaattaaacgagtatgaagctgttggtgttgatttacaaagtgctacaagatacattaataagtgaaaagagcaaggtatataaagtgatcctggccaagcacagtggctcatgcctgtaatcccagcactttgggaggctgaggcaagaacaaaacttgaacccaggagttggagagcagcctgggcatagcgagaccccatctctaccaaaaaaaaaaaaaaattagctgggcatagtgagacgcacctgtgctccagggtactcaggaggttgaggtgggaggatcgcttgagcccaggaggtcaaagctgcagtgagccatgttcatatcactgcacttcagcctgggtgacagtgagagcgagaccctgtctctaaattaagttttctcttttgtagacattttagaaaatcttaagtctgtgaatatattggccttttttcctccacaaaacacacacagacacacacacaccccccccccccacacacacacacacaaatcatcagtaagttacatttggggaaaagaaggaagagggactttttttgttttgtatttttcctttttgtggtgtgtaagatgtgtatatatcagctgagtatatcatgatacaggatcacagaccttagaggatttttctttatattactttgcattttttaacccaaagcatttatgaaattactggggtagggaaaagagagttttcttgtgattaggagtggataggtgagtttaaagtattcagacttgatattagccctttgtcagatgagtagattgcaaaaattttctcccattctgtaggttgcctgttcactctgatggtagtttcttttgctctgcagaagcgctttagtttaattagatcccatttgtcaattttggcttttgttgccattgcttttggtgttttagacatgaagtccttgcccatgcctatgtcctgaatggtattgcctaggttttcttctagggtttttatggttttaggtctaacatttaagtctttaatccatcttgaatttttttataaggtgtaaggaagggatccagtttcagctttctacatatggctagccagttttcccagaaccatttcttaaatagggaatcatttccccatttcttgtttttgtcaggtttgtcaaagatcagatggttgtagatgtgtgggattatttctgagggccctattctgttccattggtctatatctctgttttggcaccagtaccatgctgttttggttactgtagccttgtagtatagtttgaagtcaggtagcatgatgcctccagctttgttcttttggcttaggattgacttggcaatgtgggctcttttttggttccatatgaacttaagtagttttttccaattctgtgaagaaagtcattggtagcttgatggggacggcattgaatctatgaattaccttgggcagtatggccattttcacgatatcgattcttcctatccatgagcatggaatgttcttccatttgtttgtgtcctcttttatttcattgagcactggtttgtagttcttgaagaggtccttcacatcccttgtaagttggattcctaggtattttattctctttgaagcaattgtgaatgggagttcactcatgatttggctgtttgtctgttattggtgtataagaatgcttgtgatttttgcacattgattttgtatcctgagactttgctgaagttgcttatcagcttaatgaaactgaagaatgctaaagacaagaaggaaccaaagagaaaagacaaattacaagaaaaaaaattgataacaattatatggataacagaatacagcagcaacaagagaattcaaaagacaaattgtaccttctagtgattgaaataaaataacagttaacctaggatttcatagctagctaaatgatcatcaaaaaataagaatgaaatagagatattttcagacacatgagaattgtggaagtttaccttcagcagacactcactgaaaaaaattatttttaggaatgcatttcaagaagaagaaaattgataccacaaatagggagatatgcaagaaagacactatctctgcctggagtcagctctgattcataatgggtgctcaaaaattgttagaaaactaatacttttttttatatatgacttgaaattaaaatatggttattgcagcacaaattttagaatgtaaagagtgtatcacaatttaaaaataattatcagattttgaatttttttagaaaaactacaaataagaccaaataaaatttctttttttttaaaaaaaaagtattcagacttacaatttgtttataaaaaagttattcttcatagtgtatttgatactaagaatcagaatttgtccaacacggaaggaaaaaaacaatgcagttgtgttttctatgtattaaattgactcttcagttttagtctttcttaatctaaatagctctgtatgctgaagaaatagaaaacgtgcagtaagaacaaaccatctcggagattgaatatgaggacagcagaattcatttgagtgaatactttatctacctgaacattttgatgtacttagccttgttgatgtaaataataaggaataggatatatttgatcaaatcctaaaatcctaaaatttgaaagattgttagagaaaacctcccatccagtggatgaattttttcatagactttttgatagcagaaaatcctcccacttctgcttcagttcctctctgttcaggatgtaaatgtaagggttatgaggtctatgcacatgtgtttctgtatcagaagttacagttgtgcaaagcttcaacactggctttttctccacagattgctagtgcaactactgctccatcgatcccttcacatttgtctcctggtttacgagatgtggctcttcgttgtttagaacttcaacctcaggacagacctccatcaagagagctactgaagcatccagtctttcgtactacatggtagccaattatgcagatcaactacagtagaaacaggatgctcaacaagagaaaaaaaacttgtggggaaccacattgatattctactggccatgatgccactgaacagctatgaacgaggccagtggggaacccttacctaagtatgtgattgacaaatcatgatctgtacctaagctcagtatgcaaaagcccaaactagtgcagaaactgtaaactgtgcctttcaaagaactggccctaggtgaacaggaaaacaatgaagtttgcatgactaaattgcagaagcataattttatttttttggagcactttttcagcaatattagcggctgaggggctcaggatctattttaatatttcaattattcttccatttcatatagtgatcacaagcagggggttctgcaattccgttcaaattttttgtcactggctataaaatcagtatctgcctcttttaggtcagagtatgctatgagtagcaatacatacatatatttttaaaagttgatacttctttatgacccacagttgacctttattttcttaaataccagggcagttgtggctcattgtgcattttactgttggcccattcatttcgtttttggaaattatggttttgtattttcatgtttatttacattcatttttgtttattcagggaaagctgatctttttttcaaaccagaaaaaaaaaatgaactagatatgaagtagagttcattaaatatcttgctattgtcagagtttttaaaatatagacttaattttgtttttttaaattggaatacaataaagtactacctacatttgagtcagtcaccactcttattgtgcaggttaagtacaagttaactaaaaataaactgtcctctctggtgcaactcacaaccaagatcaagattaccttaaaatttatttgaattttttagatgttttggttgtcaaactgtaggaaacttcacaacatttaagtcttactctgtatgtaacaatccatcattcaccttcactactggtagtaacatagagctgccattttccttttaccatgcatcatctctttacagtaggcctggcagatcattttttaaaaagattattcaactaccaatcagtaatgtttttaaacagtacatttgctttgaacttggaaaatgtgttcagaaagaaaaatggaattgaatttcatttatacactaattccttggattttgcacagttacctaacggttttagtctggagttaaattcagatgcatggaatcctgaaggaaaatggtagctttttaatctttttgtgtgtgtgtgagtcttttaaatcaagtactgattaactattaagtacaactttgagattttagttttaactcttcagaagccagtgtgaaatagaattggttattctcaaagactcaggataaactaaataagctatatatagagtacatttaaaatgtacaacacaaattggaaataaaataagttacaagataagtttacagggatatattgcttacaatttttaaaaggcagtttgttttttatgtgaatatgtttcttagtgaaattttacattcctttgttttggaagattggcgatatttgaagagttaaaaatagtacagaaatgtgaagtttggtatctctaaatgtgttgtacttgactttcttttttattttgtttttttttttttttgactacttagaattttcacaattctaataagattgtttccaagtctctcatgtgcaagctttaaaggatgcactcttgccattttatgtactggaagatcattggtcagatgaatactgtgtctgacaaaaatgtaaactgtataaactgaggaacctcagctaatcagtattactttgtagatcaccatgcccaccacatttcaaactcaaactatctgtagatttcaaaatccattgtgtttgagtttgtttgcagttccctcagcttgctggtaattgtggtgttttgttttttgttttgttttcaatgcaaatgtgatgtaatattcttattttctttggatcaaagctggactggaaattgtatcgtgtaattatttttgtgttcttaatgttatttggtactcaagttgtaaataacgtctactactgtttattccagtttctactacctcaggtgtcctatagatttttcttctaccaaagttcactttcacaatgaaattatatttgctgtgtgactatgattcctaagatttccagggcttaagggctaacttctattagcaccttactgtgtaagcaaatgttacaaaaaaaaaaaaaaaaaatctctgggttaagaaaatttggcttaaatgtatcctttgttattttaaatatattgagatattttaattaaaatttttaccccattgaaccgattttatagtatttgtacctattttggtgtttttgtctttatagtaaataaaagtttttgaacaaa

SEQ ID NO: 34 - DNA, 60693 bp, Homo Sapiens
agctccttcttgggatctgatagacagggaaggtttcctttcctcattagaaggactccagtgatctgtggaatgagcactacagtatccttttaaattttcacccacaagacaaagccagtatgcagtgaaatgaggaaatgcctttaagtgaagagatttttatttctttcataaattgctcaagccatgattggatggaggtcctccaggtagctccatggactttaacaagtctattgaataactgcatttgagttggaagctgagttgcctgaacacaaacgatttaaaccagattagaaagtgtctacatacagagctcaataacacactcggaatcttcttgggaggacccacagactgtacctatattacttttgacccaggtggatgcagtcactctctagaagcctccccgacttcagatgtgtggcacacatccacacaggggtgtaggtaggagaagcccacaggaatggctctgcagatgttcgtgacttacagtccttggaattgtttgctactgctagtggctcttgagtgttctgaagcatcttctgatttgaatgaatctgcaaattccactgctcagtatgcatctaacgcttggtttgctgctgccagctcagagccagaggaagggatatctgtttttgaactggattatgactatgtgcaaattccttatgaggtcactctctggatacttctagcatcccttgcaaaaataggtaagtccttaaacacctggtttggtgagttatctttttacataagatagtgaatgtgaaaatgccttatagataacgggctaagaggattttaactgttactgctattacattaaaaattctcttcccttcagtcaagggaaagtcataactgcattttactaagctatttaatactttgagattgctctttgaaatttgagagcatacttctgggtactgggctgtgttggtttcttctcatttcagggtgacaaccatgtgacattgttgacatgcaaaactctcaaattctatgctttaaaaatatagagaataaagcacgtagacctgggcatgatgcaaggtggaaatttcaggaaacacataatgtttcttctgtaaaatattcttggctgtgtaattgtgggcttcatcaatcaccccattgtttattctttaaaagtagcgtgtgcttcttgcaaattgacagaaagcaaaaaacaagaaaaccataggcaacttgtattactcagtgatgggatgtcggggcatataagattatatctgtcagtaaaatattagtttatacctaccaagtggggccagtgaggcacctctaatttcctttgtgaaataaagtgaatccaagttaatagattaaattccaatcaagggatctttgtgtcaaaaaccaaagaggtggctatactctgtgactgtttaatccctaactgctcctccttatctctttaaaaccagcttattctaaagtggaaaattaatataattatctcaaatgctaagcacaatgcctcctttgcctcagctataaactttatgctatttgagtatgtagattgccttattgagatagaatcaatgaaacattttaattctcatttatttatatgtgtatgttttctctaggatgggtgtgtaatgtgggttgagccttgaggtctggcagttaccttctgtgtgctctggctattcacttagctccctccctgtgggtgtggggacactggtataggtgtcccctttagactctcctttatagttgctattcattttgagctagtaaagtgtgaatattaaataggaatgttagtttgaagaagtcttgtgcaatttgcttagtgaataagttacacaaaggatcttactatatttttaagaggtatacaagtaaaaatggctttccaaatggataacattctcagttcagaacagtctaacatcttttgtgaaatcatatagacactgattgtgttcaaggtgatcttacttggtacttgagttttccttttaaaacaatatgctagagattctgtgttccctgctccccattccacaacctggcttcctcttcacagaaatggctcaagtcaatctgagtaccaggaaactcgtcctgtcactgactagctagttgctctgtttatcagtaaacatctaaacgcagaaaggctgcattttgtcttggttttatatttgtgtaaaacctagcttgttttgtagaggcattgtatgcacccagattcattctgtctaggagcgaagaacactgtgaaaatacgattattcatagaactgttggtttaaatgttcttgattttcatgatgtaatttaacatactttagaaaaaaagagtaggatatcagaacacgcttattcgagtacaatttcatatttactagtcttcaagaatttagattatttttatattccatatggacatgaggagtgaggagataaaaaggccatatttattgaatatatactatgtgccaattactgggctggtagttttatgtataagggcttgtttactagggccaaaataataatgatgatgatgatttataatttcagcacttaagaaatgcatatgagtttttaaagattatgttataaaacatgaatcagaataaaattaataatcattattatgattcattcttttattcctcattccatcaaggtacattttctgagaacccatgaaatatgtggaaatgaccatggtccctgacctcaagggacttggtctaacggggaagataggttaacttagtacttattgcccatagatactctgacagaaaaacatcaaaactctcccccaatcctttttaaaacacccaactatatgcacttataaaacaaagataatgtataacaaagataatacaaagccacctcagactttgtggtttatcttctacttcagttccacatcttagaacatcacagatgaatgtttcttgaatctttgggaagaacataattgtagggcgttctttgactttcagacaggacttttaatatttgtgtccatttaagctctaaggcctgaaactgtaaattttaaatgattgactctattgtccatcatgaaagggagaagttttaaaatgtgaaaggcatgtagcatttccctttacaaggccctacttataggtgtgtggcctcttcctgctacaactgtgtagagagcaacttggcttaaggcaggtgaatgttggaaccatttcaggaaactggattcctggaagcagggccaaactggggagccacagggcctgagaaaatcacactatgggctcttccacctcctttacatattgaaaaaagttaagtttggttaaaataagcactaactgaagaaggaggagaaggaaaacggtaaggagaaagagaagaaggaggagatggataaggagaaggaggaggaggaaaaaggaagaaggaggaggaagagagtaagaaggagcagcaggagttggacaaagagaagatgaagaaggaggaggagaaataggaggagaagaagaaataagtaaaataaagaggaggaagaggaaatgcagaaataagcagtgattagaaaatgatgagttcagtgctccagaagaggtgcttacaccaaccctgaagccaaatgaaagtggggatggtattccttggtgataattataccctgttgtgttaactttcttgcttatagtgaatggagaagttcaaagccatggtcagggaagctcatatcatctatggatgggtgaatctaacaattcccaaggagatatttgctggctccccatggcctatggctggaagtccaccgccttccttaggtttgaattcaaggtcttccattatttgtttcaaaatcattttccaagtcctctcctgacacttttcccagttcaaaggttgctccagccaggtggatcccctcaatgaatgtcaaagatatctggctgggccatttcttcctctcttatttcactcttgatgttctccccacctaaaatttctcccattctgtcacccaaatatgcaaatcctcatcattctccaacaatctgttcaatctcttgtcatgaaaaagcttctctgataaacatttaactgttcattcatttatacactcagcaaataagccagctgttgtggacaagatactgtgctaagcatttggggacatatgaagatgtaaatcattctgcctgagtctggggagtttccacattagtaggagacatgaatcatgcacaaaacatagtagacagggattattgttattagacggagtgagataaaatgttttattattagtaattcagaggaagatatgaactcaggaaggagctagggaaagctaagcctcaaaggatgagcaggacttaaagggaccaaggaaaaggacaatccaagcagtgacaacggaatgagaagacaagtaataggccttcagagtgacaaggtcctttggctgaatgcaggctacataaagatagtgcagagtgtgtgggagacagacttggagagagccctgtggtggtctcctgagctctgaactctcaccatgtttgttgatatgttcaatatacccttcattatatacttacatgtcatcttcttctttgttcatgtcttgtttccaaaaccttatcaatagtgggaattgcagttgtctatctctttggtcttccacctggcggtacttaacatcgtctttgcacaactaatacccttggtttacaatccagaagatgctttgtgtgccttcagaatcttaggtgggaattgagacaatcagagacccatggtgtagaaaaatcatctggcagtagagtgtggtgagactggaggtcaagaagacaatgcaatcattaagatgagaaatggggaaatcctaaataaaggcagtggccaaagaaatggagaggaggggatagattttaggtgtagtgagtgagagtcatgacataagaaataaatacagagctgaatgcatgaagggtcactcatgagaatgcgacctgatttccctcttcagtggctgaccagatagcaatgtcattggttaaacacaggagacaaaataaaggacttttaatttttgtgtatgtgtttggtgaagaggggaatgaggtcaggtaagtttggaacaagctgaggttttggtgactatgatagattctgcatgaacttgaaagctgggcttgcacgagtgcaaaagtttcaccctcgtttctccttttccctcatgcaccctcgcaggtccctgtaagataggaaagcaggaaggaggatgggggagggggcagctggctgtgaatgattctgtgacctgcgccgagctgggcatgttacctactgatcttattggcgaccctcatgacactaccagttcctgctacagatgggacgctgaggctgagatgccagtcagcttgtccacggtcctgtctgcttgactttaaaagacctcaggtacacccagaccgtttcgtttgcaagcacctaactgctcttcgctgttctgcaggcttccacctctaccacaggctgccaggcctcatgccagaaagctgcctcctcatcctggtgggggcgctggtgggcggcatcatcttcggcaccgaccacaaatcgcctccggtcatggactccagcatctacttcctgtatctcctgccacccatcgttctggagggcggctacttcatgcccacccggcccttctttgagaacatcggctccatcctgtggtgggcagtattgggggccctgatcaacgccttgggcattggcctctccctctacctcatctgccaggtgaaggcctttggcctgggcgacgtcaacctgctgcagaacctgctgttcggcagcctgatctccgccgtggacccagtggccgtgctagccgtgtttgaggaagcgcgcgtgaacgagcagctctacatgatgatctttggggaggccctgctcaatgatggcattactgtggtgagatgtcatgtgcccgcccggcttccgggggagatgagggttcggggtggggctggggaccggaggctgtggagacggctccagtgtggctcagcgcagcaggacagggatgagcttcagcccatgcggtgtggtccgagttctggtgaatttccttgggatctgcactgcctacataacggttcactcacactgcttgtcattcacaaaccaactagtttcgttaaagagtggaaaaggagagagaacgtatcattcttgagttaaatgtactttttcacttagcaaacagaaactgttgctaatggcccttctggggtttcacgacagctaaagcagaaactgatgtttttatttcctctccatcatcagacctcactcttattccctttatatgcatttttgttttgtttttaacataccacattagattaggtgaaataaaagataagggtcagggaagagatgacaacagatttgtgaaaatgtgttagtttttgtatcacttagttgcaggacttgtatggaaaaaagtgaatgaggcgtttttgcttatgagcctttctggtgggaaactgagaagaacatacaggcttgagcaacacccagcattaaggctcaggggatgtctgtaggctgggggtgctggaatattgagaactagccagtcccgttgctcaatttcattaattactaaaaaccttcagcagttgttagacaagaagacttttatacatactttcatatacttttcttatttttaaatttctatcacagcacataagtaatactagaatacattttcactgtaagaatcaaacagtacaaaactatatagcatgaaacacaaaaacttctgcttgccctcacctcctcctctatgaaagaggcaaccacttttatcagcttgaccttttccctcctgtattttttatatgcatatacaacatttttgcaaatcttttatcatctatgtgtgtgtgatctgtattttttaatataaagtgggtgtattttatgtattgcttagatataacaagtctttccgtgtcttgtttttttttttcttttttttgagacagagtttcactcttgttgcccaggctggagtgcaatgatgcagcctcggctcactgcaaccgtgtctggccctctttctatgtgttttcagctattgcatagtattgcataaattaagtttacagtaacttatttagcagtttcctgatgaatgcgtcattcaggttgtttccaatgtttcattcttacaagcaatgttgaaatgcatattgaatattctttttttctgcatgcctctctctttgcattcgtatttttacatgatgttttcttagaagtgaaatttccagtttaaacagtatgtacatttaacaatttaaaatgtgctgctgttttaatcagctcctatctgcctccttggtaaatgagagattctcactctaaggttatagatggccaaacacagacacccaacactgggcagatgagactgacaacagtttatcagtcacctgtacttgccaaggggaggaggatgccacatgccccgcaggaccacacagaggctgcgcttgggaacggaatgaacaaccaggagctgtgggaggcaggctttgtggtaacaagagggtgaggtgctccctggttctcacaggaggagatgattgagttgttggaataattttgcaggttggcagggacctaagaccttctactcaggaagaagcaggaactgtgcctggtacccttgataaggagggtggtttggctggggcaccttatccagggatcggcgtggggagggaaacttgcatgtagaccagttgaggtcctcataattttgccaaatatcgtggcattacataatatcaaaccttaatttcaggccctggaacacagtcgtcaagattttccagaaagcctttatcagcttatacttccttagtgtattgcacccatattttcttatatctttgacaagggacattgtttccttaatgttttctaatgccatgagcaaaaaggatttctcatgtttgttttaatttgcattataatagtaagcaacttttcagcaactgcaaatcatgactctgtcacatgctgtacattgaaagctgatgtcctttctgggttgacaaacttaaaaaaatactggacaccaagttaaatttaaatttcagataaacaatgaataattttttttagtataagtatgtcatatcccaatttttatatgcaaatgttgcgtcttgctcatttttcttcacttgcttaaaaaaaagatttataggaattcattaaattatcttacctttaaacttttcaatgtcccataaagaccaaatattttcttccattctattatttaaatttttttagattatggtatattttaccctataaaagttctaaatttttatatagtgaaacctgctaatgactctttttttgctcctgggtttcatattttgcttccagagattgtgtctaaccaaaagacatgcaaacattctgtttttaatttttttcccatttacaatttactaattcatttggcaagcaagatctttttttttttaaactttatgcaacaatagtacagagaggaaaagtccccctttgaaaaataatctgtgccatacccatggatttcctaagcgaaggaggcccatacatgaagccggacgtcaaatcatttattcatagcgagaatccctaacttttgaggcaaggcactagaatcatcaggctggtgcattctacccttgcgggcaagcttcacaaaaagccacattgtcaggaagctgcccggggagtctggactccagactgtcataggattcagagatttcatttctcagagtctggtcctcaggccaagtgtttctgcatcacactggtgggactgatgagtcttcggatgtccagtcccatttcataccctctgacccagactgtctgggagttgaacctagaaacctgtgttattaaaacctcagatgaccgctgaagtttgagaactatggatttattgcctttaggttgagagaaactgatatatgttgatataaaatgatgatacgcctagaacaaggaccttatccatctccccagacgacactggactagtctctgagatcccctttccccaacccattccttctataaatactgtcatactttcagttttgttacaaatgagtaagtgtcgttgtctgggaatccattccatctcttaaggtagcccctctgacccatgatgtgtccatttcctagttcatctcccagagataaccttctttcactcagatccaagttttttggaggttatttggttactctcacccgcactactgacaatgtcctggagggtgtttatctgtgacaagaccagggacaccccttggaaatccattctgaagcaattattcaacctctccttcataaattattacagaggtcaagatactactggataaatgccatctctttaattttcacagcatattctttattcatcaaaaactcagatataatctacaaaagttcttgccaaggcagagtctttatcaattaccaaggaaagcatttgactccttcctcgagcttgagaatctgacttcctcctgagttgtctctagatttcacatggagagccaactctggcttggtttctggttggggtttgtttgttagcaacatgtgtttgacttccccaaagtttaattgctttgggggagacatttataagaatgatcatttcaggataaaatcataattttcaagctaccggagtatctgctgaggacactgctgtgacctctgctgggtagagctgctgttgcgttggctccgtggggttgtccacacttcaatcttgggccactctgtggtcacccacagcacagtgagtattaagtgtgcactggcactgctgggtccctaagtgaaaccagagaagccccagggccatatttagaacacagctgaaaaggaacgggtacttgctgccgtccagttgtattttgagctaagggccttgacctcaccctttcattgaggaaggagccttcttgggggcagcagtcacaagcatgccttttcggcaaggaggctgagtcatccagaaggtggcctgtgattgtgggttacatgcgacaatgctgcagatcttcatccacgaaagagctgccttcccaccaaagagaaggggttgctcccaacagtcgaaatattgatgaatctgattctccagatctcttgtcccacttttttctccctcttgctgaatattttaggttatgacactaatcaccagaacacacatacgcttaatggtaggcaaaaggagggagacaaaacccagatagctttagtgtcctcacccgccactatacacaaatggttacaacgtgagaagatggatacaaaaattagcttgaccttagtaactatctcaccatgtacagcatatatatatatatatatatatatatatatatatatatatatacacacacacaatatacacacacatgcacatatatacatatataatatatagaaaaatatctcatatatatttatatattaacatattagcatatataaacatcatgttgtacagcttaaatatatacaattttttattttaaaaaaagaatgtttctaaaattgcataaacaatatccctagttaaatctcatggccaaaatcacagcaggaagacaggtgcatctactatgtcacttttgcatttattagtgttttattaaaccctttgcttttactaagaggcatgaccaagtgcccttacttcatgaatgaagacaataaggcaaaggaggttaaaataaactgcacaaggacacactgcctgaacaatgacagagcagacatgggtgtgcacagctctccctcctcccaaactttttccttttttccttaccttttgaattttccactcatgcaactgggagtgacaagagagaacccacatgctaccgatgaggagactggacttaagtccagtgagtgaagccagtgttctttctgcaaaacactatggcttgaggcaacattctgatcctgttgtgcctcctcttgctgtaaaattgggataatgacattcttcagctcataggctcactggaaaatttatattcagctcttagcagagtgaatgcccaacctggagtaagcactcaatgaatgctggccatgactttgtattgaagcagctcccggacactgtttagtggtcggctcattctgaacaagcagctgattttaaatatggcaccacctcacagatgggagggcggattgttcttagatttataatctgccttcgttttcttggatcagcttgctggataagcaacaaagtgaggccaccaagctttctatcacccctagctccttatctcctctacctcatcagagaggtcaaaggcccagacaggccagggttgaagctggaacccaagcagcctgactccagggtgtctctgctcttgactgccacccggtacttccccttttcctcatccctctctcccctcctactcttgctccctcctctggtgacatcttcctggctctggatgccattctctaggaggatagtgggaggggaagtggagctaaatgttctgagcactgggccattcaccttgatgggtgcttcatgccattttccttatttaagcctcatggcaccttaatgaggtggtgatagtacacagtggttaaggacagagaccccctggacccagactgtctaggtccacatctctgtactgacccttctcggtccttcaggcctcttgggtgacttagcagatcgccatgtgcctaagtttcttcactgttatttttgttataaagacacagattctcatagaagtcatttatctattcattcactagagtttattctatgcagctcagtatcccagagacagagtgaaaagtcatactcactgctttgcccagccagcaattccctttgggtgaggcaatcagtggcaacagtttctatcagagaccattgacctttcatgcagtttgcaatttgccctctatttattgtggattcttgctgccagcattagattctatatctcctgatccctcatgctagaattcctttgccgtcttctcttctcatctgtctgtccctgtagcaacataactttgctggctagttgcctgttggctctcttaatttctctccatgccattccctcctgcagtcacaggactcagcatctagaatggagcattgcggagggggctgagtcaagggctctagtggaagaacgaatgcagcaggaagagtgaataatgatgaggcggcaagcagtggggactagaagaggtgggcaggggccatgttggccctggggctggcctgctgcccaggtctctgtttccagtgactgaagccctctttcctcaagcccccaagagggagcaaactggggtgattttcctcaaattaactgtcaccgccaaacttcagagttgcttcctgaacctaaacgctaagggtgggataaaatcaggggcaggcatgggcagagggaagagtcccagggtcctatctctctttccccacaccttgtcatgcacgtgtcctgcacccccactgtcctggacacagggcacatgagggtgaaccatgtatccagcctattcatttgagggcaaattttccttcatgattcctcctgctttatattttcctgcctcaaaagggacccttactctattacttcttattcaaaaagtagtaaagcatagccaagaacatggatgggaagccatatgcttcattgcaggtcctgcctccactccttgcaagctgagtgacttcaggtgaatcacttaccctctctgggcctcagtttcctttctgtaatatggagatatggttgatggagggttaaaatggattgatacacgtaatgcattcaaaatagcacgtggcacagagtgagcccctgtgtttggtgttattcatccaagtccacctgcatgagtacgtctgagccacagagctctcctgacaccctaatgatgccacatcttcgtgtctgtctatctgaacgttgcagtctcagcttttcctaaagaagagctgtatgtgcacttgaacagcatcttgaggggagagtaggcatcttttccttgtcttctttatattttctttcattttattctgattccaaggatgggagccaagaggagatagctttaccaagagacagtttcctctggccaagaatacagggatctcactgtgtatggggggcgtggacctacaagttgcacgatcttgggacccaatccttttgtgcctcagtttccacatatgtaagatgagaatgattaatctgacttcaaagggtgattgtgaggatgttgtgaaatgagacttcggatgcctggcacagggcaggtgatacacaaatgtcttcttgcccttcctgtgtgccagagataggtccacacaagaacaaccatctgccatctgccgggtgtctgtcaggcatagaaatggagattacgcctaaccttcaggcagaaagggccatgcagccttgattggttggctttgggtgcctagggagtgaactccacaaccctgcaaagtctcagcaagtgctttatctgtgaggctctcccctggggctgcttctgaccttctgttggggagggcaggagtctggtgcccatccagcccagacatgggtcccaaaggattcaggcatttgccttcagacatgcactttcagccaaaatatttggaggttttcacggtgaacttctcagctcacagctggtgtgtgtgtgtgtgtgtgtgtgtgtgtcacaggcagagggagaagtaaaccaagagagagagaaacagagagagagatgcagcaaccactatagcttgtgatgaagagcttggacttggctggggaggtgggaggacctgggagaagtgaggagcagatcagtgcaggtcccagtaaatgaaggagagtgttgcagggggcagaggttcaccaaatctgactcctaaccttccacaacagacaacccctttacttcctgcacttgtggagtctaagccacagacttgccctttaaggagcagcctgaggggtgtgggctaatccttgggaggcatgctagagcaggacagggctggaggggcactgtattatttcattgcaatgcctcccatttgattcatcaaacacctgtttggttcattttcttctggctaaataaacagaatggttgaagtttgaattgtacaaattggctttcaactagactacactgtgagctacctaggagtaattagaactcacttcaggtcacatgcacaagaaaaaagaaaaagcctctcgttatcaagttgtcttttctttgtcaggagatggggttgagcagctatggaaatggatttggaagagaaacagggagaaaagcaatgtcgctttagctttttagggagtaatcagaaagagggcagaaaagcgcatgggagaagttctctcccgccagccttgctgagtgcctgggatgcagaagcaaacaagcttcatctcctgcctttgaggagccacagctatgaacacatgacttatttctttttgtttgtagattattccttttaaccatggacctgcttgttctgtattttattagaatcctttctagccacagagaattcctaggaagttgcataatacattaatagaaattcctgacttgagagaaaagcgtagagcttcaagcacagcctggggactttcctagtcctgtggttttcaacagctgtcccacccccaacaacacccgttcatgcatccttaagggtctgtgggtgtgttgggctgcagtgggaaaaaaaacatgcccggtgtcacgtgaaaaaccccatgagttggctgtttgggaggtgctggctgacaaatagtttccttatagcttcctccatggttgcataaatggatgacatccagcagaacctgttacacaggcctggatgggagcactagatccaggcgatgggtgagggaggaagccattgaccctgactccaggctgaggtcatccatactttcctccttaccccacaggaccagctttgattgttggtgagtaataggctaataccactgagaaagctgagagaccatgaaatctaattccttttttttttttttttttgagacggagtctcgctctgttgcccaggctggagtgcagtggcgcgatctcagctcactgtaagctctgcctcccaggttcgcgacattctcctgcctcagcctcccgagtagctgggactaaaggtgcccaccaccacgcccggctaatttttgtatttttagtagagacagggtttcaccgtgctagccaggatggtctcgatctcctgaccttgtgatccacccacatcagcctcccaaagtgctggaattacaggcgtgagccactgcgccaggcctgaaatctaattcctttatgttaacaattaagttcagtcgtgtctggtggagccagaggtcccctgagttctaatcctccatccatccatccattcattcatcaaaaaatattactgagctactacttagggtcagacactgcttgttccactatgccagagcaatctccctctcagaaaaagcaaattacagagctagtctttagtgagtttaaatctatcagttacaactgatgcttgcttttatggttaaaagagttttgaggttaagtggcttttaaactaccttttgtatcatgcaggtgaactgacactagatggtgaaagatagtcctaaagtcatttgctccaaattgatgtggggagtgaaggaggagagggatttgcatagactgaggggtggtagactcaggtgggttcttggatggcaccatgggtgaggaacaggtgttggtggaggtggatgatagtattaggttggtttttaattgttgagtcttagaaacctacaggcaattgaaagaaattgttcggtagttatagaaatgaaaatctagagcctgggccagagctcaaacaagatgcatgtttggaagtcattggcaagtaggtgataattgcagctatgaactatggcaatcctccatctttcttcaagttcagaagagtttcaaactttttaaattgaaaaagaattccttaaagaaatgtcattgctgcaccctaggtcaataaacaggatttattgatacacatacttttttctcctcctcattacgtgttctgccatccattcagttcaccagcttggcctctgttcgctgaacttagaaaggataaatgtccagagatctcaaccccatgaacatggatgaacaccttgtttaacttccctatcctgggcttcaggtctttttttcccctcatttaggagtgaggtgaaagagcttcctctcttctgcttttcacattgttatgcaagcttgctaggtaattgctggtcttcttagttggtttccttttgtggttggaaagtcagagaaggtggttgccaataaactgcccatgacagagtttactatgccagagctccttaatacaagctagaaaatgaactgggttcatcatttaattttttgagtcaggttgtttactacaggtctttatgatattctttgcatttttccattatttggcatgcaggaaagatcattcttattgtattatgttgtgactcttaacttccaacgttttttttttttaacttgacagtaaaacaaataaagggtcagtaattagttaggctttttgttttaagaaactgagttatggcaagctcaagcagtgaagattaattgtaaagatatgcaaggcgatgaggaagacatagccctctgtattagccctctagggctgttgtaataaaatagcagagattggggggctgaaacaatctctgaaatatgaaagacttttattctttcacattatggaggttggaagtccaagaacaagatgtgggcagggttggtttctgttgaggcctcattccttgccttgcaggcagctaccttcttgctttgtccttatgtggcctttcttctgtgtgaccctccctagtatctcttcattttcttataaggacaccaatcatattggattaaggccccacccttatgatctcattttaacttaatgacctcttgaaagatgctgtctctatatgcagtcacattatcaggtactggcagttaaaccccaacatataaatttggagaggggggcatgattcaacccgtagctgacccctcaggaacccaggaataataagtgctttatgatgaggtgtcacaaaggttcatctagaaccaagctgcttttaggaatttcagaagcaaaagttcatagatcttttaccatcaggatgaacttgattatgctgtgtaataagcatctctccaaacctaaatagccaaaaacaacaaaggtttatttcttacttgtactacttgccttttgctagccaacaggtctctcccttcataatgtttactcaaggtctttagcttatagagcagttaccatattgaacattgctggtcactgtgctggaggaaagagagatttctggagggtctcacctcagcaagcaaatgccccattctggaaatgacatatatctcttctatttgaaactctctcttgtaattctttcttgagaaaaaaacaaacaaaaactctcaaactcaaaagttggccaggcataatcacatggtgacaaccaacctcaaagagactagaagtgcaatcctacaagattcctagaagggaaagaaatattggataagcagtactaatagctattacattgtcatttcggagcctcatcagggatgcatttggtcgcttgctcacactctgctgctttttcaactgaatttttttatttctcttcccatttgtactaatgctttttttttttttttttttttttttttttttttttactgttaatgaagaaatacccgagactgggtaatttataaagaaaaagaggtttcatggactcaagcaccacatagttggggaggcttcacaatcatggtggaaggcgaaggaggagcaaagccacgttttacatggtagcaggcaagagagcatgtacaggggaactgccatttataaaaccaccagatctcatgagacttattcattatcacgagaacagcatgagaaaaacccaccctatgattcaattacctcccactgggtccctcccatgacaagtagggattatgcgagctacaattcaagatgagatttgggtgggaacacagccaaatcatattgttttaccgctgtcccctcccaaatctcatgtcctcacatttcaaaaccaatcatgccttcccaatagttccccaaagtcttaactcatttcagcattaactcagaagtccacagtccaaagtctcatctcagacaaggcaagtccctcccacctatgaccctgtaaaatcaaaagcaagttagttccttcctagatacagtgggggtaaaggcactgggtaaatacacctcttccaaatgggagaaattgaccaaaatgaaggggctacaggccccatgcaagtccaaaatccagaagggcagtcaaatcttaaagctccaaaatgatctcctttgattccatgtctcacatccaggtcatgctaatgcaagtaggttcccatggtcttgggcagctctgcccctgtggctttgcagggtacagcccccacctcccccaccaccccagctgctttcatgggctggtgttgagggtctgtggcttttcaaggtacaagctgtcagtggatctgccattctggggtctggaggcctgtggccttcttctcacagccccactaggcagcacccaaatggggagtctgtgtgggggctccaactccacattttccttctgcactgtcctagctgaagttctccataagggccctgcccctgcagaaaacttcagcctggacatccaggcattaccatacattctatgaaatctaggcagaggttcccaaacctcaattcttgacttctgtgcacccacaggcccaacaccatgtgtaagctgccaaagcttggagcttacaccctctgaagcaatgacctgagcagtattttggccccttttagccacagctggagctgaagcagctgagacacaccgtaccatgtcctaaggctgcatagagcaggggggccctggcctcagtccaggaaaccatttttttccctcctaggcctccagccatgtgatgggagggactgctgtgaaggtctctgatatgtcctggagaccctggagacattttccctattgtcttggtgattaacattcagctcctcattacttgtgcaaatttctgctgcaggcttgaatttctccccagaaaatgttttttttcttttttagctcatagtcaggctgcaaattttccaaacttgtatgctctgcttcctcttggatactttgcctattagaaatttcttctgccaggtactgtaaatcatctctctcaagttcaaagttccacagatttctaaagcaggggcaaaatgctgccagtctctttgttaaaacataaagagaattacctttattccagttcccaataagttgttcatctccatctgagaccacctcagactggactttgttgtccatatcactatcagcattttggccaaagccattcaacaagtctttaggaagtttcaaactttcacacaccttcctgtcttctgagccttccaagtctcttggaagttccaatctttcttgtcttcttctgagcccttcaaattgttccaaattctgcctgttacccagttccaaagtcactttcacatttttgggtatccttatagtagtaccccactctacctgtaccaatttactgcattagtccattttcatgctactatgaagaaatacccaagactgggtaatttataaagggaaagaggtttaattgactcacagttccacatgactggggaggcctcacaattatggcagaaggcaaaggaggaacaaagtcacgtcttacatggtggcaggcaagagagcatgtacagggaaactgccctttataaaaccatcagatcttgtgagaactcactcactatcatgaagacagcatggaggtaaccatccccatgattcaattacctcccaccatgtcactcccctaacacatagggattatgggaactacaattcaagaagagatttgggtggggacacagccaaaccatatcaccactccagttagcttccatatcatccactcaattatcctttccctactcttagtttctatttttcagtttttctgtcccacaactcatagttgttcatggtccctcattgtcccttaatctatctcattgtatttatctagtcatctattccaaatcaattatgtttgtgacagaaaaaacagttaccataactgcaagctgggcagagtgtttcacctcagactacttcccagaccccagtctatagacagacttcttgagggtctgtctactctcacccctgagtagaaagtcccctgttaaaagtaatgtagtcaaacaagactaaacccttcctcagatgctatgtcatagaatttacccttacagggatccatgtgcatggtggggaccataactatcatgactaggagggttggtggtcacaaagaaaggcaattaattatgattatggcctcagctatcagtgtcatatgaatccataagatttaatattatgactacaaagagccttcttactttggttcttaaggacagttaaaaatcagtacatttaatgaactgacatggctataaggtttctttattttatatgaactggtataatgttagccaaaagtatactgtaaaaagttaaggatgttactgtagagcaccactaaacatgatgcaaaaaatctggtcaatagataaaattaaaatagaattctaacaagtattcaataaataaaaatgaatgcaggaagagacaataaaccaggagtgaaggaagggaaaataaaaaaatatatagtaatatggtagatctaaaactaaccataacaatattacattaactgttaatggactaaacgctccaattaaaagtcagagattaacagaactgattataaagcggggctcaaatatattctatttataagaaatgcaatttaattataaaggcataaataaggtgaaagtaaatggatgcaaaaagataaaccaagcaaacaataagcataagaatgttgatttggctacgttaatatcagttaaaagacataaagatagaaagtattacaaagataaagaaggatctatcataatgataaaaaagctgactaatcaagaatacctaaaaattgtacatgtatatccacctaatattagtgcaacaaaatacatgaattaaaaattgacaaattgaaaggcagaaaatgacaattctataattttagtaggagattctaatacctttctcttaggaaatgatactaaaattaagtaaaatattagcaaggcatggagaatctgaatattatcaaccaccttgccctaattcctattcatagaatattaggcccaactaccgcaaactcaacattattttcaagggcttatggtatgcttaataaaaatggccatacatttgacaactaaagaagcctcaataactttagaagacttgttaccatacagagtatattttttttacacaacagaattaaaaatatatttaaaatatctaggaaagtcttaatatttggaaattaaaaaacaaacttctagatgtttcatggttcaagaaagaaaataacattttagatatcttttaaataacattaaaaagtactcccaaaacagaaatacttcgaagtgaatttaacaaagatatgctagatcctttcattgaatattatagaacattgctggcaggaattagaagacctaaataatgtcatattcattaatggaagagtaaacatttttaaggaatcagttttctcctatttgatctatagattcaataagagcccatcaaaatcccagaaaacattttagtagaaactgacaaagctgattctaaaaatctgtttggaaatgtgaatgacctagattacatgaagcaatgtctaaaactaaagaacaaagctgaaagacttatttgatgacttactataatgccacgataattataataattctacacaaatgacaatattaattaaagaatagagatatagactatgaaagagactggagagtttagaaatagacttacatatacatggccaattaatttttggcaaaagaactaaggcaattcaatggaaggcaaagtctgttcaacaaatggtactgaaaaactctggtatccatgtggaaaacatgaaaatcacccctaacctcaagccatatttaaaaattaacacaacatgtatcatagatgaaatggaaaaggtataattataaatctcctggaagaaaacatggaagtaaaatctttatgactatagaaacaaagactttttgaccttggagtagtcaaaagacaggaaaagcacaaatcaaaacacacacaaaaaagaaaaagcaatgaattggattttatcaaaagaaaaaaaatgctcttcaaaatgcacagtcaaaaaagcaagctacatatgaaagaaaaccttcactatacatgcatttcacaaaagacatagagaatatggaaataattttaaataattttagttctcaataagggtataaacagctcaattgaaaataagaaaaagatttgaacagatacaccataaaagatgatatactcatggtcagtaagcacatgaaaatatgcgcaacatagtaatcagggaaatgcaaattaaatcacagtgaaatgccacccatccattcaaatgactagaatttaaaaaactgacaatatcaagtgctgacaaggatatggagcaactgggaatctcatacatttctggtggtgttctgcagtagatagggtttgtccaaatctacactgaaagtccaaggaagctgagaggcagaaaaaagggagggatatacctagttttttagaaataaacatttagcagagacttaggaacagaagctatgcttttgtctttagcagtgatgagacaatatggtggagcactatgccattagctcccagacccagggcttatataccatagagaaggaatgtgtaggacaattgtagggaaaggcaagaatgttgtataaatctgtctatgggcagaatttatgggcaaagttgtttgggcttactgtacttacttcacttactgtaaatcaagggcacaatttatagtatgtgcttttacaaaaagaacagtagataaaacagaaatcttagaggcattcccagaactgggattaatcagaaatcatcatggtggattagcatccaagatgaggttgcttcagtctccacaggtgggtgtgtaaaatgatatgatgactttgttttgtttttaatctatttttgagagagagtctcactgtgttgcccaggctggagtgcagtggcatatctctgctcacctgctcactgcaatctccatctcccagattcaagggattgtcatgtctcagcctcctgagtagctggaattacaggcacatgccatcacacccagctaatttttgtatttttagtagagacagggtttcaccatgtaagccaggctgatcttgaactcctggcctcaagtgatgcatctgcctcggcctcccaaagtgctgggactacaggcatgagccaccgtgcctggcctgacatgatgactttgaaaaacaatttggcagtttcttaaaactttcacgtgtctaccatactacctagccattgtactcctaggtatatacgcaagagaaatgacaacataggtctacaaaaaaggcttgtacatgaatgttcacagcagcaacattcaaacagccaaaaactggggagttgggagtggacaaatattcattaacaggtaaacaggtaaataaatgaagaaaatatgccataaccagatagtggaatactactcaggtataaaaaggaagggaccactaacacctgcaacaacttgggcaactcaaaaacatcatgctgagttaaataagcccgaaaaaaggagttcataatttattattcaaactgtataaaatgcaaattaatctattgtgacaataataaattagagatttcctggggccagggtcggagagaaggatggacttcaaatgaatgaggaacctttcagggttcttgggatttttctatatcttgactatggcgatggctttatgagtatctacaatgcccagaattcattcattttagatgcagtttaccatatgtaagtctttcctcaataaagttaacaagaaaaaaaatgtcagcacatttggaattgactcttcatctctgctgagccctggtcgaaggactaatgtttttagtcattgtgtgagtctctgtgtgttaaaagggctttgcaaacttttacagtggcatcagctaaaggatcataattattataatgttggaaggcttggaaaatctgttaaaggtaacaaaaaggaccgtttgctgagacaatgagtgaagaggaaaaatctaaccttgttctccatggggctgtggacatgtttgagatttagcattggctgagcttttcccttcagtgtataaaagacacacacacattattgtgacttgaaatgaacccaaagaaaatcttttgcaactataatgttacccagagcctggtaatttgaaaggtaagaactgtttttcgtgcagtagtaaggattgtgattgtaaatgcagtcttcttaattatatgtactactttagcttctgaaactgccatggcatcttcctggcagggcacactggtgtccagagacaaggctggcccagttgactttcccaggccattgggacagtctgggtagctactaataatctaacaagctatgtgaaagagttttagtttgtggcaacaatattcaaatctttgagtctcggtcatattctctgagtttcctttggatttgagagtcaaataaacaggttccacttaacctcattcagactttccttttctgggattgtggggagtgtgtgactcctcactgtggcttcactcctttcagtgtgagctcaactccaacagtgcaatactcaggccttctaagacccatatgtggcagaaagtgaaattggacaaacaaactcaccgagtcaagacacaaccactgagattcttttggattcattcaaaatcatatgtcacattttttttcaaatactcagcccaggttttcttaaagcatggcttcagtttgtttaaataaaatagaccaggattttagcagttttgtaaagtgtgattgatacacaaacagaccaatagatgttgtccaggtccttcatggatcagacactcagagtgcattaaatgtacaagagttttactaaagaaactcctgtgagggaaaatggggaagaagcccagggggatgggagagccctcaggtcgcagtgcagagtgattccaggggaaggagagagggaaggacagaagctggatgggactgtctttgctgcacttcttagagagtttattaagctcatcaggaacccacaggctgaaacacgtatccaaggagtcctttgccttccaggaaggggcctatctcagtgtccctgccaagctcaggccttagctgagaatggcagatgggcatccctgcagttagagatctgaggggctctgatggccccagatagagagatggatgatagacagcagatggatagatgatatatagatggatagatagatagatagatagatagaattagaaaatacatatctgtagtagttttctctaggagggattgtgggacttttgtgggggtttccctttgctcttttgtttctggacaatttctacactttttcatgtatattcttaaccaaattcagtttaagatctctgcaagtctttctctttttaagtaattcttttcctaatacgagaaattcacaatgttcatggtatgtgtgtgtgtctgtgtgtctgttgcatgtgtctgttgcttgtgtgtctgttgtgtgtgtctattgcatgtgtctgtatgttgtgtgtgtacttgcttggacccattggcaccaagctttctgattcttcttcatcttccccagcttcctctcctcccagaaaatacactagaaacttatctttgagggaagaaggcaagcctattataaccttctgcccacattcccttatctaaacatgcttattggctactggttacttattacattgaacagtgagcactaatttatacactcaaaacctgcatcctaggctctcttaagaaacatgattgaaccatttggggaataagccagagtttaagaccttgtaaaattcaaaataaaattatttgtgctctgagagatttataacgaaaacttctagtctgtaacacaagttaatttcacagtatggtcattttgtttataaaagctgtactggctggaatagtgtcccctcaaaaatccatgctcacctggaactgcaggataggatcgtaactggaaacagtgtctttacagttatccttattgaaggcgagctcgcactggactatggtgggccctaatccaatgcctgatgtccttataagaaggtgatatgacacagaggagacacacagagaagaccaggtgaagacgcaggcagggactggagtgatgcactcacaaacctaggaacggtgaggactgccggcagtcaccagaagaagctcataagaggcaaggaagggccctcccctaacgccttcagggggcgcgtagcactgccgacatctcgagtccagactcttagtctccacaacagtgagaggatacatttttgttaatttgagccacctagcttgtggtactttgtcacagcatccctaggagagtcatataggagtcaaggtgacagagccttattgtagaggtgcttgtggacaaaaaactcattagcagagggccactgtgcaacctcctcgtgtggcctcccccgtcaacaaagtgtattgtcaatgaaacttcctagatgaggactgatgacacctgagctacttcaagccatgcccctcactgccagctcacattcccaagcccagggccactctgtatgatgtttgatatctgcacataagggagtaacaaaaagtgtacagttacatggtgactgcagcataaatatgtccatcccataacctcctgctgcttttgcttgtatctgtccctagaggacagcctccctcaaacaaacgtgaggcattctttagaagggagagcaaggagaaggcctttgtcatcaatgcactctgactgttcatgattatgaacaaaacaggacagcagcttagggacaactttgcacatgagcaatcatttactgccaacctctctgtggaaaagcaacaatctttttttttttttttagtaagatagagtttcgctcttgtcacccaggttggagtgcaatggtgcaatctcagctcacggcaacctcgcctctcgggttcaagtgattctcctgcctcagtctcccgagtagctgggattacaggcatgcgccaccatgcctggctaatttttttttttcaagagatggagtctcgctctggcacccaggctggagtacactggtgtggtctcagcttactgcaacctccacttcccgggttcgagcaattctcctgcctcagtctcctaagtagctgggactacaagcacatgccaccatggctggctaaattttgtattttagtagagatacggtttcaccacgttgccctggctggtctcgaactcctgagctcaggcaatctgcccacctcggcctccaaaagtgctaggattacaggcatgagcctaattttttgaatttttagtagagatggggtttcaccacgttggcaaggctggtctcgaacttctgaccttaggtgacccacccacctcggcctcccaaagtgctgggattacaggcatgagccaccacgcccagccaaaaacaacaatcttttataatggaggtgatgttatagggaatcagcagaggtcgggcttacagaggacctggaggggccagaactagctaggaaaggggctgggggaggaatggcttcctgcaggctgcagaccacagcaaggggttggtgtgcacacaaagcagtgtgtggttctggtgagtcctgaggatgaagccaaacccagaacccaagggctgtcagaccacacccaagatcagtggtgatactgattgtcactcagtggagacactaagtgtctccataaggaagatgattcccatcttggagagatcagagtcaagcagaaggcgtgggtgagcctggcagggtgcagcatgaggggccacagccagaggggcaatgagagccaactgtgaaggtgagggggcatcatcagttctagaaggtccacacagtccatctatgcttctgcagcacgcagaataccatcacggccacgatttccttgagttttagcttccgtcctctgctctgattttttgcatttttcctggtgtagatagatgctaagaggcaagtactgtgatttcgcaggactcttcaggggctgatattcccaaaggtcttcattttctgcagagatcttcgttcagctcttctctatgtctcattacctgtacacctgctgctgcttttcaggacctagatcatagttctgggctatggagtggcataaaatagtgataagtagatccctgcagcttcaaaataaatgttgaaataaatagggaaataacatgaaaattcagagtgtgtgtcacataggctagaatcgtttgggggattcgatgaaatgatgtgtatggagggtataacggtctaggtgcaatcaggtaagatacaccacatgataggttaaataaaaaatgtgaatgcattataaaatgtattaactataataaaggcataactataagatataaggaaactctctatgtaccctagggctgagggagggcccccaaggaaggacacgcttgggaggggttcaccttttactggagaaggtgtggactggccactgggtagcagagaagttggctgctttatccagactggagttggtctggagttggtgggcaaacaatcgaccaccctccggaaggcaggcagggccagacatcagtcagcaatccctgtgccagggctgcagtgggagcctgcacttgggagatggcagagaatcttcagaggagcaggctgcatgggaggacggggagaaggctctcagagcgtgggctgctcgggtggagccctgggccacagacatgtggcacgtgggtcatgctggggctttttgcagacaggttatcaccaggccaaagccgcagggttgcagagggatcactttcagagcctgtggctcaggcaggatccgctggagttcctcacacccacgtggctgactctccccacaggccccagaaaaactgcaggaaggcccttctgcctgcacctgaatgtcctttctaggccctctacggacagagcttaactaggtgctcactttaaggaaaaattgcttaaaggaattccattgtctattatagaacacaaatggaagggttcatttggagtctagaggcaataaattaactgccactgaaagctttgcaaagagacaggcacgtagtaggtgctcagtgattggaagttgtgagtattacactttttattcagtgaaactgtgtacatctaaattattgggaatacagttaaaaggcagtcatcttagtattttttgttgtgtaatttatttttgtgtattacttaactagacacaaagctgagaatgtgcatgcaaagtgttcctagtttctattcataattcatatttgtttactctcttttttgcctaggtcttatacaatatgttaattgcctttacaaagatgcataaatttgaagacatagaaactgtcgacattttggctggatgtgcccgattcatcgttgtggggcttggaggggtattgtttggcatcgtttttggatttatttctgcatttatcacacgtttcactcagaatatctctgcaattgagccactcatcgtcttcatgttcagctatttgtcttacttagctgctgaaaccctctatctctccggcatcctggcgtgagtacaaaccaaggatcaagtcacatagtaatagaaagaaagtttagaaccacatcacatgagccaggcatctgggaaagacataaccaatgacgctaaccctccaacatgttgcagatttaggatcttctaaacttttatgaaacctgattcgggttctttgtcaaaccaacgttctctccaatgcctgccttcatcttcttgtgatttgcctgaggaggaaagcatagcaattatcacgtcaatttagaaggctcaggaaagctggtacagagaaaatctggggaaacttcaaggttaagttctcatctcagtagtgtgtttttttccttgaaaagtgtttttttgtttgtttgttttgagacagagtctcgctctgtcgcccaggctggagtgcagtggcacgatctcggctcactgcaagctccgcctcccgggttcactccattctcctgcctcagcctcctgagtagctgggactacaggtactggccaccacgcccggctaattttttgtatttttagtggcgacggggtttcaccatgttagccaagatggtctcgatctcctgacctcgtgatctgcccgccttggcctcccaaagtggaaaagttaattttaaagttgaagagaggcatgcacgagggactgacattcctgggctctgccttctgctgtgcccctcaaaccacatcacacagccatggctcttcagtgtgtgatgaaactagacagatgggataagactagaaatctacatttccttgctctaatgaaaatatttttgaaatgcttatccttatgtccttgtatccttgagatgtttatctttgaatgaggcttctcagcttggcttattatatctgatgatgttgttttctgtacggcattatctttctttccagctattcaggcagatacatttaattttattgtagagaaatacctctttcaattaaatgtgatagtgtaaactctaggcatctgtcactttcccacctggaaaatgatcaaaacttctaagacaaggcaagtttctttctctttcccatacttgcttaatggctctagaacagaaatatttgaaataaagccaataaaaaagaaccttgcattgtcttagaagttttgatcatttatggttggattggaggaaatgagaaccttgaagaattattctgttattttggtttaaggcagagtaacgcagagagtgtgagttgggactgacaaactcttcatgaagagggcaagagggaagcattctgcattgggtgtgcccatgcgaattacgtgtccttttatttcaccgtgccacgcccaccttcccaccacattcacctttaccttgtaaagatctcttagggagggaaaagagggagaaagaaaatctgcggaaaatctgcagccacagaagggaataagggagatattcctgcatcaacacgggcttcatgcatctgtggcattgcctgtggggagggcgttttgtggagggggaaaacctcatggattttctctgagactctgctccttttatagaatcacagcctgcgcagtaacaatgaaaaagtacgtggaagaaaacgtgtcccagacatcatacacgaccatcaagtacttcatgaagatgctgagcagcgtcagcgagaccttgatcttcatcttcatgggtgtgtccactgtgggcaagaatcacgagtggaactgggccttcatctgcttcaccctggccttctgccaaatctggagagccatcagtaagagacggcagggctccagagtctccggtcctgctgcattttcagttctcttattcccttccgcaatgttaaaactggaggactgagtagatgctaactggttttaccggttagggtagactaggaacctggtcgtgagcaggaatcttttctgtttgttccctcagtcagctcaaagtaattagtggttgataaggttctgcattgaagcaaggctggggcaaggagtacttttttttaattgaagaaagaagtttcacatctacctatttaaatataattcagtcaatggaaaaatacatgtttgttactttttatttggagttgcaccaatgtttttggttcctaagaccaacatatcccttgctcttcacttctttgcagatttgtatcctcttgcaccttaaatcagatatggattataaactgtgggcatttatttacactttcactataggataagtgagatctcacaaattgtattctatggaagacaaatactgatagaaaacatccccctaaatagtataggtggtttcatttgagggttgagtgcatgaatgtgtgatgtatagcaaacaaacaaatcagaaagtgaatatttttaaaagagcttcgtattaattagtaagaacaactttagagtgtaactggcatcacacctgtaaaatgtaactaatcttttaaaatgagaactagtggctgatgatttatcttgtacatttatgtttcaggagctagaaaagaacattaagcactgaactacaatatatgtgttgccttttgattaaaagcaaatctatttttaagtgacttgactaatatttgaagcgttatgttaaatgactttgaccaatattttcaagccaattactcaaagagaaattaggtgaaatggctgataacctatcttgaacatattaattccaaattcatttaggatgggttttaggctctagaggagattaacaggaatacagaaatattaaaatatctataagtaactctgaatatatatgtttgttgggctccttgggggagaatagaggaagctgtgatacaagtttattatcttaaatcattatcaccggccttattacaaactagctgtttgatcttggacagacatgtaactactcaaaatcgtctccctcaaccacagaatgatggatttgaacaaatttcttagttccctttcagttctaatactctgggactctgggaatctacaggggagtagagctaatgccaagagaagtaaaattacagagctttagccgagccaaaaagaaaagaaactacctaggagaggatttatattgcaggaacctcaacattgttaatccttcatgatccagctcaaccccatactcttacagttgaggaaactgatggaaaaaccaccaaaacagtgacaaaattggccacatcacagcaattgacagagccaggtgttggaatccggttctcccgctcatagcctgttctcttcccaccctgactcatcacaactaatagtagttcacactcgcgaaggcttgctacataaaaggctgcatcttatgttatttatggatgttaaatttatttaacccttacattcacattctgagagaaaagctatggctaccccatcaagcagatgaggagtctgaggacaggaaatggttaagaacctcgctcaaggtcacatgactggcatggagaggaaccaggacaaacacaacaatattttaaaaagtaaattcacttatcttttgcactatccatgtgcctattatcaaagaatgcttgctggcaagtctgtgtgacgagacgcacatgaggatgtggagagttttattctacgaagtgaaactcttctttgattcatcagagctttagtgaggacctttcctagcaggcaccactgcattggtggtacctaggttatgtgagccgcttggggatgaaaaccaatgtggtagaaaactcctctatgtttcaagcaagctcttccaccctaaaccttctgtttgagaagctcactgagagtaagaagcgcccactcaccccccaacccttgccaacttccttctttgcttgcattgaacctcaagagggacaagccaacagtaagggatttgattgtagagaccacggtctctaagaggacccctctcatttttaaattacagacctcctttggatacccaatgagaatatgagatgataagaatgcatttatccccccacccactcaacaatatccttgctttgactagttttgaaaggtgggacaaaaattatgaatatagattagaaaatatataccttacattaacaaaatcaagattttattaatttaaacacataaatgcaggcacatacacacaacacatgccaataaactgtagcgaagattcccacttgaagtgctactgtctcacaactatcaaagtgagaagccataaaagatactctacctgggatagacaatcatgggtgtatgatggaattaggctgcattgtttgcagggcacgcgcacacaacctcagttcactagctctgtatctctgctcgttcatgatcctctgctctaatacacgtttccccctttctaggcgtatttgctctcttctatatcagtaaccagtttcggactttccccttctccatcaaggaccagtgcatcattttctacagtggtgttcgaggagctggaagtttttcacttgcatttttgcttcctctgtctctttttcctaggaagaaaatgtttgtcactgctactctagtagttatatactttactgtatttattcaggtaagtagatttcccttatatttaaataaataggttatttcaggacaatgtagtaaattagtaaaatacaaataaaggcattttatctgattttcagatctgtgctcaatacccaaactaaatttccggagatttctagatcatgtttgtgaccatcctttaacttctaaaatgtattgccttttaatcaatacagcatatttatcaaaagattcctgagtaacaggtgactaatagtcactccatatttctgaaaatgagattccaattagtactacgtagcacaagtttttgttttagttggagttagctcttaatgaactaatgaaagattattttaatgggtgaaaccaaattcctatattaacatacaggcatgatatctatttttattgcagtacttaaaggaatggaaaactgaaatgaacattgcagcatttactctgtaatagctagtacaaaaacatatagattggacattctaatagttttgttaataaatttgctctctctagtgacagtcttcattacaacaaaaccctttgttttgttatttctgatctagggaatcacagttggccctctggtcaggtacctggatgttaaaaaaaccaataaaaaagaatccatcaatgaagagcttcatattcgtgtaagttatctcatagtcacaattaataaattaacaagacatttcccctttgtcaccatgagacatgtgcacgtgtcactagacttcctctttccttccccactctgccaagagtgactgtataagtttcctatggctgctgtaggaaattgccacaaacttagtgcttaaaacaatgcagatctattgtcttatagttctggaggtcggaagttcaaaatccagttgttgcagggctgcgctcctttctggaggccctggggagaatctgtttcctcacctcccacagcttccagaggctgcctgtgttccttggcccatggccccttccatcttcagagcctgcaaaggctgcatccctccaacaatgatccttctgcctccctcttccacactgaaggagctttatgatcccactgcagccacgtggatagttcaggagactgtctccagcttaaggtcagctgattagcaaccttaagtccatctgccacttaatcctcctttaaactaaactaccatattcacaagttctggggattaagacatggatatctttgcaaggtcattgttctccctaccacagtctgccgtctgtctcccaaagattcatatctgttccacatgcaaaatatcttccttctatcccaataccccaaaagtctcaatacactgcatcatcaattcaaaatccaaaatatcatctgaatcttatcagttcaaaaatcccaaatctcaatatctccatcatctagagcagggctcagtgaggctctgggtataatctattctgaggctcagtttctcttcatctatgaatttgcaaaactcaggaaacaagttatctgctcttaaaatatatggtaggacactcattgaataacagttgtaactgttgcctttcaaaaaactatggagataatggaagaaaaaaaggagtcatcgatactaagcaaacttcaatgtttcctgggcaagctctatttggttccaagggctgggaatcccctaatctcttgcaactctttgttccaccctctgggttctcaatttcaccctctgaatcatacttcctttttttttttttataaaggtagcataaatttgcagctgagtaattttatcagtctatttcttgcttatagaattgtgagggtccgacatctttctttcattttgtcctccttttttgtccaagctggtgatgtttccatcagggttcaacagagaagcagagccagtaggatggatggatatagatatagatagatatagatatagatacagatacggatacggatacagatacagatacagatacagatacagatacagatacagatatagatatagatatagatatagatatagatataggaagagatttgttgtaaggaattgtttttcactagtgttagggctggctaggaaagcccaaaatccaggggacaggccatccagaagagcaggctggaaccctcaggcatgagccaaagctgctgtctacaagtaggattttttcttcatcagggaagcctcaggcctgttcttaagacatttcaactgaatcagtcccacccagattatctggggtcatctcccttaagacaactgattatggactttaatcagatctataaaatacatttacagcaacatctagagtactgtttgattgaataaccggggacttgcctgtctaaattgatacctcaaaatactatcacagtgactaacattcaaaattgtcctgtttgtttctaaaatcaccgttccaatgaaatatggggtcctctgccctttttgaatataggaggggcaaagggtattacttcttttgcaaacatggccgagtggcagattttagtgaaaacatcccagtcaggcaaagatgaatatgacactgggcatggtttctatttgtttgttcaagttcagcacaacattgaagggataccactgtgtacagctccaaggaatagaaatgagaactaatgtctgaagggttataggtggagacttcaactcagttaatgaaagagcattctgacaatcatttcctgattggcacacccgaagctgaagtggatgtgtctaaccagtgattgggaacatgtggcatagttgctgcacatgagattcaagctttgaggagatagttgaacttgaaaaattttaggtttcctctatccctgagaattcaccattttaatactagagaaactgatgaatgatgaagtcttccaaaatctaccctaaagttcatggtcaaagtgacctaggaaatttggttatttaaattccaggaaatcctaatgaaaaattttcaaggccatttgaaaataattaacagataaggataagtagtgactgttttaaaacatgtaacaacttaacatctatctttatctcctatgatttattatttcgacatattgcataatccacctaagtccatggaacttggatatttcactcttctctcatttatttttcttttcctcaaaaaagttataatttttggtagaaggtagtgaattaattatttaataattaatttaatatttcaaactatttttcaaaacaaaattcagaagccagtatagacttcaataatttcaaatttaaaatatttggagactaatttcataattattttgaagattgcactttttcctaaatttccataaacaatttgggttaaaacaaatgcaatataatttgcttaagtggtcatatgtaattactcagatcaaacgagcatattaaaatgagagatactttgttattctatgttatagtagaatattaacagaattatattttcagaaattatatgattggataacagtgtgttcttttcttctgcaatgaaattaaaagtaagttattacaattatttaataatatcttaaatatgatatattttattattattaattatcctccgagtgatttcagtaatgagaaatttcctagatcattctagaaaagtattatccaaagcaaatgccaggtgccctgttttcattacgtattatgtgaattatgaagaaacttatctacagagtctttaaaccaaagttgaaattactatgaaattactatgaaaggcaccaaatattttattacatgaacacagtgatagaaagtcagataggctccagaaaattaaaggctcctttgttttttaaagtgtcttagttgtcctgtgtgtctttcagagttcgcgtttctccagcaatcattttcttgtgtttgtttggcagctgatggatcacttaaaggctggaatcgaagatgtgtgtgggcactggagtcactaccaagtgagagacaagtaaggaggctgagggtttcactccctgacaaacttctaaaggttccattggaagctgggcataaaatcagagagaattcagggaatggagaccaagaagataaagtgctcctgagccatcccctacaggaagtggttgaaattccagggcatgctaagcctggaaaatgaagaattgtcaggtggaagacgcagttgacttggtgtaggttgtttcagagagaactggtacagctagtgggtagaaattagaaaagtaatatttaagttaaaaacaaggacaaggttcccaatgataagatcagctctaccacggaatggccagcttagaaaaggagtttagaaagggagcttggtgcctccttaggaatcctggcaagggattcctccattgttggggaggccatggtggaagatctttaagattctcaaatatagtaattcttttttaaaatgcccaaatccctcttcttcaccatatctcacctttcagaatgtattgttttactggacttagtttccagttcaggagggaggttgcggctagagttgtcagtgagtagctggaagctcactgaggatggggctctgagaagctctcactctcgtggcgcaggcaaggaaaagaaagtgcggaaggagattgagaagaagtggtcagagaggctggcagcgaagcacgagcgagtcagggtgtggagggcgcagaggggaggacccagcacgtcaggagacacaaagcatccagtatgggaagaatgagggcagcctctggagttgaacagggcaaggtcaaggcgagctcagtgagaagaaagtcagggagggtgttatggttggggaggtgattaccgtgggctgagaatacacaggaaccgcggcttctcatgagggcagaaaactagaagacagaagatcgacccagttggaataagaggaggcctggtctgagccgagctgggacagcaaagctcaggaagccagcccctaaccctggaggggcttagcacctcacagaccaggaaaccaattgccagataataaaccagcagcccggaaagctatgtgcccctctggaaaataaagcaggcgggcaaactactctttgaatgtaaaatgattgaaagtgttgaaaattccaactccaaacaaatggctgactctgaaggcaccatatgcatagcgcagctcagtcgaatgggctggccagaggttccttacaatagtcagcggccatcagtctcgcctattcagaatctccatcattcaggctattgggacatacgtagggtttttttcttccccttaattggtaggattcaaaatgatctgcagcataatggggcaaaactactgtaactaccgggccatttaaacttattgggttctggttgaataggccagtattactgtaagtgcagctgccgctgttatgcgctattagaatggaacacttattcaaaagcttcagccccctcatttcttctcttacaattggagctgagctgggctgggcctcccccgcgcctcacttatgcacactttttgccctgattgcagcttgtcccttccttttgtttagctgattttcaatgtattcaggccagtaggccattctttttttttattttaaaaaatgcataaatgctatgaatttttttaaaaaatgtgttcaaatgctatgaattccaggcactgtcctgatgtttcttcagaataaagttaagtagtaagtagtttgtttcaagagaaatgcatacttaatgtaacacatacagacgttcaagatttccaaaatgttggttttcatttttaggtttaagaagtttgatcatagatacttacggaaaatcctcatcagaaagaacctacccaaatcaagcattgtttctttgtacaagaagctggaaatgaagcaagccatcgagatggtggagactgggatactgagctctacagctttctccataccccatcagtgagtcatatctgttctttgttctaaactttcactgtcagaattccaaggggcgctgactcattgcctcatttaaaggtatacgaggagtaaagaggcagaaatataaagaagaaattatttttaaaatatgtaatctaagtcttggcatttttatggcttggcccaagctcacatattttacctagtttctgaaaattactttctagcaaatgttgcttccttagagttgtatgacatctttctttgggagggaagggcaagcgaatgtgtagaattgcagcatattttacaagactgtctcattttcctcttgacatgacccccgtgcatgtgattctgtccttcctaccattatgtttcttcccataagccatttctcttcctcttttacatgagagatgagttaactttctgagatgataacttggatttgggaaggagtgatgagagcaagaggtgtggtcattggtggtctatgtaaagagaaagttgtgtttgtaattgcatctaaggcgaaggtctacatgagattgtgaaatttgtcttgagtctatgtgagaccagcttggagtagaagcagggagttgcctggattcctggggaacagggagttgtggaagcaggacatagggaggggtgatactggaatataaacccatcattacaagacgattttctatgcaacgtggtagagcctctggtagccacttgtcccaagagctggctaaatacttcttaaagctgttttaactctgacatttaatgagagccccttcaatgtcaaaagaactcattaatttcccaaagatgcccagtttttctccaacaactgatttattgggaaaattaatcacaacatatatttaggataaggaacatgggccccctccatcctgttgtcttcagcaggtaaaaacacttgatcatatgcttcaattatgtcttcacatttaaaaaggaagttggaagaagagctaagaataggtagcaataaatttgtctctattgcctgagtgttatttctgagataacaccttcatcccttgcctgctaataaatcagaaacacccttgcatttcttacatggcctgagaagaatcctaactaaaagtcactaagaaataaggcagaaagctttgtattatactgagataatccctgaggatatctcagtataatacaaagctttctgccttatttcttagtgacttttctttgagggtggtggaggggttgtcggtttgttttgatgctgctcatcacatggctttaaggaaacttctgatattaaaatggaaaagtgttgacagatatatactggcagtgctctgctgcatcatggtggagccccaggcaaaggaaacatcaggcatatcgatcctctattatttaaaatgttgatattatattcatcagtaattttttgcattgacctttatatctataaatattgcatttaaatctgacttaccttagttactgagttttttgcaacccccttgcatttgacacctttgatccaatcctgtctgttaagacacctcctatgtgccagccaccttgaagcagacacaggccttgccctcatggacaccatactctggtagggtcatgacgttaacaaaaaaggccacacaaacataatcataaagaatagagagctacgcaagtctatgagaggtgcacctcacctgggctccttgcctttgacctgctcactgaaggatgaatgctgattaatgcagtttagaccatttcacttatgtgagcccttggtttcggaaggtatgggtgcttatctaaatgagaatcagtctgccgggtggcaaagcatattttgaatttttgtattacattgcatcagtcataagcatttgccttaatttctgatctcaaggcaatctttaaaccagttttatttggagtgggggcctgccggttaagtcaattatttctttagaaatgaatttaagattagtgagacagccttataggtacgagataatttttttttcctcgtacaccccaagcagttagttaactggggtgggagagattttttaaagttgatatttaatacatatttagtatttaaattgcctttatttgatctcatcagaaatctgtaggacgtcaagcaaaaaggaattcctctcctgagatcaaagcagctaatttcttaccaaacaaaccttcatacaataataggaaaaagaagtgtgtactcagctcgctttttattattctgtatgagatgataacaacaaaatgcacaggtatttttttctttagaagttcaagcaattgttctacaaaaggtttagattttcaaattctatgaccttcaggagaacactgccactatggttgtctatttgcacagtttggatgatgttgattttttggaatcccattgcttttacatacattatcttatttgaaactcaaagcaatcctgtgaataagtagaatatgcactttgattactatctcaaatatgaagcagctcatctcaccagtgagtggtaagctgttagaaattatcagagatagagacccaagctgattaaaagtgttgaagccttacacattttttaattaaagtgatattaaaatataaaatatttatatatttataggcataacaaacgtaacaaccatgcaacttcaaaatgcattttaaaactcccagataattttaatgtgtcattttttcaaaagaggcctaaagtaacttcattgtagtctaagaattttctaatggattgcacattgacaggtataaattcacatttccacattctcacacagaagactaggatgcaggttctgatgccatttttcacttccacaatggaacactgtattttgaggagcagcatcatctcagccactcatcactcattccaaatgttgttcatcttggtgacctctgtaaaaacatgctaagcagctgcacacagggctgctggtgggttccactgtgtgcaccgcaggcaagtcttcttgtcttctgagcccacttttcctacagacttcacatcttagctgcttaaaaaaagatgtgttcttctaaataaattcccaagtcatatttgatatcttggaacttcatcctatgatatgtgtattctactagatgttatagtagaattgaagcttctttttacattattatagcaactgaccaaaagagaaaaagaatgagggcagactgaagagaggttgattgatgagaacaaatatacacttggagagaagaaataagctctggtggttgataggactgtagggtaactatagttaacactaattgtacatttcaaaatagctagaagagaatgatttgaatgtttctaacataaagaaaagacaaaaatgtaaggtgatggatatcccaattaccctaatttaattatatgaatgtatcaaattatcacatacaccccaaaactatgtacaactactatgtatcaatataaaagataagtaagaagagttatgggaaagatgaacgttatattcaatatacgtaggttcagatttttccagtttgattgaaattattgcagaacttttatttaaggtgatgaagatctcctttatggataatgaatgaatggtccagtgacaagagtcttttggtttataagttgacttgatatagaaatgatcactcattcagtttttctaaagctgtatctcctgtgtttgtgctgtgagtatttcagggacgattttgctaatgaagtggcatgaagaaaactccaggtatcaccttgcccaagggaatcaattctgtagctgtagaatgatagctgatataattccatagctgcggcttctcagtgtggctccatgaagggaaatgcctttgggatacctggagcacccattccagccagagcttgaatggattttaactaagttcgtcccccccaaagtggtcagttataaactgggaagagtgccaagttacagctactgctatatcaagtgtaactttaccatttcctttatcaatggttttccctattaggttgtttcataatgaacacataaatggaactatttgactagctgttgtttctgcttagcagtacatcacattcaccacattaaaggaatgtgttcagattgtggaagtgtgtgggcatatctaaatcagaataaatgttatgtgaaggacatttaaacagttaggtttaaatgccctgataataatgtttagatcaccaagggtggtaactgtatatcaatagaggtggcatttgcagctttacgatatggaaactgatttcgatcagtttatagagaggacattagtcagtctacagatagcattgctaaacaaaatccaggcttgctgtgatattcagtatccaagtcctttaatatcttttatcaaatgtacattacttttaaaatgtcttcactatttatggctgtattgctactaatgttttgaaaaatacttaaaaggtggcctgtattaaaactaataaatactcatgtctgtggccaattatcttaagagcatatgcaagcagatatcaaaggcttcagtgcccttatgcgttcaaaattcaaaagagctgaggctagaaacaaacaaacaaacaaacaaacccattaaggtttatatcaagatgttaaggaaggtgatagtattaaaaagggagttaattatttttagttctctcctttttgttcttatgttccacatggaatatatattattcatgtaatacaaagttttttaaaattactgccactagattgtaatcaaatacatttgtcacatgatcattcttcccccagcaatgtcaggactttataatccccagaggacaattgtgcattgactactaacctgggcacaggcataacccgttttttaatccctttcagaggtgggaaggggtcacagtgtataatatcttagagctgggctggctttcatggtataaatggtctaattgcccttgtaaaatgtgattctggtttcttcaattatttcttaaccaaagataaaatccctacagatacaattccaatataaatgtactcatgaaactaatattctattagataaatgctaatcaaaatgtggtgtgtagatggtattaatctgtgaattgcttgtcacctgtcctcaatgagataggtaagtacaaaactagcaaagagtttgtctttgaatgaatcattttttttctgttgcatttaacggtaaaatatttggattgcatggtatggtatcattttctaacaattgatttttattgtgttgtacaaacatttcagtctataacagatttggaggaaaaaaataacttgttaccactttagacctttttaaaaaaatgggttggaataattaccatatataagctatagccaagggaacagtattttcaaaacctgaagtcaagacatgtgttttgacatcaaaccaacttactagaacaataggaaaaattatatgtaggattctggaacttaggattcccctcagtacagagcaaggcccactgatagttttgtggcacctcttgccaaatgaaagaataatgtttgtctcttctccaataatgattccagggcccagaggatacaaggaatcaaaagactttcccctgaagatgtggagtccataagggacattctgacatccaacatgtaccaagttcggcaaagggtgtgtatgagccacctgtgttgtccccattttctgtccttgaaaacagtctctgaagggggagtctgttgatgttcaagtctcctgatgttcacgtcaccctctgtaaggtggtaacttgctgaatattttctctctgcttagtttggagaatagaaagttaattgtcatgtttctgctgcaaaattggtacctgtgacataaaaagaaatgcaaatctagttaccgtctctagggggcaggctgccctagccctgcagcctggtgctgtccagaactagcaggtctctgtagagaagcacacacaccacaccacagaacaaagatggcaccaggatgctgatcacagtgcagttgtcccaattgtattgactatagtaaagatgagaaagttgagatagtttaggttacaatattgaaactctaatttataatgaataaatgcctgaataaaaggagacatcttatttctcaattttggaactaggtatgaaatctctactagtccttgggacctggtccaaagtgcatactaagaagatttctgaggacactggatgaatctttctgaaactttgacttagttaaataatattccatttaattagtcatctaacgaagtcatataatgacaagttttttcaagtttgaggatttgatcatccattttaatcctaatacttgggtgtgattggaaatgaattcattttgagggcctttggttttgtgactgtgtcgttgatcatagtcttaatgaaactaaaacaaaatcacctaggcaaagctccccattttcaaagagaagatgctgaggtcagtggagttggttatctgacttgttcaaggttacaaaacaaatccaggttaagaacacaggttttctacccacccacccagtgctcttttcatgactctggacttatataatccaatgaaagtgattgttttctggtctcctgtttcaactcaaaggtcaatgattaagaggaatgtgtcagtgaaaggctctgcaccagctggaggaatacaggtcagcactaatggtagtgcgcttagagtaaattccatggctttcaaatcattccaagtgaaactgtttcagtaagactatcacatcctgccttagataaataatagataacaacttcctggtttgaaaaatgtggctagcttagtgagagccagaacccatagggtacctggtactcagccttttccctatgtggatgaaggccaagtttagggaaaggtctagaaacggagatggagatcctaggactctaatccagtctcaaataaggtcaactgctcatcctttcttttcttccttggatgcagtttccaagatagcatcctttggtcttttttagtaagtatcctactcattctgctttccagtgttctactttctaagccatacagcacctcccttcctcattgccctcgaattaaagcacaaaggcctctttccatttaataagtttattgctgatgaccttgggagccaaatggggagaacacaattgataaacagagggcagttacaagcctatgaggtggctttttgactctgctttgcttactccgtaagtcaaactcaccagtcctaccccttcccgtcttcctttccttactcagctttacaaaggtcataagaattctctcttccaccatggtcctcttgatctcttgaaggaaaagtctacctgaaaatgcaactcaggacaattatacatttactctgtttctagcagacaatctacatttttgaggaatgtcacaaagggtgtacattagccatcctgcactctctagcctgggtgatagatgcaggcctggtagccagggcatttctcattgttcacatcttgaaagaggccatcttgggcgtcgggatttacctcagagcaggaccaggatgaatgcagagtttgactctgggcgaccctaatgcacagttgatccgaaactgagctggccctgctgggtctgttgctcctaggaggactccagccaattctgtttgaagtccttcgactcagtacacccaggacagaatcttcatgggtggaaaacttaagggactcacctctggaggttcccggtaggacaaccacagaagaagctctctgaaacacagtggggatggagattgagaaacactgttactaatcttacaagagaagaaactggcttcagcccagacctccaggataggtcacagattgatgggtgattcccgagtagcctggataatcagatcactctcagaatttctacatactttcaaaggaaaagagcaatttcagtttcctttagcaaatagttaatacacatctagaatgcaccgggcatcaggaacactgcactgaaaaagacaaagttcattctcctttaaggctcaaggtccagtgggaaatgcaagctccactataacacagaaatggagggagaggagcgaagacacttgcatggacattatatgcatagagccttctatgctccctgcagataggcaaaatagagaagcacgtgggtcatgggaggttatgggaggtgaaatggaagccaaatgtccaagtgttccttataaagtgcagcctcctcccaagtctaggtgtaggaaatcctactagcaatacattgtatgtatacaaacatgcacacacacacacacactgaattcagttttgcatgattttaaaactgataaacaattgtaaaagtttgtctctatattcttaattcttgtgttatttttcacgacagtgtcatgttaccattttttaatatttcaatgtataaaatgcacataggttgaggtgtatcattactaatgatagacaagaattcatatttcaaaatgtcttcaaaattcaacttcttggggcaaattcttgtcagatctgttaatttgccaaaagtggatgataaagagcttccattgggagaaggagaaagttggatttacccctccctcactgttcccttggccttcagtttatgccttcttttcttttcccttggagacagttgtcagtctcactctgtcacccaggctagagtgcggtggcatgatcatggctcactggggctttgacctcctagactcaagcgactctcccacctcagcttcctgagtagctaggaccgcaggttcacaccaccacacccagcatttttttttttttgtattttttgtagagatagggtttagtcatattactcaggttggtctcaaactcctgggctcagtgatccacttgtcttggcctcctgaagtgctaggattaccagtgtgagccaccttggcagtccagtttacaccttctttacaacactatttttatacaattatctattttgtgagggttactttagttaatagctaatggaaaccataaatctacttaactggatgcacatatactgaaacacaaacaatgaactgcaagccgatgaaaccgatgaggatgccattgtcaatcccttgttgacttgaccgtctcatgtatggactcagtgagggcccattataaattcatacattaagtactaatagagcttaatctgttttgtatttgtttggataaaaatcaatagaaatagaagtatcagtattttctttctcaccctgtggggcatcttgtggcactttttggagtgtgtgcaccctcctaaaaagcacatgacctggaaaatggagcctctactccttggcaggctgcctgtggcctggccgcagcccctccatgcccctccagtctcacctctcacacactttgaatgaagcaccccattcttttatggtaacagactcattcctggctcttttccagcacatcctctgactgttctctcacctctaaggtggttaccagctgatgtcttagctcatgtgttttctcttcctggaatttattcccaggataacactcactcatctttcaagactcatctcagtacactgaacctttcccatccaagactggatgaagtgccttttgcctgtactctatgacccccgatgatcccagaatcttatcacttagctgcacgcatagcatcttatccctattgatttgacttctccaggaaactgtaagccttttgaagactgtaattctaatttactcacttatgtaatcctgtgccttccacagcacctggcacatagaacattttctctattgaagtgaaactgactatccctattacagcatccgtcacttgggagggagagcccctgctgtcccaatcctatcatcctccaggactttgtggtttatcagtgcatacagtgtgtcacctactgacccctggcaaactgagcatttgctggtggacctttagtgagcaccaggagggagaagaaatttcagttaagcattttgcaaacatctgtctgaggactgactaatgttggcctagggtccatgacaagtttccactggtctggggtaaaggacaaggaagacattctcataaagctaaattgattcagtttgaaggactgttttttttaaatctcaaattatgttcttcctgtgactttggttaagagactttcttcctgaattgatgataatggtgataggaattgtgtgtgtgtgtgtgtgtgtgtgtgtgtttgtgtgcttgcgtgtgtaggtatccttaattggcaaaattaaaaaccaagagccttatggaaattcccaaagtagtttagatattttcctttcttattaaattcactggcctggcatcaaaaacatgacctggaaaggaaagtgtatgtaaggggcaggccaagtctgtgggtaactaagagaaagacctctgtaagggttagagcagaaggcagaggctctagccacagctccgccctgaaagcagtgacctggggtcatagacttttcttcttggcgctgaggcttgttcattcgtaatcaaggcaaatgcttagctgacctccaaggtgctcacctgttctcctggtcttaggttcctgatgtttccatggcttccttggctgaaagttgtatggaggagtccttacgtatttgacattccattttctctgcagaccctgtcctacaacaaatacaacctcaaaccccaaacaagtgagaagcaggctaaagagattctgatccgccgccagaacaccttaagggagagcatgaggaaaggtcacagcctgccctggggaaagccggtacattggggctggggactgggacattccttcagtgtgcaagtgtttgtcatctgctgagcctgttcctgtacaggatctcacatgcatgaccatcgatgcttaaacaaacaaaaccccaccttgttacctgagagatactaaagcaagagtgcaggacaccagagcaacctttttctctgggttcagggccccaaggcatctgcccatagggtgcttccctccacagtgggtcagggactgccacacacttggtgtgctatgagtccagacacagaccttatggtgaccaggtactgaccatgcccttcagtcctcatggtcagtacctggtcaccatggggtctgggtctggaccagaccctctgatcccaggatgcttacttctctcccaagaaggtataggaagggattggttgttaccaagactcctgggtcaccttcacatcagccactgtgttcctgcactcttcccattggaggccataacaaaccagtcttactggcaatttgaatggaggctgggtgagaagcagaccttaatctcaagcctaacctcagtggggatacgagagtaactttgaaaggttgctaatggtctattttatcatgagaggggaaggaaatacatgttggagactggcgtgttctgctttctcaaaacaaaaaaactaaaagccagtaatccaaacaagatgccacagaacaggtctgtgttcttccccttattttattatattagttttgagacagagtctcgctctgtcacccagactggagtgcagtgagtggcgcgatctcagctcactgaaacctctgtctcccgggttcatgcgattctcctgcctcagcctcctgagtagctgggattacaggtgcccgtctccacgccctgctaatttttgtatttttagtagagacggggtttcaccatgttggccaggctggtcttgaacccctgacctcaggtgatccgccctcttctgcctcccaaagtgctgggattacaggcgtgagccacagtgtctggccctttatttgccatgtgaagctcttaattgagacagcttattctgctttttctttctacttgctacccacaggctggcaccaagaatatccgctacctctcctacccctacgggaatcctcagtctgcaggaagagacacaagggctgctgggttctcaggtaagctgcccacctggctgctctgctgcttttctgtagagtcaggtggtaaatatctgggggtgtgggccaagaggcaacattaagaacattatgtaggttacttacatgataagaaaaagaagaaaacaacttcttttatagttgaaactcggaactttgtttatgaacactgaaatttgaatttcgtataatttttacttttcatgaaatattatcttcttttaatttttttcagccccttaaaaatgtactaaccatttgtagttgacatgccatacacaaagaggaagtaggccagatagagaccaagggtcataatttgatctcatcttgaagaaatgtgaaaggagtgtttcattgaagttctaatattcacccactatttaaatatgagcagagttctccaaagctggtttaatttcactaaaatgatttcaccagatttactgattaaatgttttccatttaatatttaattattaagtggaattcttagaattattgaaactttattattctaataaaagcagttactatttttatatgtgtataaaatgatttgctattagcaaaaggtgacataatatatgtaatatgccgtgttatctatttttattttcctaatttttaagtgttaaaatcatgttggaaattcacgtaaactaaacataaaggattttagtatttaacctttaaggagtatatgtaattacctcaaaatgaaactttttttctgatttaaaaacatacttgatacaaagtcaaaatcattcagtagagaaaagcataaaaaaagttaaaagcatttgcaaccctaatgccaaggtatgatcaccatagaatgttttggtgagcacccttctagaattcttcctatacctgcctgatcccacactacccatactgacacctccctccacaaaaaaatcacaaaaacattgcatcatatgatacataaaagcaaagtatagtcattgttttgcaatctttataaattgcctagttcactgaacaaatgttgtacctaggtttccatgtcaatagatgtggatctaatactcatttttaatgagttaataataattatatgcatgtaccaaagcttattaagctaattcctaattaataaatacttaaggtattatcaacttttaataaatataaacaatgatacatattaagggctctggaccacttgtgattggtattttaacaaataagcaattactcccttagtatattttcctagaagtaaaattttgaggtcaaattcatatagatttaaatttttacatatattgtcaaaacaccatcacaaaagattatatcactaatttgccctcacaacaacagtctgtaagaatgatcttttcctaataccactgggatgttgtcaaacttttgagtaatctgtgatatcgtagcataaaatttatatgtcagatttaattttcatatgaatctctttgatttttagtgaagttgaacatctttcacattttggaaacaatgatatttcttggggtgaagttttctgttcctgcctttgctcgttttttgttttgtttttttctatttggttgttgattttcttgagatgaatttgaagaaccctatataacaaggatatcatccattttatctcctatatgttgccaacgatttttttatttttttgagatgagtctctctctgtcaccccggctggaatgcagtggagcgatcttggctcactgtaacctctgcctcttgagttcaagcgattctcctggctcagcctcccgagtagctggaattacaggcatgtgccaccacacccggccaatttttgtattttcagtggagacggggtttcaccatgttggccaggctagtcttgaactcctgacctcaggtgatccccctgactcagcctcccaaagtgctgggattacaggcgtgagccaccgagtctggtcgatagtttaatttttttaaaccatcttcctggtacaaataacctggcactatttttgttatttgagtgagaaaacaagaaagtgtcacagttctttcttttttttttttaatttaaatttttttagaaaaaaatcttaaaaagggacagggtctccctatgttgcccaggctgatctctaactcccgggcacaagggatcctcctgcctcgcctcctaacatgctaggattataggtgtgagccaccatgcctggacgacagttatttcttaagagatgagcatcaatactgcatgcctatggtagcaggagatgaccacggagcagattcatttgaacaaatcttaaataagcattataaacaaaatacagcaaaacactaaagtacaatacaccttgcaaagtggggtttattccagaatttgagagttgtttaacatttggaaacatacatatattattcactagactgataaataggtcacaggatcctaaccttttaatggatgtcctcactaaaggatatctcagtcacactttcagtcaaagccataaaatgccaggaagaaatagacaggatatatatgaaggaaaaataaaattctacttctccacactgtcatttccggtctataaagaggatgatattggttccctccatatgcaattgtattgtcctgatgtgaagccagtctcatacatgcaggatacgcatatgaacaggtacataaagctgctagagcagagtctggaaccaagtagatgtgcaagaaatattagtcattattactattactacttagggacttaaagaagccttgacatgggtaaatacagatgttcttggaaagaaagacaacacttcaccatgtcagttctacatgaattacttcagacttggaatgaactgttagtcccaatgatttcttttctttcaaatatactcgactggttctaagtttcatccaggtgaacaaagacagtggttaaactagaaatctgagggaaaagtaatgaaatagcacttatgttagcagttttctttaataagttttaaagatgggaaatcagtgctctgcaatatgttatgggtcatatgtctgcaggattttaaatacttgttcttatttgtcatggaaacttatgcctatttatgcagactcatttctggcttgcttggaattaactctactgtgaataatttgtcatttctgtggttacgatttatgaaaaataataaaccatgatacatttaaaaaggattataatagtgatcaggataaggctgagatagtcctcaatgtgtaatcaagcacaattgatcattggaatccttctctccaaacccaaagtctttctgcaccaggagaatggctggaggggatctaggggagacagtggagagtcatgttctgcaggcaagcagtccctggctaacccacctgaaacttggagaatgcttcccttcctagctctccccttgccctccagggtcaggacttttcttgttctggatgtcttggagctccatgctggtttgggggacttcacatgcttttccagggctcttttgcctttagggctcacttggtgttataactagagaggtcttgactggaaacctcttatatgacctgaggctgcttagaatccatgtgcatcaaggcagatgaaaaagctctggagatgaatggtggcaatggtaacacgacaatgtgaatgcacttcatgcaatgaactgtacacttatttatagttagatgaaaaaaatggttaaaatggtcaattttatgttacgtatattttaccacaagtttaaaaaatgtggaggtggggagtgttgcactccgagtctgggtgtctgaacagtgtatcctgcatcaggtagttcatcctctgtgtgttggggcccgccctgcgctgagcagaagcaccttccttatttctcctttcatgccagggtgcccatgtccagaagttaaggcttttggtcaggtgggaggtaaaagaacacatactcagattttgttgccaaagtatccactgctctgcctggaactgcactacctgggtgcccatgtggaggagagttatgcgaaaaggacaaaacacagtcctcactcttcctttttctgccttctgctttccagccaacttattccttcaattttgggcagctctcagccgagtgaaactttgcaagtcacatacccatgcctcttcctagagcttggagtccactgtaaaataacccagagggtgatcaggaaaccaaaacagtgaccagggtctgtccactgatggagcactcaacaggaaaggttggagtgaaagaacagggtttgggggcagaagcctccaggccattgtttccttagctagtgcttcaagcaccaaggatccagaggaactggtcccaggccttgttgtagagaacatgttaaaggagagtcagggaaaaaaaatggacagatatatagatatattaattaatgttttctttattgaaagaagttggtctcctttggccaatttccaagttagcttcttagtataatttggtcacattttagaaaaacattattgaacaggatattttaagattttcaggtgtcccacattctaaatacattttttcaagtgtaaatctttgggcatattcattctagatatggagtttttgttttgtttttttaggagggagaatgagagaaagaacatggctttcagatttaaatataaaatacctaaattcttttttttttttttttttgagacggagtcttgctctgtcgccaaatctggagtgcagtggcgtgatctcggctcactgcaagctctgcctcccaggttcacgtcattctcctgcctcagcctcccgagtagctgggactacaggtgcccaccaccacgcccagctaattttttctagaaaatacctaaattcttaggagaatttttaaagggaaaataaatttataaggctaagactttgaagaagtgagagtaaatgatatatgtgagaaatattcctttgaagatgtgtgcacattgaagtggggacaagacaatgtcccaggcatcggttaggggtctggaagagaatccaagaggggacattgcatagacagctgctggctcccctctcatgaggtagccctccctcttacacgtggatacaccaaggagacagcaaggagacctgatggtaagaagtggatttgaagctggataggctctgctcaaactctggtcccatattcaccagcttatgatattgagtattgcttaagttcgtgaaacctcagccactttacctgtgagattcataactttactcacccgaaagggccgctatgaggattcaatggcatgatatatttaaaaggattagcacagtgacaggcatatagtaaattatcaggaaagggaagttcccatcaagtgccattcacagtctgtcacctgcttagtcctctgaaaggagggcatccggtcacgccctggtctctgctgtggctcccttctatccccctttctccaggattgactttttctatatcaaagattggaactcagatgtaatgctttctggtaaccactgattaaaaagcaaaccaagataaaagcaaccactttcagatggctgcaccacataacctgtgtgtagcattggctttggacaagaccaagcatctttgtgtcccatggtttatgtctatggccaactgatctgattctgtaaaaagacactaccttacttacctggggagactggcttgatacagcattttgcatgcatttctatttatttatgacactgcacttatagcttctgtcctcccatctgcttggggcagtgtccttgagaaggaaaaattgtgctgataagaaagttgagtgtagagctgaaacctcaggaagagctttgcttcactctgagttcctgccatgtggatattaagtcttaactctgatcttaagtcttgttctttccccttcttgccatgatgttttcctagatgatgacagcagtgatccaggatccccatccatcacgttcagcgcatgctctcggatagggtcacttcagaagcaagaggcacaagaaataataccaatgaagagcctacacagaggaaggaaggcattcagctttggttatcaaagaaacacaagccaagaagagtacttgggtggagtaaggagggtggccttaagacccaaacctctgtttcatgcagtggatgaggagggtgagtctggaggggagagtgagggcaaggcctctttggttgaggttcggtcgaggtggacagctgaccatggacacggcagggaccatcacaggtcccatagtcctttgctccaaaaaaaatagtgttattgtccacaagattgttttggtgtttctcaagagtctgtcttcctataactgtgaaaggaggatttctggaattcagaagagagctattgagtttgctgtgttgaagctattaaacatggatctataagcagcaggaagattttttccaaggactgggagcaaacttgcaggctctgccatgtacttattgtggggtacctttagatgaattccctgtgagtgagagaagttgatcaccccaggaattagtcactaagaattcctaagaactttctatcaaaagcattggatccaagccatatattgaaatacaagcgtgattaatcagtaattcacattgccgatatgcatatgcaacttataatcaaatagaactagaagagactttgaagtcacctgactcagccccttgtgtttacagacaaggacatgtagtccaaggttgcatggtgagttcacagtcggattgtcctccctccaaactgaaactaatttgattttgatttcatattcaatatgcaataattatgttctatcagagataaaatttgttatgaatttgctttatttaatcagtagcaatgatagatgtgatgcatactataggattaatctgtgaacaatgggtttacggtctatttcataattgaaatatttattttaaaaatgaatattagaaacaaaacagccataaacagagtttaatagcaatgatgttaacaacaagtatttataaggggtgcatttgtagggtgtgacattttaccctagggtataaaactatttttcttttattattattattattattattatactttaagttttagggtacatgtgcacattgtgcaggttagttacatatgtatacatgtgccatgctggtgtgctgcacccgctaactcgtcatctagcattaggtgtatctcccaatgctatccctcccccctccccccaccccacaacagtccccagagtgtgatgttccccttcctgtgtccatgtgatctcattgttcaattcccacctatgagtgagaatatgcggtgtttggttttttgttcttgggatagtttactgagaatgatgatttccaatttcatccatgtccctacaaaggacatgaactcatcattttttatggctgcatggtattccatggtgtatatgtgccacattttcttaatccagtctatcattgttggacatttgggttggttccaagtctttgctattgtgaataatgccgcaataaacatacgtgtgcatgtgtctttata

SEQ ID NO: 35 - DNA, 13400 bp, Homo Sapiens
gccaattgctgaccgccacagccacagccagggctagcctcgccggttcccgggtggcgcgcgttcgctgcctcctcagctccaggatgatcggccagaagacgctctactcctttttctcccccagccccgccaggaagcgacacgcccccagccccgagccggccgtccaggggaccggcgtggctggggtgcctgaggaaagcggagatgcggcggtgaggcgcggcttgggccggggctagggggtgaagggggaggaaggcggtgggccccgcctgacggagggcgtgcaggatcgcgcctctgactcggtaaacccgggctccgctttccaaatagcctccacgtgttcaaaatagccgccgctgtcccccatgggccgccatgctaaagggccagccaatgggaacgcgtctcggggcccatggcgccaatccgcgcgccgcaggccctcctggctcggtgcgctgtccaatcagaggggagagggggcgggacccagagggaggttttttgccgcgaaaagaccacgtggggacgcggtggggcgggtctggcgggggcggggcacctctgtgcagggttcccagtcaccgcgacgctcctcgggaagccatagggcgcctcccagcccgtctccccgctccagtttagaacctaattcccaattcccggaccgggcccagccctgggctcttactgtccgcttttgctgggacctgttccacaaatgggcgtcttctgccttgggccgtgggggttgggccggaagctgcggacgcctgggaaggggccgctgcagctcttgagccgcctctgcggggaccacttgcaggccatcccagccaagaaggccccggctgggcaggaggagcctgggacgccgccctcctcgccgctgagtgccgagcagttggaccggatccagaggaacaaggccgcggccctgctcagactcgcggcccgcaacgtgcccgtgggctttggagagagctggaagaagcacctcagcggggagttcgggaaaccgtattttatcaaggtaaatatggaaatgcaccttccataagggtaaatgtggaggctgccggcccttttgtcttgttagtgtagccggccaagttcatgtttccgtaggcttaggttgtacccccttcaacctcctttactcacaaagggggtaaaagaaagccatgatgtttcactctgcagctttatattggttaaagttgttaacgacccgcgagatgatatcatggattcatttaagtcacatagtctattgtccaggaaaggctggcgtagtaaaatcaccaaccatcctgaatgaaacctggcttgagctttaaaaagccgagaggagtggcactgtcaggacccagcccagagaaagaggcaaggaattgacctgattgaaccacttaggtgggggggcaggcactgtttttgtttgttgttttttaaaagaatttggacataacatgacaaagaactaatgatgttccaaataacttgcactagaagctttcttattgaattcttatggtttccaatgagaatctgattttaagtctagtttatctttaaatcagctaatgggatttgttgcagaagaaagaaagcattacactgtttatccacccccacaccaagtcttcacctggacccagatgtgtgacataaaagatgtaagtacaacttgttgataatttttattggggagaaggagtcaaatagtatttttaaattagggacactggagttaagccacagtccatcattcagtagtaaataaaacactgaaatcccgaggtttggctgactgtatttcagcctgtatttactctttttaatgtttaccacgtggtatttatgtggcaaaaaggaaaactatgtacatcctgtgctcttatttcttgtattttttttaaatcctgaaactaacctcccgcggtgtcagatgttatggtggtggtgaagttcaaactgacacacaaagcagttaaatcttttgcagcttgttatagtcaaccccaccttgacctgaccacactgccttatagttagcactttcaagctcttgacttctggcctgaacagttttgtggttctgttatcagatccctttgctttagtttgtcttatataacagttgctggttggcggctctcatccatcttgtgttcagaagttcgtggggctgggcacggtggctcatgcctgtaatcccagcactttcggaggccaaagtgggaggatcatttgaggtcaggagttcaagaccaatgaaacctggtctctcctaaaatacaaaaattagccgggcatggtggcgcacgcctgtaattccagctacttgggaggctgaggtgggagaatcgcatgagcccaggaggcggaggttgcagtgagctgagatcacaccacttcactccagcgtgggcgacagagccagaccctgtctcaaaacaaaaaaaaaaccgtggcttctcactgttgaactatgaaagcagagcaaccctctttaaatagggccacgtcctacctctcagccttacctccacctcccactctcccactccagagttggacagtgtggcaaacccctccccacttctgtctcttaaaaatcaagtagatgcctctgtggcacctccttgaattgaagtccgttgcctgccacctctgtgatccagttttcctctgagctgctacgatgcatttagcacctgctgacactggacttttaggtttcttacccgttttcctcccccgttttgtaaactggggcaagaatcttgtgatttaatgaatatctgtgaaatgacatagaagtgaaataggtgaataaatcatcttgataaggcagccacacctaatacttagaaaatctcgtaagcttaattttagagtaagaatttagaatctagctctttggttttgaagctaaattaaatcctattaagatcaatactaatttgcttcttgtttgaatgccctattctgaataccagtaatcagtataaacagggaatattaaaaggaatattttgagggaatgctcaaaaaccagtttcaaacctatgaggatcagatgggccagcagggcttcttgacagaccagcattgggagagttgtttcacaagagaatatgttggcatggtgtgaacaccaaggggagggacaagaggtccccaaaagcctcctggtcatggaacatctggagctggattctgaaagatagagtatgtcagctgtggaggaagattctaagaacgcaatggcagaagcttgagaatgaagactaggtgggtgggccctggatgggaaggacgaggcggcctatgtttcaacacctcccgtgacaggaacttcatttcatttcattgtctcttgccacctactcccatggcccttttgatctgacctcattctcttctggctccacctgttagaggatataggggagcagacaccctcatatgctgctggtgggaaatctgaattgctttttttttttttttttttttttttttttgagatggagtgcagtggtgcaatctcggcttactgcaacctccaccccctgggttcaagcgattctcctgcctcagcctcccgagtagctgggactacaggtgtgcgccaccacacccagctaatttttgtatttttagtagagatggggtttcaccatgttggccagatggtttcgatatcttgacctcgtgatctgcctacctcggcctcccaaagtgctgggattacaggcgtgagccaccatgccaggccctaaattgctttaattcatcgaaaagtaactgggggctaggcacagtggctcatgcctgtaatcccagcattttgggaggccgaggagggaggatcccttgatctcaggaatttgagaccagcctcagcaacataagggaggccgtgtgtctacaaaaagtaaaaaaaaaattaggtgggcatagtggtgcactcctgtgggcccagctactctggaggctcaggtgggaggaccacttgagcccaggagggcgaggctgccatgagctgtgatggcaccactgcacatcagcctgagcaacacagcaaaaccgtgtctcaaaaaattaaaaaagcagctaggtacatatctttacaagtttaaaatacgcttagcctttgaccagcaactctgctattagcaatctatgccatagaagtgttttatttgttttgtttatgtttgtttgaggcagggtctgtgctgcttacattacagtattgtttaattcctgacccctggtggttcacaggtgaaggttgtcatcctgggacaggatccatatcatggacctaatcaagctcacgggctctgctttagtgttcaaaggcctgttccgcctccgcccaggtacagttgctttacaggtgactgcagtccagacatgattcctttcagatgtgtacttagcttattacaagtgggactatctggggcactgttcactagccttggaggaggatttctcggcctcagcaccattgacatttggggctgagtcattctttgttgtggaggaggagaggagtcctgtgctattgcaggatcttgtgccacatccctggcctctaccactggaaaccaggagcaacccccagctcgtgataatgaaaaatgtgcagacattgccaaaagtcccttgggggcgtaaaatcacccctggttaagaaccactgctttgggccgggcgcggtgactcacgcctgtaatcccagcactttgggaggctgaggcaggagaatcgctggatcccgggaggcggaggtggcagtgagccgagatcctgctactgcactctagcctgggtgacacagcaagactggaaaaaaaaaaaaaagaaccactgcttttggaggatttggtgtatgatatacataaatatgctaaggacagaaaactgtccctgagcaacagtgggggtctgggttgtaactgctgggttgatttacttaggttttccagagtgctgttaaatccaagtacagactaaagtaaaggtctttggcagagtcacctgttagaaggaggactggcagtgttgatctcattaatcggcgccatatgtgccagtgtcccttccaagggctggctgtaacttctaaccttttcacatatgtcttagacgttactgagctttcaaaattatgcttaagattctgttttttgtttttcttgtggcttgctttcagtttggagaacatttataaagagttgtctacagacatagaggattttgttcatcctggccatggagatttatctgggtgggccaagcaaggtaagccagcgactgctagattttttttttttttttttttttgagaccgagtctcactctgttgcccaggctagagtgcagtggtgcaatctcagcttactgcaacctctgcctcccaggttcaggcgattctcatgcctcagcctcctgagtagctgggaccacaggcatgagccaccatagctggctaattttttaatgtatttttagtagagacagggtttcaccatgttggccaggctggtctcgaactcctgacctcaggtgatccgcccgactcggcttcccaaagtgctgggattacaggcataagccaccacgcccagccccgactccattgttgatggtagtggctgctgccattatgccggctgcagcagggaagcacagcttgctacactggatcccatcaagcattggtttcatcatggatttagctcctgttgctgggtattgggctgatttgcctgagcctacatttaacctgtttctctcatgtgtataggtgttctccttctcaacgctgtcctcacggttcgtgcccatcaagccaactctcataaggagcgaggctgggagcagttcactgatgcagttgtgtcctggctaaatcagaactcgaatggccttgttttcttgctctggggctcttatgctcagaagaagggcagtgccattgatagggtatgttttgttttctttcttttttttcttttttttttaacactataaaaacaatgtaaagaattctaggagtccctgctgtgtttggtcctggaaaatccatgttataaaataacttttattttcccttaggcctgttataagggtttcccattgaaaactgagaagaatttggacaaattataggggtgatgagttgtgtatgaggaaagcaaagcaactggccaacttgtgactgaatgcagttggtgctgtaggcatgaacttggtgtctacaagatacaagtccctgggtaccattcacttaacaagtgatggatgaggcatgtttctggcttccaagaaatttgggaacatatagaaaacacaaagaattccactcaatcacaaatttaacttgcccatgaaaatactatcagtgatcattattgttttgtttctgggttttttgttttttgatggagtctcgctctgttgcccaggctgtagtgcagtggtatgattttggctcactgcaacctccgcctgctgggtttaagtgattctgcctcagcctcccgagtagctgggactacaggcgcccgccaccacacccggctgatttttttttattttttagtagagacagggtttcaccatgttggccaggctggttttgaactcctgacctcaagcgatctgtcctcctcaacctccaaagtgctaggattacaggcatgagccaccacacccggcctatcggtgatcattattaaccccaaggtctaattgcagatacccaacacgaccaaaccagtggctcccctccctacatcttccccctatctgctacctccctctttcccttcactcactgaagcacttctacacctggttgtggaaatcagagacctaaaagtcatccttgaatcctccatcccatcagtaaatcccatcaactctgcctcccaaaacaccccagtctactgcttctcattcgccactgctgcccttcaggcatgagtcaccatcatctttctccaggagaaccgtgatggactagagatggaggcttgatggagagccgcagagtggaggagggagagatagggggtgggaaggagacgagccaggggtgtgttcatccctggcaaatgggagagacattgggtgggggagaaattatagagtaaatgcttcaatgatcgaaggcaagggcttagcagaggtaacctgacaatagtttttggtgtatcagcaggaggtaacgggggtatcagaaatgtgcacgtatatttaacccctaccttgtgtgggtactaggttgagcacttttgttttttgagatggagtctttctgtcacccaggctggagtgcagtggcatgatctcggctcactgcaacttcgcctcctgggttcaagcacttctcctgcctcagcctcctgagtagctaggattacagttgcctgccaccacacccagctaatattttttatttttagtagagactgggtttcaccatgttgacaaggctggtcttgaactcctgacctcaagcgatcctcccatcttggtctcccaaagtgctaggattacagatgtaagccaccgcacccgaccaggttgagtactttgcatgcagaatcttacttaactctcagaaaggctttgaggtaggcatacacttgtatgagtgacctaagatctgactggtatgaactgctaagatgtgatcatctaggtatgtaagaagtgtgcgtgagagtaattgctaatctctatcccttagggaggtttacggccagtgttgctcttccgcagtatattggtaatctttaatcatggtttggtctgaaagtaaacagttgttaaagtagcttggtcattaaagccaaattgcatatctccagcccagtgtctcttctgatctatagagtgccttgttactactgccccatgaacatgccaaattcaacattttccaaacgaagtttctccttttctcatccatgcttcactaaacttcctcctctgcactccctagcagcaaaaagcaccatcatctgcccagttgtccagccagatctattactgacacctgcctacctctctttctcccctcttctgtcctttttttccaccttcccagtcagtcagtcattcatatctgtgttctttcttccccctccaaatctacccctgcctgaccacctttgccttcattcaggccctcacctgatcttgcctggagggttctgatgctttctccctggaaggccttgccttaggctgaagatctgatttcaggggggtagaggggtggcccccaatcggcctcccagacttaactctatccctctttgcactccgatccctaggctgacccattcccctttactttttcacggtgccccacttccctgcctttgcatatcctgctttctctgcctacagtgtagaggtcattttcttctgggattctttagagctctgcagggctgacatttacaggggcctgtgctgcttgcgtgtgtgttcagcatttggtgtgcatgacttcttatcacactcagcccctgtgatcctcatttgattggtcacagtaacttcataagctgggcggtattgttattcccagtctacagatgaaaactgaagcagcttagagttgcagcaacttctctgtggtacagctactgagggtagaggtaggcctcgaccccgggcagtctggctccaggctctgtactcttaaccacactggattgcctggctttagtcctcacccctcatcgcccctcctggactgagccccttgaaggcaagagtgttttgagaaacagtgatttgttcgttagtttttatatacagaaaagaagaggaaaacaaaaatggtctatatctccctgttaaaataactatagttgatattttaaaaaaatcaaagtagtcatttgccacataatgatgtttcagtcataaactgtatatatgacgatggtcccataagattataatattctggccgggtgtggtggctcatacctgttatcccagcactttgggtggccgaggcgagtggattgtctgagctcaggagtttgagaccagcctgggcaacatagtgaaaccctgtctctactaaaatacaaaaaattagccaggtgtggcggcgtgtgcctgtagtcccagctacttgggaggcagaggttgcagttagctgagatcatgccactgcactccagcctggcaacagagtgagactctatctcaaaaaaaaaacatatatatatatacacatatatatatacgtatatatatatgtgtatatatatatatataaaaaatatttttactgcatcttttctatgtttagatacacaaatgcctaccattgtgtcacagttgcctatagtatttagtacagtaacatgctacacaggtttgtagaccaggagcaataagctacactatatagcctaggtgtgtagtggtaggttatcccatttgggtttgtgtaaagatgccctgtggtgtacggatagcagtgaaattgcctaacaacacacttctcagaatgcatccctgtcattaggtgatgtatgactattgctttttttcttttgaaacagggtctagctctgtcacccaggctggaatgcactggcttgatctcaactcactgcggcctcaacctcccaggctcaagcaatcctcccaccttagtcacctgagtagcagggaccacaggcgtgcgccaccacacctggctaatttttgtatttttttttgtggagacagggtttcaccacgttgcccaggctggctcttgaactcctggacttaaacgatcctcctgcctcggcctcccaaagtgctgggattacaggcgtgagctaccacacctggccactgactattcctcttttttttttttttttttttttttctgagacagtttcactcttgttgcccaggctggagtgcaatggcgtgatctcagttcactgcagcctccccctcctgggttcaagtgattctcctgcctcagcctcctgagtagctgggattacaggcatgtaccaccacatccagctaattttgtatttttagtagagacggagtttcttcatgttggtcaggctggtcttgaactcctgacctcaggtgatccacctacctcagcctcccaaagtgctgggattacaggtgtgagccaccacgcccggccaactattccatttttgtggcgagatttttttgtttttgtttttgttttttaattcttccttcttaggagctgtaagactattcagagagttcagaaaggcacaaaatggaaagtaaatggcttccactctttctcttaaaggaactactaaatacagtgtcttgggtatttttctaaagtttttaaaaaatgaaattattttgcattttgttcacttggtaaattttggaggtcatctcatcagtatatttatctttcgcatgtttttctaggagttatgtggttttacattgtaagaactttagaaaaatacatttagccagttctgtaacactgaattgtatactaggttttagctgacataagcagtgtgtcagtccctttatatgtacctatttgtgtaggtacaactggtccctggcttatgaagtttgacctgatttttttcgactttacaatggtgtataaccatactttgagcactcacacgttgtttttttttctttctttaagagacagggtctcttggctgggagcagtggctcacgcctgtaatcccaacactttgagaggccagggtggcggatcacttgagctcaggggtttgagaacagcctgggcaacatagtgagaccttgtctctaaaaaacacaaaaaattagcctggtgtagtggcacgcacctgtggtcccaggtactcaggaggctgaggtgggagagtaacttgagcctaggaggtggaggctacagtgggccacagtcatgccactacactctagcctgggtgacagagtaagaccccatctcaaaaaataaaaaattaaaaaaaaagatcttgctctgtcacccaggctggagtgcagtggcacaattatagctttttgcagcctcgaactcctgggctcaagtgatcctgccacctcagtcttctgtgtagctaggactgcaggtgcatgccatcacacttggctaactttttaatttttttgtagagatggggtctcgctatgttgcctcagttggttgtaaactcttggtcccatgcagttgtcctaccttggcctcccaaagcactgggattacaggtgtaagccaccgtgactggccccgttctatttttcactttcagtacagtgttcaatgagttacatgaggtactaaacacttcattgtaaaagaagctttgttttgcccagctgtaggctaatgtaggtgttctgagcatgtttaaggtagggtaggttaagctatgatgttcagcaggttatatgtcataaatatatcttcaacttaggatattttctacttaggatgggttttccaagatgttaaccccatccattgtgttaataagttgaggagtttatctgtgtgtgtatgcatcatggtgtcctttagcaaatacagtcttagcagtggaaattgctggcagtatgatagggacacttgaaaattgcatagataattgccaacttgaaggcagagggtggtgctctttgcatctcagagcctagcaaaggtaggtagttgctcaacaaacggactaatgttctaatgcaaatgctgaatgctccactttggaagggggagaatttagagggcaaaggggaatcgcacagggtcttaaagtgcaacagccacagtccttcctttttggggaaaaaaaaaaaaagtcccggccgggcatggtggttcacgcctgtaatcccagcactttggggaggccaaggcgagcggatcacgaggtcaagagatcgagaccatcctggccaatatgatgaaaccccatctctactaaaaatacaaaaattagctgggtgtggtggcacgcgcctgtagtcccagctacttgggaagctgaggcaggagaatcgcttgaacccgggaggcggaggttgcagtgagtcgagatcacgccactgcagcaagactctgtctcaaaaaaaaaaaaaaaaaatttaaaaagtcccaaatctgccaccatttattcttgatctttttcagaagcggcaccatgtactacagacggctcatccctcccctttgtcagtgtatagagggttctttggatgtagacacttttcaaagaccaatgagctgctgcagaagtctggcaagaagcccattgactggaaggagctgtgatcatcagctgaggggtggcctttgagaagctgctgttaacgtatttgccagttacgaagttccactgaaaattttcctattaattcttaagtactctgcataagggggaaaagcttccagaaagcagccatgaaccaggctgtccaggaatggcagctgtatccaaccacaaacaacaaaggctaccctttgaccaaatgtctttctctgcaacatggcttcggcctaaaatatgcagaagacagatgaggtcaaatactcagttggctctctttatctcccttgcctttatggtgaaacaggggagatgtgcacctttcaggcacagccctagtttggcgcctgctgctccttggttttgcctggttagactttcagtgacagatgttggggtgtttttgcttagaaaggtccccttgtctcagccttgcagggcaggcatgccagtctctgccagttccactgcccccttgatctttgaaggagtcctcaggcccctcgcagcataaggatgttttgcaactttccagaatctggcccagaaattagggctcaatttcctgattgtagtagaggttaagattgctgtgagctttatcagataagagaccgagagaagtaagctgggtcttgttattccttgggtgttggtggaataagcagtggaatttgaacaaggaagaggagaaaagggaattttgtctttatggggtggggtgattttctcctagggttatgtccagttggggtttttaaggcagcacagactgccaagtactgttttttttaaccgactgaaatcactttgggatattttttcctgcaacactggaaagttttagttttttaagaagtactcatgcagatatatatatatatatttttcccagtcctttttttaagagacggtctttattgggtctgcacctccatccttgatcttgttagcaatgctgtttttgctgttagtcgggttagagttggctctacgcgaggtttgttaataaaagtttgttaaaagttt

SEQ ID NO: 36 - DNA, 17180 bp, Homo Sapiens
tcctcctgtggtatttccccatatcagttgatggcaaatccattgctgtggtcactcgggccaaaaaatcttggtcttatcctctactcctctttctttcatacgctctcactaatcccttggctctccctgcaaaatgtatcaaaaatttgaccactcctcatcacctctgctgccatctccctggtcctggccctcatcccctcttacctgatactgcaatcagctcctgactggtctccctgcttctgcccttgttttctcaatctgttctcaatacagcagcaagaattttctgtaaaaagacaaggcagatcatgtcactcccttgcttgaaaccctgcagtgacttcccatgttactcggagtgtgagttttactgtaacttattagtttctacgtgatgtggctccccatcacctcttagatctcatcacttattctcttccctgattttctctgcttcagccatatcagcctcattgctgttcttccaacacaccagacatgctcacatgagggcttttgccctcgctgttctcttagccgggaaactcttacccggaaatctgtatgccacgtagcatctgctaaactgcagctccatatgttggggcgcctgagcagggataagaaagggagtgaactgaagaggaaacaatggagtcaggtcccgcacaagaaacaaaatgcccgccttgcttcctctgtcttcctcaggtacctggcttcaggagctcaggtggggggtctcctgcggggcaggggggacgtgccccactctagttcttcagaaaatacccatctgcatcctaacctcaaaagatcctgaagccctgaaggaatcacatctctctggtgctcctgcagacctcccaaaaaggaaccactcccctgaccccgaatgtggtggtcctccctgctctgctcctaaaggatgtagggaagaatgggtctcttccagtcatccactcaccacatatgtattcctcccgtctcccgctgggcctaggcccagccagggtaagcccaccacctgctcccactcttcttaacttagcttcccttcctttcctcctcggccctttctagctgttcccagtctgcaggccttccccacgggcacacaggtggagaaaggctgaggactcagcggacagcctggtgtggtggggtctctaagtcatggggagaaggcaaggcggcttgaagggaagggtttgaaggtggaaggatgcagaaggccagagacaagaagacgggagcaaagacagccagaagctgtgatgatacggtgatacagagagaagtggaggcagcatcggccagaacaaggggtcaaagtcagaggcagaaacagcagcgagaaaagcaaaagctgacagatggcagaagccacagacaggcagcgcaagggagaggcagacacccagcgagagagcaaacgggagaggcatcgtgagacgcgggagcagctggagagggaggttagggcgaggtgcatgcaccccaagagatggagaaacagagaccagagcgagagacacgcacgcggacagaccagaaggctgcagagagggcgagggagaaaaaagtgtcgaggcggggagtggcgggaagcggccgggagcggggcgggcgcagcagagcgggcgcggcgccgggagctggctcgtaaaagccgcgtcgagcggggaaattaccgccagaatcgctgagctccacaaaacgccgcccgcgcggcccgccgccgagcccgctccaatctccagcctcatcgccgcgcgggctggttatgcatttaaatgttatttaattggattgcggaggagctgggggccagagcggccgcccgcccccgccccgcacgctccgcacgcccgggctgctcgcctcctctgcaaatctgttttccaagtcacagattgcagcacgccccctcccaaaacgctccccccacccagacagctccccttcgagtctgggctccttcttctgttcccccgcccaaacagagccagaggacactcagaaagacacgacaagccccccgaagatgccccaaacacagaggctacacaaaaataccagacacacaaagacacaacagcagcaaaaatgggtcacactcaattacactagtgtccatctggaagactgaaaactgcagagacaaaaaagatcccatgatcacaggaggacacaaatgcatgtaatacagtggactcccactctaggggaacacactaccctaccccttaaaacggtacttgcaaagcagcgctaccaaacacaggaacaaaatgatgctaactcagtgattcacaggggacacacagaccttccatacagccaggtaaggagcaaaacacatccacactcatgctcagagcaaagtcatcacaccccaatcactcagctgtgtggccttccagggttgaaggcaaaccccttccttcaaagacattttgttcttctcccaagccacagaagtatcatcacatgaggttctgagagggagctataagtcagcaggtttctaaaaactgaacaaaaaaacaacccaaattacagcagataggctggagggtagataccagaaagagcttctgaagaagacaaagtgtgagatcccaagaggagaggctgggcatttgtgtgaagttgggattctctcagtcaactgttgacaggagacccttttttgctgcctgaatcaggtgttagcaccatccaggtagatggaaggacagaatgacctgcaaaaacatgtcctccacatactcctaaccagcggacaggaaattgctggcctgaaaagatcagggtcaagctgcttcaattaatgaaaatggaaatggcaacctggcttggcacaggccaccatggaggactgttctgggctctcagccatccctcctgcaagccaggactagagacagacatcaggctgagggtccttgaatgagatgtaggggcagaagaatggacaagatgtacaggaaaattcttttgcaggtgttttgtttgttctgttttgtacttgagagggtgagggccaaaataaggagggagagaaaaaaagaaagtttcctcaaatacattataattcaaccttgactggtgagcatgggcttgagccaggctggcattaaggtctctgaagaagaaagcaattcatcttcccccaaagtaatttatttctatatcacctgatggtcacagctgggaagtttatccatgtgtctaacctcaatgtctcatgctccagttgaagttctttacttctctggggcaccagggaagaagaggaaacagctgccctatatcctcctaaacaagaatattcagagtcaacacttagtctgggataggctgcaatctctattcccttcttccattccatcactagcttctctaccccagctgtggccaggctgcatttccagtcttttttgatctgctacctggacattgcctgccaccatctgctgcagttttccatccccaaagttaacagatgtgttctgaaaggaagctccacttctcatcttccatagggccacacccaacccttggctcttgcctaattcctggcctctgagcccctcccctcatcctgtttcctagccccttgcagttggggctgagaaattcctggacatatctgacacaatggtcccgttttgcaaatatccactccatggaggtggtaagatttagcaagttatgagataagaaatctcccagtctccgccctctctcacaggcacacacacctcctccccagactctgagggctaatcacttcctcattcagtgtgcccagagcgctgtgtttataacttgttcacaacatgctttcagcttgatttatatataattatatgcctgtatctcccagcactagacagtgaacaacgtgagggtaaagaatcatctaattcacctccgtcactccctacagtgcctagcacaaggaatgacacacacacagcagacatcaataaatgtttattgaattgaaaaaggaaagtgagaccacacagtggccaaattcaagacccaattttctttaagctatcctgtatcagtaagggagaaaaaaaaagacagagataaaaggccggggccaggcacagtggctcacgcctgtaatcccagcactttgggaggccaaggcaggcacatcacctgaggtcaggagttcaagaccggcctgaccaacatggaaaaaccccatctctactaaaaatacaaaattagccaggcatgttggcacatgcctgtaatcccagctactcaggaggctgaggcaggagaatcgcttgaacccgggaggcagaagttgtggtgagccaagatcacaccattgcactccaacctgggaaacaagagcaaaactccatctaaaaaaaaaaaaggctgggcatggtgcctcatgcctgtaatcccagcactttaggaggctaaggtgggaggattgcttgagttcaggagatagagaccagcctgggcaacatagtgaaaccccgtctctacaaaaaattagccaggtgtggtggtgcatgcctatagtcccagctactcgggaggctgaggtgggaggacacctgagcccaggaagtcaaggctgcagtgagccatgatcatgccactgcactccagcctgggaaagagaagaagatcctgtccccccccaaaaaaaaaggccgggcacggtggctcatgcctgtgatcccagcactttgggaggccgagacgggcggatcacaaggtcaggagattaagaccatcctggctaacacggtgaaaccccgtctctactaaaaatacaaaaaaattagccgggcgtggtagcgggcgcctgtagtcccagctactcaggaggctgaggcaggagaatggcgtgaacccgggaagcggagcttgcagtgagccgagatcgcgccactgcactccagcctgggcgacagagcaagactccgtgtcaaaaaaataaaaactaaaaaaaaaaaaaaaaaaagaggtaagaaaattctctttcttcaccaacacaatctatccctcagaagctcagaagcatccccaccccaagcacacccttggtctccaccaagttgagtttgtgtgttttggggtgggacctccatcattcctctgaatcagaacttgaaataccatcactaggcaaaaagaacaaactctagagaaactagtgtttctggatggcacacgggtagctttcccagaccagattcatgcattacttccatgtctgctctgaatacctactttgtgccaggtgtgggattacatactgggaaaagaaaaaggagaccctggcctttgccttcaagacactcaggacactcctgcctgaaccttggctgcatattggtagcatggagagattctgttgaagacggatagcaggatgcccctcgcacctcacaaatcaaaatatcttaagtggagctgagacacttgtttttttaaacctccaccggttaattcggattcactggcagggttgtaagccactgatctctagatcagtgttgtctaacacaaatttctgtgataatggaaatgttcaatttctgtgtcatccaatcagtagtcactagccatgtgtggctattgagcacttgaaatatgaactgaagaattgaatttttttccttaatcactttgaactaaaacagccacacatggctagtggctactgtattggtctacaaaagtctagatgacaccaaattatttcagtttggctttagaataattctcacaatgctgttttatagcaactaaaggctccattctctaccactcagagaaaaaaaaaaaacaatgactttcctttccctaaggacactctcatttgcactgaagaaactgctctagaatgaagggtaaaagccagtctgatgagactaagtctgatcagctacctaagcccctagaccagcttccaatcctccagactggaaaaaaggcactcctaagtaccctagtttgtttatggttgacattggttggggacaaaaaaagcagtgacatgactttgtgtgcctgttatagactgaattatgcccccctgccgatttgtatgttgaagccccaatatgactatattggatatagggcatttaaagaggcacctaaggttaaattgggtaataaggggggacctaatccagtacaactggtatccttccaagaagagaaacaccagggaggtacatgctcagaaaaggctatgggaggacacagcaagaaggcagctatctgcaagctaaggagaggcctcaggaaagatcaaaccatcttgatcctggacttaacgggctccagaagtgtcagaaatttctgttgttttaatccacccagtctgtggtagttttgtcatggcagccctagcagtgtaatacagtgtccttagggaaaggcaggcccaggaccttaatcaacctctccgacaagatgcaccccaggaattgaaagcaacagccccactaggacccagacccagcagcgactctgccatacccaggccttcaagtcattctggtcactactgttcaagtgcctctgtgtattacccaatcctatcccactatctcatcacctagagaccccaactctaggctttcaaccagacctgctatgcccctagatgtcctccctatagactcatcccctctcttcccatccctttccccactgcacccacactgcctcctacatggtttgccccttcatctccttctatgggtttccacctattgttgggtattttcagtgtgtgtgttctgtgcatctcacttcccccactacactttaaattctcaaagattattctagcattcaagacccttcacaggctagcttcaatctacctcttcatctttttctccaaactgggccaagccaataggaatctacttgtgtgttggtaaatattaactgtcaacttgattaatggatgcaaagtactgtttctgggtattagcagaagagattaacatttgagttagtagactgggagaggaagacccacccacaggaaaacccacccagaatgtgggtgggcaccatccaactggctgctagggcggctagaaaaagcgggcagaaaaaggtgaaagaagctgacttgctgagtcttccagtcctcatctttctcccatgctggatgcttcctgccctcacacattagactcttaagttcttcagcttttggactcttggacttacaccagtagtttgccaggggctcttgggacttaggccacagacagaaggctgccctgtcggcttccctacttttgaggatttgggactcggactgagccactactggcttccttgctcaacttgcagacagcctattgtgggacttcgccctgtgatcgtgtgagtcaattatcctgaataaactccttttcatatatacatgtatcattagttctgtctctctagaccctaatacaacttgccaccccttgaacataacagtgctgttctctaagttatccaaaactttcccagtcttaaggccacctgaaatgccacctcctccagagagctttccattatatatttcctcagctaaatatataatgaaatgatggcttctatctctgtgcagttattccactgtacctaatccagtgctctgcaacatggcgcactcactacgtagcactgacagcaaaaagagaaggaaaggagtctatggcatgtggaagttcaatactgtaatgcaattctgatgctaactacagggagttagtgcataccctcggggtttaagggcatactccccaccaagactgctctcacttcagatgtcagttgcgagcttgaggatccccagaccacctgcacttctgaccaactggctataaattcaggagtctccacaaccccccgccacccaccctgaggttggagaatttcctagaatgactcacggaactcaggaaaactctatacttatgattatggttctattacaaaagatacaaatcagaaccagccaaatgaagacaaatatatggtagggtccaggagtgtcccaggcacagatgtgtgccctctgctcatagaaacaggataccaatgcacatccctcagcacatccatgtgttcaccagccaggaagctgaccaaaacctgtgtcagaagtttttatatctagagttttaccatagatataattggttaaaatcatcggcatgtggctgaactcaatctctagcccctctcccctccctggggatcaagctggtatcatccagctcaaagtcccagccctgtaactatatggttggtcattctggcatggtcagcctccatcctcagtcaaatcttacagcaaactcaggtgtggtctgagatcaaattcaatataaaattaggtgcagcctaaggtcaaatctcaacataaattcaggtgtagtttcagggacctgccacgaaaaacaaagatactcctattacttgggaaattccaaggatttagagtctccttctcaggaactgaagacaaaggccaaattctttattatacaatgaagtaggggaggatttatatgaaaaatcttactaattctggaagctggaaatgacctgtgtcccaggagataggaagtagaccatgtgttcctcattaaggtggtctcaagacctgctctgctcccaacttggttcactttcccagcccttaccaaaggggcacccagtcaaccattcagcagacataaaaaatgagttggataccaggttcccatctgccccatcacctgtttctcacggtgtccagagtatcatataagacccctaacagacacttaacagagaccctgcaggtttggtaaggcaattggagatctgctacatccagccaggcagcagcactttgggaggccaagacaggtggattacttgaagtcaggagtttgagaccagcctggccaacatggtgaaacactgtctttaataaaaatacaaaaattagccaggcgtggtggcacatgcctgtaattccagctatacaggaggctgaggcaggagaatcacttgaaccgggaaagcagatgttgcagtgaactgagaccatgccactgcactccagcctgggcaacagcatgagactccatctcaaaaaaaaaaaaaaaagagagatctactacatccttcccccagctgcccaagagaacccctggccaacaatgaagagggaagaggggggaaatctaaatgactaccttccacctctagcatgcaagagggggaaaaaagtaacaagacaaaaggctttaggagctcttaatgcttagagtgaaaaaaaatcacaggctagttttttcatagtcattgatccatctctgacatggcaagaattttcccttcaccctggccgcaggtggaagcccagactctctcctagcaaggtatccagaatggagaggggctacccttgtagtgcagtgctgtgaatcctcaacccagaggcaagaaaacaagaagactatgtaatgagcacccacatgccaagcccatgcaaggcactttcaagtgtgatctcagttaatcctcacaccaaccccataaggtaggcatccctgttttacagatgaggagcctgaggcatagagaggtttattaatttgtcaatcaaaaagttccaagtttcaaagctgggatgaaaagccaggtcttctgacttgcactctgtcacactggatttttcctctgatccagctgcagcctcccataagaagttcactcttaatttcatgtcccatgctttgtcttggtccctgtgaggaaaggggtcagctaaaggtaactgttctataaggatgggtaggtatcctggcaagatatttcctctgaaatagtaaacgtgaccttagaagttactgtctagggcactctcagctgaataaagtctcccaaggaaacactgaggtagagcagtctgcaagtgcaaaagcacaccttctgcagattccctacaaagtggggtcccctgaaaggggcaatgttaaaaggtaaagaaagcaggaatcaggagggcaaacaggagtagtgtcaaaactgccatggcaggttggaagacagttcaacagatcaaagaatacgtttcccagcgaccagggtgcacagaaggaccttttgctccagtccaggagatgtgttgtcatctgcttggccaagaatgacttcgaggtcttgaatgtgtcccatgcaaggccccaagggcactcatttcaacagcagtggcagcagccccagctcattcaatctttccttggccactgcctcccagcccttgttggcctgtgggttacggggagagggatgcaggagcccttccacctggacctctggcatcaggcctgccagagcccgtcgtgcccgctgctctgccagtcgcccaactcccaccaccagccgcacccccagcagctgcacctgccggcagagggctgcatcacagatcccaagaagctgttctcgctgcttggcaggcagctcagcaggagtaaggttgcgcccgctgggagccaggaaaagcagagggcatagattgtggacaaaacagtgatggaagaagacctcaggctgtccacagaggttccggaaaaagccccagaatcgggcaccactcacttctgactgtgggcactccagtcccagcactggtcgtttaggatgctcttggggaggggtcagcacaggccccacaatgcccaaccagtcccggaccatgcttacttccccaaagggcacctgtgaggaaggagagagacatgaaaggcttcaaactggagacctgaggcccgggctctggaccaactgacttctttataccttacatgaggatccagcctgcaccccctacccctaccttcacccaaaggcctgagacaaggattcttggccctatggtttgagcctgtctgtctttttccagttcttcattgtgaaccgtggtccagaagaatttgtttccctctagcccaactagcctttgggactaagtacagggactacattgagatatctagccctacacagggtttgatggttagtactggggacagacagatggtctgagacagaaaggcagccagggttaaaggaggcacaaggatgggctgaccactgctgtctggatgccctctcagccccaagcctcaggctgtcatttccatcgatcatcattgatcacctttcatcacccagttggggtcaataaaagcgattgagccttctgccctgaagcctcttcccctcccccacctgccaagcacccccactgggggcagtcactcatcctgagccctgaaagaaaagcgggcaggcactggagccaggctctgttttgaacctcgccttagctaggaaacagaacccaggttcccagaacgccctgcatctcttacatacccacccctgtcaaccagtctcttctgaggacccagcagtcctagtccctcttctgaccccaaccacacttcagggacaggggagatccagtaaagtaaggatggggctggcggaaggaagggctctcagaggcaattactggccagctcacagggaaaacgaaactaccattaatgtgcttggttaattacgggcagagacgctgggagagggcctcggaccacaggagccagtatatgtgttgagacagaatggggcgggaggacctacacatgtctacagccatgcacatgctccttctccacagcacacccagccaagcatccacctagaaccccccactccacccactggggaagccaaaccctttaccccagtctgggccatgccaaaaggtccagggttcatgcccaggaagagtacttccttggggccctggcagtagcgagtcacgtagttgcgatgtggctcccatgcatactccacgggattgtagatgatgcccacaggctccgaaaactgcagctggctcagctcagcattgagccgaagctcctcctccaggaagctctcagccaagcttccagggcagggctggggctccatgagggcacctgcaggctcatggatggaccccagcaggaaagcctggggcatatgtccatgccgctgtcacctgggaaaagagatggacagaagccccatcaaccctcagccacagagtaggagggatccatgcttgccagggcccccactaccatttcctgggctcagaagggaccctaagagaccatgtcagtcatctaccaaccaccaagtaggactgaactcatctcagttcttggtaatgaagggccctttccctccccacttccattatctgtcctcttcacatggcacctggtgaggataagccatagccaccaaacatctcccactccaaatctcctttccatcaggcataggtcactagttcctgggctatgccgagcacatagtaggttttcaataaacatttactggtggcatcctttcagcacctttaaggtcatcctaaaaaagaaaagcccagccagaatggactgttctggaaagcacggcgctgaagaatgaaatgcaagtgcacagccacagcccagagacctgggaaggctaattacaatagcttccaggtggtgagcgactgctctgcaccaggtacacctcattgatcctcacaacaatcccatgaggtgggtattactgctcccctgttataagtgaggacactgaggcttagcaagattaagcaacttgcccaaggtcttacagttagtaagtaataaagctggatttggttgagcccaatctctctggctcaaggctatgctttaaccacccacgccatcttgccttagatggtttgatcagccaccctgctaattctacaaccccctaaccccagcctagcttctttcccacactcaggaataccgagtaggatgattacagactcctcatagaatcttacgagctacacaaccatggccagagcctcaggtttccaccttcaaatacaaagaataataatatccacttaataatgttgacataaggaaggccaggcatggtggctcatgcctgtaatcccagcactttgggaggccaaggcggctgaatcaccttaggtcaggcgttcaaaactggcctggccaacatggcgaaaccccgtctctactaaaaattacaaaaattagctgggcatgctgggcgtggtggctcaagcctgtaatcccagcactttaggaggctgaggtgggcagatcacctgaggtcgggagttcgagaccagcctgaccaaaatggagaaactcccacctctactaaaaatacaaattagtcaggcatggtggtacgtgcctgtaatcccggctactctggaggctgaggcagaatcatttgaacctgaaaggtggaggttgcggtgagccaagatcgtgccattgcactccagcacgggcaacaacagtgaaactctctctcaaaaaaaaaaaattagctgggcgttgtggtgggcacctgtaatcccagctactcgggaggctgaggcagggagaactgcctgaacccgggaggctgaggttgcagtgagccaagatcgtgccactgcactcaagcctgggcaaaagagcaagactccatctcaaaaaaaaataaaataaaaaataaataaataaataaataaataaataaataaataaataaatttgccgggcgcaacagctcatgcctgtaatcccagtactttgggaggctgaggcaggtggatcacgaggtcaggagttcaagatcaacctggccaacatggtgaaaccccgtctcaactaaaaatacaaaaattagctgggcatggtggcacgtgcctgtaattccagctacatgggaggctgaggcaggagaattgcttgaaccaggacctgggaggcagaggttgcagtgagccgagattgtgccactgcactccagcctgggctacagagggagactgtctcaaaacaaacaaacagacgtaaggatggaatgagatgttatgtttaggtgaagggagaaaagaaatgggagaggaagaagaaagggaagagagaagggaggtgggaggaaggagaagggagggggcaggaacatgacagcaagctttgtaaactgcaaaggccattgcttcactccactcccattcaaacccagtgttccaacctgaccattctactcacattttcaaaatgcctttcctgcctcaactcccaaaaccttgcacataccatttctacagtccaaccaaatacactcctgaagtcaaccaggacatcatccagcagtcatccagtcaactaggactgttgattccccaacctgtccacatatccaaatcactcccatccttcaaaatgcagctcaaaccatccctttgataaagtcttccctcctcagaacactgcagtatttgccatagtgtcccaaccccacccccaacacaagtaggtcccgtgtgaggcctgggaatctgtgttttttgttttgttttgttttgttttttttttgagacagaatcttgctctgtcgcccagactggagtgcagtggcgcgatctcagctcactgcaacctctgcctcccgggttcaagtgattctcccaccttagcctcctgggtactgggattacaggtgcgcagcaccacacccggctaattttcgtattttcagtagagacagggtttcaccatgttggtcaggctggtctcgaactcctgacctcatgatctgcctgcctcagcctcccaaagtgctgggattacaaacgtgagctaccgtgcccagcctgggaatctgtattttaaacaagcttcccagggtgattctgatggttggtgaaggctgagaaccactgtgtgtcaccatggttaccgtcgtcttaatgaattccttttgcctccccagctaaacttgggcagatcaagagccaggccttgttcaatctccctccataagcccaaggtcctggcccttattaggtactcaacaaacacctgctcagcaatgtccatcttctttttcacttttgtttaaaactaccttctgtgctgggcacagtggctcatgcctgtaatcccagcactttgagaggccaaggcagaagaattgcttgaggccaggagttcaagaccagcctggctgacataatgagaccccatctgtaaatataaaaataaaataaacagcttttaccaaggaggcactcctgatggatccttctccacttctatatcctgagttcactcaaggcttagctgcccactttgcactctgcttgttttccagactctgggtctgtgcccatcatatgtgtgcctcccatgcgacaaggaccattgtcattccttcctctcaactttctgcctgggtcaggagtgacttctccaagataagaactcaaggttgacacaacagctcgataaacctattttctcaccctagcctaggggaagtgggagagaaaagaaatcagaggcccaacttaggaagtccttccctgactgtctcagtagtctttaactgatctgttgtccaggtggctacccaggacaaactgggctcatacaaaagctgagaagggtgctgtggagaacgccagtgtttcaggggaccttgctttgcatctccccatgcaacaccaacattagcagattggctgctccagctctagaatctcgagaagtcttgagcccacctttgacatttagacacctgtgttggaaacagcaaggctggggaaaagagtggcaagatactactttcattgttccataacttcaaagcctgatctcatagcaagagccacaggctggaagtcaattgatttgaattctactcctgtttcatctctaagaaggttctcttgagcaactcatttaactctcttctctatggaaaatcacatactccatccaacctaccacctgttaactcattttttttttcaatacttatgagtctcttacatgacaggcactgcagcagtctcttgatgaggaagaaatccaaaaagagtaaaatgtaggccaggctttctgtaagctcataatctgctgtgagggcaaataaacaactaactgtaatacagtgtgatgtgagctttaatacccggaacaaaacactaagagaacccaaaggaggaacttgtaagttctacccaaagtcgccccaagagccagaggcttaagaaatgtagatattttataaaatacggtgtcatactacattaagcacaaagacagcggagttggaccaagcgataaggctgaccaccaagggccgacttcagactgatgtcagacttctctgacatcaaatccgggaagtgaggaaggaatcgaaatcacatatgcactcccctgtcctttggaggcactccgggagtccagggacaataataaatatccttaaacgaaataataataataataataataataataaataataataataataataataataataataataataataataatgcataggccgggcgcggtggctcacacccgtaatccgagcactttgggaggccgaggcgggcggatcacgaggtcaggacttcgagaccagcctgaccaacatggtgaaacccagtctctactaaatacaaaaattagctgggcatggtggcgcgcgcctgtaatcccacctactcgggaggctgaggcagaagaatcgcttgaacccgggaggcggaggctgcagtgagctgagatcgcgccattgcactccagcctggaattcagagcaaaattccgtctcagaaaaataaataaataaacaataataataataaagcataaactcaaaaagaccatttcatctggttccaaaggggccgactactaaggcaccatacaaaacctccgggggcgcccgctggctccggccgactggaaagccttgatcctgcagacctcccaggcggtttcataggctgggctctccctgcactgagtcttaccccatacggagggagggaccccaaaatatagaaattctaaccaccctctcggctcagccccgacgaccctgggagccgtcaacttgcccccacagtcccggattcccagccccctacttcctcacctggtccagctccccatcccgtttccggttcctttcccccaccc

SEQ ID NO: 37 - DNA, 9236 bp, Homo Sapiens
ttatttgtctttggggtcagcttttatttttattttttaaatatatattttttgagacagggtctctctctgtcatccagactggagtgcagtggcatgatcatggctcactgaagccttgacctcctgggccctcatgagctcaaatgatcctcctgcctcagccttccgagattacaggcatgcaccaccacgcctagccgataaaaatatttagtgggcccctagctttagcaaggctgatagaaatttgctttgtattattgatagtttagaactatttttcatcttctgattatatttcatcattggaaaagccgtattttttttggattgttgtcaaataataatttattttaaaaaaatctcaaaacatgttcaaacacattcagtagcaaagatccaccattggcacacacattaagaaagcacacacactaggcttctagttgggctaattaaaatctctatggctggaaaggtggttggttgtacttaattaagcttttttgaagtgcaaagctatgcataacagatgagcttgaaagctgcagagtttaagatagacttaatttttcatgattttcccaaagccagtcatgatatttatttaatttgtggtcttcagggtgcacctggaagaaacataagatacagaggcagagaccttaatgtaacttagtcagaaatacattttttaaaattggctttttaaatgtttgctgggggacagtacattacgataccatacctaaaagttataacctttaacctcctgggattcatgaatattttaagttataccttatattaaggtaatctcacacaatttacaaggtactgtccaaattactactcaaccatgacttagaatgtggggtggcgataacatgagtcaagtattaatacctcactttccagaaggaggttctagaccgagaggttaaatggattctcaggtcacaatggattgctctgatgaagctgggataggaccatggtccttcagttcaggcttggccagacctactggctgaatgcatgagggtgagtctcaagctgagtgggcagcataccaggccacccaccagctgccaggatgaccaccagcatgccacaggctgggcatattcaacagggctgaagcaggacccagtcaccacaaacgtagtctgagaccactaagagaaacccaatatgcatacattgcaggcccaaaccttcctgctttcctgtagtggtgtacttttgacaggaggaaaaccacgtcaggcttagagatagcacacaaatagggaatgacaggaacagggccagaggtgacaaaccactggagatgagtcagaggccacgccgctggactggtctttgtggacttgggagcgcctactgatcaaaaaccccaaaacccacatgccacccgcttccccgcagccaggaacacaattgtttgtgactgtaatagcatttgtatccaataaatagtcttaaccataatggtggacttattttgcctcagagaccaaatgtgctgaattatggatgggagtgagcctcacctgcttccactcattgacacaaaaaattcggtaagagtcgttgccatatttaccaatcccatgaagctcaattggatacttccactgctttgtcaggtattcatctgaagaatacaacatcccacattatcaggtcagcttctaaagacaccctcccaaaatgtgtggtgatggggcaggatggagagaacagcagaaagggacaggaaaggctctttcccagcaaccccagttgtgattactcttccttctgaattcctgcagcacccatatcatttgccaattcctaaccactcttttgtgctgtgctaacaagacagaagtcatgtccttgaggtcaagaactgggctttctgcttcactgacttcttcccctaattctgcccacatgcctgacccagtgctgggcaaagatttattgtttaggtcagtgggagactgtggtttggggaaagtggacttttttaaatgccttgggtgcttgagctgaaaaacctccattaatatagtatctgagaacattaaagtttaaggtgtggctctcttaaataagcacaatgtattatgtttttcctttgggtgtataggaaaatacctgagaacttgacaatggtttttgcccgaagatcgtagagaccaagaggtttaagaagttctgacacatctctccagtctgcggttcttgctacctcagctgaaggatacttctccagaaacttccaaagcacaggtattgccattttgcctgggaagtaaaagtaactgaatgattacaagactccaggtgggctgatttcatgttcaagtagtttctcatagaaatctcatccagagggtttttttttttaaagaaaacaaaaaacaaaaaaacactggtgagaagccattatctgaaccagcaaccactttcagaatcaaatgccaaaactgctaatatattgggctaatagtccaaattatgctgaaaactggccttgcatgattagcttttaaatgatcagatcagcagataatgagagtagaagcatatagaacacaaggtacattcagtgaaaaagatacttttaaacacacatgaaagagggtggagaaacgttaactgattttcactgatgatcaaaaagaatttggaagtataaaataaataaaatctacctctttattctaaaaggtctgttggatgtcatccagtctcatttcctcataggtgaagagtttaagggtgaagggggaatgccctatcccaggtgacacactcaaaatggactttgaacccaggcctcaattcagtgctttctccctaccacactgtctctactaagacaaagatgataataatccccaaacctgaggtccgattgagaaatatagtagcgatgagaagcttccatggatcatgaaaaagtgtttcttgaacgagattaaaaggtgaccgaggaggtgtccatttcttaaaggctttacgtcgtggggggctaagagctaaacaaacatagtgcatcagaattgaaaacccaaaatggaattagaatttgctgttctgattgggaaagggataccttctttgttatatttgctggaaaaatacaggcttgttttccttctttctatctgtgttcgtgggatggtatcttctgaaaaggaaaagtaaacactttatggagtctatggtttagcttaaagcaatattgagggatgcaaataataatatcaacactattacaaagcatgccaggcactattctaagccctttacataaatacccaattaatctaactaatgacccatgaacttggtactatttttatctccactttacagataaggacattgaggcacagagaagctaagtaacttgctcaagatcacacagatactaagtgtcccagctaaaattcaaatccagacagtctggctcctgagtcctcacctttaaccactctgtgacactagttctttatgacttatgttcagagtttatagtattgaaaaattaaaggcagtatggaatattttaaattacgatgcatttgtataatgtggtcattaaagtattttttagactattgtgaatattttcctattaacttctaaatgaaaaagcaagagtctacatatgatcccaattttataaaaaaggggaaacatatataaataacaatacagaagttaagaatgaaataagccaaaatgatataatggttgttgccaagtgctaatttttctttccttctttacttttctgtattttccaaaatttctgcagtgaacacttacttttacgcttaccaaaaaaagggatacagacaaaacagaatctgcagaaaaacctacaatttgaaccctagaacacctgagacaactacctattgagaacctctatctattgggaaccagtgttatcagacttctcaaatttctaaaatcacatgtaatactccttaaccataccctcgcaatttgaatatcagttaataataccttgcatttgtatagcatctttttcacttctcattttacaatatttttgatgtgaaaaacaggactagtcaggatggttacctctattttacagatgaagaaagtgaagcttctaaatgaagcaatcatcccaaaatgatactgggattgactataaactggaacaagtatccaggtctccagataattagactactgttttttcgctattttagtttgagtaggtaaagcccagtagagagtaaaaaaaaaaaagaacaaaggaaactgctctgactgctctgatttgacaactttttctgtgggctcctatgaataattactagtctcctttatgccaggtttacttggcaatttctagctaagccaatgggtgtcttcactatttcatggacacctcgtactaagagtacttcatctcatgttgagaactagactcttaccacaaaaaaaagtttttaatatttgcccattttgctagcaataaatctacataaacctcaaagctttcttcaagaagctcagtgtctaggacacagacttgaagaattcttatgcagttcctaggtatatatggccatcttgtgttaaaggcagagaaactccaggcacagaaaagacataaaatcatgggtagaactgggaacaagaatcaaacctaatctcctgcttcacaaatttctccaggctgtttccccacaggagtttaagtaaaattattattctttaaaggagttattcattataccataatggcataatgaataactaatacagggctgctcaaaaggtctcccttttatctcttattcactgaggtattataaagacaaaactgctaagttctgaattctgtattaagagcatattacaaataatagatgaactatgtgattatacttttgaattatttagagctctaaagcattttagagaagcattacattaaaatagaagataaaaatgactatgatatatacaaaattaaattggaagtcacacttagtagtaagtatcaggaggggtgtgaagacaccaactattctccactcatttatgtatataagaagccttccctaaatttttcacaagtgaaggcttttaattttccttcaagttttaagattactggctggaaagaggatgggaagaagggaaagcactgctgaggaggagagtcccagctgctgcaccagggagagacgatggcagctgttaatagtaatactctcctttgccatggcatcacgacagcagtcagccgattttctctctgccataggaaactgcttgaatatcagtttaagataaagtattaggatcaactggtatctcatatttggccctatttcttggctctattttcacatcttaaccatgtatgggcacgaatacaagatgcagcattataaatttctcatcacataatgtttaatagtgcttgaaagcactggataccttgaaatattttctcaccagtgaagtctttcctggttggtgagcagttgttgtccatttcagagccacgttttaaaatgtcagtatgcaaatgttctttcctttccacaacttctacttttgttccgatttcttcagattctaaaaaggtatcctcatacttctcgttgtgttctgagtctttggctgaacaaaatttgtttatgatgccagaagttttttgttcagaacaaaaatttgatcctgaactcaatgatctttcttttttttttacaaggctgttttcttcactggtcacactgagggtctcaccacatgctccagcatcagaaatgcagacagttctatcaagctgacttttttgtgcaacaggttcactttcagcatctgctttattacacacagattctcttttgctatcactttgaacaaaacctgaacagctcttcctacatccttttttagttttcttaattgggattcctttcaaaatagtcacctttcctttgggctttctaacctttctgaagttaacatcatcaacaccctcatcttctttcaaaagcaaatgagtggaagtaaagttagagagtcctctgctctcctgcaactctgaactactacttggcggcataaacacatcctttttgcacttgcttcgggtcctgaggttccagtttgaattgttactttggttttgtagatgggatgtcagggctgccatgctgcagtctttatatcttgacttgataccccttttagaaagtacagtaaaatcaaaatcttctggcttaagagaagtctctccatttttgtgaagataattagcaagtgaacttttggatctgaacttcagtccttgtgggctagaaaatgatattaaaggaaacttactgctagtaaatagaagggacttttaaaagaactggaccacatttcagatttctaattaatttccaaatgttgccataggtatctgtcatttaaaaatgaaaaagagtgataaatggcacttttaaatggtttcctctatgacaatataaatttataaatataactaaaatgcaacctacccgttaaccattcacagaaggagggacaaaatgtatgtaattttccccaaatcacttgatgtaattaatagcaacattgaaagaatagaatctgcaatggttttatggtaaaaatataaagaagctaagattcctgctatgctcccactacctgcccagacaaaatcatttggctgtactatctttaccatcttatatgcttacctgataaagtacacatcaaatcttcctgctgtcttcccaaataacctttgcttcacaactctttcccatccacatgggacagacttacggcattctgttcctgcagtagcaccaaactgagcagaagcgatgggttcttgtagcaagggattacattcactgcttctttttatcatcatttgttcctcatcttctcccactctttccaattccatagcaacatcttctttgctggaaaaacaaagtctaagtgattaacttatttaaaatttatcttccactgcctactcagttttaatccatgacaatgcaggaaccacatagattatccatattaaaatgagggagattaaagtcagtgtggaccagtcttgtgctatgggagtattttcctgtcttccaaaagcttcccatatcctctagcacaggttaaaaggtgttggaaatctctgcacaacaaaaaagtcaagctagaaacttttcggattaatcactgagtagggctattataaagatttctgggggcacttaccataaatttgagaatatgaaccaatagctaagctcttaagcaccagaaaatgcttaaataaatcagtgagttacactgtcttctctgcaaataaatgaggtaaaagttttacataatgtaaaatttctgggagagagtgtgtatcactttcatcagatgtaatcctccagaaggtaaataatttgatacagaatttttgaatcttcttcattcttgatcctcatggtaaccttgtaggtacaataaggtttactctcaatttattgataaaattgagtgacaggttaaattacttgcagaacagacacgagaacccaagtctaccaaatcttggtctaatacttctcccccatactgttattgaaaaaagctggcaaggcaaggtggctcattcctgtaatgctagcactttgggaggaggaagtgggaagatcacctgatcccaagagtttgagaccagcctggagagcacagtgagatcctcgtctttgcaaaaaatgaaaaaaaaaacccaaaaaaacaaaaaaaaacaagcaaccgggcgtggtggagcatacctgtggtcccagctactaaggaggccggggtaggaggactgcttaagtccggcaggtcaaggcttcagggagctatgattgtgccactgcactccagcctgggtgacagagcgagacctcatctcaaaaaaaaacccactaaactaaaacttcattaaagttccaatgtgtcttctatgatgaaaacatacttttaaaattaaaaaaaaaatttcagtaaagtgtatcctaatcactaaaccacagattgtaaaaggtggatgggtctagagagatcatttaacccaagttcttttctacaaatagggaaactgcaagaactagaattagaatcaaggttttctgatgtaatttggggtaaaataattttgaggagctggatggatcttatgaaatgatattgtttacaattttagagataaaaatactgaagcctggtggaatcagcacaaactcttaagagactggggctcaaattccagctctaccagctgtaagtttagcagcaagttacttaacatctcaaagtctcggtaaaagactctgtaaaaagaaggtgatgcctctttcaaagtagttcttagtattaaattttgaaaaaagtaggtaaatcttaacctcctatcacacacgtagtctaatgacttcctaggatcctccaaccccaaggggacctctttcacaaaacctcccggctcccccccagtctccctagtcatcttagatgaggaagtcgagcgcaccccagggctgatcgcacaggaagagcacctgggctccagaccctagtaactaaacccgtgggcttcgaggtttctgccgaccctctgtcaaaggttagaaaggcccacacactgtccactctcccgataccattttacaggtggtgaaactgaggcccaaaaggggacagtaacttaccggaggtcattcggcgggtctgggactaggcgctcactagaggtgacggtgggggcagctccgcggtcccccagactcagactctccagcccagtcgtgcccatcgagcagggtccggctgcagcaacgagcccagcgccgcaacgcccagggtgtggggcggagtaagatgtgaaacctcttcagctcacggcaccgggctgcaaccgaggtctgaatgttgcgaaagcgccccagacgccgccgctgctttccggccgccccctcggctacagccgccatttccacgctccaccaatcaaatccattctcgaggaagacgcaccgcccccacacgccccgaccaatcgctcgcgctctggttgcgctggcgccttaggggctccagtgccaccattgcttttgctgcttttctggctttccctttcggacatgcgcgctcggagcaag

SEQ ID NO: 38 - DNA, 38303 bp, Homo Sapiens
ctacttccggtggtgctgtggtctgcccctggagaacccagaagaacacagctgtgcgcgcccacaggctctgggggcgggagaagataagtcgcaaggagggggcgggacctacacctcaggaaagccggagaattggggcacgaagcggggctttgatgacccgcaaagggcgaggcatgcaggaggtggaggaattaagtgaaacagggaaggttgttaaacagcaccgtgtgggcgaggccttaagggtcgtggtccttgtctgggcggggtctttgggcgtcgacgaggcctggttctgggtaggcggggctactacggggcggtgcctgctgtggaaatgcctgcccgcgcgcttctgcccaggcgcatggggcatcgtactctagcctccactcctgccctgtgggcctccatcccgtgccctcgctctgagctgcgcctggacctggttctgccttctggacaatctttccggtgagtgactgagcctgagaagcctgtcccctcggactggctcctgccgcctcaacactgcctggcatggggtacaaaggaatttgggggatgatggaagaaacccggggtacaaaagaggaaacaagcacgggtagccaacctgttacctttaatatgtctgtacagtgataattgtaaggatccagcggtataaccgatgcagaagataatagcacttgtttttctttttttgagacagggtctcgctctgttgcccaggtaggaatgcagagaggcccattccagcctcgaccccccgggcgcagcctcccgagtagctgggactacaggtgtgcgccatgcccggttaaatttttgtattttttgtagaggtgaggtttcgccatgttgctcagactggaagatagcactgttacttgtattagtttcgtacatggagctattgtaggataggagggaccccaaagggtgcaagaaaggaaattgagtgccagggttgtcatgtgccttgggctcaggtggagggagcaaagtcctgcacactggagtggtgtactagcggatcaagtatggacactgactcagactgaggagcagctccactgcactgtgtaccgaggagacaagagccaggctagcaggcccacaccagacgagctggaggccgtgcgcaagtacttccagctagatgttaccctggctcaactgtatcaccactggggttccgtggactcccacttccaagaggtggctcagaaattccaaggtgagtacaggacctgggctggggttagggttcttggacataagtcacttctctatgactcagttttgccacctgtaaaatggggattatatctacttcataggcttttatgaggatttaaggaactaatacatgtaaagtgcttagaataatgccaggcacatagtaagtattattaccattattattatcctgctaatcaccatagtgaagtgacaaggattttgagcccattcctggttgtgtgacctagggcaagtgatttcattcattctgtaaatatatacaaagcatctgctgtgtgaccggggatacaccagtgaacaaaacagacccaaatgccagtcctcatggagcttacattgtggcctctttatctgtggaatgggatggtaactcagccctcacaagatgctatgaggaatgagaggtctggtgttgctttctctaacggtgctgactctcattctcctgggatcctcctggagttttggtacctaggatctgacctgtgggtgggaagaggccacacccaacagcaggtacctctcctaccccctgcatttctggtctccaggtgtgcgactgctgcgacaagaccccatcgaatgccttttctcttttatctgttcctccaacaacaacatcgcccgcatcactggcatggtggagcggctgtgccaggcttttggacctcggctcatccagcttgatgatgtcacctaccatggcttccccagcctgcaggccctggctggtgagtaggtgggtcccctgcccccaggccttccatcagctttcaagatctgttcatttctcccctggttaccttctcaaggcttcctgccttcccaaacacttcccctatccagaaccgccctgcctggtctgatcaactccagttactcatcctccctatgcatccctaaaatgtcagcacctcactggtctgtgctttttgcccaatgggttcaatgcctaatcagaaaaatatctgtatacaatgtacagtagtttggggttaagagcatgcattctggggacagacccatgcctggttctgaaccccaactctcacttgggcacattatttagcatctctgtactaaagtttcttcatctgtgaagtagaataataatagcacctacctatgctattattggagttgtcatgagggttgaagaaaggaatatacatactgcacctagcacagtgtttggcacacaggaagtatatgtaaaattcaagctggtatcagccaggcgcagtggctcacacctggctaacacagtgaaaccccgtctccagcctgggcaacagagcgagactctgtctcaaaaaaaaaaaaaaaaaaaaaaattcaagctggtatcattgtagtgaatgggatagttttgtatctaagaacacgtgtgttcttcacagtagccctgtaaggcaaatgttttacagaggcaagtgtatcgattggcagatgtgagaaccaagctaggacaagtgcttgggaactgcatagcaaagagacagactgcctcaaaacaggagaatgtttttggtgcttagaaacccattcctggccgggcgtggtggctcacgcctgtaatcccaacactttgggaggtcgaggcaggcagatcatctgaggtcaggagttcaagaccagcctggccaacatggtgaaaccccatctctactaaaaatacgaaaattagtcaggcgtgatggcaggcacctgtcccagctactccggagggtgaggcaggagaattgcttgaacccgggagcaggaggctccagtgaaccaagatcagaccacagcactccagcctgggttacagagcgagactccatctcaaaacaaacaaaaagaaacctgggtcaggcacggtggctcacacctgtaatcccaacactttgggaggctgaggcaggtggatcacctgaggtcgggagtttgagaccagactggccaacctggtgaaacccgctctctgctaaaaattagctgggcgtggtggcaggtacctgtaatcccagctactcaggaggctgaggcgggagaatcatttgaacctgggaagcagaggttgcagtgagctgagatcatgccattgcactccagcctgggcgacagggcgacagggcgagactccgtctcaaaaaaaaaaaaaaaacctggccgggcgtggtggctcacacccgtaatcccagcattttgggaggccgaggcgggtggatcacgaggtcaggagatcaagaccatcctgcctaatacggtgaaaccccgtctctactaaaaatacaaaaaaaattagccgggtgtggtggtgggcgcctgtagtcccagctacttgggaggctgaggcaggagaatggcgtgaacccgggaggcgaagcttgcagtgagccgagatcgtgccactgcactccagcctgggcgacagagtgagactctgtctcaacaaaaaaaaaaagaaacctgttcttgagtctcagctcctggcttagttagtcataaggcctcaagaaagtcattcacctcttccggcttctcttagcttgtttgtagaatgggaataacagtttctatctagaagggctttgggagtgaataaagcaatcatgaggcagtgtagtgtaatgggttaagagcacggcgttagccaggtggggtagctcatgctggtaatttcagcacttttgggagcccaaggtgggaggatggcttgagcccaggagtttgagaccagcctgggcaacatagtgagacctcatctctacaaaaaataaacaaaattagccaggcatggtgacacaagcctgtagtctcagctactcaggaggctgaggtgggaggatcgcttgagccttaggaggtcaaggctgtagtgaactgagattgtgccactgcattccagcctgggtgacagagcaagaccctgtgtcaaaaaaagaaaaagcacaggtcttggtgtcccagacctaggtgcaagatcttatctcccccatgtcctttcttaagtaagttaacctcttctaagccctcattttctccacatgtaaaatgggaaaacagcagtactgtcagtggggttcttgggaaaagtaagcatgataatatatctgaagcatgttgcctagcacttgatcatagaagctgttgctatattgtggttatttttttagatcatgagtgtgaacactctttcggaaaggttaaggaactcagttggggagctcctcaagggaagcaagtcctcagtccctggactagacttgggctccggggccaattcatagcaggtgctcagaaaacatgtgtagagggacaggacccaggcctaaccctttcccttgcacataaaagtgtccactatcccatagagggtggggaggtaggaggggaacttaggaaaagcactcttgtgaggtagagagctcacttactagcctaaggacaggaagaacttgaagatgcctgatgcttgccctcctcctcactccccgcagggccagaggtggaggctcatctcaggaagctgggcctgggctatcgtgcccgttacgtgagtgccagtgcccgagccatcctggaagaacagggcgggctagcctggctgcagcagctacgagagtcctcatatgaggaggcccacaaggccctctgcatcctgcctggagtgggcaccaaggtgaggccccagggggtaggagctgccctctctactgacactaagaggagagcaggaaatgagccaagcctgggagctgggtggaggcttggcttccggaggcagagcaggaaggagaaaggatataagtagatgttttatgagagaaaaaagcagagtgcagaaagagtagaaaggatatagccctttgaatgaatttctagaaagaccatttgttcagatgcaacacatatatgctgctatatatatgcagcaatttccagaaggaaattgcaggaaactaaataatagtttccttgggggagacaaatgggaagatatttcttcttttcggttttttgtttgtttgtttgttttggtagaaataggctcttaacaatgttgcctaggctggtcttaaactcttgccctcaagcagtgttcctgctttgccctcccaaagtgctggaattacagggatgagccactgctcccggccacattttgttcctttcgtaaaatgacatgtactgacaaaactttttgcttgatgtcaatagggttaactggcaataagatgactggaaattaggcatttgtctttttttttttttttttgaggtggagtcttgctttgttgccaggctggagtgcagtggtgcaatctcggctcactgcaacctccgcctcccggcttcaagctattctcctgcctcagcctccagattagctgggattacaggcatgcgccaccacacccagctaatttttgtatttttagtagagatggggtttcaccatgttgggccaggatggtctcaatctgacctcgagatccacctgcctcagcctcccaaagtgctgggattacaggcgtgagccactgcacccagcctttttttttctttatacttctctgtagtttaaaaaatgaatttttgcttaaagatttttttttgatgggctttggactacagcctaacattaaatcttggttctgcctattctcagccatgtgactttggccaggtcacttcacctttcaaagcctcagttttcttgtctgtaaagtgggtgtggtaataccttcttcccaggttatgataacctggcccacataggtgttcagctagtagcacctcttattacagcaatttcagtgtattcataggccgcgcatggtggctcacgcctgtaatcccagcactttgggaggccaaggtggacagatcacttgaggtcaggagttcgagaccaggctggccaacatggtgaaaccccatctctactaaaaacacaaaaattagccacacgtggtggcacatgcctgtaatcccagctacttgggaggctgaggtaggagaattgcttgaacctgggagagccaggattgcaccagtgcactccagcctaggcaacagagcgagactccatctcaaaaacaaacaaaaaaaaagtgtattcatagatagtatctgttgattgagaatatagaacaacagtaaccccagagtgaaggagaaagcagccggctttggggctataagcaagatgctggccacatgctgcccttcttccacaagggctcattctgtgtctgtcaaaggtggctgactgcatctgcctgatggccctagacaagccccaggctgtgcccgtggatgtccatatgtggcacattgcccaacgtgactacagctggcaccctaccacgtcccaggcgaagggaccgagcccccagaccaacaaggaactgggtgaggaaagtgggctgcaggggctggcagtgggctgggatggtagaaacttctctctctcttagtcacctctccctcagaccctacttctgttgatgggtcacagaaggggtcagataacttagtctcatcacttctgatttaggaaactttttccggagcctgtggggaccttatgctggctgggcccaagcggtgagtgtacctaggtgtcctccctaggtttcctctcctccagcccagacccagtggactcttccaccaccgccccaggtggccctaaaggactctccagccacccctgtcccaaccccagtggattctcattgccttcggccctgttccccaaggactcttccacctcccaacactgtcactagtctcaccagccctgaccccagtgtaccctcctccccacacagactccaccctcctacaggtgctgttcagtgccgacctgcgccaatcccgccatgctcaggagccaccagcaaagcgcagaaagggttccaaagggccggaaggctagatggggcaccctggacaaagaaattccccaagcaccttcccctccattccccacttctctctccccatccccacccagtctcatgttggggaggggcctccctgtgactacctcaaaggccaggcacccccaaatcaagcagtcagtttgcacaacaagatggggtgggggatattgagggagacagcgctaaggatggttttatcttccctttattacaagaaggaacaataaaatagaaacatttgtatggaaaatgcagtgaggagtggtagggaagcaggtgaggaggggacagggcagagaaactcccggttcagggagggaaggggagcaggctgcccccaagccctcccacgcagaggatcatgacccgaggtccagggccctagagctggtggggcagtgtgggggacagttctgtgcccggctccacgcagcagtctcgacagcaacagccagctgccggccctgcatgggaagacagaacagaggtggccgcaggggcaggccctccactccagcccgggtgcacctttgtggaccacccatgcccttctgcagagcccgctcctcacccccagccactggtgtcagcagctccccatggctcgccgtctgcccctgcccctcctggctggtgcccagctgcagtttcctcatgtgccgcaccacagccgtggcattgaaggcttgctggcattgaaggcattgaagggagaggggagaaaggacttttgagagagtcaagtcatggggcaggggcgcagtgggattcttgcaattgttctgttattttcattcaggagttattttattaattcccctaaagccccccaaaaacctctacaaggctttattatatatttacacacacacacgcacatatgttagatgtatgtgtatctatatatataaatagaaacataactataattcatattaatatgtaatagcaaacactatagcactgtatgtcaggcactgttctaagcactttacgtagtaattcatttaatcttcatgaaagtctttgaggtaggtactattatcattttcaaaggaggaaactgaggcacagaaagctgaagtaacttgctcaggtgtgtctctattcaatatctccacctaggtgtcccacacacccctcaaattcaccatgtctaaaactaaaaccatccccccaaaacatgtttctgtccctgtgataaccatctcagtcatggtaccaccaccatccattctgttcccagccacagtcttgggccagcccttgacatctctttcccccaacatccattgcatcgtcatgtcttgtcagtttcacctcctaaatgactcctggatcaaccactgttctctgccccctgttgctgctactgtggttccaaacccttaccatctcctgcctgtatctctgccacagcctcctaatgcgtcacccagtctttactccatgccattctctgcatcctgagagctctttcttttttttttgaggtggagtctcactttgttgcccaggctggagtgcagtggcgcgatctcagctcactgcaacccccatctccgaggttcaagtaattctcctgcctcagcttcccaagtagctgggattacaggcacgcaccaccatgtgtggctaattcttttatttttagtagagacagggttttgccatgttggccaggatggtcttgaactcctgacctcaggtgatccaaccacctcggcctcccaaagtgctgggattacaggcgtgagccaccatgcctggccctgagagccctttctatgcagcaaatacttgcctaagattcttctggggctcctcagtgccctcaggatcaagttggtgctcctctgtggcatatgaggccctaagaggcctggccccttacctgcttctctaaattgggctcctgcctctcagtcccctcagcccctccagtctggccaggcttagcacttgcacttcccggaatggctatagacattattccgctatgcctcactaattcctacttaactgacagctctgtcaggtcatcaccacttttatgacctttctcggaccccataggctggatcagatgcctcctgaagaattacagacttcttcctctagacttggaggtgagggaccctctctggaatagagaaggtgttgggagtgtttgttgaatgaaagagtgaatgaatgaagtccttcagtaaggatccctaagcagttactgtgtgcccagtgtgatgccaggtgctgtgcaagctgagcctgggtagggatggggaggagtcctggggaggctgggaccagaactagggatatggactcaccttccacttgctcttggcaaagttcttcttgatctgctcactcaccgactggtggatattcttatctagagctgtatctcctgcaatcctaggatggggttatgtggtgggttgcctatgagggcagaagcagacctgagggccccaaatcccgccccagctcacaggttgtgtgaattctcaccatgggtgctgcaaggcctgctcacaggtgaatcttttctctgggtccttctccatcaagtgccggatgaaatctttggctaaacccccaagacaaaagcaaagataatgacagcatggtactgcctgtgtactccccaagagcatacccactccctcaggtctggcctggcatcaagacaaagaggccaaatcagtccatgccccaccccacccaacctatgctcttcttcaggccctcccaccccgtgccttccagctctttcctttctctcttaagaaaaacatatggccgggcacagtggctcatgtctgtaatcccagcactttgggaggccaatgcaggtggatcacgaggtcaggagttcaagaccagcctggccaagatggtgaaaccttgtttctactaaaaatacaaaaaaaattagccgggcatggtggtgggcgcctgtaatcccagctacttgggaggctgaggcagagaattgctcgaacccgggagacagaggttgcagtgagccgagattgtgccactgcactccagcctgggcaacagagcgagactgcgtctcaaaaaagaaagaaaaaaaaaaaaaagttgttcttgactaatctcagtgcattcacactgatgataaacgatagtagcttcacaggtttgcttcttaatagggggcacaaaaggaggatgaaaatgtttatggtggtgttttagacattagggtgtcaataggggagaggtattttcaaatagactatgtttgaagattgaacaaatgaatgcctagtttctcactctgggagccaagcagaaggaagtacccaagcagaaggaagaaggggtagggtgtctggtctcgaagacagctctttgtgtggtgctggaaaatccgacagaaggaaggcaggagggagaccgcccccaaagcaggtgagggaggaaccagaggcagggcccaggggaaaaaagcaaagccccaaataccagagtcagagatgtcgtcccagtaaggagagtcaaactcgtactcggccttcaaaatctgttcaaagagtttggcatcattctcgtcatagaagggagggtaaccgcagagcctgggcagggagaaactcatcctcatttccactttcgggtgccgttggctccggggtggagcactggggcagtctcaggggtcaggcaggagccatggaaggagttccccctttataaactctaccagccctgcctgctcactcctgttctagctacattatcctttctgttccttgtatgtgccgccatcttgccctcctcagggcctttgcacttgccattgcttctgcctatgccactctttccccacacctccaatgtctggctccctcaccactcggtcatcacctccacagcgagcccttccctgacctccctactgaaatggcatcaccccgtctccctattcctgcttggtttttctccacagtatttatttttatcacctgacgtcagtttgtagatttatttacttgttgattgtctgtcttccctactagaaagaaagtcagctccctgagggcaggcactttgtctggtttgtgctgtgctaaatttaccccagtgcttgcttggcacagtgcttgaaacatagtatctattgaatgaagtaatactggtaattgattggtggaaggaagggagggagggaaggaagggagggcagagggagagcagaggaaggaagagaggaaagtaggcgagaggacaactctggagccacagcctaccatggccaagccccacttacaagatgtaggcgatgacacctatggaccagcaatccacagccttgctgtagggcttctgggccaggacttcaggggctgtggagggaagaggacgtggtggtgacaaatctctgcccttcaactcctggttccccccaccatcacagccccagcccagggccctccgcacccacgtatcccggagttccacaggcggtggagagcacactgcccgggtcctccatcttggagaggccaaagtcggagatcatgattttggagtcttcatccaggctgtagtacagcagattctctggcttgaagggcaggagggaagagaaggggcaatcagagatggttagaggctggtagaaccttctgccgctccaagcaccttctgagaaataatggatccccaaaagccactgtggcttcatggctgtcataagaaaatcaaggaagctctcaagaaggccaaaaattccaggaaggacaaggctcaagagggtgtgggggggaactgtctctaaacctcaggtgtgcactgtaaagccctaaaggaatgtttgaatgcctattttatgccagaccctggattagtgcttgatttaatgccatcctcactgcttccctgctaggccagtctgtataatctcacctaacagatgaggaaactgatgcctttggaggcaaagtgactcacccaagaacccacagttaggcagtagcagagccagaattcaaaaccaggcatgtcacaccccaagtgcccttctcctagaacggattgagatgtactgctaaatgtgagccccgtcgctatttccgaggagtaggatttcggggatttctggcttttttctttatgttttgctgtcccatccaagttttctacagaaggggaataggattttttgtttttattttattttttttgacatggagtctcgctctgtcgtccaggctcgctctgtcgcccaggctggcgtgcaatggcacaatctcagcttgctgcaacctctgcctcccgggtccaagtgattcgcctgcctcagcctccctagtagctgggattacaggcatctgccaccacgccgggctaatttttgtatttttggtagagacagggttttgccaagctggtctcgaactgacctcaggtgatccacccgtctctgcctcctaaagtgctgggattacaggcgtgagccatcctgtctggccagatttttttttttttaatcagaaaaagacaaaatgttgtttggataaaatgccacacaattcactcgtgttcctttgagtatctggactagaatgggaggaggcagtttaaaggttacaagatccactttgtagatggaaatccaaggctcagtgagggggtgaaagttgcccaaggtcagacagtttggggtttgcaaaggccccacccctgggtaccctagctcaccacacccccttgagccccaccttgagatcccggtgtacaatgcccaggtcatgcaggtatttcacagcatccagcacctggaagatgaggcggctggcgtcccgctccgtgtagaagcctttttccacaatacggtcaaagagctccccacccgacaccctgcagcaggggatagggcagtctggcaaagagggttgggacagctgggagaggtgtgggggcagggcagaggttgggccactcacagctgcatgatgaggtagaggtggcccccactctcatagatgtcatccagggctacaatgttggggtgcttgatcctgaaaggagaaatgaggtggtttagccaggcatggcggtgtgcacctgtagtccaagctacttgggaacttgggaggctgaggcaggaggatcacttggccccagcagttcaaagctgcagtctgttatgattgcacctgtgactagccactgcactccagcctgggcaacagagtaagaccctgtctcaaaaaaaaaaaaaaaaaaacagcggtttagagctcaggacagctcagccacccccaacccccgaccactgcctacatacctgggtaggacaaaccaaggatctcgtccccaaagggaaaagctagcttaccatggtttattaccattttttggaaggtgagagagcagagggataaacactgggctctggcatacacagacctgggtccaaatcctgcccgtcacatgctatttgggtgcagatcttttcaccagtgagccactgcacccagcctgatacatacctcttaagagttttctggctaggcacagagactcacacctgtaatcccagcactttgggaggccaaggcaggcggatcacttgaggtcaggagttcgagaccagcctggccaacatggcgaaaacccatctctactaaaaatacaaaaattagccaggcatggtggcacatgcctgtaatcccagctatctgtgaggctgaggcaggagaattgcttaaacctgggaaacggaggttgcagtgagtcgagatcatgccattacactccagcctgggcaacaagagcaaaactccatctcaaaaaaaatatatatatatagttttctgtgtttacatgtttgtcagcctcccccaccagacataagctccccgaatccagaggctttgtcttgcttgccactgttcctccagcacctggtacagggtaggtgctagatttaatgtaacctctctgaacctcagtttcttcatctataaaatgaagccaatggtagtacttccctcaaagagttggagtgaggatcatgtgagataatgcaggtaaggtgcttggcacagtgcctggcacacggtaaatactcataagtgaaacaataatggtaattgattttttttttctttttttgagacggagttttactcttgttgctcaggctggagtgttgcccaggctggagtgcaatggcatgatcttggctcatcacaatttctgcctcctgggttcaagtgattcttctttctcagcctctcaagtagctgggattacaggcatgcgccaccatgtccagctaattttgtatttttagtagagacggagtttctccatgttggtcaggctggtttggaactccccacctcaggtgatctgcccacttcagcctctcaaagtgctgggattacaggcgtgagccactgcgcctggcgtttttgttttttttttgtttttttttttttttttgagatggagttttgctcttgttgcctaggctggagtgtaatgcacggtgtgatctcggctcaccgcaacctccacctctcgggtttaagcaattctcctgcctcagcctcccaagtagctgggattacaggcatgtgccaccacgcctggctaattttgtatttttagtagagacagggtttctccgtgttggtcaggcgataattgatcttgatgatgaggaaggctcagctctgccacaaacttgccatgtgactgtatacaaatccctgtcctctctgggtcttattagaaatgctctgccaggagttgggtgtggtggctcatgcctagcactttgggaggccgaggcgggtggatcacctgaggtcaggagttcgagaccagcctggccaacatggcgaaaccccatctctactaaaaatacaaaaattagccgggcgtggtggcaggtgcctgtaatcccagctactagggaggctgaagcaagagaattgcttgaacccaagaggcagaggttgcagtgagccaagattgcgtcactgcactccagccggggcaacagagtgagactccatctcaaaaaaaaaaaaaaaattatctgcccagggtggttggaagctcaggggagagattggaagtgattctctgtaagttttccagtgaggacaggaggtttcatatcagcatgagcaattcatagaccagttggttgtggatttagtctgggggtcagcagacagtcatttttaaacttgctgagtggttttaatatgtgaggggaacttgaggtaggtccagagacaacaccaactgagatatgtgggtccaagccatgttcaggatggatctttacacctgattgaacagttaaacccctgtgactaagcactggcacctccatcacatctgtcatgttaggccaggcacttgaaataaaggacttctgatgttccccacaaccctgccaagtggaaattgtgatccccattttataaaggggcaatttaaggcttagagagtttaaatgatttgtccaaagcaggaaaggaggaggatgggagggccaaggcagggtcagcttggggcagggaaaggctgtggcccacgcacttgtgcaggacagcaatctcattctccatgctgccttccttgccctccagggcctccttggcaatgcatttgatggccaccagcttctgcgtcctcttatcttctgccaggatcacctccgagaaggcccccctatcgggagaggggattcacaaggtgaagaactggaaccccagcttccctccagcctctcctccattccctatgggttctgtgaccactgctggaccaaggacgtggatgaccctcccctagtcactcatccatcccctggctccagagatggtcacatgacccaggcctggccagtcaaagtagtctctcccctggccacagtaattggtcatgtgatgcaagccagcttactagcactttgagaatgagtctcctgttgagctggtaggatgtaagcctggagctaatggcgatcatctttgccaccacctggggagagcctgcttgggaatgaaattaacacaaaggaagtccaacctgagaaatggccaaatatatttcctgataacattatgtggccctctggatccagccatgcctgaggtctacccctgggcttttggattatgtgtacagttggttcatccctttttctgctaattcgagtcatggctaatttaacaccctttagaaccttaaagaaccatcagcatcacccgggaacttttttagaaatgcaaaatctctactgctttggatcctgggtcaaaaaaaagaaaaaaaaaagaaatgcaaaactttaggccctgccccagatttactaaatcaatctgcagtttaacaaaatcctcaggtgatttgtatgctcattgaactttaagaagcagtgttttagaacaggttcttaaaaaggaacaaataaactcatttaactaaagttaactgattaaagaggatttgctagggtattctttccacatctgtttgctttctctgggagaataagaagtcataagtcaaagaaaagcatctctcgtggtgaaatttcaatcctcagggataattagttactgtagtaacctcatcactggtttccagtcttgtccctctccaatttaccctccaagctgtggccagagtgactatcctgaattgcacacctgccaaaaagtcttaagtgtctcccggtggcctatgggacaatatccagcctccctggcctggcttccaaaaccctacacaaactgtcccactttcatctccagcccctttttccactctccccccagcctgtgattttaagctccatcacactctacctctctccacatagaaccatgcctctaagcctttgtttatgctattccttctgcctggaatgtccttcttcctctctgacaagtgcacacctacccatccttcagtccccagctctaatgccccattctccaggaagttttcccccaggcagaaggcacagctctctctgggctccacaaagccctcaatcccaaccttaattggagcacagcacacaccctgttgtcattttctgtaggtctgtctcttgcacatgtctgggatcaacttgaagggcagagaccaggtttgagttatttctgcattcccagcaccaagaacagagccatctccagcctcagttcccaaacctaggctagaacacttagctcttggcagcaagttaaatggactgactggcaccttcattctctcgacttctttctcttcaagaacccagggctattgggagagcagcccgtgtcccacccactgtcatccagaagtgaaaagctggggacagtttaggccctagatagtgctgccacagggcctgggctgtgggaaacaggaagcattaattgaccagaggaagccccaccctggactcagcctccctcagccatccagcacccaatcctgccctggactcacgtgcccagaacatctcggaagtcgtagatgtctctaatgtcctccgcctgcttccacctggggccttccactgcccccagcatggcccactgccccccgaccacagccagggctcctgtaaggagaatggaaggaggagactcagcagagcccagccctctgtctgggaatttactgcaggccccattcagtcattcaacctgcatttattcatccttgattcatccatttgacaaaatcattcaacaaacattcatttgtttattcaacattcagcaaattctcatgcctagagaaaaacctttcacagtggcagcaaaattctttatttaacaaagtcatgcattcattcattcatttattctagttctcttcccagttttccccctatccaaatccaagcacctagggaaaccctgacttctggcagtacaacagataaacccccagagcagctggtagaagcctggaggatccccctgtccccagaaccagtgatgtccccgccccaccctggggattgctggggtgtctcctttccctcctccttcccccgactccccggcctctccgaaatcaggtttccagcagcctgggcttccagcaacatctcagccacatttttaaatagctctttctgcactgttaccacagcaacaacagccacagctggagctccccagacctctccctcctgactccccatctgggtcccgggagcatgagaaatggtcctgctcactctgtcccttcctggccccatctaaccctatccagcctggcccttcctctgctgaggtctgtctcatccagcaggagagggtgggagttctctcccatttatcagatgaagaatggggagactgaggttggagttaggtagaggctggctccagaggccctaatgacacctggcctggggcccccagctaagcttgctgagggcaaaggccatcgaatggccttggctggtacttccaatatgaagccagaatgggccccattcagagaacacagcctcccaacccatccacagatgaggccaaaacagagcccagcatgctttgtgacctcagggagagcactttccttctctctttttctctaagggagaatgaggagaaggtgccctgactagggcctctggtgtgagattccactcctggaacaggacctttttcccaggggaccctgcccacccatccaggggcagaatcttctaggaaaggagactcgagtgtaagctctagaggcagagtctgaaacccacatggaggcctaccaaatacaaccctcacagatccacacacatccctgtagcagacatgccacaccaagccccctccacagccctgaactcaaacacctgcctcccagatccagtacgccttgtatccacatcccgtgacacctgatcatacatgtactcccagacatcagcacacatgtccacaccacacagtgccccagacagccctgcacccgaacacctgcctgtccatccaaacatccctcacccagctccctcttacaccccaaaacacacatccacccgcacccacacaagatgacacccagacacacacacacacaccctcatataccagacgtaccctacaccctccagctcctctaccccatcccctggaagctcctgtattccaaaccaaaccccaagtccttacacacctaactccaaacatcctcagtacacaattgtacaccccctcctaactctgacttaagaccctgagagccaaataccagcacacaaaacacgtggacacccctctggaacaaaaaacacacagattcccagatcctccacccatgtctgacccacacgcctgtcctaagacagtacactccgcaagcccccccaccccatggatacctccaaatgcccacgcccttccagtcaggcccagctgaaggcgctcacacaggcccccttctctattacccactcagtgtcccataggcccgcctggcacctgctgggcctgggacagaggtggagaaaggcccagccctgcccctcagggtccagcccgcccgggagagtgcccagtggccactccttgggaaaggatacccagaggctaggggctcccaccgcccccacgcagcgcccaggggtgcagggatggggggcccggctgtacctgcggctgccccgccgcggggctggctgggaggcccgcggtggttggcgccgagctgtggccgcggtcctcaccgctgcgtgcctgggccacccgcccgcgctcttgctggagctggggctcggctcggctcggcggctctctccgcccgcctgcggctctgatgtcagtggaggtggagcctgcggcggagggacccgggattgggaggcgaggcaccgctccaaggctggggaaggggcacgggtggaggccatctccctgcttctggtcagagatctcctgctggacgcttcccgcccttggtcttaagcggggtccatttcacagaggggacaactgaggcccggagagatgattttcaaatcagcgggtggtcggaagcaaagcaggattcgaaccccgtctgtctgaagctagaggccggccaaactcaccctgtggcctggtggattttctttcagaccagttctgcgacctcccttagggctctgtctcccttctccgtgccctgaagggaaacaggccctggaactgcacgggagtctggtgggggatgggggagtgagggagtggggaaggaccgggcaagactaggcaatgaagagagtggaggtggtcgcagggtgtgggccccacttgacaggtgggaagactgaggccccggttcctctgcaagatggagctgaggcttcagccccagacacttgctcctcagagcgggtggtggtgcctagaggtattgggggcagagggaattggggaggaggaagttaaatcgggatcctgaaggaaacaggccaaaaaggaccgaggtgtcacgtgactggcggggctccagagtttgatggctggggtccaggttaggggagagagcctgcaactaggacggcaggcaagaggccaaaggtcggtttgctcaaggccttccttgggaagaaatttggtgccgagtggaaagagggggcggggggagcaactcgcaggaattggggatggggctgaactgggggcagccggaggaggcacgttgcttgggaccccactccacctccaagggcctccaagtgccactccctactcctgaattcttgcatgttccagctggtgatggggagagaacagtgcttatgcccagctcatttcctttttctctttctttctttcttttttctttctttctcttcttctttttttctttttcttttttttttaagacagggtcttgctctgtcacccaggctggagtgcaatggcatgatcacggcccactgcagcctcaaactcctgggctcaagtcatcttcctacctcagcctcccatgtagatgggactacaggtgcgtgccaccacacctggcttttttattttttgtagagatggggatctcactatattgcccaggctggtctcaaactcctgggctcaagcaatcctccccaatcagcttcccaaggttctggaattacaggcatgagccactgcacctggccaatttattatgcccatcttacagatgagagaggaagatagctgaggttcctggaaaggctttggagtctaactgatcctggtcatgctttacctctccgaacctcagtttcttactcgggaacatgggaatattgaagattgactcagagttctgagaattctatgatataatgatatgaagtgcctagaacactattcaaaacatgagagctagactcagtgtaaactgagactcagagagaggacttgatttggccagggatgaggggttaagggatccatcttccaaatctcagtatctcagactccttagttcatggaaaaatacatttcctgctcagggctgagcccccactctcccctatacccaccaagcacacccactgagctaggggttcttttaccacaaattcctgttcatcttgatgacaacaccccctgggtgataagatgacctctgtcctttcgaggacttgtacaacttcttttttttttttttttttttttttttgagacagtctccctctgttgcccaggctggagtgcaatggtgccatctcgcctcactgcaacctccgcctcctgggttcaagcaattctcctgcctcagcctcccaagtatctgggactacaggcgtgaaccaacacgcccaactaatttttgtatttttagtagagatgggggtttcaccatgttggtcaggctggtctcgaactcctgacctcaggtgatccacctgcctcagcctcccaaagtgctggaattacaggcatgagctaccgcgcccagctgacttgtacagcttctatggtgtgctttacatttttcctgcttttgagcatttctgagaggcctcgtgttttcttttctttaacaaacacattatctttactttcttagtatttctattgaacaagtgatacatggtcattgcaggaaaattccataatgtattgaaaacacacacagactaactgatgagattctttcgcttcccaagtgacagaatgccaacctaaaccagcttcatccaagaggaatctatagttcacaatagctggcacaagattgcaggaaaaacaccagagattaggggcttggagactggaactggagatgtagtactcataggatttgctttctctgtcttccctcctctctccttgtcttgatttttcttcacacgttggcctctttttctctccagagtgaacttctagttggcaggaaacatggagtgaggcagccccagctttccaattaaacacagtggaaggaaagcatcctcccaatttcctatctcattctcagggaaggactctggctctgcttgagtgatagagtgacatgttcaccccttggcctccaaaactgttgccaggagaattagggtgctatattgagcaagtgtactgtaatgggcagccataaggaatggaagaggtatcttgtccaaaggaattaggggtgcgagggaggcaagaataacacaacactctcagccgggcccccaccaaccagagacaaccagtgttcacatttttagtacaattcttccagattttttggatgcgtatacatatacatccttctgcagcccccagtcccgatgagcacatttcaaagtactaatcaaaaagtgagtgaagggccaggcgtggggaggccaaggtgggcagatcatctgaggtcaggagtttaagaccagcctggccaacgtggtgaaaccctgtctctactaaaaatacaaaaattagctgggtgtggtggcatgcacctgtatccccagccacttgggacgctgaggcaggagaattgcttgaacccaggagatggaagttgcagtgagctgagattgcaccattgtactccagcctgggtgacacggcaagactacatctcaaaaaaaaaaaaaaaaagtggctgggtgcggtggctaacgcctataattccagcaccttgggaggctgaggcgggtggatcatgaggtcaggagatcgagaccatcctggctaacatggtgaaaccctgttatcttttgtatttctactaaagatacaaaaaattagccaggcgtggtggcgggcgcctgtagtcccagctaatcaggaggctgaggcaggagaatggcgtggacccgggaggcagagcttgcagtgagcagagaccacgcgccactgcactccagcctgggcgacagagcgagactccgtctcaaaaataaataaatgaataataatttaaaaaaaggtgagtcaaggaaagtcaaatgttctcagggaaaagggggatgatcttttcttcttttttttttttttgaatggctaaacagtgcagacatctccatcaattcttttatttatttatttatttattatttttttgagacagggcctcactctgtcacccaggctgtggtgcagcggcgccatcatggctcactgcagccttgacttcccaggctggagtgatcatcccacctcagcctccggagtagctggggctgcaggtgtgtaccaccatacctggctaattttttttagttttttattttttgtagatatcgggtctctactccctctgttgcccagacttctctggaactctggaatcaagtgatcctcctgcttgggtctcccagagtgccgggattataggcgtgagccagtatggctggcctccatgaattcttgaacctgacagaaaagaagctattgaaagagtgagtagttaactaagattagagaaaatggaagaaataacaaggaaaagatggacaggtttattttttaaaattctttggctgggcgtggtgactcactcctgaatcccagcactttgggaggccaaggcagaaggatcacctgaggtcaggagttcaagaccagcctgggcaacatagtgaaaccccatctctactaaaaatacaaaaattagccaggtgtggtggcgcatgcctgtagtcccagctactcgggaggctgatgcaggagaatcacttgaacctggtaggcggagactgcattgagctgagattgcaccattgcactccagccagaatgacagagccagactctgtctcaaaaaaaaaaaaaaaaaaaacaaaactttaacttttgttacttttttttaactttttttcaaaaagtgaaaaccctactctactccgaaatggtagccaaaaatgaaaggcaaacttcagactggggaaatgttttgtagacaatggcttaatatatttattatataaacagcacacaggattgataacaaacagtaagaacctaataaatggtcaaaggatacagataaaacacagtaaacacaggacattttgtatctcactagtgatacaaaaaagtacaaaatagaaggtcatttgcagcctttcaaatttgaagtttaaaaagctggtaacactgaaggctgatgttgatgtgaggaatgagtagtcctacattctggtgggaaaatgatttgctaaagatcctttggaaagcaatttggcaatatgcatcaaaggcttaaataatgtcgaggccttttgattcagggactcctcttctggcaatcaatttcagagaagtaatcctaaattaggacaaggctatatgctccaagatgtttgagtaattttttttttttttttggctgggctcatgcctataatcccagcactttgggaggccgaggcaggaggatcacttgagcccaggagttctcaccaacatggtgagaccctgtctctactaaaaatacaaaaattagctgggcgtggtggcacacgcctgtaaccccagctactcgggaggttgaggcaggagaatcacttgaacctgggaggctgaggttgcagtgatttagattatgccactgcactccagcctgggcaacagagcaagaccctgtctcaaaaaaaaaccccaaaaaaacaaaaaacaatatgccctgagcttttgattaaaggttttgataagaaatcaccatgtgaaacttaatttccatttgctatcaaatgtatggagagtattttcaatgtatgattccagtttccacatgagatattactgaaacagattttggaggacatctaccagtctgccacattccacatctcacttgtatttctttgcaccaacttcaccctcactccctctcattagtccagcctctatgctgctctgagagtgctttctgctcacaaaccaccagtggctccctgttacttcagaatgtgattctcaaactttaatatgcaccaggaatcacctagaaggcatgttatatataatgtaaggctatgccccatacccagaggtttttttttttttttgagacagtctcactctgtcgcccaggcttgagtgcagtggtgtgatctctgctcactgtaacctccaccttccaggttcaagcaattctcctgcctcagcctcccaagtagctgggattacaggtgcgtgccaccatgcctggctacgttttgtatttttagtagagacagggtttcaccatattggccaggctggtcttgaactcctgacctcagatgatccgccttccttggcctcccaaagtgctgggattacaggtgtgagccacggcgcctgactatacacccagagctgttgattcagtaggtctgtggcctgagaatttgcatttttatcaatttcctaagtgatgctgttgctggcagtccagggaccacacttggagcaccattgtctagagaataaagtccatgctccttaatctgccattcaaacccttgcccagcctggtcttcaacctactttctagcttcatctcttatcctttcctttcccctccacacacccagggctccagtcacactgcagttcttacttctctctaagcaggccagctgttcacacctctgtgccttgctccttttgtctggaatgttatcttctgcccagcaattttctttccacatcctccctgaagcctttcctgaccctctaagctgttgttaagtctttctctgccccaggtccctgccaactttgcacagtcttcttttttcttttttcttttctttttttttttttttttttgagatgaagtctcgctctgttacccaggctggagtgcagtggcgcgatctcggctcactgcaagctccgcctcccgggttcacgccatgctcctgcctcagcctcctgagtagctgggactacaggtgcccgccaccacgcccggctaatttgttgtatttttagtagcgaaggggtttcaccatgttagccaggatagtctcgatctcctgacctcgtgatccgcccgcctcggcctcccaaagtgctgggattacaggcgtgagccaccgtgcccggcctgcagtcttcttattgctcttgcggcctagtgttttgattgtctgtctagtgtgtccccatttctggagccttagtcacctccatagctctcagccatggtgacagggtcactgaatgagggaacaaaagtataatgaagaagtggaggtgtgtggatggagtgaataagtgaatagggtaattaggtaggtgaagagaagaaatggggagtttattgatacctaaacgagtgagttacagtccactggacttggttctttccattgagtcctgagccccaggccaagaaataaatttactccccgaccacatttccacaaagctcctgccatcactttcttttcagcaggagccaactgggacccagagcacttggtgcccagagtactcaggagcagacaggggctggggacccactgtgggtcagagctcaccctccccgttctcactcaccctggtgttgctgaaagtcagctgtaaggcatttggaactctggggagaccatgatgtgcaagacagatgctttctagggccaagacacaaaaggctttgcctccaaactagtgataaggaatcagaattgttttgaattaaatttggagacttgaggtactggaactaatccgccctcctcatgacaacccagcttcctccacactcataaaggaggcatcttttggctccagcagacactgatatgattgtaagaactctgccagggatggtgctacctgggggcagcaactattcctgcatcaaggctgcatggcctcagcaaggcacagcatctctttgagtctctgtgtcatctgcaggctggaatattactctccttggaggtgcatggtaagcatcagataggaggggtgggtaaagggcctggcacagtgccaggcagatagtaggtatgcaacagagaacagctagagtgctcatgactgatccttgaaagttaagtttcttctctggtgaaccaggcccagtcggtcttctagggttcttctttctatttatatctgtcttccttctttcacaattccatccaattttgggatgtcagctctcatcccacctcctccacaaaactgtctctgttcttggaactctctaccaacaacgcccaccatacttatggtgtggcccagtgaacatggaagtgagtggttaagaggaggggggtcttcaagcagagctgccatatatggctgcacaggttgggcactgcccaagtatagggagtaccattcacatacactgtaatgggagtggggccccagtgagttgtaatgaagaggctctctctgtaagccaaatggcctgagtttgaatgttggctcaaccactcaattgcttgacaaagcaaggtatgtaacctcctaagcctcagtttcctcatctgtaaatgggatgttattatggggtagctgatacctaccccataatattaggtagttgaatgagttcagaacaatgcctggtgcatactaacatttactgagcccttcattgcattatcattatgattagagttggtttctcatcattgcatgtgtgggtgtcttttctctctgagaaggctgtgagcaacctggggacaatgagtcactgagaaattgcagcagcttggcccagcacctagtgggaggcagggcctcatgctgtcctctctctcaggatcctacttcatctttctttttgccaaaattcacttgtaataggccttttttagttacaaatcacaaaactctaaagcaaactagtttaagccaaaagaagcctttgtgggctgatatatgtgggaagtctaagggaggatccggtggcttcaagaatagctggatgcagcacttctccatctcctggctctgcttttctgagctggctttattctcaagcaggtttttccccatgggaggagagcaggtcactggggtagactgagtttatagtctatggcttatggtccaacaagaagtggaactctcctctcagcatccacagagcaatcttatggagggcctcgagtgacccagcttgggttacatgcctgcttctgggactaatcattgtggctagagggattggcacttgactggccaagctggggtcatgtgtgcaccctagtttggcagttggacaagaaccatgtgtgatggggaaggaacatttctccaacagagaggtgctgggtatacgagaatgttggccatgttcgccctccttctttatggctcagttcataggtcacttccttagggaatcttaccctcccttctctcctgcgtggacctcaaccttcccacagtaaattgcaaattattccctgattctctcagaccagtctgggaacaacttgaggcaggtaccagagcatatttattcatctgtgtcccttaggccaagcttcctgccccagctgtggaagagacgttgtcggtggtctatctagcactcacttccctgtttcctactcagatcttgttgggttttactctctctccaccaccttgatggagtagcaaactccactctgactggcataaagccattacagtctcctttgccacagtgactgaggaatgggcatgtgagactgagtttgggccactgaaacatgatggtatctgggaaaaggcttcttgcttctgtagatgggccatggaagcccgctggctccggctccctcctgtgctggatgtaaatgaggaagcatctggccccaactgctccactgccacactacagccagagaaggactcaccttaggcagaggtcgacactgtggagggcagtgtggtgacccctaagaaacctggacccttgggggaggggggagggaaagcattaggagatatacctaatgtaaatgacgagttaatgggtgcagcacaccaacatggcacatgtatacatatgtaacaaacctgcacgttgtacacatgtaccctagaacttaaattaaaaaaaaaagaaacctggacccttgatgaccctgaagaattgctagattggctaaccgtgaaggccactctgtcccaggactgcccatcctgcagccaacacatttccttactgtgaatccactttgagctgggggggcattgttacgtgcagccacaagtatcctcagaaagaggtactcagaaagttctccctgactgaatgccatgggttagtggccatgggctgagagccaccaagcataccccccacaaaccttaccacccacactggttccttcctccccactgtaacagacattcaaagactggatgctttttttgaaaaaccacagcagtcactttattcttaagtttgcactttacaaaaccacaagggagaagtccttgaaggggagacaggggtaggggattagggagtgggggatggtaaagaggggaagaggaagacccagaaacgaagtcccctccaaccccatctcggggaccaagcagagactaggcctcaggctagcccagcagggcttcctgtgtcctggttgtacagagctaggccaaaagacctcaggggaagggccacggccctctagagactgccgccatttgagggacagccacaggccaatgtttcctgtgcccaaagaaggaagtgggcctcccttcccctcccctaggccagataatcagcctgaggcaggggtgagggctacccatccagcagcttcaggatgctctcacgctccttcagagtcttccaggcctggtccttttctttcttggtgggagtccgcttcttctgccgggcagccatgatcttgcgaaaggcgtccatgacctcgttgtcagccatgcgcacccgctgcctcagctcctgccggctcacctcctcctttgccagcctgtggggaccagccagccaggtgccagggtcagcccacctccagagaacaacccctccctcttcaagaccgagcctacccaccagcccaggctggcatgcctgtggattgtgtcatacagtcgtgaccaaaaagcagttactgacctacacttacatggcactatcttaagctcctgaaaaatattaactcatgttgatcacgggggaggctgtgcacatgtggggacagggagatacgggaattctctgtacctttctctcaattttgttgtgaacttaaaactgctctagaagaataaagtcttggctgcacatgggggttcacatctgcagtcccagcactttgggagcccaaggcagaaggatcacttgagcccaggagttcgagaccagtctgagcaacatagtgagactgtctctacaaaaaatttaaaaaattagctgggtgtggtagtgcacacctgtagtcccaactccaagggagctgaggattgcttgaggccaggagttcaaggttacagtgaactatgatcatgccactacactccagtctgggcaacagagcgtgactgtgtcttcaaaaaaaaaaaggtcttaaaaatatacacagtaggctgggcaaagtagctcatgcctgtaatcccagcgctttgggagatggaggcaggaagatcacttgaagccaggagttgagaccaacctcggcaacagagtaagaccctgtctctaaaatatatatatatatacatacacacacacaaacacacacacacaggcacacccactctctctctctgtctttcagttaatcctaacaaccctgcaaaatatgtactattattcatatgttacccgtgaggaaaatgaggctcaaagatgatcccaggatcccacagttagtgagggggagatctggagcaggctggggccaaactcttgtttttaaacactgttgtttcaggtgttccggtgccagcagaaggcctgcttacgtcggcatctgcattccagagccccctaaggtctaggcagcctgaggctgacaggaggtgggtgagacaccagatcaatctctctgaacagggtctgatttatacatttcatcgatggtggagctggaaggtcacttagtgattgagtccagcctgccagttttccagaaggggaaggagatgctcaggtcaggggctgcttaaggccttgcagctgctctgcagcagggtaagggctgtgctctggtttcctgagagctgcaagccatttcttcattgcccattacttctttttttttttttttttttttttttgagacaggtctcactctgtcacccaggctggagtacagtggcctgatcaagctcactgcagcctctacctcccaggatcaagcaatcctcccacatcagcctcctgagtaggactataggcatgtgccaccatgcctagctgatttttaaaaatttttagtagagaagggggtctgactacattgcccaggctagtttcgaactcctgagctcaaacaagcctcccacctcagtctcccaaagtgctgggattacaggcatgagccaccaggcccagctagggcccactacttctgtaactgcacatgcctgcttttctctctcttcctctctctccctctgcttccctcagtgcctcttccatctgtgttttcttcttctcacctttcagagaaaacaaactattatagaaagaggctttgattcaaccacaggttcaagtctcagcttgctgtttattgactgtgtgaccttcagcagagcatttcgcttcactgggcctttatttcctcatctggtaaacaacgaaaatagctcctccctcctgggttgttgtcaagacacttgagagagtgtacataaagcccctgacacacagtaggccctcagcatacattagtcactcttatccttaaataccctggcagcttgtcagcaactacctctccttttaatggcacttatctttactgatcatctgctagtaatctgcaagtcccttgctctgcctctcttgctggcccccagcacaatatctaagagacagtaagaatggccaaatgattagcctggcatggtagtgcatgcctgtaatcccaactactcaggaggctgaggcaggagaactgcctgaacccgggaggcggaggttgcagtgagccgagatcatggcactgcactccagcctgggcaacagagtgagacaccgtctcaaaaaaaaaaaaaaaaggccaaatgaatgaatgtgccctgtcctgtcagggctctatgaagttaagacacagcacttgtctgtgagaagcaaagagacttgttcgggttgcttccctatctctttacctaaagggtagctattccacagtcttcctcaagatgtcacctataccctcgtgatcaatgcagaacaagatggatgggagttgacatcaaatgaatggcaggcactgtgatggattcccaaaagaacatgtcctaaaacactggtcaatttcttgtgatgagcaaataaaaatcacagatctccaacaaaatgttaacagttaattagtctaggtggagaatatactgatgtttattgtatgattctttcagattttctgtgtgtatcaaatttttaataacaaaactttggggataaaaagaaaagaagcatgaaaagacaaaaaataaatcacacaacaatgtgaatatgggtaacactactaaactgtacacttaaaaatggttaagaagcgtaaattttttttctttttttttttgagatgcagtttcactcttgttgcccaggctggaatgcaatggtgcagtctcagctcactgcaacctccgcctcccaggttcaactgattctcctgcctcagcctcccatggagatacattttatattatgcctttaccataattaaaaaaccaaactaggccaggcgcagtggctcacgcctgtaatcccggcactttgggaggccgaggcgggtggatcacgaggtcaggagatcgagaccatcctggctaacacggtgaaaccccgtctctactaaaaatacaaaaaaattagctgggcgtggtggtgggtgcctgtagtatcagctactcaggaggctgaggcaggagaatggcatgaacctgggaggcggagcttgcagtgagccgagatcatgccactgcactccagcctgggtgacagtgcgagactccctctcaaaaaaaaacaaaacaaaaacaaatcaaatcaatcggtcagtcacagatgcctgagccccactctgtggaatcagaatttgtttgggacatacccggtggactggccactgctgtttttttcgaggctctccaggtgatttagaggccagccaggattggaaagcctgttgtaaaacccctgaaaggtgactagccgtggccacagcctccaaggccacccccgggactgtgcatcctgctaacgctcacctcagcaggtcgtgcttcttggtgcggttgtgggcactaagtgccttcagctcagcctgccgtttgcgaagctcagcaaggacctcatcctcggagtcctctgcggggcggtcctcagactccaaaaggccctgggcaattagctcctccttgatgcggctctccagggacttagtatgcggcacactgcagcgggaggcaggcccgtcagactcaagagccagcttggagaagggcccaccttggaggttcccagggcttcccaaggtcagtgaaaacctgcctttccctttgggcaccccctctgtatctatccagatacaaagggagggacagacacatctggtctggtttttaaaacaagcaacgtatgtatctactattcaaaaaatatggaaaaacccataatgccaacaacccagagagaattactattattttgttatatattattatatatattccagattttgttatatattattcctaatcttttgctacatattagtccaggttttttcccttatgtgcacatatttaaatatattgtaagtaagccaggcatggtggctcacacctgtaatcccagcactttggaaggccgaggtgggaggatcacctgaggtcaggagttcaagaccagcccggccaagatggtgaaaccccgtctctactaaaaatacaaaaatgagccatacatggtggcaggcgcctgtaatcacagctacttggtggctgaggcaggagaatcgcttgaacctgggaggcggaggttgcagtgagccaagattgcgccattgcgctccaacctaaacgacaagagcgagactccatctcaaaaaaaaaaaaagaaaaagaaaaaaagaaatatattttaagtaaaaatagtattataccatccatactgggctacaactaatattttctccacttgtcactctataatttacatcttttcatgtcatttaactatatttctctatacttgcagctatatgattaatagccccaagttatttcatcatatggagttatgccaatttagccaaccattccccttcagcaggacatttgggttatttatggtatgaacagttctgtgctgaacaaccctgcactcagtctgtgcatgcagacacgctgggtcatcactcacacttgagactgctattaggcttcacctaactgcccccagcctcttactgatgaggacttccccaggttgagatggagagaagccaacagaagcgggggccagactgtgggttgtggataggacaccactcacctgaagggcttgttctgattgcgaggggaggtgcttgccccgtcagcccctgattctttcccagacatgtcaggaataggagaatcctccataggggaaataatattttcctagaagaccacaaaaatgagtggaaggaaaaatagctgttccactttcctgctcctttctgacctacactgacagtcttcaaacaccagaaatatccttttatctttcccatcccacctaccgtgggaagccttcccataccaatcccaaattgctttgatcattctagaaatcccttttattttcgtactgatgtgaagaaaaaggaacacagaagagaaatgattaacactcaatgatggtaatgaacagctaaggtttgtgaagcgtctgcaacgcaccaggcagtgtgctaggcctgctgtggcggagatgctagctgtccgaatgccatactcttctttcctccacggcagctaggcaatgcctgtccagttgtacttcccaggctctcttgcaggcgggtatggtcatgtgacaagttctctccaggggaaagtgatcagaagagataagagccatagctaggcatgggccaaaaagtttccttcacacactcctccttgttttgttttgttttttttttttgagatggagtctcactttgtcacccaggctgtggagtgcagtggcacaatttcggcttactgcaagctccgcctcctgggttcatgccattctcctgcctcagcctcccaagtagttgggactacaggcgcctgccactatgcccggctaatttttttgtatttttagtagagacggggtttcatcatgttagccaggatggtctcgatctcctgaccttgtgatccgcccgcctcagcctcccaaagtgctgggattacaggcgtgagccaccgcgcccggcctccttgctcttattctgtgggactggagtgacaattacgcccagagtgaccttgtgcagactgcaaggccaccgtcagctggggtccctgtctgatgatatgagatagagacctgccccttcccctaccttagataacctgcaacatgtacccagactgttccatgagataaactcttgtgtttgagccagaatagaaaactgagtctcaatgaggtgaaagagtgtgagggtgtgtctaaggtcaaccagcaggtataaagacagggcccctgaagctagggtttgaatcctggtgtgtgagacctcaagtgaacagttcccttttctgagcctcaatcttcttatctgtaacacagcgttaaccactgtcctggcctccagtgggaggatgtgtataaagcccctccaacagatgcttagcaaaagtaattgtggagtaaggctacctttggggaaagttggagaaaaacaggggcatgagaggggcttctaggatatagtaatgtttcattttgtaatctccaggctggtaatacaagctcatttgtgaaaactgtacatttatgatctgtgcacttttctattaggtgcacaagttatatattattcccaatcttttgctatatattagtccaggtttttacttttgcaccaacctatttttgcaccaacctaataaatgtatgataaattccgataaaaaataagcataacacattaaaacacaaagtaaatatggttcctcttttgggttaggctgctcacctccaccagggcctgcaggaggcgctgcgtcagggcaccaaaggggcatccatcttccggctgttcatgctgggcctcagacttcttcagcagggcatccacatctaagcgggcacaggaaaggaggggaggtgggctgaagttctggaattcaagtcctgacctggggttggcagggaggtgagaggcctacctttagtgtccagttcggtcagtggccccatgaggcctttcttcttgtcagccacagccgctgcccgggccccatccttctgctcctccagcaggtcctcctgggcccagcgctgggagtagtgcttccccaggggtgggatctgtggaaaagatggcacccaaccctgagtgggtaagcactggccagccatgcttcattcattcattcacttacctatcttatatctctctcaagtccctagtccaaggccaagcccagtgtcaggtgtaggtaagaaagtacaacgaagataaaacctgtacttcacactctagtaagggagacaggtccaaaaagaactaagacacacacacagaagccaatctgaaataattcccaagatagaaggtgcagaatacgtacacagattgtctcaggtcacagcaattgcctctcgagagaattaggagccttcaggtcacgggtgacagggaattaccttttgtattgcttgaatttactgctgtctgtatgaactctttttcagataaatttttaagaaatcagataagtgaagtgaaagagagagatcaaagtgttgtggcagcacaaaggagagactgactaactttctgctggggaatctgaaagagtgctttggtggaggtaacatgagatcagggccttgaagggtgagtcaagtctgtcaaggagacaagagggagagaagagcttgccagaggcccagagaccagcgaggaggctgtggtgtcctggaatgagggcgagatacttggtgggactggtcaacacggcaatgaagagggatatggccgaggaaaatggagaggggcactggagctgtgccagcaaggactgggatgcgtggacttgatcctgtagataacgggaggaagaaaggcctggatgcagcgccatgtcatgagcacatctgatcatgacagctcacctatgggaggattctccctcaacatttttctgtattttctaaattttctttaatggagcatgttttatttattttcatcattaaaacatagtttta

SEQ ID NO: 39 - DNA, 8058 bp, Homo Sapiens
ccatctgcaaacacaccaaagctttattcaacaggcgtggcttcctgaagcgtaaagccacttcacagacggtggccacagcggcacctcggccagagccatgcggccatcagagaccctgggcggccgggcagagggcttggttgaggcaggcgtggcagcgagggtgcacaggcagacaggtctgctggccgaagcccaccaagagtccattgatctcgtgccacagctccctgtgggggtgggggctgggtcagtgctgacagagggcgggcggggtgagctcttctccctaggaagccccccacatactcatacctaggcagccactcctccagggcggcgcgggtctcctctggggacttggttgccttcttggtccacctcagcctgttggcgattctgtgcacatgcgtgtccactgctgctgggaggccaagcggggtgaacaggggcacactccaccagcctagcccgtgcccctccccgcccagaggcgagtctgccaccacccccgtggccctccagttagacattggaaccgcaaagccctggctgcaagcctacatgtgaccatcttggctgcccctgaggtgctggggcaggggctgagccctctgttggggtgcaggcctctctcccatcacctgagccagcctggggggctctgttctgggctgcccactcccaacactggtgctagttggatgtgtgggtggtggggtctctgctttgggcagggcctgggggtgatgactcggctctgcttggagctctattccccacaataacagcgacagctcgcttggacaaacgcttgctgggggccagaccctgccagagagattggccagctcagtgagtcctcatgaggtcctacggatgctgaaaccgaggcccggcaggatcccgactccgaagcacctctcagccctcagcctccccaggaacgtggccctgtccccggaagggtccatccaggcttccctctgtctgtctcctgtggcctgaggctcctctcggcataagcactggctctgggcaccaggctgggtggcaacagctctgcctggcaggccggcatgaggtcactgcctgcagacctagcacctgccactgcagcggtcagggacacagcgggagcatgccctggccggccgcagctgctgtccacctgggttctggctcctgctcccctcagctggccaccccaggcgtctgctcactggggctcccttctcccacccggtggccccggccagctgcagccccagccctgcctcctcctcccgtgtttcccaaagagaaagccgaggcctgcaccagctccttcgctgctgcctagaaaaaggtgtccgagggtgtggggagaccacaaggcctgaggggtcacacccctggggctctgagcctcagtttcctcctctgtaacacggaagtggccatgcttcaaggctgagtcaggccacgtcacgttgtgtgagcctcctgcccacctggacagtgaatgacgaggactgcctcacccactttgtggccagagcttagagaagccaagggcctggcccagagtcacccagccaggaggtgcagagctgggaccggagccagcaatctatggctgtggcatttttttttttttttaaacggagtcttgctctgtcacccaggctggatacagacaatggtgcgatctccactcactgcaactttcgcctctgggtttcaagcgattctcctgcctcagcctcccgaggagctggaattacaggctcctgccaccacgcccggctaatttttttttttttggtgagacggagtcacgctttgtcgcccaggctggagtacactggcgcgatctcagctcactgcaagccccacctcccaggttcacactattctcctgcctcagcctcccgagtagctgggacaacaggcgcctgacacaatgcctggctaattttttgtgttttttagtagagacggggtttcaccatcttagcctggatggtcttgatctcctgacctcgtgatctgcctgcctcggcctcccaaagtgctgggattacaggcgtgagccaccacgcctggccacacccggctaatttttgtatttttagtagagagcgggtttcaccacgttggccaggctgatcttgaactcctgacctcaggtgatccacatacctcggccttccaaagtgctgggattacaggcttgagcccttgtacccagccagctctgacattttaactgagagcgtttctctttcggggaacccctaggaggcagccctggggtctccttgcaggtggtcaggcccacagacacctggagagggaggtatttccacatggctgtctcttgtgcccgctgctcccaaagcccgttccctgcctggctgcgggcagggaccttcccccacagccctgcccaaccacgatgcagcaccccagggacacgggcagctgaggacagccgcccagataagctcaagtgtccactgagaggctggcaggtggtgacgctgggagtctcagtcgggaggaggccctgccccggcgcacctggcctggctctggctctttggggctgctgtggctgttcagcctcaccaggtggccccggctcagaatagaggcccccggcccttggtggccctcttgcccaccagaaagtgctgcaagccccccgcctccggcacaggccccctgcaggagtcccaaaggggcctgggatgggggcacacagagggcagggccaagccctggtttctggactggctgggcccggctgcgtgtggccttaggagccccaaatcctctggacaaagccgaggaggaggcagccccaccccaaacccaggggtctgtctgcacccaactgccaagaagcctccggtgctaggaagagacaccaggacctgggaaaaggattcaaggagggccctccccccagtgcctccctccccaccctcccctcttctccctctcaaccctcccctcttctccccgcagcacctccctctccaccctccccccatcctcccagcgcctccctccccaccctcctcccccattcccccagcgcctccctccctaccattcccctcctgtccccgcagagcctccctccccaccctccccctttctccccccagcacctccctccccaccccacctgctgaggggatactcttcctcctccctcctcagtccttacctccccactctgccctcatctcattccagaacttcctgctcctggccctctctctcgcatcatggttttacagatgctgttccttctgctgggaacacacttcctcctcttggcctggctcaccccaccttgctctgcagctctcaggtgaaggatgaccttgggggccttcccagaggccctgggcccaagccaggccccaagagcaccctgcacaaccatcagggtttccactccacgagtggggaattcctcgctccacatttctcccgaatacaacgcagatggagtccagctccggggcctctctcagagccctgcacggagcaggtgctcagcccatgtgacctcctgccccagcacctgtctctgagtggggctggcctggctccaccctgggagcacctttctgactctatgggctgggtggaggaccagcatgctggaagtggagtcacaggtcacaaggatgtggggaatcccaagagcagccagtgggctggagccagccccgccctcctctactcaccaatgcctgacacagtgccccaggccacagccatagccaggtgtgccatcttgggcccaacacccggcagcgccaccagctcggccacagaggctgggatgtccccaccgtagtgctgctgcaggatggcgctggtctgcttgatgtatttcaccttgctctgaaagacaggggtgggttcagccttggaggcaagggcacagcccaacctgggaggatgcagcccccaggagacccacaggtggccagagctacctgcacctgctgaggacgtgtgcaagctcagcccccgccccccaggaggcgggaacaagcggagggcagcagggaggcccaaggtaggcctgaccccctcctcccacccgtgtgggccaatgatgcacgtgtaggctctggctggggttcccctgcccgtcattccctgccagcacccaggccaggccaagcaggccagccgctcccaggagtggggcttggctgcacctgcgccttcaggaaggagggctggagctggggcttccccaccagctgccaggcctgccgggtggttcccatcctgtgcctgagtggagagggctatttaaaacccatctgagaaactgcggcccacgcgggtgccaaggggaagcggccccacccaccaagctgctttcaacagatccgcccaccaccatccagtgctcggcggggttggggagcagcctccccagggctcctggagggtgaggggctctggacaggagggggtgacacaccgggagaggctagcagtaaacaaagggaaaggcgggtgggcaggcagccttggcggtgaggaagggtgggcaggcggcgaggcggggaagcagaggaaggaagggaggatgcgaacaggaaggccaaggagctgctgggactgggcgtcaggcctcagggccccacggcctggggggggcttcagggggaccccccgagcctgagatgcttgaccctcacttcctgcaccgtcgccacccccctcagccttctgaggtctctctcaggccactgccacccggcccccgttgccacaggcagggctcaccctccagaaaccgacggggtagatgagcttgcccagcgtggcatcatctgtctgcaggatgctgtccaccgtcaggccccgcgcccgcagtcgctgcatggcgcccgccgtcacctggtctttggtttggctggagagcatcagtgacagcagcacctggtacctgcgtacctgcttgtgcagtgacagggaccggggtggcggcgggtcctgggtgattccctggccaggctccgccccccgccctcgacacaccctggtttgttgccctgggccacacttgaggcatcagcctccccctgtggggtggggaggtctggtttgggtatgtttggtcatctacaacaccaggacaataatagtacctgactcactggagtaatgtgaagcttaaatgaattatctcagtgcttagaatcgtatgtggccgggcgtggtggctcgcacccgtcatcccagcacttcgggaggccaaggcaggcggatcacctgaagtcaggagtttgagaccagcctgatcaacgtggtgaaaccccgtctctactaaaaatacaaacattagctgggtgcggtggtgcatgcctgtaatcccagctactcgggaggccgaggcaggagaataatttgaacctcggaggcgaaggttgcagtgagctaagatttcaccactgcactccagcctgggcaacaagagcaagacttggtctcaaaaaaaaacccaacacgatcgtatctggcccatcactactgaacagccattggccactactattatgattgcttcgtgaatcatcacactaccctttaaaacaaatttttttttttgagatgcagtatcactctttcacccaggctgaagtgtggtggtgccatcttggctcactgcaacctccgcctccggggttcaagcgattttcctgcctcgccctcctaagtagctggggttacaggtgcctgccaccacacctggctaatttttgtatttttagtagagacgtggtttcgccacattggccaggctggtctcgaactcctgacctcaggtgatccacccgccttggcctcccgaagtgctgggattacaggcctgaaccaccatgcctggcccatactacccattttacagacaagcaaactgaggctcagagaggcctgtatccaagccacctggtagcagaatagggattagaactcagcttggtctaagggtttcaggccctgggaccgtgaagcaaaaggaactcttccttcctgatatcacacaaagcccaggtcacgcctgcactgggcagaagttcgagcacgaggccctaaaccactggtgtcctgacctgctgagtggctacagtgatgcaggcgatgctctggggcaccgggtgtccatcctcccaaggtgctgtctgcaggggagggtgccagccaaaagccaccgggtagaaagaaaacaaggaccttgctaagatggggggtcatctgggcagatggggcccctgcctacctttgggggggcactggagtcatagcagtgctcagtccccagatggtccacaggtgcatcctttttgttcctcatggcacggatgttgaccagctgttgctgccagtcctggggctcccagactggcaccttgaggggctcagccccctcacctttctcactgtccgagccctcataggccacacgcagtctctgtgctttccgcggacgcttcacggggctgtggcttttcctcgcttctgcaaaaagcaccacgcagtccctctggtggggccacaggtgaaggtagggtaggggtgccatcccgcctgctagctcacccctcactcgttcatgccacaactgtccatcatctaatacacttggggtgctctgccctctgcagtctggggtatgtgggccctccttatgccagcgaccctgacaaggtccatgttagctcatgaggactctagcaacagcctgtaccaaggtgcccccaatacatcttctatactgcaccagagacagtctgctaacacccacatcaggttgtgtcactcccttttaaaaaatcctggccggccgggcgcggtggatcaagcctgtaatcccagcactttgggaggccgaggtgggtggatcacttgaggtcaggagttcaagaccagcctggccaatatggcaaaaccccatctctactaaaaatacaaaagttagccgggtgtggtggcaggggcctatagtctcagctacttgggaggctgaggcaggagaactgcttgaacctggggggcggaggttgcagtgagctgagatcacaacactccactacagcctgggtgacagagcaagacccgatctcaaaacaaacaacaaaacctcctaattgacttccgtttactgtcataataaactccaaactctatcctggcatcaaagctcctgccaccctggctggcatcaccacctgcctgctcccagctgcaccagttcctcctgacatagtctggactacccctggggtccctgggtgcctatgggaatccagctctggccaattctgcagaagtcccagcgggactagcgcagaggccctgtccgtgtccctcactgctcactgcagtgcttggcccccagcaggtcctcaacggctgcaggataaatataataagtgccatgccctttcctgttttccctcagaggcaccctcccccgagctgggggagcaggcttctggctgcgtgtgtccttggcacccagcctctccgaggacagcaagttcactgcaggagggcggggatgggacccacagagcctggagtggagagtcccggacagagtggtgggaaaggaagcgttttcttgcttggggcgaaagggggcagcggagcggagcgcccgaaacccagcccctgcggaccgcaatctttgggaaaaaggcgcaaggtgggaacgcagggccgcacgtgggaaccgttcgcggctgccgggtttgcagcccctgcccgcgcagctgggagccgcaggaggcggcccgggactccagcctgcagcccctatcccgcctcctcccacgctccagccacggcgcggcgctacctgctgcagcctctcttctccggagaggcccgggctcctccctacacccccgcggcccagccccgggtcccaggctccggctccgggtcagcatcctcgcgctcaaggcggtcatgccggactcctgcggactacacatcccggcggcccatgcggccccgtca

SEQ ID NO: 40 - DNA, 8833 bp, Homo Sapiens
gtcacactcatctgagggctccagacacatggcctgtgcgtctgtcctgcccagcgtctcccacctgacgcggccaggtgcccagttgctcttcaaggccttttcaggtgctcctttccaggaccagggtcacagaagtcaaagctcaggaaaagcccctcgagggtttttgtgcggcagaggtgggttgtggggtgggattgtgcctgccacagtggaggggccctgcagacccagataaaccttcaagtggccagaagcgggggatggctctgctgggtgctggggctgccatgggccgtgggagccagcagtgtgcccagctccctcagggcccgtcccctaggcccttccgtccactgggccaagcaccgtccctgcccctccctaggggcatggatctgacttgagaggttgtgagagcttacaggcgctgggccgtcggggaggcctcagaagcgtaggacggctgcgcactgccgggccgtgttcagccctggtctggcctcggcctctagaggaggctgcctgcgctccagcaggcccaacccagaacgtgggcgagctcccttcagcatccctgggcggaaagagggatgggggctctgctgcagaggcagaatccgcgccgctccctccttccttcccccgaccagcctgtgacaaccccggccaggggcgggggcctccgcacaagcctggcgtccacttcctggataaggactccccggcccactccggaccagggctggggcggcctcccaggcgctcactccgctggcaccccaccggaaaacacgtctgcggcccgccccctcccccaaagcacgaccactccgcccgggcccctcgaggatccactcaggttcacgacgggcccgtcctctcggtggtctgaccaccggctggtggagtgggctctggggccgccaggcgaccagggcgcaggcgggggcggacagctcattgggaggggcgccggggcacagtgcggggctcgccccacccccaggtgccccttccccgctctcgcctcgcaggcaccgcatcgggcccgggaatcggtccggacctggcggtgggcgctgggaagaggatccacctccacgtggcccgccccgccccgggggcgcagccagttcccggcgctcactgccccccttctcccggcttccgtccccttctgcgcaggcgccgctccgccccggtcctaggggtgcttccgtggtcggcggctgctgggctccgcgccggggtccgagtcccacgaagccccggcccgagccgccggatgcccgcgcgcagcggggcccaggtgagcgcgcgcctcggccgccccgcggaacagacgcgcccacccccaggcgcagcagcgagcgcggccgcgggagcgggagtgccggggacgggcgtagcgcccaccgccccgagggttcggggcagagccagagcataggccaagggccaagctcgggccgagagcagtggccgcagcgcccgggggctgaacccacggcgcgctggcagcgcgggccgagctgcggagacggtcacgtcagcgtccgttccaggccgactggcagtctccgttctacattaacgtcagcactcccgttaaaaataatgcatctctcccatgccaggaggacttaggtgctgctaaagaccagccctccgggtgctgccaggccggcgctcacccgccaccttcatcttcccttctcctttgccccaggacagccgaggatgtgtggttaggttccccctacccatggggaggccagaggtgggaggctggcggcctgctcggtctcagcagaccctcctagtccctcaggagaccttgcctttgccccacttgctcgttatccagcctgggccatgaagcagaggacagttagggaccctgagcacgcggtggtcaccccggtgctcacccctccctgtgtgtccgaccttggccctgctaagatcctgtgttttgaattctggcaagggttggatgaaagggcagggctccagaaaccagctcagacgtttgcttgggacctgcatgatgagtgggaatcggagggcaccagccctgctgtcccaggctcaggcccccatctgctccccaggtcatgcagcctgggcccccatgccgtgcagctcgcacatatgtggggcagagcagccaccctgcccccagcagcagccgtccatcgtcagacgtgatcatttcctgaggcctcgagtgtgtcagggtgtttgtgcctcataacaacccacaggatggtcacccccgctttgcagatgaagaaaccaaagcaggtggtcagatccagtccttgcacttcctgagcctgaccttaccacacagctgtctcctattcggatgcttatttattttttttcccattacagttttgccgacggatggggcaaaagaagcagcgaccagctagagcagggcagccacacagctcgtccgacgcagcccaggcacctgcagagcagccacacagctcgtccgatgcagcccaggcaccttgccccagggagcgctgcttgggaccgcccaccactccgggcccataccgcagcatctatttctcaagcccaaagggccaccttacccgactggggttggagttcttcgaccagccggcagtccccctggcccgggcatttctgggacaggtaatgtgaacatagcagcgagggccctcctgaagtgcctgtcactgcagttgtccctgaacccctgtccgctgcctgctggattggccctcagttagtcctccttgtcctcatgcatttagcggctttgctcacactggtccctgcttagcttcatctcagttgcctgaggtcatctgggaagaatgtagagattgtcagtgctgcttgcccagggtggagcaggggtgccactgtctgcccccggctctgggcatctagggcaggagcacttgcaccgttagccttcctcaccggcaatccacctcagtttttccacacgtgggaactgtggctgtggccagtgtcgggctgccccttcccgctgtagtggctcacagtgcagtgctggcttcccagggcccctgcagcttaatgtaggtcaaggatctgggctctgccaatcagacttggagtaagaagcagggactgcccaggtcccatcctggtggggcctacggtgcagcctgtccccacgagcagatgctcacacagccgtggcatcttggctggatctgttgggagcgaggtggtggcggtggtcctcgatgccaaagccccaggcctgcctttctggttctccagaggctccaaggccttccctttgtcctttaatgagcctacttttaggttataatcaccaagaagaaccagaagagaaataccagtgccaggagttgggtgctaaaggagcagaccctagaatgtgggctcgacctcatggagaacagagaacattctgtccccatgcggatccttctaaaagcaccttaagtaatgggcatttgtggccaggtgtggtggctcatgccggtaatcccagcactttgggaggcggaggtgggtggatcacgaggtcaggagtttgagaccagcctgaccaacatggtgaaaccccatctctactaaaaatacaaaaattagctgggtgtgatgacgggcgcctctaatctcagctacttgggaggctgaggcaggagaatcacttgaacccgggaggcagaggttgcagagagctgagatcacgccattgcactccggcctgggcgacagggcgagactccgtctcaaaaataaaaaaaaaatacaatgggcatttgtgatacaacaaaacagcacgtgtggcaggtgcgtcgtaggaacagggcaagggcgcagcatggcatcagggaccacaatacgtttgtctctattcagcatccttgtcaggccacagtcatgcccacttgagcccattggtggacaagatgatgtccagcagagaagagggtgtctcaccctgtgtcccttggatcagggacagccctctgccctctccataacctcctagtggatgcccttgcagacccctcagccaggcttgggtcatgcactcatccctaaaagggtcactgcagtgagttgccatgaaatcccaggccactctctgggctgaggagggtgtggtctcccccaggaggctctgccaacaaggaagaggggtgtgtgttggccatgggggtggggaggggtgagaggccccagtatctgccactggtggaaatggtatcagtgaaatcctgatcagaaatttgggatggaaaaggaaacaatgagaaaagggctgtgggaacctcctctccagagtggtagttgggcccccccagtgtgcccccatggaggcacaggagtgtgcagagtgaagcccctggaggggcattccctctaagctccagggaagatggaacagggccaccctttctcccctggacatggcctggccaagcctggcctgttcacttctgtcctcatggctctggatgcctaaggatttctgggcttcccgcccaggcactgaccccttcttcccaccaccctatctccaggaaggcctcctgaatgctccccacactgaccccttcttcccaccaccctatctccgggaaggcctcctgaatgctccccacactgaccccttcttcccaccaccctatctccgggaaggcctcctgaatgctccccacactgaccccttcttcccaccaccctacctccgggaagccctcctgaatgctcccggcgctgaccccttcttcccaccaccctatctccgggaaggcctcctgaatgctcccggcgctgaccccttcttcccaccaccctacctccgggaaggcctcctgaatgctccccgcgctgaccccttcttcccaccaccctacctccaggaagccctcctgaatgctccccgcgctgaccccttcttcccaccaccctatctccgggaagccctcctgaatgctccccacgctggccccttcttcccaccaccctacctccgggaaggcctcctgaatgctccccacgctggccccttcttcccaccaccctacctccgggaagccctcctgaatgctccccacgctggccccttcttcccaccaccctatctccgggaagccctcctgaatgctccccgcgctgaccccttcttcccaccaccctatctccgggaagccctcctgaatgctcccccggcgagcatctaagctccagtgcccctcctccccagcccgtgatactgaccatggcctttggcaccacagggcttcgtgggctgaggtgaaggtagcctggctgtccagctgacctatctggcctaaaaacgagaggtgcaggggatgtggttggtccccagtgctctgctgttaactctggggctccgagcagtgacacaactgttggccgttaccaggaccatggtccaggctggggcaccgtggggcagctgggcctactgctcagaaagccggagggtgggagctgagtatgagggtcccttgtggccacctcagcagcccaggtttaggggacttcacgggctctgggattgcccaggtagctggtgtggggacatccttggggtcctgtgccttccgtgatgcctggcctcgtgctaaatgctgatggttttctcaagggcacttgggaaaggaggaatctggggaatggagggtcctgctgagaggacttgacctgcaaggtgaatccatgactgccggttcccagcccagcctggctgtggcctgaggtatcttcggcctgcggtctggttgtctagcagggctggaggagacaactggtgccctcaatagccacattcagcctcagcaggagcaagagaagaggcaggatggagacggggcaaggtccctggctagacctgggcggctgacacaccctgagctggggagatgaggtccaggctgggcactgttagggtgagtggacccccatcccttcccgccctgagcagaaactgactgcccacaggtcctagtccggcgacttcctaatggcacagaactccgaggccgcatcgtggagaccgaggcatacctggggccagaggatgaagccgcccactcaaggggtggccggcagaccccccgcaaccgaggcatgttcatgaagccggggaccctgtacgtgtacatcatttacggcatgtacttctgcatgaacatctccagccagggtgagcagtgctggggcacggggggttggagggccggcagagccctgtccgctagcagccaggggaccactaggaggactgaggtggggccagcatttgagcgaggaggtgccacttccaggccaggccagggtttcgggagctctggctacgctgacggggcagggctggttaggttaaaggggtagaaagggccgggtggggccgggcgcggtggctcacgcctgtcatcccagcacttcgggaggccgaggcgggcggatcacctgaggtcaggagttcgacaccagcctggccaacacggtgaaactctgtctctaccaaaaatacaaaaattagctgggtgtggtagtgggctcctgtaatcccagctactagggaggcggaggcaggagaatcgcttgaacccgggaggcggaggttgcagggagccaagatcgcgccattgcactccagcctgggtgacagagcgagactccatctcaaaaaaaaaaaaaaaggaaaggaaaagaaagggttggttggagtggaggcagaaagaaggccgaggacacagtgtcgcctgcccttgacggaggcagcacatgaggatgagaagctgattggagaagaggatgactgcagtgctaagagcagcgtggtcaggttgccaaggatggagcagtgggcacagcagggggacttagggtcggcggaggagtcggtgaggaaagggaggtttggcaggaagtgatcaaaggggtcatgtttttgtcaggatgtgggacttggatgtgttctgtgtgaaggagccagggcacggggctgtggtgatgagggcggccaggctttgactcatttgcaggcggctctgtgggggctcagtgagacaacgaggggcgtgtgccctgcacccacagggatgtagagggtcctgctcctccctactgaggtgggtcagggtgggcagcaggcaccccacctggtgagctggaagcagcgtgggaatcacagaatggacgggaacttaaaggctttgcttggcctggattttatcttgaaatacttttgacagctggctggttgagggtatctgctcacaggaacgccgcatttgctggctttgtccactagtgctcgcccctggctgctgatgcggagcctcacgtggccgcagcccaagagtagggactggcttggccacctccaggctaagcttcggactcccaggtggctgggagggccaggggtgcacaggtgcatcagagcaggtgctgccttgctggagggccagggctcttctggccagggtccaggtcatcattgtccccagccaggaatccaaggggcctttccaaacctgcagggcagagggaattcgggtatctgtgcttgagtgagcccctgggcccaggagccttcgcttgctgtctctgtttctcaaggggcctggcctggtgagggagggggctaggctggaggagggatcccaagggaggtgagggggctttgtcagcctcctcctgccctgcctgtgcagggtgttgcagtcagtccttccactgagtcattgcatgggctctcccaacatccggtgcacactggcagctgctctaagccaactcctagcccccaccacttgaccaacacaaacactgagtgggtgaggcagaaggggagcgctggggcctggctaggccaaggcttcctgcttcctggctgaatgatcgcacccgaggactggctctctggagcttcctttgctggctttatagctgctgccagtcacaagaccaggggaagccaggtggaaaggaactgatacccagcatttgtcatgtgtttttaacagtctggctttgtgggggcggccacagtgggggaggccctgcctggtggtggaagccagaggtgcccacaggaggcacacctcatggtgcaggcttggaggatggcaaggtaggcagaggggtctggacacagtgaggtgcagccccctcccaccaggtcagacccaggagatggtgcaggtgcacagagcaggtccctggcccaggcaggaaggcagctgcaccctccctgcagcacaggatgtctggatgtgtactagggcagagaggacaggagcctagggaggctccacttccaaactgtccgtcccacaggggacggggcttgcgtcttgctgcgagcactggagcccctggaaggtctggagaccatgcgtcagcttcgcagcaccctccggaaaggcaccgccagccgtgtcctcaaggaccgcgagctctgcagtggcccctccaagctgtgccaggccctggccatcaacaagagctttgaccagagggacctggcacaggatgaagctgtatggctggagcgtggtcccctggagcccagtgagccggctgtagtggcagcagcccgggtgggcgtcggccatgcaggggagtgggcccggaaacccctccgcttctatgtccggggcagcccctgggtcagtgtggtcgacagagtggctgagcaggacacacaggcctgagcaaagggcctgcccagacaagattttttaattgtttaaaaaccgaataaatgttttatttctagaaaactgtg

SEQ ID NO: 41 - DNA, 8357 bp, Homo Sapiens
gacctgggtttgcttctctgtcttcacctgccagcactaacccgcagctatactccagccacacaggacttctttgagttctttcagtgaccaatctctttctcgcctcagggcctttgtactggcggttccttccgccggacacgtcgggtttcctcgtttttgcggactggcgctttctgatttcagagactctccgcaacagaaccatctcaagtgggtctacctcctcgcctttttttgttgttgttgttgcttggctgcgcttctgacagggcaggccgtgatgatgtttgtttatgagttaggtctgactgttcgttggtgcttaagatccccaccgggtccctagggcctgtgcgtaccgcgcacctgtgcacgtcctgcgcgcagctgcaggcgactccgctctggctcgtcgctgctgtttcctgctgggggtgccgaccctgtcccacgctagctgggtgacttcccccaaccgcagagacagcggcgacccggggcctcagacctgcccccgcatctcgccggcgccaggcagtgggaagtcaggttcttccgccacctcccagccaggtaactgccccgaagcctgccccaaagcctggaaccccccaagctcggggaccccaccccgaagaatcgcgaccgcttccctgagggactacacctcccagcggctcccagcgcgctcccgggcaccgcccgttctggcgttaaccctttagtggctgcagtggcgacgagcggaacggagtgcgggttcccggggagggggcgtgcaggatcgggttgtggggggtgcgctgtagggctaaggagaagatgagctttggggggccctgaggaggaggggagtcaggattaaccgaggacagggtcgcagcgggggcatggggaggacgggcccgagagcgccgctcctccccaaaactaggatttggagcctcacgttctcccgcaaaacgagccctgtgggtgccaggccaggggcggctcccaggtgtggagggggcaaggtacgggcgtctgccgtcgctaagtgcccccttccacttaaggcacaccttcgcctccgattccgaaccgcccggggacagaggcaagtggcaaagcagggagggcggaggtgaggagtcgataccccccaccccagggaccaggcgctgccgcgggccctttccctcccccaggcccggggcaggagctcggggagcccttcctggtgcccgccgtcctcctgcggagccatggggagcggctccagcgcatggcggcagcccgcccgcctcgtcctggcccctgccctgacccgggggcggccgcggggatgtccggtccgtggggcaggcccggttctcgctgcggccaagcggccgattcggccgctcccgccgctcccccgcgccaggccgagcttcgctctttccctcggtggtgagcggccagatccaggcgggtcctaagtgtggggggaggggggcgcagggaggggcggccacgcgatcctaagaccctttcagatggtgggagagcctggagaaagagacagcgtgtgcggagggggtgctccctcagatggggggtcaggaagtctccctcaagtgtctgggacagagggacagcaggggccaaggcggagatgagatccgtgagtgaggggagccgggaagaagtaaggctgcagccgcggccccgcaaggattgggactttcgtctaaacgcggtggaagcccatggaaggaagcggttagcagcaaggcagagtcctgctccctctgcagccccagctcccagcgccctgggctttccaggcacctgtccgggtaggggattgagggccgtggccaggcccgcactttcctgccagccgcagctggccacatgcccatctgaccctccgagttctcctctaaaaatggggctgacagccgctacctcacaaagtccacaccgggctcaacccgctgccttcctccccaacaggactctgccaccctccctcaggatgcctgagggccccgagctgcacctggccagccagtttgtgaatgaggcctgcagggcgctggtgttcggcggctgcgtggagaagtcctctgtcagccgcaaccctgaggtgccctttgagagcagtgcctaccgcatctcagcttcagcccgcggcaaggagctgcgcctgatactgagccctctgcctggggcccagccccaacaggagccactggccctggtcttccgcttcggcatgtccggctcttttcagctggtgccccgcgaggagctgccacgccatgcccacctgcgcttttacacggccccgcctggcccccggctcgccctatgtttcgtggacatccgccggttcggccgctgggaccttgggggaaagtggcagccgggccgcgggccctgtgtcttgcaggagtaccagcagttcaggtagggccagcaccaggtgtgatgaacatagtcgcgggctccacacctgactctcttagtgccttcttggccaacaaggggcgagtccctgccccttctgggcctcagttctctcatctgcagatcaagacagtatacctgtcctgggtcagctccctgagccagtgggcatggaaactcaaaactaattgggggccgggtgtggtggctcaagtctgtaaatcccagcactttgggaagccgaggcgggcagatcacgaggtcaggagttcgagaccagcctggccagtatggtgaaaccctgtctctactgaaaatacaaaaattagccgggcatggtggcacatgcctgtaaccccagctacttgggaggctgaggcaggaaaagcgcttgagccggtgaggccggggttgcagtgagctgagacagcaccattccactccagtctgggcaacagagcacgactctgtctcaaaaaataatgataataataactgatgggggaggagagaggagagccaagaggaggatgggtaggtactgccctgaggacatgtggccagttagtgtcagagaagctggggctcccacccacaatcccacaccacctctcagggctcccaggaggctaagaaggtggaggggctttaatatggtaagtgaggctgagcggaattgtttcaaggggatggggaggggactatctcatgacatggcttccgccttgggctttgtggtctcccacatccggcctgcccagtattctgtgtcctgtggtctcctctgcgccacttccctgcctgcagtagggtgtaacagccccacctgggatgtgatgcaggtcacctcacatggcacagtgttggccacttcctttcctctgaagaggaaacgtgtatgagtctctgcttcatgccaggccttgttctaggggctcggggtacagcagtgaacaagatgaatgtggtccctgctcccacagaactgatgttcacataggataggggaatgagaaatggacccatgccttaggaaaacccaacaggtgaaggaggtagaggatgacttggccgagggtgggggtacattagcaatggccactctagggaggtttgagctgaggcctgactgatgagaaggagccagccagaggaaggcattggaactggcaagagtcacaaatgcagaggcctggagtagggttggcaagttctccctttctgggggatgctgtgcgtccgttgacccttaggagacttggatacctgtgggatgggttggagatgtctctggtgccttagaagaaagttgactcctggccttcccctgtgtgaactccaagcacatccccagggaaacatctgtctttggtcctggattcctcccacctcagccttcctggggagtcacgccacaagttaactctgccagctggctctgaagtttctctcaaaccacgagcatttgggctgttttcttagtcccccagctggggcgtgtggcaattggcttacctcagggatcagggcacctcccaggctacccttgtaccttcaccccagaactctgtcttctgacccactcatcacacccattagtcagtcttgccatgacccttttccgcaaagaaacaagatgcacatcctcttcacggtgaggaggggagacccatgacccttggaggtggggtgggggctgctagggccctcactggtactccacatatctcctgcacagagccagacaatgtccaggatcttgagaagaatggaccctaccaatggcaaacccacatatggtctctaacccaccacaaatgctatacagggagctccagactgcaaacacacttgaggtcctgtggccacactgttctcatgtcctgaggagtctgaggtgataaacacacaacctcatatacaacctcatgttgctttttttttttttttttttgagacagggtctcgctctgttgcctaggctagagtacagtggcgccatcacagctcattgcagccttaacctccagggctcaggtgattctctcacctcaacctcctgattaactggaaccacaggagtgcatcactaagcccctggctacttcttaaatttttggtagagatggggtcttccttgttgcccaggctggtctcctgggctgaagtgatcctcctgcttcagcttcccagaatgctgggattacaggtgtgagccaccacaccagcctcaagttactttagatcagtatttttcacctttcacaatgaatttatttttaattttgtttttattttttgagatggagtctcgctctgtggcccaggctggagtgcaatgctgcgatctcagctcactgcaacctccacctcccaggttccagagattctgctgcttcaggcctcccaagtagctgggattacaggcacccaccatcatgcctggctaattttgaatttttagtagagacagggtttcaccatgttggccaggctggtctcgacctcctgacctcaagtgatctgcccgcctcggcctcccaaagtgctgagattacaggcatgagccactgcacctggccgtcctttcacaatgaatttaaatcccttgatgttcccatttaacagataggaaaacgggggcagggagaagaggaactgtaactcccagtttccttccccttgcacccagaaacaggttctctgagcccctctccccatcccatggagggtggggatgggtcttacgcacccagaccgtgttcctccagggagaatgtgctacgaaacctagcggataaggcctttgaccggcccatctgcgaggccctcctggaccagaggttcttcaatggcattggcaactatctgcgggcagagatcctgtaccggtcagcaagcaggcatgggcatggggactgcggtgggccaggtgtgcccacattccccactgcctagcatggcttgccttgcccccactacaggctgaagatccccccctttgagaaggcccgctcggtcctggaggccctgcagcagcacaggccggtaagcccagagagggatggagcacacgtgctggcacactggtgtccacatgggccggcaaggagatgggtggggtcaggtgtccccagcttagctcaacaacaggggtggggaggggatgaactgcccaaagtctgaccaagctcagagagaaggtcagctgcctttacatggccctgctgacagacaggtcctgcccctgccccttcctcagagcccggagctgaccctgagccagaagataaggaccaagctgcagaatccagacctgctggagctatgtcactcagtgcccaaggaagtggtccagttgggtgaggccaaagatggcagcaacctctgcttcagcaaatgattgtgtaaccctggggcacttgtccctctctggacctgattcaccgatttggaagtttgtagccctagctgatactcaatggactaggcctcctcacttgtcaatagtgtttccaggctgggcgcagtggctcatgcctgtaatcccagcacttcgggaggccgagtggggtggctcacctgaggtcaggagttcgagaccatcctggccaacatggtgaaaccccatctctactaaaaatgcaaaaaattagccaggtgtggtggtgggcacctgtaatctcagctactcgggaggatgaggcaggaaaatcgcttaaacccaggaggtggaggttgcagttgagctgagatcgtgccattgcactccagcctgggcaacaagagcaaaactccatctcaaaaaaaaaaaaaacaaaaaaacagtgtttcctccaagctgcccatgagacaggcaggacaaggattcttttatatatttatacacacacacacacacacacacacacgcacgtttatatatatttttggtagagataggatcttgccatgttgcctggactagcctcaaactgggctcaagtgatcctcccacatctgcctctaagtagctaggactacaggctcacaccaccacaccgggctaattgttaaaaattttttttgtagagacagggtctccctatgttgcccaggctggtattgaactcctggcccctagggattctcccatctaagcttcccaaagtgtcgggattacaggtgtggccactgcacagggccaggacaaggattcttaatcccactccaggatgggaaacccatggccgagtgggaagaaaccagctgaggtcacatcaccagaggagggagagtgtggcccctgactcagtccatcagcttgtgtagctgaggtctgggccaggtctaaccaggctccccactcctcccaacctgagcctgccctctgatctctgcctgttcctctgtcccacagggggcaaaggctacgggtcagagagcggggaggaggactttgctgcctttcgagcctggctgcgctgctatggcatgccaggcatgagctccctgcaggaccggcatggccgtaccatctggttccaggttgggccctactgttcacacaggcagagaccccaggaggctgatgggtggaaacgtggggtcacaataactggggtggtgatgctcagggtctgtctagaccctccaaggaccacactgttcctgagggtcacacccctcccctcccatgcgtcccagggttgcagctagtggaagtagcccaaggcaggtagcccaagtgaaagtagccaagggcagagcagctttgctgatgtggactctaacatgggggatgtcctagaggcttcctaagggagaagctacactgatctggatgggtgtgtgtgagtcctgcctctccaaggaataccgcccctgtgccaacccaggctgattcctgaattatccccatcccattttagggggatcctggaccgttggcacccaaaggtaagctactcctaatgtaataggctaagagagcagaaaggacttcacgcctgcaagggctacagcacccttctccaccctatccccctgcaaccctgggagtcacccctgggcaggataggaccctccaactccaacaccagtgtcctgcagggcgcaagtcccgcaaaaagaaatccaaggccacacagctgagtcctgaggacagagtggaggtatggctgcctgctcccgcctcctcccctgcactctgcagccctggctgcccctcccaggcagctgccttaccctaagagggcggggggagtggtgggccctaaccaacctctgaactgctttctgagcccctcagggacccgtgtctcctccatccaggacgctttgcctccaagcaaggccccttccaggacacgaagggcaaagagagaccttcctaagaggactgcaacccagcggcctgaggggaccagcctccagcaggacccagaagctcccacagtgcccaagaaggggaggaggaaggggcgacaggcagcctctggtgggctttcctcatcactcccagaaactggctctacaggagaggatgggatggtggcctaggagcgcgtgtacaaaggtgggagaaaggctgccatggcagcccctggagtcttagctgaccatcttgcctgttcttcccccaggccactgcagaccccggaaggtcaaggctgacatcccatccttggaaccagaggggacctcagcctcttagcaggaggctctccttgcttgcactcaccctttcttattgtcttgccctgcatctgggggtctgaatttttgggagcaggcaatatctgaaggtgcaaacaggccctacggctgttccctgcacaactctcatggttttaattgtaccccatcttccacatctttaaagctcatgtgaaaaatgctgcatttttaataaactgatacatttgaacttc

SEQ ID NO: 42 - DNA, 17684 bp, Homo Sapiens
ggggcgtcccctaaggggacggaggccgcatgggccgccgagccgggaaatctccgcccccagctggagcggctgtgcgggctgcgtagcggtgctgggtcgggccgacgtgccacccacccggagccggtgagtgcagccgcccgccctccggtagatctgcggcctggcggagaagtcgggaggggacaggaagggagggcgggccccgggccctcctccgtctcagccgcctgcggaggtgctgcccacgcctggaggcccccactgaccctcagacccgcgtctgcgcccctctccccgcaccccgaggcagagttgggaaagcagtggtcttagaccccccacctcgggcactcggaagagaacggcggagacaacccctcctcttccctggctggcgcagcgccagcctcgagctcctcggtagcccccgggcagggagggccggagggtgggcgcggcatcttcagcgactcttcgaagtcccttccgcgtctcatctttcaaggctgttgcagaggcggcttgcttcccacctgtccatctccataaaaatccctaaacgaaacatgcccacgtgtccggagattttcaggacttggtgcatttcagatgaaggcttttccagaagcttccccgtagaagaggatcaggcatccaactggttaaggtcagcagcgtttggcacgtctccttccagcctggcggttttgtcaggattccctggggagtgtctggaaagcctgatgaggggaaatagtacatctcagcgaatcggcaccagcgagtgtaagatgcgcgttattgaatgtgctgctgccgaatatgagaatgccgagattgtgagccgtcaccatttcttagattttaaaagtattctaaaatgttttttagaatcactgaaatataatagctaccccctgcccgatatctacttagttcttttcgattttcatcataacttatagagaggctggtgcaggaacaggtggttaggcagctgccccgggtgaggctgggagtctcctctgcccgaacagcccgggtgtacaccactcagactgcctcatgtaggcggctgtcagtggactgggatgatttgggggcagggagagtagaggtggccctgggagccctgcgtggtgattagaacagaaccacagctgtttctcggggatcagagataactgtctgtagctatgccgggcttacctacgtggctgggggtctcacttatgattctgagctctgtctgcgtgttggtcgtttcatgcacacctcccccacgctagtggtcggcggtcctggagggcggcatctggtcccttcaaaagtgggaaataagtcggcagcagtgggtcagaatggctgttttttgagagcgggagcagggggacagagaaagtcaggaggtgttagaggttcacagtccaggcaaaaagtaacaaaggccagctcctggtgtggcaggtgccgctcaggaataaagtggatggtgcccatgatgtgctgcctagcacactgttggtgcttaataagtgtttgctgcatgaagaaaggtaagaggggctgcctttcctgctacgtttcccacaccctgccacagctgctcttctctatgatctgaccgcctcccagccacactccctttttggccatgcttgctcttaaagttagttggcagcaaaaatggcggcatggaggatgcttggcacctgttaaagatgctagagataaatgagctaagtcggtggcctcttttgcccatttctgcccacagggatgccagaagggccgttggtgaggaaatttcaccatttggtctccccctttgtgggtcagcaggtggtcaagacagggggcagcagtaagaagctacagcccgccagcctgcagtctctgtggctccaggacacccaggtgaggtaatactcctctgaagggttggctctgtcgcccatcctgcgcctcccctaggatctatccccatatgtctcagggtgtcacttccctgagtccggaaccaccaagctcggactccatgcagctccctctttcagtctcacgtgtctcagccagaagtagatatcgctgtggactgtagaactgtaaagaacacgtgtggatgagctggagaccccgattcagagggtctggagtgctcctattctctccggccgcagctgatgggcacctttggctgggaactgtgttctattcccctgagccagtggagaattaaggacagagcagaaccggctgggcacggtggctcgcacctgtaatcccagcactttgggaggccgaggcgggtggatcactaggtcaggagttcaagaccagcctggctaacatgatgaaaccccgtctctactaaaaatgcaaaaattggctgggtgtggtggtgggcgcctgtaatcccagctgctcgggaagctgaggcaggagaattgcttgaacccgggaggccgagattgcagtgagatgagattgtgctactgcactccagcctgggtgacagagtgagactccgtctcaaaaaaaagaaaagaaaagagcagaaccttcagatctaggttcaaaccagctcatccttccaggggctcacggagctccctgttttctcaccactgcctccctctctagccttcttatcctgccccaaacctgtcttctgatcgatgaaactgcctttggctcttcttagtgtttctgtccgtggttttcacttgctgccccctgctcaagcacttcttcctttttctcccaactctgcccctgttccctcaatttataatggtaattcctggtcttccagcttccacttggccattgcatcctcagagaagcctgccctgtctgctttaggtgggaaggagactccatctctgtgcttccaggacatcatgtacttcctcctgttcttccctttttactgagttgttctgcttgttgaggggagaggacagatgcagagggcaggggctgctcctcgccagtattgtgcccccagcacttagctgagtgccggcacgtaggaagcacgggtggtgcctgtggatgagctcacgcgctctgctgctgcttagccgtgtgctcttaagcatgttcatctcatagctctttcttctattgtagaatggagataagccattgacctcttaaagttgttgttttaagtagagtttatgcctggcacataacgggtactccataagtactagttccctttcttccatcttgccctcaccccccacccccgcaacacacacacacagaggttttaaaaccgttgttagttagaactggaagagatcctgtagccctgtacccatagttgattcctttggagactgaggctcggagaagggagtacttagcccaagctcaggtggctggcaaggaacaggtgagagcacggggtcccatggcctccaggactgtggcctctttgtacacactgtccttcgaggtttgcaggggcagaattgtctcttgtctctggatccccagcacttaccagggtgtctgccacagagctggctgtaagagaatatttcccaagtggatgggtgggcagatggatgtgcggtgaaggaacccgtagacgggactgggagctgctttcccagtaaaccaagcagaaaaccatgttgcagggaacctaaggttgcagggaaccttcggggctgcctggcagtgctttgaagtgagcgcccttccctgcttctccctgtcggcgggtccctgaccctaggaacttagaactgaattgagaacatacggcttgtatcgacacaggccacactattaagctatgctaaatggggagggcagagcacatcataaaggcccaggtaatgaccctgacaggaagaggtcccggtggcctggagaagatgtgcaggaggtaggacttgagttgggccttgaaggctggaggatttcagtggactgaagagggaggaaagggcatttcaggcttgagaagcagttacaggcgggccgatggaggtggagtgagcagggtgagttgatgaggcaggagggagcttggctgcactctgtgccatctgtttgtctggcacatccttttcttgtcagctctccattttctatataggagttgtgttggattactcataacagactcagaaaaatggctactctagctcatggttttctcctcctccagtaatggaacagtccagggtggtataggagcaacattggaaaccaagctccttctactctccccttccaagactgggtaatttatgaaggaaagaggtttaatggactcacagttctgcatggctggggaggcctcgcaattatggcagtaggcgaaggggaaacaaaggcacatcctacatggtggaaggcaagagagcttgtgcaggggaattaccatttataaaaccgtcaggccaggtgcagtggctcatgcctgtaatcccagcactttgggaggcagaggtgggcaggtcgcctgaggtcaggagtttgagaccagcctggccaacatgttaaaccccatctctactaaagatgcacaaattagctgggcatggtggtgggcgcctgtaatcccagctacttgggaggctgaggcaggagaattgcttgaacccaggagacagaggttgcagtgagctgagatcgcacctgcgctccagcctcagcaacagagtgagactccatctgaaaaacaacaacaacaaaaaacccatcagatctcttgagacttatttactatcacgagaacagcccccatgattcaattacctcccactgggtacctcccaccaggtccgtcccataacacatgggaatcatgggagttatattattccacccccaggcccttccaaagcacaagtcctcacatttcaaaaccaatcatgccttcccaacagtccccaaaagtcttaattcatttcagcattaatttaataggccacagtccaaagtctcatctgagacaaggcaggttgcttccacctatgagcctgtaaaatcaaaagcaagttagttacttcctagatacaatgggggtacaggcattgggtaaatacacctgtttcaaatgggagaaattggccaaaacgaaggggctacaggccccatgcaagtctgaaatccagtgaggcagtcaaatcttaaagctccaaaatgatctttgactccatgtctctcatccagggcacgctgatgcaagaggtagactcccacggccttgggcagctctgcctctgtggctttggtagggtacagtccgtcatcctggctgctttcacaggctggcattgagtgtctgtgtgttttccagggcagggtgcaagctgtcagtagatctaccattctggggtctggaggacagtggccctcttctcacagctctactaggcagtgccccagtgggaactctgccttggggctctaaccccgtcttttccttctgcactgccctagcagaggttctcaatgagggctctgcccctgcagcacacctctgcctggacatcccgttgtttctatacatcctcagaaatctaggtggaggtttccaaacctccattcttaacttctgtgcacctgcaggctcaacaccacatgtgaaccgccaaggcttggggcttgtaccctctgaagcagcagcctgggttgtacattggcgctttttagccatggctggaggggctaggacacagggcaccaagtccctaggctgcacacagcagagggggccctggatctggcccaggaaaccattttttccttctaggtgtctggacctgtgatgggaggggctgctgtgaaggtctctgacatgctctggagacattttccttattggcttggtggttagcatttgactcctagttacttatgcaaatttctgcagccagcttgaatttctccccagaaaatgggtttttcttttctactgcatcatcaggctgcaaatttttcaaacttctgtgctctgcttcctcttgaatgctttgccacttagaaatttctttcaccagatgccataatcatgtctctcaagttcaaatttccatagatctctagggcaggggcaaaatgccaccagtctcttagcacagcaagaatcacctttactctagttcccagcaagttcctcatctccatctgagaccacttcagcctgtaccttattgtccatatcactatcagcattttgatcaaagccattcaacaagtatctaggaagttccaaactttcccacattttcctgtcttcttctgagccctccagactgtttcaacctctgcctgttacccagttccaaagttgcttccgcatttttagatgtctttacagcaatgcccccctcccaataccagtttacagtattagtctgttctcatgctgctgataaagacataaccaagacttggtaatttataaagggaagaggtttagtggactcacaattccacatgtctggggagtcctcataatcatggtggaaggcaaaggagaagcaaaggcatgtcttacatggcagcaggcaagaaagagcatgtgcaggggaactgccctttataaaaccatcagatcttgtgagacttactgttgtgggaacagcatgggaaaaaacccatccccatgattcagttatctcccaccgggtcccccccacaacacgtgggaattatgggagctaaaattcaagatgagatttgggtggagacacagccaaaccatatcacacattttatggtcagtgatgtccagtcatcagttgttggacactcggattgtttcaactctttgacttctatggataatgctgctgtgggcattcatatgcaagtattggtgtagacgtatgtttccatttctcttgagagtattcctaggagtggaattgctggaccatatagtatgttgaacttttttagtgtcttctgtagtgttttccaaggcagctgcaccattttatcatcccaccagcagtgtatgaggaccaatccttccatttttaacctcttgccacagcacctggggcctccccatctccaggtcacctggggtcacgatgggtaggtcccctgggttctctcttccttggggctcccctctgctgcagcaggggtctctgctctccctcatcagttacccttcctgtgcctgttcctcatcttctggggggactttgtatctcctgtctgctcctcctcttggtcctgagagttgagagctctttggttcctatagcgggtttgttgggagtagtgctaacagcgcacgccctggctgctgtgtctgaccaggagcccctgttccagtgtagggtttccacctctgccttcaggtatgtcccctcagctgggcacaccctgtctcctctgccctccactcttcttgtgaagcccagcccaggtaacggccagcttcccctcatcatgtagactcttcttccgtgtgctacgtctgcttctacccacacttttcttttcttttttttttgtacagatgggcgtttcactttgttacccaggctggtctcgatctcctgggctcaagcaatcctctcgtctcagcctcccaaagtgcagggattacaggcatgagccactgtgcctggcctagccacacttttctctgtgctcttgtagtatctgttttcacagttgtccccctcccacccccaccgccttttaaaaatttttaaaattgtgatgaaaaacacataacaaactttactgtcttaaccattttaaagtatatagttcagtcatgttaagtgtattcacgttgtctaacagtttccctgaacttttttatctccccaagctgagactccatacctgttgaacgctaactccccctttcctccctccctgcagcccctggcaatcacctttctactttctgtctcgatgaattttacttccccagatacctcatatcagtggaattatacagtatttggagtttttttgactggcttatttcacttagtataaagtcctcaaagttcacccatgttatagataagggaagattggagattgttgtaatctaattttgctgctattacagaatatttgagactgcataatttataagcaatgtaagtctatttagctcacagttctggagcctggaaagtccaagggcatggcattggcatcttgccgtgtcatttgcaattggcattattccattcaggaggccagagctctatggcctaatctcaaagttgccatctcttaccactgttccattggggattaagtttccaacacatactttttgaggaacacattgaaagcattgcagagccttattcatctgtttgcccttggagcctagcacactgccaggcacattgaataagcttaattaatgattagtgaattgaagtggctgcagtgtcacaggaacccaaaagagggacagcagaaattgccatagttggtatgaggacatcctgacctagacatttttgacctagtaaatgttttgttcatgatgggcatttgacagttattttcatcagaattatatcaacattggtgagtttataccaagaaatattttctgcagcaaattctattatgcccacttaaatccttgctcagttttttttttttttttttttatgtaggtcagttaaaccatttctaatatgtggcagataacaatctgtgctcagatttacagataagctattctgggattatttcgaaaggtaatgctcttttgggtggaggacttcaagattaatttgtgtactaattaacaagttaaagatcataccagaacagtgatctttaagcacggacctgtagtggtcaagaaagtaacacaggcatttccagtattaatgccagatattttggtttatactccttgaaagactgcctgaatttcaggctgtgtagaactgactcatcctggaatctaggcctacatattgcatatcaggaggtgcaatatgaaaataaagtcaaagcaagggcccaggcatggtggctcatgcctggaatcccaacactttgggaggccaagacgggcagatcgcttgaggtcaggagttcgagaccagccttgctaacgtggtgagacgtggtctctgctaaatatacaaaaattagctgggggtggtggtgtgcacctacagtcccagctacttgggaagctgaggcaagagaatcacttgaacccaggagatggaggctgcagtgagccaagatggtgccactacactccagtctaggcgagactccatctgaaaaaaaaaaaaaaaaaaaaaagacagcagaacatcctttaacacacattttctatatttattttcttctactgaaatcattttcagtgagatgaggtgggtcctttgccttatactttttagagtggtgatctgattcactgatcaatttttgtttcagtatctaatttttattgattacagtttccttatcaagtccaatatgctggtggagggggtagcgaggggtacccagtttcacagggtgttgtctttagctgctctgtatgtgtgcattcccacgcaccgcttatttctggcatagaaaatgtattacgaatggaatgaaggaatgacaacttatgttcatttcttagctactgcatgaaaaaattgggagcgattcccttcaggtattccagggtggccttgccatcttgcatgggtgtgtttcactgccaactaagtctccttgctcccagtcactttgaaaaccacatgcgaactgctcacaccactggagcaaaagagcaaaaggcagagtccaaagacttcatttgggaaggccccccaggaggggtgagaaggaagacctttgcaataggataaatatccgcattccccagttcccctctctgggtctgtaaggcttggatctctgttcattttttctaggtccatggaaagaaattattccttagatttgatctagatgaagaaatggggccccctggcagcagcccaacaccagagcctccacaaaaagaagtgcagaaggaaggggctgcggacccaaagcaggtcggggagcccagcgggcagaagacccttgatggatcctcacggtctgcagagctcgtcccccagggcgaggatgattctgagtatttggagagagacgcccctgcaggagatgctgggaggtggctgcgtgtcagctttggtttgtttggcagcgtttgggtgaacgatttctccagagccaagaaagccaacaagaggggggactggagggacccttccccgaggtaatggtgtggccatctgattttcgtgggctctgatagtcatagggccctgcttggtggggtttgggacttcagcagtggggacatactgaggacgtccagtctgccccccagggccctgctgtcttggggagagaggccacctctgtatctacctgtgataggaagtagactgtggtctgcatgcaggagagggttgtgcaccaagaggtggctgggagaaggggagaattttcccagcaaatgtggcacttgaggggggactgtccctgaagaacattttattgcctgactcctgactagtgtgctttgaatttagggagaagattttcccagttttattttaagtatattgtttgtgtgtttattttttattgagatataattaacattcagtagaatgcagatcttaagtattcagcttgatgagtttttttgctttgttttgagacggagtcttgctctgttggcccaggctggagtgcagtggcacgatctcgcctcactgcaacctctgcctcccaggttcaaccaattctcctgccttagcctcggaggagctgggactacaggtgcgtgccaccacaccggctaacttttgtatttttaatagagacggggtttcaccatgttggacaggctggctggtctggaactcctggcctcaagcgatcgcctacctccgcctcccaaagtgctgggattacaggcgtgagccaccatgcttggccccagtttttataatctatgaatgttgagatcaacattttatgcataagactctatctaggtttaggatatgtcctcagtgtcaattcccagaggagtaattgctggtcagagggaatgcatattcttagggctgtacatttttctggccttaggaaagtgctagctgagctgaaatctcatgaatgttaggtcgtttgtgtacttcttatcaatgtaatgaagcttttgcacagaaagtctgtttgtttttgtgacatgtgttgccagtattgtttcaagtctgtcctctgtcctttgattgtgcttatgatgtctcttggcatttgggattttaaatttttatatcatcaacggtgggtatttttcttggttgcttgtaggtttccccttttgctaaaaaaaggccccttctgcccccagagaaagtcacatgccttctattttctgaagttttataacttgtaaaaatgtttagaagtgtagtctttatttgtgtggcctgacgtaggtaccataggatgctatgggctgtaaaaataactcggagtagcttctgtggtctggagattttgggctcacatgactggaagttcagaaggagggtgggctttggggctgccgttccaaggttctggcttcctgtttttgtgattctcctggctttgcactttccacgcattggttttctccttagaccagcagcaagaggctactgcagctccaggattttattcacaccaaaaaatccagaagaagagcagatcatttttagaagttcagatgaggaaactttccttagaacccccagcaaacctgtcatcatcaggagcctgccctttgctgagtcctggattagtcaccagctggaggcattgaaatgtgctccccgaaggaggctcacccctaggttttcagatatagtgccgtagagtgaatgtgtatcatgccattatttttaaatctctttttacctggttaggtctcttttctcatgtacctgttttatgtttactttgctttgtctcttttttctttaataggctggcctgagtttatctactttgttggtctttgaaataaatactattagcttgccaggtataatactgactcctgtctgtaatcccagcactttgggaggctgagacaggaggatcacttgagcccaggagtaagagactagcctgggcaacatagtgaagaccctgtttgtacaaaaaaataaaataaaattaaccgggtgtgggggtgcatacctgtagtcccagttacttgggaggctgaagtgggagggtagtttgagccagggaggttgagactgcagtgagctgtgattgtgccactatactccagcctgggcaacagagcaagaccctatttccaaataaataaataaataaaattagctttatatatcctttctatatggaaagggtatatggagtattgaaaatattaggttgggtgtggtggctcacacctgtaatcccagcactttacgaggccgaggcaggtggatcacctgacgtcaggagttcgagaccagcctggccaacatgatgaaacccccatctctactaaaagtacaaaaagttagccaggtgtggtggtatgcacctgtaatcccagctactcgggaggctgaggcaggagaatcgcttgaacctgggaggaagagattgcagtgagccaagatagtgccactgcactcccgcttgggtgacaagaatgaaactccatctcaaaaaaaacacattataagtcaaaaaagcatttaatatgcctagcctaccaaacatctgggcttagcctaacctaccttatatgtgctcagaacaattacattagcctacagttgggcaaaatcatctaacacaaagcttgttctataaaatgttgaatatctcacgtaatttattgaatgctgtactgaaaatgaaggttttataggtactcaaagtatggcttttactgagtgtgcattgattttgtaccattataaaatcaaaaattaaaagtgaaccattgtaagtcagggatgtctgtatgtgtgtatgatccagccacagagtgtgctctgactacgttgtggtaacgatgtggggatgtgtgtatgtgtgtatgatccagccacagagtgtgcttggactatattgtaacgatgtggggatgtgtgtatgtgtgtatgatccagccacagagtgtgctctatgttgtggtaacgatgtggggatgtgtgtatgtgtgtatgatccagccacagagtgtcctctgactatgttgtggtaatgatgtggggatgtgtgtatgtgtgcatgatccagccacagagtgtgctctgactatactgtggtaacgatgtggggatgtctgtatgtgtgtatgatccagccacagagtgtgctctatgttgtggtaacgatgtggggatgtgtgtatgtgtgtatgacccagccacagggtgtgctctgactatactgtggtaacgatgtgtacatatgacctgttctttcttcccaggttggtcctgcactttggtggtggtggcttcctggcattttataattgtcagttgtcttggagctcttccccagtggtcacacccacctgtgacatcctgtctgagaagttccatcgaggacaagccttagaagctctaggccaggctcagcctgtctgctatacactgctggaccagagatacttctcagggctaggtatgactcatgggaaaggggtgagtccacagagttgcttcatggaaaagtcggtcctgtgggagtcagaagacctgagggccaccctagttgtgccagtgctgttggttttgaggtgccacttgctcaatctcctttcttttacttcccttgtttttagactgagggcattagatcaggcagtttttaacttgtctctctgcttcagaatccacaccctaactgtgttatcagttgtgagccctctgccagcagcgttggagcatcacctcctaaagggtggggtcatgtctccggcacctctgtaccctccactgcacagtgcagcgcctgcacgtaggaggtgcctgacctgtgtctgtaggaactgaagtcgtgcaggctgctaacagagcagtgagcgcgtgttctaagggatgctgctcttgggtggatggagcttcctgccctggccagggcacagagatgactcagtctacactgggttcttatgcgacgcgagtgaagaagctgtttccctctctctattgcagtggcgtgagcagtgaaactgtgagcatttcaggatagggagaagtgctgaacaatttcaaaaatacatataacagctaattagcgggactatgacagcgtggcgttcttattactcacagtaggggaataattgtgcccaaaattggttgctgaagcaatcaggcaggttggtggtgacagagtcatctccatatccaacatgtggccttgctgcctgctcaccacccttcacgagggtcggaggaggccaggtggtacagcaggcacttgccttgcattttcatgttaggaccatgggagtccctgtgcactcaggagcgaagagccgtcggaagtggctttttgggtatatatggcaagagctaacagtaacagtagtaattaataacggccagtgttttccaagcagctctgatgtgccaggcacatgttcttgtccttactgctgtcctgtaggatggttatagtgcttttcccttccttcagatgaggaaactgaagcagagaacacatcgctagtaaatggtgcagctgagatgtgaatccaggtgttttgtcaatgaattctggagagactgatgtgtgtaatgaggagtgtgactatgaggctcttggaaacagcaggaatttccttcacccactcactccaaacacacagacactcacttgagctctgtcacgctcaccacctctccttaaggagatcattgtataatggcccagcaagcatggactcagtccactgtgggttactaaagattgcaatgaatgcctggtggagctgaaagagtatggttggaacattcccaagagagttactgattctggaaggagggatcgaggctggcttcacagagaatgaggcaggagtagaaaaataataagataacagctcccgaaacactttctacataacaagcattatgcttggtatttcatttattttattttttgacacagggtctctctctgtcacccaggccagagtgcagtggcacaatcacaacccactgcagcctcaacctctgtggctcaagcgatcctcccaccttagcctcctgagtaggtgagactacaggtgcatgacatcacgcctcactaatttttaaaatttttgtagagacaagaagctctcactgtgttgcccaggctggtcttgaacttgtgggcttaaatgatcctcctgcctctgcctcccaaagtgctgggattacaggcgtgtgccactgtgcctagctatgcttgacattttgtttttaatttaaaaaaaaattttttttgagacagggtcttgccatgttgcccaggctggagtgcagtggcacaatctcagattactgcaagccccacctcccaggtttaagctagtctcctacctcagccacctgagtagctgcgattacaggcaggtgccaccatgcctggctaatttttgtatttttggtagagatggggtttcaccatgttgtccaggctgatcttgaactcctggcctcaagtgattcacccgcctctgcctcctaaagtgctgggattacaggaatgcgccaggccaacattttaaataataacaacagttaatacttattgagtactctacataccagccactgtgctcagcgtcttttggtgaattctcatttaatgctcacaaaaaccaggtaagccatccctgccttacagataaggaaactgcagctaattgaggctgaggagcttgtcagggtcacgtgggtaggatctgcttgagctgcgattcaagtgcaggcagtcagatgcccgatccgtttttgatagcctgtttgccatgacgggccatgcatgagtttcatttcatcttcacagcaaccttaaaggtaggaattgtcaactccattttacagacagagaaatggagtcagagatcgcagacccgtctagggtcccccaggacatggaagagctgatttctgccttgttaactttgtgggtggtttcatcatgccatgtgtcctttgtccttcccttaccttcccccgctttatttcagggaacatcattaagaatgaagccttgtacagagctgggatccatcccctttctctcggttcagtcctgagtgcctcgcgtcgggaggtcctggtggatcacgtggtggagttcagtacagcctggctgcagggcaagttccaaggcagaccgcagcacacacaggtctaccagaaagaacagtgccctgctggccaccaggtcatgaaggaggcgtttgggcccgaagatgggttacagaggctcacctggtggtgcccgcagtgccagccccagttgtcagaggagccagagcagtgccagttctcctaaggagctggtggtgctcctcacggaaccttgccgcttggggaacctgacgtctaagtgtccagaaaggaggatgtgggcagggacggggtacagaggatagtgtgggtcagaggtgccagtagtataatattcgtctccctggagttatgttgaaggcagagttttcatagggttagattttttttatccttttctagttcagttaattcatcctgttgaattgcaccatcgtgaaagatgggaaaaatcgtgatgatgggtaaggggaaaacttcccggaaggcaatggggcaaggaaaaagaaagcctatgggaaatggctgtgctcccaacatagctttgcagatgatgtgggttttttttttttttttggttgtttgttttgagagagagtcttgctctgtctccctggctagggtgtggtggtgtgatcttggctcacggcagccttgccctccctggctcaagcagtcttcatctcagcctccagagtagctgggactacaggcatgtgatatgatgctcggctgatttttgtttactttttagagagatggggtcttgccatatttgccaggctggtttgaactcctacaactcaagcattcctcccaccttggtctcccaaaatgttgggaccacgggtgtgagccaccgcgcccagctagctcctgtgttttgtttttgttttgtaactttggttgatgttaaggccctccattttggaaagcaggaaaacaggatttttttttttttatcttgttccctggaggatccagggatgaggatagagtggcctgagagcagtgcttggattcagcctcctgctgggtccttctgctggatacaggcaccaagaggcggtcgtggagcagggagctgcgccttcctggggtgcccggtggtgtgtagagaaaagctgcttgtttactccttaagtcaatgtattggtgactgttgatttgttgaacaattcaggaatcaagggctgtggagaaactccctcatgttgttggcaacaggtgaatgaacctagagcggtgacatgaaaataaagctcactgttactcgct

SEQ ID NO: 43 - DNA, 53102 bp, Homo Sapiens
gacgcgcgcgagatttgaatttcctctgcgtgcggtcagtgcccgcgcagcgttgagttgcacagcggtattctcaccaggccctgcaatcggtgggccacagtgccggccacagagatggtggaaggaccaggctgtactctgaatggagagaagattcgcgcgcgggtgctcccgggccaggcggtgaccggcgtgcggggaagcgctctgcggagtctgcagggccgcgccttgcggctcgcagcctccacggttgtggtctccccgcaggtgagctactcctgtaacaggccatgcagtcagcaggggggaaatggaataaagaccccatcagggttccaggatttaaagtgtcatctctttgctctggcccaggtttcctggggtcccacctttcacagagtttatcgtcactttactgtagggagaagtcggtcctagcgcgcctgcgcaggagaggagggctagcgttctgggctcacgctgccggagcaagatgccctaggggaatccagtgaaggtgttttatccgagtcaccttacttaacttctttatgatacacacatggtttcccatgtctacagctgcattttttactattgatattatcaaatctctgctacctctgatatgttttcttcgtcccattttaagcttttagcataaaattctactttcttgcttggctaatctgcaattggtaagtatatcacaactagtatataattctaaaactacacgtagaaaatttagcactaacttctcactcaacttcatattgccatctaattaaggggcaatgaaacccagttctggttcccttaagtgaatttatttctttttaaagtaaactagcacagcttcttgccactcaggcattcattgcagacgatgtggtattcatttggccagaacttgtactaaaaatattctgattaaggcatcatgttttaaaagccctctagatgtatggatgattgtatttcatgcctacatgcaatattgcactgtatttcaatttcttctgcaaagcttcttatagcctttggtcctggaagaaaaagttgcctgctatgaaattagcatatgcttacaacttgaaagaaatgaggttctaagtctaagaaaatatattttcaaacttgggaaaaaataagttttacatctccttccaattgcccttttgtttattttgacttgatatgccagtaagtactctgtacctatttttttttattattgttatagtgtttctaaaatcgtttcagggtaccacagagatggattttagatggtttcttaagaatattaatatttatgaaaattactcattcaataaaattttgaatactcaagacacctggggagcaaaaacaaatacttcctcttttggagcctatacttcagttgggaagacacaaagacattcattaaataatcacctaaagaaatataaattaataagttctgtgaaggagagatacacgattctttaaggacttgtaggaagacctgggaaggcttccccagggaagtagcaaagctgaggtgtgggccgggtgcagtggctcatgcctgtaatcccagcactttgggatgctgaggtgggcagatcgcctgaggttgggagttcaacaccagcctgaccaatatggagaaattccatccctacaaaaataaaaaattagtcaggcatgctggtgcatgcctgtaatcccagctactcaggaggctgaggcaggagaatcgcttgaatccaggaggtggaggttgcagtgagctgaggtcgcgttattgcaccccagcctgggcaacaagagcgaaactctgtctcaaaaaaaaaaaaaaaaaaaaagctgaggtgtgcagggtgagtagaagccatgcagctcagggattggaacaggaaaaagactgaaagaaagccagagtagacactgccctctcatttaggagtcgactgcagaaatccaggtgacaaatttggggtcaagtgctggtggtggagatgaagacaagagaatcactatgatgggagggctaagcaatggatatgacatgaatatacttagggatatcatcatttacatcattcaaccacaacgtattttgtgttaggttttatgctagctcctgcggatacgaagatgagtaggatatgctttctgctgtgagagtccaacctaatgttttaaataaatatcacctcattggtatttaggaaaaatagcttaaacatttccttttaagttttgttgtgattatctctgatggtatggcatgagatgcttttacatttcattcagtcatgaaaaaggataaccctatgataaaggattaacctgattctacagatgaggcatatgaggctcagagtgactttaagtaaatttgcccaagatcacatgtctagtaaggggctaaaccagggtttgatttttctttaaaactccaaagcctaccctcttaaccatgccatagctcctctcagccataaaagattcagtaggatctttattgcttttttagcatacaacggtaagaacaccataatgctcagtatatagtagtggttatttattaaatagaaaagtgcaatcttggatttttggctgtgtctaccaccatttttagttttgttcggttgagtcaattctcttatatctattctgataattctcttctaacagcttctatggccatgtttggattgcacaaaagagtgcagcctgataatataatacaaatgcgtcagtaatggttaggcaattattaacatcacttggcagcaatattcaataagttataccccacacataaaaagcctggcatttaaaggtattatttttgataccttgatagaaagaggcattaaaaattggaataggtctttgtggttagtatcaggaatctggttctatggacactggattttaaaatcaatatggaaggaatacattctttgaggctgttggtaaatttctaaataatttactatggcttcattttctgggactttgatctgaaaaaaaaaacataattataaccttttgtaaacatgaagagtcttttgcattttagagggatccatagtaaatttcattaaaacatggtaggttgtcacaaacctctggcaagatcattactgtagcagatgatcccatgtctcctaggcatttatgccaaagagttaaagctatttaaatgtttctgctactggcttgaaatgattagttttcacaaggcagcatttaaaaataatttaataactgcatactgcattctttacagtgcagtaaacatggaaaaagttactaatgagagctaaagaaatatttaatgggcattcaaaataaaatatttaaacctcagataatcataccaaaaaacaaaccaaaaaacactacttcagtagttattgccataatggactgttactgtgtcatatagcattcctctttgttacagtataaagtttatagagaacacacttgaatgcatgtctgcctgtgacaactgatcctcattttgagaaaacctagccatagaagatcccagcatctgctagtcatggatgtactatattatttttctgagtcgtgatccactgtcttgtcagcataaaattgtgcaacagtataagcaaattgcataaaactctgctggagattgtggaaacttatggtaagaaacaatattggaatataaatgaacatatctggttaatgagctttgaagagtcaatcctttgattttaattgttgggtggatacaatattttagtgaaatcatatttaatctgcatgtgttttcaatctcacaaaacaggatatgaaacagtttataagcattcattttatttgaaacatggtctgattatttccatcactccttaaaatttgatacatgtatttaatatgccagctatttatcgttatatatgcttcacagtgtcaggaactgaggagacatttaataaaagttgaatggatggagaagaacaaggttttgaatagtgcaaagtgattaaagatttagaaataaattccatttggactctttcattatgagaatgtgtatattttgttgtgcatgttatatggaaattcctactaccagaatataaaccaggtagtaaattttccttcttcaaagtgggggaaaaaaatcgtggctcattttattgccattatttaaagaaatgagctaatctacagagattcattttccagcaaaatgaggctcatttctttaagcatctgaaggggatttctaaataatttagagaacatgcattatatacttccttaccttcttaaatggatactaataatgatttatccttaatgactcaagatcatcattattggtatccagaatcctatggaatcatgaaacaagggataacaaagaacagaaacattcttacaaaggaggaaaaaggggaggtgattttccatggccattgtagctttttatccaagatgaacatattcggcatgctgcagagaagagagcatctgatcatcttgattttgaattcccatttttttgttacttcctcgtctggagatgcttattgttgcatcttagcttatttggtcaggattaaattaagcagcatgtaaaattcttagcttagtacctagcaaaataaacatcctgggaattgttcctttttcttctggatcagagctttctcaccagacccatttatctgaggaacaccctatttttatgaagggtttgtaatcatttggtgccttcagataaggtacaaagtctttagtctgagtaagtgcttgaaggtcctgcacttagaaaattgtagaatatgtttttgatgaatgggcctgaggacctctattttgttgtttagaaatcactttaaaattatattctttgatgacttcgattggtatttaagagatctctgattaaaaagtgttgttgtaggccgggcgcggtggctcacacctgtaattccagcactttgggaggctgaggcgggcagatcacgaggtcaggagattgagaccattctggctaacacagtgaaaccccgtatctactaaaaatacaaaaaattagcttggtggacgcctgtagtcccagctactcgggaggctgaggcaggagaatggcgtgaacccaggaggtggagcttgcagtgagccgagatcgcgccactgcactcgagcctgggcaacagagcgagactccgtctcaaaaaaaaaaaaaaaaaaaaatgtgttgttgtactggggggaaaagtgtgtgaggaaaagaggagagagtatgaaagtaaatatggtattttcttctctatagggaaaatacttaactgcactagggttgaaacatttatctatggaaaagtcttattctgctctaaaaagtttgtctttcttgtccatccatggataggcaggataaatggtaatcagcacaataaatcatgtgctgtctctgaaaatacatgttgttttgaagatttcatattattaagccacttgaaaatgggaaggtgaacccttctcaatcatacctaaacttgtgtcaaaggagattttcgtctttatttcagaaaaaactaaaaaggatgaaatgttcaaataatacagtaatggattataagggtcaacatgggaaagtcaagtgtatattggacaattacgtatagtcatagcaaagataacaggcttatggaaattagtttttgaatttgggcagcaaaagcttgtagagagcagtgataaccctagattctatggtaggacaagtgaatatcttataaatcttaggtttattgcaaaaaccttgcccagtttgtacacaatagctcttaaaacaagtagaacaaaccattaccagtataccagaattttaccttaagatggatttttaaaagaacagtgaaagatatatccaggtgcttgcaatggccaattgtaagttgaaaattttattttatcccaagtatattatccagagctgattattttagaaatgatagagtaccaggaatccgctgacttgggtaaaccatctgcatgatagacaactgaataaaaaaatcttgatgtgtcatttcaaaaccaaaattaagcacagtagtaccacctgtccacagaaggtgcatttaaagacacccagcgaatgccagaaaccatgcatagtatcgaaccctatatatgctatcttttttcctatacatacaacctatgttagtttaatttataaattaggtacagtaggagattaatagcaataactaataatagaacagttatgacatactgtaataaaagttaatgtggtatctctctctctcaaaatatcttatggtactgtaccgtgagtaactgaaactacagaaagtgaaaccttggataggggagaactactgtattggattagatctttttagagcaacaatttaaatgctaagtaaacttgtcaaataaaaaccaggcattctaggactggttgctaaacacagaggaactcctccctaaaccttcccatatggttcatttaattttatgggaaattctggtaagtagagtattttacttccattatagcttctagtagtcatgaggatttggtcctcctatgtttaaatctcactccattgcaggtaattagaaaataagatattgggatgttaatgaattttaaaaggagattaagtagatggtagagtagaagattttgccaagatatcttgggaagagtcaagcaggatggggatggtgggaggggaagaagtgaatgtatattttaaagccacacttggttttcagagctaaaggaggaggcatctatttaatcccacaaatgtgcactgaacctcaggcattgtgtaaagccatcaaggatattagctaaacttgttactgtccccagagagcttatagacaggggagaaatgcaagtcacagacaagtaataattcagtatagtaagtactatgacagtggtttagaaaatactatgcgaaatttggcaggtagaaagcctcaagattatcctactgtccaggtggggaaaccctaggcccagagagaattacagactatatatgtgagcaaggaagaggttttactaacattgcattttaatacccaaataccatcgggtattaaaaaaggaattcttaaacatattcaagccaaggtcatatagcatctgtacctagaagagtttctgctgcactgaagtcatttgatatttttaggttaatgtttttctataagttaatatctaccttgaattccttcacttgctcttctgtcaacatgtatgttacaatattaacattcatcaggcgataaacatcttttttcaacattggtaatttcagagttttcattttttaaagatcatattgtatgttgtttttaattgcagagaatagggtgaaacaccagtagagcaaataagacgtgtattacacctttaagactttagttggaggttctctttgaagctctgtcagctaggacaacatatttcaatttccattgacagccatgtgaagatatataatggtctcatgcattttaagtatattgggggctttgtatttttgactccttttcctttcacaacagagtttatttacaagggaacgtattaccttttttcttgttaataagtggcgcagtaaacataaggtttgaagaactagccaccaaaactttgttttgctaaatggccacatcattttccacggttagaactttcttttcttttttttttttttttttttttttgagatggagtcttgctctgtcacccaggctgcagtgctgttgagagatcagctcactgcagcctccacctcctgggttcaagcgattctcctgcctcagcctcccaaatagctgggattacaggcatgcaccactagacctggttaatttttgtgtttttagtagagttttcatcatgttggtcagtctggtctcaaactcctgacctcaggtgatccgcctgcctcggcctcccaaagtgctggaattacaggcaccgtgcctggccaccatggttagaacttgctaaaatctctgatagatgacagtaggtttgcagatatagatgtctgctccaggataacctttgatgccttgaggcataaatcctggaaataataaaaacttctttcaaaaaaacctatccctcagcattggttatgagggacgtttcagccgttcttttcataaactgtacatggaactatattccccacagtgtaggttctatagaatcttgaggcaggatcttataggctcatttaccacataggaattccctgggggaaaatctctggtagaaatcaggatggctagttttgagtctcttcctaatgaatattattaggagtcctaagcattttaatattggggtaaaaagaagttgaggtttccattaagaacccttacttttgtcagttttttcctgtttgttttttcaattgatctcacctgaaatgtatgtcatatggtggtttgaggttaaatgatacaaaaaattttacacattatttctgtaagtattttggtttgccagttacaacaaaactcaatggggcagtgctgctgaattagatttgggcgttttgataatggggcagttgtcttcatggagtagaaaacttccccaggaaattggcaaagttttcagaactgatagagtaaaatcagaaaatctatctactactcttcctcttgttctctgggccatggcatacaagggcctttgctctgtcattccttttgcctggatcatggctcacttatttaaaacttgcccaaatttcaattccttgatgaaattatgactgctcctttaaaattgcaacccgttgcaccctcccccaatcttgctctctccttttcatctccatttcttttccgaatgttctaacatactgtgttattgtgtttattgcctactctttttctactctttttccttactagaacataaactccacgagggcagctggttttagttgttttatttatggatgcatcccaagcatctagaacaaggcctgacacatagtggaaggtcagtaaacttttctaaaatgagtttatccaggtaaacagccatttttaatggggaggaggatcatctttccagatgtcacgtgccacttttgttgtagacaaagccaggtgaataacatgaactgttacaggtgttggcttttggagtttttaactaaatggtgtaagttcttgtcaaagctgttaacttggtgatgtgagcagacttcacatgagacatttgggactcgtgtactgtcttattaggtgttgtgacagcactgtctatttcaaggttacttctctgtctctttgctagtagccattataaaacctggtaaagtcagaactaagcagaagaaagaaggtccaggtagggagaagacaagtagtgagtgcaggccagtcagatggtttcccatcttggaagaagggaagagagccagtcaggtgcactgagaagcagtgatatggtagctgacataggatttcataattggccaatcggacattagatagatgttgagtttcagctttaactttttttaatttcttatttttaattacagtaggcttttgggggaacaagtggtgtttggttacaaggataagttctttagtggtgatttctgagattttggtgcccccatcacctgggcaatgcacactatacccaatgtgtagtcttttatccctcacgcccctctgtccctccccgcaagtccccaaagtgtaatgtgtcattcttatgcctttacatcagatgtaacttataaaacctaaaggggtaaaggagattaaagcacaggagtggcagtagtagcaaattctttcctaccgaagaagcagggaacgctactatatatgagagagagagaagggtgtgtgtgtgtgtaaaatgggataatattcatcacctggcctctgctgggagctctaagaaaagctagaaaatttcacagggtatggctaaaacaagttgctagtaaagaatgttggaaaaagataagagattgttgacattggagtggtggggaaacaaggctctcaccattgacttataaatgtgggtttaaaatgttagtaagaacttaaatctgagatcctgaaaatgtacaacctaatctatattgagacaaagatctatatctgctttgtatatcatcatcttaaaagtgtcctggcaagtttataggaactttttacatactaattggttgtcatggaaacctaccttaaaacccactattgtaatctatacttggcctgaagtgtatttaagtgacttaaagtctcctgttaaggagaaaagcatcaagattcttggtgtttgtcaattcagggctctaaaagattgacttatataaaaagaaggcaaatgtgttttttcctcactgagtactcaagcctgccttcccagtgcttgataattattgataggtactagagttcatcccagaaagggcaaccaaagactgagctttgaggacatggtggcatatacctacagtctccaacaggttctttttttgtgatttgtgcagaacaggaagtgactgctgtctttttttttttttttttttttttttttttgaaacggagtctcgctgtgtctcccaggctggtgtgcagtggcgtgatctcggctcactgcaagctccacctccagggttcacgccattctcctgactcagcctcccgagtagctggggctacaggcgcccgccaccatgcccggctaattttttttgtatttttagtagagacagggtttcacggtggtctcgatctcctgacctcgtgatccgcccgcctcgacctcccaaagtgctgagattacaggcgtgagccaccgcgccgggcctgctgtcatttttaattactcctgtgcatttaatttatctgtcattctaagccagtgattgattctccagttcttaaacaaaggagggatatataaagccagtcgcctgaacttcaggcagttggaaaattctggcattgactgtagctatttcaaccttgaatgggtttagtggaagaatagtgtctgtctcttttttttttttttctttatctccctgttatctctctttgagctaagtactgtgattgtatcttaacaaagaccaatttagtgaaataaagaatagagtggacatgtcatcttaagcatttagaatgacaaatgtctgtaaaatcaaaagtttgagaatcactgaacaatatcatttcactctaaattgaggaaaaattgtgacttgtttctagactctgtatctaaagctgttttataattatatcttgacatttccccactcccactgcccaccaaggtttcgttcagaatcttctgaggatccttaggcccatttgagaaaaacacaaaagaagttagaggtaaatgaggatattaccttagactgagttaatgcgtagatgtaattctgtgtaccctattttatcttatataataattacgcatgtcttaagttttacatttttattacattttgagtttaaattaaataatgtttataaaacatatataaataataaaaaataatgacataagaaacaccagtatacataatgctcagtttaagaaaaagggcattactaaaatctaaaccaaacgccctttcttttcttctcccacagaagaacctacattttatatttttgttttctgtttaattcatgtttataatttcctcgaatatcttataggattctgcctatatgttgtcattctaacaatatattgtttggttttgcaaggctgatgggggaaagggaatatgagtttattttttctttattcttaacattgtgcttggaataggacaggtctcaaattagattcccctactcagggggccgcaggtttttatctctgatctcctgcaccctcacaagatgtgaaaattgaagctctcattccttagtttcatgtgaaaattgaagctctcattccttagtttcaatcaatgcccttaggatagatgctggcttcacagctctccctactacctctcagggttctctcccgcttttagtttttgaccttttattatttcatactagcttaaaagttcatcggtgaagttaaaaatattttgttttcatattttatcatctgtcatttgtagctgtttttatctgaccactctttcagggaacttggctatatacttctggaaatggaagaacctatattccagtttttagttttagaacattcgtgttgtattcctatgctttcttttcatatgcacagagctatatggtcctggaagaaactttattttgcttgtctaccaattactttttttcacttaatttttttggcctctctctctttaaatgactgcatagtgatttgacaaaatgtatgtaaacagccgattacattacatgacttgttggagattattcttctcattggaatgcacctgggcgtgaagtaatataaacacatttaagaattaaataatgcttttgcttagagtttgtgtgtgtgtgtgcttatgtgtgtacatgtattttccactaggctgctgcactgaataatgattccagccagaatgtcttgagcctgtttaatggatatgtttacagtggcgtggaaactttggggaaggagctctttatgtactttggaccaaaagctttacggtaagataagcctgtacgatacatcttatctctctatatttaaagatgcgtagaaggctagatggagtttgccgggtgtcacatttaatcatataggaagtactgtgtttttaagagagctccaatatgagaggttgtgattctatcatggaaatcaataaacagcagaagaataaattctgatgtcatcatcacttggaagacagtcattttacagggcttcccaagatgtattagagcaacacatctgttttgctagtccccaagcttcctataccacaagtctctccttgtttttaccgaatgcttattgtattcagtgacatcggttactttatatttgtgacaggccctagtttggtttaaatgtatcacttgatctttaaatatttttctggcttcctgctttctctgaagccttgaatggaatttggaaatttacttagagagtgtaaaaactttccagagaaataacaggttctccattgtttcacagttcccatggaaattcatggctaatatactggcagagaaggactagcaacctatttcctttgttgacttaatgataaaaaagtcaaaatatatgtaattgtgatgcatgatcacatgtttaatttttgcaggaaaatgaaagcggcctttgagttaatatgtctacccaatctcattctgtcttttctgagtttagcctaagcttttgccaactgtaaaaattgatactgcttcctcaaatcgtttttagtgctgtttaaagatactgaccacagttatcacctttttcttaaaagaaaagacctgttcctggaccccatgctaaccaaaggtgaataattgtcacaaagagatgatactatatgattgttctttattgcatctcatctaccacatatttagagtaatccagggtttatgtaattgcttttcctttgaggtgttctcttttcattgtcagcagctgctgtccttggacaacattgtcacttcatggttttgcttagtctggaattgataacatcagcatatgcctagttgttcatgcagtaatgatatattgcaggttacactgctgctgtagtagactgatgtgatggaaaactcatagctctggatagagtagtacacaatgggatctatgcacgatagttgaaaacattgatatgttattgattctctggtgttaggtacagatttatttctgtaagatgagagggggtttttatcaagtgctctccaccagactgataagggggaagtcatttctcagcacacggctgtcagtaagtgttccatgaagttctaaacaaggacaatcacttcttcaaactcattgaactagtgccctccctggagagtacctatgtcagtatatgggtgggaaaaatgcagtggcttgcttcctttcagtttcctgcagccataacaactattggatgtaacaattcaaggtcaatggcagatctgctgttggaatctgaacctaaaatcatttgcccctcttttcacaatgtaacagaagttcaaaaaatgtacttccaacctgtgcttcttagaggaatggataactctctcaaagaaatgtgatctttttgtgaggctgcaggtctgtgcacctgcaatagaaatgtagtcttcatttttgacttctgcctcccacccacctggctcatctgcatttgatagagcatatagcaggaaacactttcaaaggttgctcacagttttcccttgatacccaacttttcacaagcaaaattgcccgcagagtttagtcataaagtgtgtgcatctcataggttgggccatgaatctcctgggattcattggttgaatctcctgggattcatttgttaatgaaagtagaatacgagcatagcctctaaaagaatctgccctgtaaaaatccacacatcagaaagatacaaattagagagtgattacttctctacctactaagtgatatattcaagtgctcctgatagtgccaaggaatactaaaaattatttgatacacatttattttaggagcactattgtgttatgtgtgattaatacctgtacaacttctgaacactttccactaactcttcaactaaaacaacacaaacgtcacttgaagtttttgctacaaatgtaacaagtactcagtagagaaaactgaaaaataatgaaaataagtgtaaagtaatacattctcaatcccactaccaggtgtaatctttattaactttggatgcatacaatgccacattgccagtatagtgtgtgcgaatgtttatatgcatgttcacccagctgcactcacactgaagctatcattttaatcaaaatggacatagctgttgcattttggactaaaatttaaaaaacagatagatagatagatagatagatagatagatagataagtaaatatatttttccaagaccattttctgtttccagtttgtgatttacatgactctggcttttgaagttatatgtgctcagagaccagaaactatatctgagatattttggaggctttgccattttagaaatgccttatacatgattgattttataatttattggggtttaagtatgaacctcaaaccagttatgcaagagataatataatgattctttttagtttgctgaaatgtctttattgaatccatcatatattacttataaaagagttttacagcttcaacatagtttctgtactatcatataacatgttaggagaaatagaagtgtacttttactctgtataatactttaagattcattcatactgtttgaagtatcagtggtactttcttttcttttactaagtagtctcccattgtatgaacataccatattttgttaattcattcatcagatgatggacatttggattgtttcaagtttttaatattgtgaataaaattgctatgaatattcacatacatatgacatatatatgtggacatacattttcatttctcttggataaattaccaaatgacttagaaattctaagtcatttggtaagcatatgtttgactttaagaggaattgccaaactgttcttaaaagtggtggtaccattttacattctcaccagcagagtatgagaatttcagttactcagcatctttgccagcacctggtattgtcagttgtgttaatttcagctattctaataggtgtacagtgtatctcactatgattttaattttcttctccctactaactaatgatatctgatgcaatatgcatatttcctgtttgtgtattttatagggtgatgtgtctattaatgttttccttttttattggatatatttttgtattattgagttatagtattctgtatatattctagatgtcagtcatttatcagataacatgttttgcaagtattttctcccaatctatggcttttctcttcattttcttaaccatatctcttcaagattaaaaacttttaagtttgatgaaacctaatttatcaaatttttttttcatggttcattcatacgttttgtgaccagtctaagaaacatctgcctaatgcaaattaatcaacatttccttgtttgttttcttctggaagttttattgagttagctcttctgtttaggattatgatctattttgagttcttttttgtatatggtacaaggcaggagctggactttgtctttttgcgtgtgtattttccagcaccattgttgacgagattatcctttctccattgaatttctttgcaactttgttgaaaattagttgaccatatatgtatgggtctatttctgaactctgcattcagaagaatatcagataaagtgatattcttttatcattttttgtgtctgtcctttcaccaataatacactgtcttaattaaagtagctttaaagtcagtttaaattaagtagtgtcagtcgtctgactttattctttttttttttcaaaattgtttttgttgttttagttatctttctacattttagacttagcttgttgatttctacagagttctttctggcattttgattggccttgtgttggatctatagatcaattaggtgataattcacatgctaacattattgtcttccactccatgaacacagtatatattaatatgtatttagatcttccttcatttctttatcagtattttgtaattttcagcttcagacatattttatatttgtaactaagtgggtttttttggagctattgtaaagggtacttttttaaaatttgaatttctaattgttcatttgcagtgtatggaaatacaatttttgtgtgtatattgaccttgtatcctgcaaccttgctgatatgatctggctctgtgttcccacccagatttcatcttgaattgtaattcccatgtgtcgaggtgtgggggggcatgtaatccccttgtgtcaagggaaagaggcgactggatcatgggggctgtttcccccatgctgttcttgtgatagtgagtgagttctcactagatctcttggttttataaggggctcttcccccttctctttctcttctctctcctgctgccatctgaagaaggtccttgcttccttttcaccttccaccatgattgtaagtttcctgagacctcccaaaccatgtggaactgcgagtcaattaagcctctttcctttataaattatccagtctcagggaagttctttacagcagtgtaaaaacagactaatacacttgctaaactcgttatagttctagtcgctttttcttgtatacttttagtattttctatgtagataatcatatcatctgtgaattaaagcagttttattttttcctttctgatctatatgacttttttaaaaaaaatttacttcaagttctaggatacatgtgcagaacatgcaggtttgttacataggtgtacatgtgccatggtggtttgctgcacctatcaacctgtcatctaggttttaagcctcgcatgcattaagtgtttgtcctaatgctctccctctccttgtcccccacaccctatatgccttttatttctttttcttgttttattgcactggccaggacccccagcatgatgttgagtagtagtggtgagagcaaataagtttgccttgttgtctgtgatattagctttattttcttttattaaatcaaaaaatttcccttttatttctaatttgttgaatttttcaagtattttttctgcatctattgagatcatcatattgcctttcttacttcatttgtttatgtgtggaattctatattgattgatttttaaattttgaatgagccttgcattcctggaatatactccactttgtcatgatggattgtcctttctatatgtttctggattcgattagttaatattttattgaggacttttgcttgtgtcttcataagagatattgcactatggtgttatttttctgttactgcctttgtctaattttggtattagggtaatgatggcctccaactgagtttcatctgatattccagaaacatttgtgtagatttgttattggtataacatcaactggtctgatgtatttggagttccagaaaggaaagagaaaaaaacaaaacagaagacatttttaaaagaagtaatggccaagaattgtgcaggattaacaaagctatggaacaaggtgacataatctaacattcttgtaactgtcatcctagaagaaagaaagaacagaacagaagacatctttggatttaaatggccaagaattttcttaacaaaccacagatccaagaagctaaaagagcctcaaaccaaaccaaatgtccctcacacgtacctagccaatgtgctaaaaaccaaagatgaagagaaagtgctggaagcagagaaaaagaaacattgcatattaatacaaaggaacaaagctaagaaatacatttacagaaattatgtaagacagaagacaacagagcaacgtttgctgaaagaaaaacctctcaactcagaattctaaacccatctaatatatctattaaaaatgaaggtataataaagactttttcgaaaaaaagaagctaagagaatgtagtagcaggagacctgcagtgcaagaaaagttaaagtctgtccagcataagggatataataacagacagaaatctgaactacagaaagaaaaaactgggaatgggaaacttggaagtaaatataaaagatgtttttctgttatgttctatatctaaagcaagcataataacaatttattgtggactttataacatatgtcagagtaaaatgcattgcaacaatagtacaaatgagataggaaaatgatggtacactaatgttgttgcaatatacgttttgcatatcatttgaagatatgcatatcatttgaagatatcactgagataacttgtatctcagtaatatacgttttgcatatcatttgaagatttgcatatcgtttgaatatatcactgagataacttgtatcacagtgtaagatgtgtattataaaacctagagcaactacttaaaaaaattcaaaaagtggtaaaagtaataagctgctatggagataaaatagaagttttaaaaatgctcaatccaaaagaatgcattaaaagatgaacaaagaacagatggaacaaatagaaaacaatagtaatacagtatatttaaatcaaagcataaaaataatcacattaaatataaataatctaaccatcccaattatttggcagaaattaattgaataaaaacacaagacccaactataatgtgcctataagaaaaccacttaaaatataatgatgcaggttaaaataaaaggatggaaacagaaatactatggaaacacttatcaaaagaaagctggagtagctagaataaaatcaaagtagatttcagatcaaggaatattactgagggtaaagaaggacattaaaaaaagattaaggggttaattcatcaagaaaatgtagtaatcctaatagaaattcaaaagatgtaaagcaagaactgctagaatggaaagggcaaagagaaactaatattgttgaataattcaacactctcttgtcagtaactgatagaacaagtgggcaaaaatcagcaaggataaaagacctgagcaacactatcaaccaccttgacctaattgacaagtagagaacattccacccaacaacacatgcttttcaagtgcatgtggaacacttagcaagattgaccagattatggacagcaaaatgagtcttaacaaatttaaaagtattgatatcatggaagaatcctctctgactacaacagaattaaactagaaattattgagatacctagaaaaatcttttttttttttctttttcaaatggagtcttgctctgtcacccagactggagtacagtggagggatctctgctcattgcagcctctacctcccgggttcaagtgattctcctgcctcagcttcttgagtagctgggattacagacgcctgctaccatgcctggctaatttttatatttttagtggagacggcgtttcaccacgttgcccaggctggtctcaaactcctgacctcaggtcatctacccgccttggcctcccaaagtgctgggattacaggcgtgagccactgcgcccagctgaaaaatttaaagtatttggaaatcaatgtgcttctaaactcacctgtcaaataaatcacaaaggaacttagaacatattttgaactgaatgaaaatgaaaacgccagatcaaaatttgtaggagacagctaaagcaatgcttgaggaaatgttctggcattaaatgttttttataaatgaataaaattctctaagatttaagcttccatataaaaaactagaagaataagagctaattaaacccaaaacagacagaaggacggaaataatgaagataagaacagaaatcaatggaatttaaaaatgaaagcaatagagaaaaaaaatcaatgaagcaaataattggtcctttgaaaagcataataaaaatgaatgacaccaaaaattggttctttgaaaaatgtaataaaaatgataaacttttagctcaatgcagtccaatataaacatgggagacatatatataatttaaaatcttccaatagctgcattaaccaaagcaaaaagaaatcaattttaataatgtattttattaacctatacaaaatatttcaacatataaacaatataagcaattattgataagctatgtaactttttttatactaagtcttcaaaatctactgtgtattttataattagagtacacattaatttgaactaataacatttccagtgctcacttgccacatgtgggtagtggctgccatattggacaatacagctcacatataaacactatgaggaatgacaaagggaacattactgcagatcctcaagttgttatttgaatagaaataggacactatatattacctaacaaatttatgtcgatgaattcaacaactaaaataaatggacagattccttgaaagacacaaattatcaaaacatactctagaactaaagtaaaaatatgagttattttctatgttttaaataagttgagttgatagtttaaaacttctcaagaaagaaaaccccaggcatatttaaggaacatgctctgttttatctttttcatccttttttctctttcttaggtttggataatttctattaatctatattcaggttcacttattctttcctctgctctgtgcggtctgctggtctgctcattgaagaaatgtcttctccctgctatcatgtattttggtttctctgctgaaatatcacacctgttcatgtgcctttatactagatccttacatatgttaaatcattaacatattaataactaatatataatataaaatttgattaagaatcaatattttaagtttaaaattaatttaacattacttttaaatcacctgtctcatagatatgacatctggtgcatctttgggtctggctctgttgactgctttatctcttgatatatttatctcttgatacttttttaatctttgtgtgtatatatgtgtcttatcatttttttgaatcctagacattgtctatagaagacaaaaagctaaatcccagacaccatgtatagacatataagagctaaataatatttaagctcagaaacagtcatgcctcttctgtcagtcattagtgtcagggattgagtgagtctagtaaagtagttgaccttcgtttgagttttgctttgtttgggttggcttcagtgcaccaacaacttcaaaactccagctgctactgctactttatgccttgtgtgtggtctggtttggcagtggatggtttctctgtgttgctgctcgactctcagctttcagcacatcttgcatattcatgtcacagagaaagtctctccatgttcttacctctccaccatgtagactgctgtcgcttgtgactcagtgggaggcttatgatggggatagtggggatatttacttctggattagcctggaacttgggcaggcctttgtgtatgtagaacccaaggtcgcagttttcttagggttgctgtcccttgccctcctatggcagccaaactctgccttgcacctgtgggtgtacttgggtcagagagcttcctacctcttttctggtggaagcagatttctctttgtatcatcacagtattttgtgccaaagccgattttctgtttcaactctagggacagatggcttttgcttctacctcaccttcaacaggccagggtacctttgcttgggctgggtggccgaagggtttccgctgctgtcctgtggcagactgcttatggttgttattcagtataagacatattgtttgggcagaggaagtttcctgttcctccctcaaggacagatatgacctttgtttctacctctcccttggccccagcagcttaaagactttttaagacttggacttcatctcaaagaagtgttcaagaagcagacagagtttcatgaagacaggtgtcatgccaccaagagcagctctttcaggtctcttgctgtcactcacatctttcacatgggcccacgagtgtgtattctccttgtgtctggggctccggggattctaaactgttacaccagcccacattcagtatgtaaaagtttgttgaaaattttgcagttttctgctttcccatttttatagtagccttctcttcctcttgtgctctgccacaggtgaaacaatttgtgtattctgactttactttccatggcggggcttgtcacattttggaatttagcttacctggttgcgttgcaatctcatgtctctgatgggcttaagaaaatgtatgattttgtagataacgtgattttttttctccttgttggagcggtagctatgttcactttcagccttctgcatcctaagtagtagcagaactcctattttttatttttagcattgttaaaaccatatctttttacattcttttttttttaattcccagcataggttttacaactattatattctacattttccactctttattacccttaggacacttctgaccacttgaaaatttttataggcagttgccttatttgcaaaatgtagttgtcattaatgtgaaactgtgacagtactgctttgtttatgctatttgtgcttgcttaaggatgttcagattattctgacagtgatagcttggagaatacggctgattcttaaaacaggatcagggcttatttactagtttctttaggaagatatttctaatgagaggaattttcttactgttaattgaatttttagtttgggcacattttcatattagaacttggttgcaagtgacagaggcccaactcaagcaggttcaataattatttattatcttttgttgactttggcaccaaaaacttctttaaaatttaaaaaagtgtatgaagtatcttacaaaacctgaagagaatacaggcaggcttcaaggagaactaaagcaagcaaagactaaaagctgttaggattcctcttcatttcttcactctgctcctcactgaaatcttctatagtcttcctctttgcagggagaccttcctttgctttgctggtgctcacatcgggaatcattcccatagacagctctcatatgagatctcttaatgctagcaggatctccttgggtcctacgtctttaaattcatcagaaaaattgacgaacccagcttggatactgatggatctagcttgggacaggtgtccatttctgaatcaactgtatcaaaggcacaggatctgagaaaacgacagagacctgttcaggttaagcctgaacaggttaatgcccacccttggaccaggcaactgtggttggcaggtagacttctattatgcagagtgaattgtcttgggtaaccttttgggttggtagaaggagcttgagatagaaataaggatctgataaaagtttcctaaactaattaattatgaggaatcctgaaaagcaaatgaaaccctaaaaatgtcttttctttatgtaatatgggcctatgtcctggtttaaaaaaaaaaaaaatcagtatcaattgttgtcgcagtatagatgtttactgtgcctcaaatattttcatgatactgatacattttttatagtttaagatcaaaggtacttagtaataaacccacgagatgtgttggtttattggggctcaattataatatctatttaataaaacaaaataaataaaaatttaaaaaaacattttatgcacttttttcctaaaaatgaattgatttataagtcagagccatacttatttgatctaaggttcttgctggggctactcctgcatttgaattgggtcttaacctttgagattttttatgtggatgtggtttcattatagaaagtgatttagaatccactttatgagccatgcagctgaaaagattttagatatgatggcttctgggcatgacagttgtacacctttcactggggttgaacttccataagttaaattatggagtacttacaggcacacatttttcctgtcaagaactatggggcatgtaaaatgcatttatgattgatagtagggcacacagagtttaaaacccacatttttaaagttagactggttaaccttgtacaatactataacatggtgctccgcaattagaagcacagagcagtagcattcgctgccaaaagagccatatttatgaactcaacaaagctatgaggagaaggatttgaaaggcggatcacagtatttcatcttgagaatcatttttgatcttcatcatcagaggtcttacagaactactttttttaaaaactggacatgctaatcaatcctataaaatctgaaaggttacgaatttttcatcgctgccttgtggctttcaagttaaccgtaaatatttataaatctcctcttcccaatacatatagaggtaaaagaaaacgaaaagaattgaggacaatagcattttgacttgttctctctttttttttgatacgtaagattttgcaaaaataaaaaaaattgtttcattgcctagtgcaaaacaaggggggaaaagagcatcttaaaccatagatattattttgcaataggtaattatttccaatccattgtggttagaaataaggaatttgaatattagtggctttgtagaatttatgaaaacacaaactataggcaacttaaacttagccttatctcatcccaagcctttgaatctgagaaaatgccaagagatgctagactgttccatgaataaaagatacttcatctgacaagaaaagaggagcaggggtgtatttttttgggcttattgttggtaccatattatttctttgagaagttattttacttttgagttgaaaaactgattgtcatgtcttctatctttataaggatacaaagtcatgagagaaaaatatataataatcttaccactggtttctgccctttaaaagtgtctatcctgactaacatttgtttgcttataatccaaaaaaaaaatgatagtacaggaaaaaagcttgataaatgatatactttctgccactcaaaaatggtttgattttgtttcaggattcatttcggaatgaaaggcttcatcatgattaatccacttgagtataaatataaaaatggagcttctcctgttttggaagtgcagctcaccaaagatttgatttgtttctttgactcatcagtagaactcaggtaaaaaaaattaaataaaagtacttacgctgcaatactgcagagcttggtttgggatgtcacacgtgtaactaaagaaacaaataaataaagagtttgtaattgatgaaacctcattttaaagaagccttcagataatataatttgtaaggtctttgttgtttgcatatgtaactcttataccctgattaacataaagtgcttatagcaaagctcattttaaaagacactttgtgaaattataaccagacttatgattaatgtgttttatattcctttctatagaaactcaatggaaagccaacagagaataagaatgatgaaagaattagatgtatgttcacctgaatttagtttcttgagagcagaaagtgaagttaaaaaacagaaaggccggatgctaggtgatgtgctaatggatcagaacgtattgcctggagtagggaacatcatcaaaaatgaagctctctttgacagtggtctccacccagctgttaaagtaagttttaagtatttttttaattatctgttgatttttcggtactgtgaaggaaccaacgtggaagccttaactctgcatttcagtaacacagtctcatcagacttcaggtgtcccgcttcccatttctacccaggtcaatttctcagtgcagccggctcctaccaccgcacttgcacttacagttgccttgtgcacaccctcccactccacatttcactctatcagtcttccttaacttgccctgctttttgttctctccataccaggtatccctttcaaacataacatatttacttattatactgattgtttaaaagctgtctccttctgctagaacacagtctcaaaaggaaacaaggcttttgttcactgaagtatcccaacatctagaacgtgacctgtggtgtatggtaggcattagatattaatatttgtggaatatgtgaatgaactaactcacaacttattttctctctctggcatattaagtacatgttctgcacacgcttgtgtattcctgattacagctgttggtgacattagaagctgctgttgtggaaggatagcaatggaaggcaggcagcagggaccaaggaataagtgatcagtgaggaaatgaaagcaaaatgtagagcccttgttcacataggccggagtgaagggaaaatattggcttgctagaggggattccagggcaagacatgagttggttattttattttttttcttgttctacaactgcagagacttgaacttatttatatgttgcaaaaaaaaaaaagtggttaaagggcagaggttaaaattgtagaaaagggaatggtgatgaatatagcaatgttctaagagggtaagagaggtgagaaccctaacccaggtagaatacatacattttagtttctagggaagacctctacattagggcttttatcaagacctgttgccactaactaaattaatttttagctcttttagctgaattattttttacataattgactctattaactaaattatcttttacataaacccaggttatttttttactttgtgtagatacttactagatagttttagtaatacccaaatcagtaggaatgaagctttaaaagaagccagttaatgataggtctagattagattctgctttttgatacttggaacacgtgagttcagtatggaaataatgaaacagaactttaacaagagtgagctttttaaaaatcacttagacctctacgaaagttgtttttgaaaaaaagagaacccagggtattgttgttatctgtgatgcactgagaatttactttttatctctgcatccagccatccatccatctaggaaatgatcatttacccataatgcctgggggtttaaaaattaatgacattggccaggcacggtggttcatgcctgtaatcccagcactttgggaggctgacgcgggcagatcacgaggtcaagaggtgagaccatcctggccaacgtggtgaaaccatcctggccaacatggtgaaaccctgtctctactaaaaacacaaaaatgaggtgggcgtagtggcacatgcctgtagtcccagctactggagaggctgaggcaggacaatcgcttaagcccgggaggcggaggttgcagtgagcagagatcacgccactgcactgcagtctggcaacagagcgagactctgtctctctctctcacacacacacacacacacacacacatttctgaaatttagctcttagcttcttaaaagcacgtgcacaattactgaaaaagtacagtttaacttttcaagatgtgacttaatatagtatgtaagatttggaaagtaataaatattttggatgtatgtaagttttaaagtttaagtgaacaattgaatatgtataatactttcaggatgactatgttgattagattttcacttctatagtcactgataagtgattttctttgtacatgtatgtgtctgtttatatgcagcttccctcagtatacacaggggatcagttgcagtactcctgcctataccaagtccatacatactgaagtcctgcagttggccctagggacactgctacacaaaaagtcagccctacacacatgcaggcttcacatctcacaaatactatatttttcattcatgtttgattgaaaaaaatctacatgtacgtggacctgctcagttcaaacctgtgtcgttgaagggtcagctgtacatatagatattcacacacaggcaacaagcatgaggcatcagagggtttcttttgggattaccattgacggcacatgtgccaaataataattctgcaagggtaacactgagatttatgttaggctgtgtcagaaaaaaattcttcagtaaggtctgtgtctgagctcttccatgtgttaataagtactttgatattaatgcatgtatagaaatgcatatcttttctaaagctcgatagtgaccttggtggtcatctactcctgtgcctattttcccttcccttctttctgttttatattgttcttggtaatttttttttttgagtccagcaagacttctcaaggtgtctgatagacaatgctgagactttgaagatgtctaatacagaataaatattcaataaatgcttgaatttacaattaaaatgtataaataggaatcatattttgtcagtaatattatcagttcaaaatataactactgttaatggtactaaatagatccgtaagaaatagagctctagaagatattcatatacgattgactcttgaacaacacaggaattggggtgctaacccctcccattgaaaatctatatacaatttttgactcttcaaaaacgtaactactaatagcctactgttgatcagaagccttactgataacatagttcacacatattctgtatgttttatgtgttacatatgtattattacaataaagtaagcttgagaaaagaaattgttattaagaatatggtaagagccaggtgtgatggtctgcgcctgtaatcccagctacctgggaggctgaggcggaaggatggctgagcccaggagtttgaagctgcagtgagctatgatgatgctgctgcactccagcctgggcaatagagtgagaccctgtctctaaaaaaacagaagaatatcataaggattatatttactactcattaagtggaagtcggtcatcataaagttattgctcctcatcatcattacattgaatagattgaggaggaagaggaggggttggtcttgctgtctcagggatggcagaggcagaaaaaaatctgcgtataagtggaccctcccagttcaaacccatgttgttcaaaggtcagctgtattcaaaatctatttacagttctctttcacagaattggcaaggcgtattatttcttacagtaatgagcaagtcatgaaactaggctctgctgttttttccacttcaaggtttgtcaattaacagatgaacagatccatcacctcatgaaaatgatacgtgatttcagcattctcttttacagggtaagagcaaaatttttcaactgtgtaaaatgtaaaatgtcagtggtttccttttggagtgcaccaaaaaatgtgaaagctgtatatagccatctagtggaaagagcatggaggtacattaagggagagtgacattatgtgggtgtaattaacatcttgaaattctaggtcataggtcagttcaaactcgtctaactataaccatattcaattatctttataccaagttaggagcagccatgttggcatttcacagactctttttctatttttggatacataaaatatagaaagtctagagaggctgacctacagtaacactttcagataaccttagttccatcaggctttgccactgactatagaccttggttcaatcaagctttgccacttactactatctgtgtggtttagattctttggataactttatttaagtttagtttcttcatctgtaaaatgggataataatgtttctctgtctaccacagttttgagaaggaaggacttgctgacttgtaaatgtggaaagttatatactatatgcatatatagaattcaataaacacatcttttaaacaaagtaatgcaaatatgtattttctttcttcacagtccattttctgtatccaaaattttcatttttactatgttcagaaagtcaggtattgtagtattctttattaattggcctaaaatgtgaatgaacctcttgctctgcagatcggtcttgagtaactatggctatttttaaattgcatttgcttacttcttcctccagaaaaagatgaccatagaaaactgcccatttccacccagattaaattgggtctttcaatactttccttaaattaatataaattgtgtaattttcagctcatacgtggtgagccatatttctgggcttttaaattttcacagtgctgatggaaactcaagatattttctttgtaggagccttaaatatttgtgagtggaataaaactgaccaaatatatcaaaatatcttttgaagtagaatttataccaaaatggaatatattctctgctaggatggtatttgaatgtttattttctttctttctttttttattaatgaatctctaaggttaaaaaggaaaaaaaaatcctttttcaggtcaacaaagaaaatgctcttattaaattttgtcccctagaattaagttttttggttgttgaaactgagtgagcagtttcagtcttctaaaaataatcagatttcaagctaatctagcctttttcttttaactatataattatggttaatttaaaaagccttaaaagtgtaaaagacatttttaaatatagaacttttacatgtcatttagataagaggataaagctatgcaaagagcaattttgaatactaatgtcattaaataatgacttatttcacacaaattttatttgacaaatattaccaaatcttgtcaatacctttttctctgatgaaagaaaagattatattgacatatgtacaaacatatgtaaatttttagcagatgattttcagaggtgactttcgagaatgtgtctttggctccttggcagcactgttttgtggataacagaattttttggttttttttttttttagtgccgtaaagcaggacttgctctctctaaacactataaggtttacaagcgtcctaattgtggtcagtgccactgcagaataactgtgtgccgctttggggacaataacagaatgacatatttctgtcctcactgtcaaaaagaaaatcctcaacatgttgacatatggtaagatattgaatttaaagggataccatttgccctaaccatctaactaaaaggctaataatctgagaatataactgaataactgtcaggctattcagaagagaacgtgactcaaaagtattttagtccttgaaaggaaatagtaaataatgtcaccaaagaacctgagggagccaaagatgatttatggaccagttctgaatttaggtggaaaatctctggctcagggaataatatctagcctttacctttaacctagtttgtaaagtgagtaccaggagatgtcaataattggaaaaaaatgcaactaccttcaaaagtctctgcttcacttagaaataatattataaaacaaaagcaagatctttttacagattgtatgtctagttggtgaaataatagaccacttactaaacccacgtgtagtagttctgccagttgctgagtatgtctcttccaatgatacattccagaactggagaaataaccgcaggataggtttgaggacttactgtgagaagtatttgggctaaaactccattgatcacctgaccagactggtggtggatcacagtgatatttttgtctcctggaattagtgtcagttcagagccagtgtccaataatccttgaaaagtctgattattttcttttccccaatgtacagttaccttggtaacaggccataggaccttttgggggaaatctaagagaaagattatgcagtagaaagcagctgcatagcagtatatgtgattataagattatgtagtataaagcagctgcatagcagtatatgtgattataagattatgtagtataaagcagctgcatagcagtatatgtgattataagccagtagtaccagtatgacatgaagcacaaaaaatgctgcatgggttcagggatattagaggtttctatgtgcaggaaggttgggaagatctcaaagaaagcgtcatttgagtggagctccttgttccactctttccccccttctccctactgtacttgactagacttaaaaaaagtatcatttgaaatttaccttaaaaaatagaattttgattaaacgataaagcaaacagtatttaattggaaaaaaggagcatggccacaaaccttgactcattaataaacatggcatggtggagggatgatgagaatactggccaaccccaacagaggctccacgttgtggaataataaaagctagttttacagggagagtgggatcaaatggtgggggtcattagtagtttggagaatggttaaggtctttcctaaattagcacattaaggacttttagttgattgtagcatagttaacatggaaaacgaagagactgaaaatgcatgtaaagaagctggtgcagagtaatgggcaagcgatggttaccagcctggggtcaagacactggacgtggtaccctagtaaaactttttaaaagtcaacaaggactgtggcagatttgataggtaggatgatgcaaaaggtttcaggaccaaataataaaaattttcacattgtgggtctgggaaaattgggatgcagcagtgaagatgcagtatgtgttagatatgtgaaagaaccctggaatatccaggaagacatgtcttaggggctgcgatccaggatgagagaggctgtcggcacagtgctgttgattgaagcattccaacttctcagttcagtaagaatgagaaaggaaatgagccaaggtctgagcttcagcaaatacctataactacaaagtgggcaggaaagaaaaagcaaaggaaacaaaaccataggattggacataggaagagactcagggcaccactcggctgtgggaaacccgggaggtgggaagtgcggtcatgtctgtagagctgggggcaggggagggagctggtgtgcagaggaagtcccagcttaagtcttcataaatatgtccagaactgcgtgctttttctttgtgtccctgcgtttcattttctgcatcactcttcttgttctccaatacttttctctacagcactctatatcttcttccactcagccgcttcaccccgtgttactatcatagacatctgaaatacatttagataattttatatatatatatataatacacacttaatggtttttaaattttttatgaacattcataatttttttttatgaacaagaactttcatagttttttatgaacaggaacttttttataatataggtatacatttatttgaccaagtaactagatactgcgttgaacacagtagctggcagatagaagatcttcaatatatatttgtctactaaataaatgattaatgttctgtattggttttctatgaattgatatctttgagattaaaaaattataaatatgttatttatcacataaatagttgtcaatgtcaaaggtttttttgaaactagatttcaaagaccccacagttccccaaaagagacctatgagttagggaaggctgtgctgaaaatgttctgggccttgtaatccctcttccctcccgacctgattctgttttctacactggcagtcagcttaagactttgtttggaaaatcaactatacactgtgaaataaatgtttacatattttaaaaagcttgaaaaccaagatgatttgccctgttcttagatttttctgtgaataagtacatcccatttattttctggatgagtatttgatccttttttatgttgattaaattttctcattttaatgtaaagtcatttcaagttaagctgaagaagtctgaaaaggccactaccaattatctaaatcctcctgtttcttctgtctctgaaagcttactgaactcatgaagtcctcccccaattttccagtttctactgatcatatcacacttttaatactgatgctatttattgttggttcttttttctttttatttgagttggagtctcggagtctcactctgatcacccaggctggagtacagtggtgtgatctcggctcactgcaactttcgcctcccgggttcaagtgattctcctacttcagcctcccgagtagctgggattacaggtacccaccaccacgcccagctaatttttgtatttttagtagagacggggtttcaccatgtgggccaggctggtctcaaactcctgagctcaagtgatctgcctgccttggcctcccaaagtgctgggattacaggtgtgagccaccgtgtccggcttattgttggttcttaattatttgctagctaatataatttatgtatgtgagtattatttcctttaaagaaaacagaggaggtagtctttacctttcattagggactttaaatttttttcgttgttatttactttatttattagggtctgctatacaccaggtacttggaatacaaagacaaaatagaacacagcctctcaaagtgctcaagggctaatgtgggaagtaaatggtaaatagataaagcaccgtgatggaagtgttgtaaagggacatgtttatcctactggcaatggaagtatggaagaagaaacacttaagtctacctgggaaggacaaggaagtctttctgaaagaggcagtctttgagcttagtatagaaagaaataggaattcatcaaagacaagaggtaggaaaaggattttctgaaagacgaaacaacacatgggaaagtatacagggagaacatttggaatgctgcacacaggatattttgttccttcaggagcacatattcaggtctctaaaaaccatctagtttggaaatgtggctgtagttggttgccagtcaatgagaatttagtgctgtctgcaaaccaactcttttttttttttattattattatactttaagttttagggtacatgtgcacaatgtgcaggtttgttacatatgtatacatgagatgttacatatgtgtacgtagagatggcgtttcccatgttggccaggatggtctcgatctcttggcctcgtgatccacccgcctcggcctcccaaagtgctgggattacaggcatgagccaccacgcctggctttttttttttttttttttttttttcttgagacagagtctcaatctatcacccaggccggagtgcagtggcacgatctcagctcactacaacttccacttcctaggttcaaatgattctcctacctcggcctcccaggtagctggaatcacaggtgcatgctaccacacctggctaattttttgtattttcagtagagatggggtttcactatgttggccaggctggtctggaactccttacctcaggtgatccatccacctcgacctcccaaagtgacaggattacaggcatgaaccaccacaccagccaagttttttcttaaatagatctcctcccactggaatatagttatctacaaatattcaataaatataggcttaatgaacaaattttgcccctacatatctattacaactgctctcttgaaaatcacctatttcccagaggtcttaaataggcttcttcaagcctcaccctctctaattcagttgaattatttttaaatttttaaaattttaatctttttaaagacaggagtgcagtggagtgattatagctcactgtgatctcgaactcctgggctcaggtgaccctcctgcctcagcctcccaagtagctgggacaacaggcatgcaccatcatgcttgcctaattttttatttttatttttagagatggaatcttgttatgttgcccaggctggttttgaactcctggcctccagcaatcctcctgcctcagctgtccagagtgttggaactacaggcataagccaccgtgccagccgactcagttgaatttaattctctccatcacttcccatctttgttcctatagctctgtttcttctgcctctctttcatgggctccttttcttttgatcatcaaagttaaggcaacagcaaggctctctattggacctttctgcctctcctccctccgtgcattcccagtgatggcgaatactaccagattcagctatcatctcagaccatttctggtaaagatctttaggttatgtgtcaaactatagttcttgggccaggtatggtggctcacatctgtaatcccagtactttaaaaggctgagagggaggttcacgaggtcaagagattgagaccagcctggccaatgtgggaaaccccatctctacgaaaaatacaaaaattagctgggtgtggtggcgtgcacctgtagtagtcccagctacttgggagactgaggcaggataattgcttcaacgcgggaggtggaggttgcagtgagccgagatcgcgccaatgcacttcaccctaggtaacagagcgagactccgtctcaaaaaaaaaaaaaaagaaaaagaaaaaacctatctatacatacatgtataagacatgaggcgatgataagtggtgattagtgttctcaagaacatgagccacagtagcggatagtgacggagacggctcatttttgatagggtagcagataagtccgtggggaggactttgttgaaaagatttgatgacttgtagcaatctgagggtgggggaaatatttcaaagaaggtagcccagaaaagcataaagcctctgagttgttgaaggaagagaaagaaggcatgtatgactgaaccaagcagagggaatgagagacagaggcagcccctctgcttgggagggaccaaggagcatgcagagtcggcttggccaaggcaagtttctgagtagactggggagcctttggagggttttgaacgggcgtgaaataactgacttaatgtttgaaaagattaatcactctggcgactgttgccaatacttttgagctgggaagccactgggagagtttgagcaggagggcagcatgaagtgacttgggttttctgaggatgatttgggctgctgtgtggaatagagacggtcatggaaccagagtgaagcggcagcatcgggggctctcaacagtagtgcaggtggtaaatgctggtgacggggaagagagagaaggtggtgggaaaaaaaggttgaatttaggataattttggaagttgagttagggttaaggccagaaatttatataatttgggggcccttatttatgaaaaacaataaaaaattatgactacaacgttaggtcctaatgtgaatatgtagaataagaaatcacaacaaattatattttttaaacaccacaaacatcagaaaaatgagatattattagttcactgcctgacacagctgtgtaattgtgttcctttatgtttttggctgcaaactccttgattgccttttcatatgaccaccaacaatatcattacatcttttattacggctagatgagaaaacttttagcttcacaattggctgttgatagtgacacatctccaacttcctctatcttttctttaagcagtacttctctgtaaggaaaccctaagagcagtgcctctcaaactttagtgtgtaccagcattttctgaagggcttgtgaaaacacagattgccgggccccacccctagagctggggattcagtgggtctgaggaggggcctgagaatctgcatgtctaacacgttcccacatgacgcccatgctgctggcctgaggacttgactttgagaaccccagccctttgatcttcctcaggtgcctcaggttccccccctctaccaggttgtttctgagttagggtgggtagtataggggtagagtggcctggcagcctggatcatggtggcctgtgagctcggaacgatgcagtatcttttgttcaggtccttctcctcaagcctcagggcagagtccgcctgctccttgaggtcaccagggcaatagtttccctgggcactgaacagatgtgaggtgatgctggcagcacccaggcgccaggattaccgctgcctgcaatcctctgagtccccagcatgtggtcgagttatggctcccattctccatgctgcccaccccagtgtgcagaggacacgtcaagccatggaaagttaaacttcttttgcttcatgtaaatttgcatctgcagcagatcccacgggatttgctgatggactggaagtgggatgtgagaaaaggaagtgttaaggatgacttctaggtctgggcctgatgaattgagcgatactgatgccatttcctgacatgagatagaatagtagaattgcagattggtggctcatgaatttttttttttttttttttttttttttgacacggagtctcgctctgtcacccaggctggagtgcagtggcgtgatctgggctcacttcaagctccgcctcccgggttcacgccattctcctgcctcagcctcccgagtagctgggactacaggcacccgtcaccacacctggctaatttttttttttttttttttttgtatttttagtagagacggggtttcaccgtgttagccaggatggtctcgatctcctgaccttgtgatccacacgtctcggcctcccaaagtgctgggattacaggcgtgagccaccgcgcccggcctcgtgggtcatgaattttgtctgtattcatttccgctggctgccatcataaattatcatgaccttggtagcttaaagcaacagaaatgcattcactcaaacgctggatgctaaaagctcaacatcagtttcattgaaccaaaattaaggtgtgggtaggactgtgctccctctggaggaactggggggaatcatattcctttcctcttctcgcttccggtgctgccagcgttctttcatgtgtggctacatcactgcaacctctgcctttgtggtctccttgccttctctttggtgtgtatcaaatctccccctccctctctcttataaagacacttgtgattgggttaagggaccatcagctaatccaaaataatctctctacgccaagatccttaattacatctgcaaaccctccttctttataaagtaacatttatagattcctggaattgtgccctatgtctttgggaggccattattcatcctactacaaaacattaagtttgggattcttcttacacatccaagtggagattgggaagaatttattaatgagtgattaagaaatagagcagtaaagaaaggaaagaatgtttccaaagcctccatatgtaacaataaaattctccttatgatcagggaaacttttaggacagaagaaaatgaaaatagggaaaagttggagcacatggaaaatctaaaagtcatttaaattgtgtttgtttaattatagataaatgcatcatgctgcctttcaaagtaagttagtagaggacagagattaggtcaaataaacaaattctgtagaagatctgatattccatagggataataaatactgagtggcattaaaagtcaagggaagtaaagataaaagaatcctaatgagatgtatcttactttcagattttcttattctatttattattttaccagacactcctgaattttaaaactagtgtaattatatgtaaggaacaaaatgtcacaggagacaaggttacctttgaaagtcaaagaactcatgttctgaaatgtaagatacatagcctttacctgcaagagctttgttcagtattaatgtttgggatcatgaagggaatccgtgatactgccatggttgcttaactgtgtgacatgctctatatccagacctatagctagctgtgcattagagagtaggactatgtcacagccgtataaaggcattttgtgtaaaaatacatggtcaatgaaggacttcagatggagaatcatgatttatatttgtggccaaaaatcagggttttattgtttgcttgctaatctattaattggctatccaccatgaaacagtcttacatgaagggaaacaacacaaagagatatcttttttcatcattatgaattaatgaatttacatagtgctcagcagatactgtagagaaattctagagtttcctgagttttctgtgcacatgaagtaaatataaaactttcacatctttcaatcctctaatttctgcataggtgtattttcccataatttaattgaataaaggtattttcattttgtttgggaaaaaagtaccaattacttaaaacattatttgagaaatacttcctaatgtgatatcaaatatttttagttggtttaaaaaaaagctactcgattatttgactctaaataacttttatttgatgtttctcactttaacaacaattagttgttaaaggggggtccaggtgaaaacattttactctggccaggtgcagtggctcatgccttaatcccagcgctttgggaggctgaggcaggaagattacttgaggccaggagttcaagacagcctaggcaacacagcattccatctctactaaaaatttaaaaattagccaagcagaccaatgtgcacctgtagtcctagctactcaggagattcaggtgggaggattgtttgagtccaggagttcgaggctgcagtgaactataatggtgccactacgctgcaacctggatgacagagcaagaccccatctctacaaaaaaaaaaaaaaaaaaaaaaaaaaaaaaaagactctaagatacagtactaacttccaagcaataataaagagatagcattggggtattaatggttctataatcatttctaaaatatccagacaagaacaaggcaataataacaatgattaattttaaaaattatcttatagcaagctaccgactagaaatactataatcagttggacatctagcagggtggatcatgttatggactccgtggctcggaagtcggaagagcactggacctgtgtggtgtgtactttaatcaataagccctcttctaaggcatgtgatgcttgcttgacctcaaggcctattggtaagactgaattttgattttgagtttgttacatttctaagagggttaattatacaaagtcaggaatatatcttgctccatcttgatattccataactaaataaaatttctttctcaaaggtttaaaggaattgccagttttcacatgtaaaccatgctaatattctgttgagtattttttttgaacagggagggaaagcatgtttgtgctataacagtatgtgcctttgtatctcaaaaaaatggagatgatcacatctgttctctactgtttctaatgaattattcaataaagctttgttttatgcagatttcagcaactttcgagtttgttattcagtccaagtgttgcataaattgaaagggaggatttctgtaagaatctctttgcaggtggaatagaaaaatgctgaattttttctcttctttatcccttctaccccgtgctattaaaatctgtatccagacaattgtactgatttcattgaaacccttcaaaataactctttatagctcacgatttcatgcatttagggcatgtaaaacctcagaggaaacctgtgattaagagccatctcattgcagcggcttctattgtgttctcaaagtgttatttctttcttcaattagagatgagaaagttcattcctgacttacgcacccctgcattgtgtcaactgtcatattgtgttttgtttcctgggccagaaaggcagacatcaccccttgcacagctttgctgtgctgcatctcctgtttccatccctccctcttcagtgtccttcagcagaggcggagcccatggaaaaacacaatcttaggttgccacattgatttcaacattctgaaatgcatttatatgtctcattaactattttcttgttaatgtttctgagtcagaaagacatcttaatgataatatagaatgtattatagtacagattccaaaatcctaggatactctgttgtgaaacattgtatttaatagatgttaagtctggccagtcgcggtggctcacacttgtaatcccagcactgtgggaggctgaggcaggtggatcatgaggtcaggagatcgagaccatcctggctaacatggtgaaaccccatctctactaaaaatacaaaaaattagccaggcgtgctggcgggtgcccgtaatcccagctactcgggagtttgaggcaggagaatggcgtgaacccgggaggcggaggttgcagtgagccgagatcgcgccactgcactccagcctgggcaacagaacaagactccgtttcaaaaaaaaaaaaagaagatgttaagtctttgtaattcatctttacttattttaaataagcctttcactttgtcttgtcattcctagtagtctagaaacaggtctctaactgctgacctaaagctttatgggatatcatctctcaactaccactttttaatgctttgcctaatattagcaaaactgataactgagtgacctttaaatgcttaaacatcataaaaagcaaatataaatctttgttaaacccatgtctgggtttctgtaagtcgaaattttgcattttacataatatttcatttcctagccagaagatgattaattctgacttgtctgagctaactttgtgttattagttctatatattagttcactgtaataaagtgaagtaaattttttaatcaaataaaaagatgtttcacataatcagtatgttatatttatgggactattgcagaattacttctctctccttccagattcagtgctcaagagtgaagaaaattctactgtctttagccacttaatgaagtacccgtgtaatacttttggaaaacctcatacagaagtcaagatcaacagaaaaactgcatttggaactacaactcttgtcttgactgattttagcaataaatccagtactttggaaagaaaaacaaagcaaaaccagatactagatgaggagtttcaaaactctcctcctgctagtgtttgtttgaatgatatacagcacccctccaagaagacaacaaacgatataactcaaccatccagcaaagtaaacatatcacctacaatcagttcagaatctaaattatttagtccagcacataaaaaaccgaaaacagcccaatactcatcaccagagcttaaaagctgcaaccctggatattctaacaggtatgatgcttttaaccttggtctttaagataattgcttttttttttttttttttaagacgaggtctcactctgtcacctaggctacagtgcagtggtgtgatctcagctcactgcaacctctgcctcccgcgttcaagcgattctcctgcctcagcctcccaagtagctgagattacaggcacatgccatcaggcccgactaatttttgtattttcagtagagacggggtttcaccatgttggccaggctggtctcaatctcctgatctcaagttatctgcccacctccgcctctcaaggtgctgggatttacaggcttgagccaccatgcccggctggttgcattaagttttaagaagacagaaattgtcccttggtaaggaagttgaattacttttggtaacatgaatcaaaccctaaaagactattatagtagtctgtctcccttcccttctctagattataatgttagagaagggaaggaaatgaaaaacgtaatttcctacatgtatgaaaagttgggttttttttttttctgacaataaccatacacatgatcaatacagaatatttggaaaatattgtaaagtataaagaaaaatatttgtcacccataatcatactgcttatcaataaccagttagcattttttaatatttccttccaatgaaagatagtcttccaaaaggggaactattttttataaaagtttagtaagtatactgtgttctaaaaggaggggtctgaggtgcctgtagtgacctttctgttaaagaacgtggatggatctcaaacagtcatgcgagatggtgtttatttttatttttatttttttctttgaggtggcgttttgctcttgtcgcccagctggagtgcaatggcacaatcttgcctcactgcaacaacattcggctaattttttttgtatttttagtagagatggggtttcgccatgttggccaggctggtctcgaactcctgacctcaggtgatctgcccacctcagccttccaaagtgctgggattacaggcgtgagccactacgcctggcgttgttctttaactaaaagtcctaaaaagcatacttgctactttgtatctgaaattcaaaagttgtaattctaactaagaaatactaccagagcagatatattttataggacttccagctacatgtccaggagaacaccctcatttttgtcacctgtgatacagaaattttaatacataacgtcatcctctcttttccttaatgattatcggcagctcctgaaacaattttctgttgaccctccttccccctttatctggccctcccagtccctttatctggaattcctaactatggcaacccgatgttatatctccaacacaggacacatttctccaccattttcttttctcagctgctttcttttttccttcagaaagcagctgacttacatccagcatttttaaataagtggagaatttataacatataaatggagggtcgtcctcccatgtatgtcttttcttgccaatgggagacaggcagagaaggagttacagtcatccctcggtatcctcaagggatttgttccaggacccccaggataccaaaatctgcagatgctcaagtccctgatatgaaatggcatagtccttgcatataacctatgcacaccttttcatatatttaactcatctctgcattacttcttataatactgaattcaatataaaggctgtgtaaataattgttatactgtatattttgtgtaatttttttattgtttcattattttttgtttccaaatattttcgatccaaggttggttgaattcatggattgggaacctacggctatggagggatgtactttggttgggacctagagtaatctcaggtggaattctgagattcactggcttttcctcttattagctgtgcctttactgatgggtagatgccttctctcagcggtggggtgagggaccatttggtgtaaactcctagagcaacctgtaggaatccttaagcttatttcataacaaattctgagacagtctctgctcaatagatgtgtttactccaagtttcctattccagctctaaatttaccatcagttaatcctgatgatttatccttgactggtttttttaatgtcttgttcataatcatttatgataactggtttaacttttgttcatatactcacatttgaagtaagctaagggggctaaacttttaactgactggataaatccaccacgttttcactttaaccctaattagtgcctcatgatagaagttcattaaggagttaattaagaatgtttgagttgggaggctgtcctggaacagaaaatcatttccaaacagtcttttctgttccgtggcttaagtggaaagtagaagtgatcatcttaaaatattgtggcatttgttgtacctagatgaaatatcttggcatatttttatttccttaatgctttgtagaaaatctcagacattttaactaatgaattagggatttaaaaaaacattaatgtaaccttaaatttaaatgatttcttcataagccattagtaataggatcatatgattaatcacagtgcacagcattacttaggaatgctgcagcctgtgtatgtattgaatataagaacaccaggactgagactccacaatcaatcaagatcaactagcagaataaatgtcaagtgatgaaataaattcacccagcagcccttctgcacccagctactttacaaggaataaattgcaaattactgtcatttatttcatttttctccttgtctggcagctatagtgttcatcttgtggacaagatgcctagcagaagctcacaacataatactattaaagcaggtggtccattcataatttatagccagtttattttttctttaatattatatgataattactttgacttttgttctcttaattactgttctcattaccacacaatccatgcagtgttgatgaggcatattttctgattggtcttgagatagatgtgtattccatccagctattggcttataaattagatgattgaacccatttttaaacagttaagaataattactagaaacagtttaagttgtcgatccaattactgtaaacacagagcaaaacacagtgatgcagtttcaaagaatgcatgtgttttaggctgaaatttttcctgcgttgatgcaaaggctcacataggagggtgaaatgacaataacaaaatcattaatattttctcacatttgctgccgtcagggatgttgaagatctgtctttaatcaccagtgcaagtactgacaccatgtccttgtctcttggttgcttcttggagttttcagtctcaggatttcagaaccacctggggccgtccagaatgagtcatttcacttttgtttgttttaatcctcgaaataatcctgtatgacaaaatctacattcagtgagaccgattaatccaaaaaattcagacagtatttttattataatgaatcgccctatctataaaatgagttaaaccaagcttgtccaaccataggcttgtgggctggacggctttgaatgcagcccaacacaaatttgtgaactttcttaaaacgtgagttttttgtgtgattttttttttaagttcatcagctgtcaccagggttactgtattttatgtgtggcccaagacaattcttcttcttccactgtggcccagggaagccaagattggacacccctaagttaaactgtgataaattgaccatgaaaaaataatattcactttaaaattacagatctgtgcttagtaatgtcttccttcttgatgatagtttttgtctggtctctgttcagttttatttattaataagtattgagaatctattatgcctcgggcattgttcttgattctaatgacatgtacatgagcagactatagccagcagggccaaatccatcccaccacctgtttgtgtaaagctttatttacatttgtttagatattatctatggctgctttttgtgataacaaacttagaccgtaagaccagcaagcctaaaatacgttatctgaaaaggtttgccagccccgatctgttgtattaatagatcacttataacccagaattaatattcaaaatcatggtcatgatcacgaaaatgaacaattctgtatgctacatttaagtaagaaatctgctatattttagaaagtttttataaaacaaagaggaactaagatgtcctcagttaatcagaacatttaattatcctggataatgttgtctatcataaaattaagattagctgtgcatatttagagccagtgtgatacaggtggcattagtatcttggttacgttacttcagtgcttcataacttaatgtgcatatgaatcacctgggaatcctgctaacatgcagattctgattctgcaggcaatcaggagtaggggtggatatgtctgtgttttctaacaagctccgggtgatgctgctgcttctggtcagtggaccacactctgagtaccaagaataagatcacacgtggctatgtttttgttgttgttttttgttttttgttttttttgagaaggagtcttgttctgttgccaggctggagtgcaatggcgcgatctcagctcactgcaacatctgcctcccgggttcaagggattcttctgactcagcctcccgagtacctgggattagaggcacccgccaccacgcccagctaattttctatttttagtcgagacggggtttcaccatgttggccaggctggtcttgaactctcgacctcaggtgatccgcccggctcagcctcccaaagtgctgggattacaggcgtgagccaccatgcccagcctgtggctatgtttttaatttaatttttaagggaagaaatggagtggaaggcagaagtgaaggcagagagatgacatttgggcctctcctttctactttaatcctaccttctaccttggcccttctccccagaaaaattttaatacagaatctaaacctctccctggatatgtggaaccctggagctctctaggttgaaacaagtaggttagaaaatgttcaaccgttatccaaaacagccgcctctaaaataatatataaaactgtttttgtgtccacacaatttttaataagaatgcatcatttcattaattttgttaatattcttaatcttttctcctttaattttaagagagcattgtttatgaaccacttgctttaattgtgaaatctcttgacttctctacaactgtccagatatctggcttcccttgaagttaaagttttggaggagattggtgaaatggagttttggagggggttggtgaactgaaaggttgtggaaaagaaaagtcctctgcctctcagctttcctatttctgatctggtattacccatgacttgaaaatacagccaccacccctctaccctggaaaagttaccatcaaaatagttgctggtgaagtatttaatggtgacgattgatttagcaatgcctgcagctgctcttattttacaaatggctattgaagaaaccttcaaaaactgccctcagaatgtttgagttcatcccagcaaacattttcaaagcagtatatttaagcatcctttatataaatgaatttcagtccatttaatcacaaataagagattgcattctctgaacatttcaattagatatgatgcattgaggcatcatagaaacaagtgtgtaaaaaatgcagtttaggaagcaaggaaaaagggaaatcacctttgatttttaagtttttttttaacaattatttaagaatgatatttttgttctttagatatttaccgaaaagatgagaatggattaactgttttatcattaaagagttaaaaaaaaataggaatattaagagggggacttctggttttaatgaatgtgaacactttctcttcaaccagtttattaaaaaactaattctcttaaaggcattattaaaatatgcacaacacagaaaatttaaataagcttcttttcaagaagaaaattctgtttatacagctacagtacaaggccagcttctagcctgtgtacactgggtatgagggcaacctccaaatactcttgatcctaattatgggggagaataaagcttccctgctagctttacaaaattcacatttttgctctctgccaggcagcctgtttcttgcaggaatatgattgcgactattatagtagccttgatcaaagaaaagcatagaaaattgtctttaaagtggacagcagagagagtgatttctatggccttgtcagagccattgatgagagtttgctaccgatgagaaaataattagagaagattgtgactagctactttggggccagtgggaatggagaacctggacttgagaatattttagaggaaaaagaagtggctacagtgtgatattgggtaagaaaagaactgaatatcacaaatgaaaaataaaatttgatttactggatacacagtccagctgcttttgttctttagaaagttaaattacgtgttttaggtacataggtaactttggaaataaattagaattacctgggaaaacaaagaataaagacagccttttgcataatgacctaatgttaacgaggtccactttttgatagaatttcttggtacaagtgaaattctgacatgtgggggtaaagtggtgtgaatggtcccttagcactcctatgctgtacttattttgtaacctgtcattacagtgaacttcaaattaatatgacagatggccctcgtaccttaaatcctgacagccctcgctgcagtaaacacaaccgcctctgcattctccgagttgtggggaaggatggggaaaacaagggcaggcagttttatgcctgtcctctacctagagaagcacaatgtggattttttgaagtatgtgtaagatttatctagcttactaaaatgtaattaaatgctttggttattaatgtataacaaatagcaatactttcctagttttaccttttacctttaaatttgaaatagccatattggcattcagtctaaagcttgaatgttgactaacttaaaattcagatgttcagccacaagaaatttaataaaataatagctattacattgttagagtatatcatatttataatcataagtctagaagtgttgcacttagcttgtaaagttagaaagacactgagtgactagtaggtactagtagtacatatgtggctaataatccaaggtaagaatttgttcttcctaacttcagcgctacatcaaaacctttggtttatgcattggataaaggtttataagaaaagcaatttacatgcctgggatttacaataaccttatcaaatcctacttaaccacacttgacccaaaaaagtgatggcaccatagcaatttagctataggcgattcctcctgcctttccagtctgtggatgtatccctaaagatgaacctaagataggagataagaacctcaggtccgtttagtcagtctcacttccggtattcctcggtgtgagcatctcatcaggctgagtgtgattctaatgttcagagatacatattttttctagttactcttcatctggaatagaactgaaaaaagaaaatattgatatgtttcagtgctggcgcaaagattttctggtggactttttgaaagatcaaatatctgtcttcaatgtgataccttcttaaggaatttcccggggaaaactggatagtgattttagacctcaatctctaaacacagtgtaactctaccctacaaaattcacagatttcctcctcaagaagcttttatagatgtaatgggaaaatattattagcaatattcatggtattgctaaaaatataatagcctttttcatatctctcttgaggtcaaaattagtaagaataatataatagaatctgtctaattcagtctgcgtaagtatttgattctttcttttcctaaggaagtttaatattaaaatcatgacaaatctttgatcttacagggttttttttgttgttgtttgatttttttagagacagggtctccctatgttgcccaggctggtttcaaactcttgtgctcaagctatcctcccacctcagcctcccaaagtgccgggattaaaggcatgagccaccgcacctcacctgatcttacaggtttaactgaaacagacctatagcagggatattggtgattacagcaagattttgatagttttcaattattcttaacaaagtgaagaaacttctgtaaatatacctttagataaagggaagctcagaattatggccattttctgcgtgattcaaacaaatttgtaagagagatgcttcttttaggatataagcttttttaaaggcgacgactaattactggtctattttacaatgtcaaattaatgataacagcagtgaagactatatggcactaatcacatgtgcctagggttagcctgtacatcatgataacttttgtataaacttgtaaatttacctttttttcctgcagtgggcagatttgtccttcccattctgcaaccatggcaagcgttccaccatgaaaacagtattgaagattggacctaacaatggaaagaatttttttgtgtgtcctcttgggaaggaaaaacaatgcaattttttccagtgggcagaaaatgggccaggaataaaaattattcctggatgctaatatctgtagattctctggcatttagtctcttcaaactgtgtataatgtttggtcctcctctgtttcatagaaaagtcatagaatatctatgatacattgaaaagttactgcaatatttgagaactgttctttttttttcttgtgtgtgccatctttccattgttggctacgtcttttcttttgccttgatgaacgttctatgtatttcatcggatatacagcatattccatttaggatgtgtatttaatgcatttagtaatgacgataaagtgtttttagtatgcttttagtctcttgtaactggggagaagcagtgttttttttttaggaaaggattatgcgacacaataaaataagatattctgtctgtagtgaatacatttctcatgtactaacactatttataatatatgattaaagatatttcttgttttattaaataataagaaataagatctcctttatg

SEQ ID NO: 44 - DNA, 2642 bp, Homo Sapiens
cagacagaccaatcacgcgcattcttcggccacgacaagcgcgcctctgatcacgtgaccaggtccgctacccacgtgggggctcagcgtgcacccttctttgtgctcgggttaggaggagctaggctgccatcgggccggtgcagatacggggttgctcttttgctcataagaggggcttcgctggcagtctgaacggcaagcttgagtcaggacccttaattaagatcctcaattggctggagggcagatctcgcgagtagggtacaaggcactatgaaatgatctagtttcgtgggtgaggggctgaagggcctatgatgcacggaggcggggaaaggatttagagataacgtggtttgaaaggcgggacctggtgcggggacgctcttgggaggagtcttctccccagccttagctggtttcatgatttctttgcgtctgtaggcaacgcggtaaaaatattgcttcggtgggtgacgcggtacagctgcccaagggcgttcgtaacgggaatgccgaagcgtgggaaaaagggagcggtggcggaagacggggatgagctcaggacaggtaagggaatgaaatcagcccttcttcctagaagctgcggcgggggtgtttgtcattcccttgatgtacggtaagtacgggccgactcatttttgcaggggtttgtgaagaagtcgcaggaaccgtaggctttcgttgggtctatagttaacgccggatcgcagttggaaaccaccagctttttgtcagtatatattactcattttatagagccagaggccaagaagagtaagacggccgcaaagaaaaatgacaaagaggcagcaggagagggcccagccctgtatgaggaccccccagatcagaaaacctcacccagtggcaaacctgccacactcaagatctgctcttggaatgtggatgggcttcgagcctggattaagaagaaaggattagatgtgagtggaatttgagggaaagagacattttttagtattgaatggtcttagggtttagtcaccccttttctccgtttagccttcaggctgttttatttttctcctgcccgtagttttctgtggggcttccccagtcttgccagttgtatttcctaaatgtctgttccttcacttccattgccattttcttttttagtgttctctcctcttcccagaatgttgcaaaaacctcttcactatacttcctccattttatcttcctgcattgcattccatatgaagcatgtcctccattccattaaccatagcttaaaaatcttagcttgctatccactgcctatagaaaaaacacatctccttggcatagcatgtaagactttcttacctctctatatttgttttcatttatctagcttagaattgtttgaatattgtgctgcttgactcgaactccttaggccaagagactgtttaacccgtgcgtatctatgacttagcatatagattattcaataaatgttctgctgaattgataatacgttttccacctttcttttcacttacagtgggtaaaggaagaagccccagatatactgtgccttcaagagaccaaatgttcagagaacaaactaccagctgaacttcaggagctgcctggactctctcatcaatactggtcagctccttcggacaaggaagggtacagtggcgtgggcctgctttcccgccagtgcccactcaaagtttcttacggcataggtgagaccctattgatgcctaatgcctgaactcttcaaaaccaattgctaattctctatctctgccccacctcttgattgctttcccttttcttatagttttttatgctaattctgtttcatttctataggcgatgaggagcatgatcaggaaggccgggtgattgtggctgaatttgactcgtttgtgctggtaacagcatatgtacctaatgcaggccgaggtctggtacgactggagtaccggcagcgctgggatgaagcctttcgcaagttcctgaagggcctggcttcccgaaagccccttgtgctgtgtggagacctcaatgtggcacatgaagaaattgaccttcgcaaccccaaggggaacaaaaagaatgctggcttcacgccacaagagcgccaaggcttcggggaattactgcaggctgtgccactggctgacagctttaggcacctctaccccaacacaccctatgcctacaccttttggacttatatgatgaatgctcgatccaagaatgttggttggcgccttgattactttttgttgtcccactctctgttacctgcattgtgtgacagcaagatccgttccaaggccctcggcagtgatcactgtcctatcaccctatacctagcactgtgacaccacccctaaatcactttgagcctgggaaataagccccctcaactaccattccttctttaaacactcttcagagaaatctgcattctatttctcatgtataaaactaggaatcctccaaccaggctcctgtgatagagttcttttaagcccaagattttttatttgagggttttttgttttttaaaaaaaaattgaacaaagactactaatgactttgtttgaattatccacatgaaaataaagagccatagtttcagcctt

SEQ ID NO: 45 - DNA, 7551 bp, Homo Sapiens
gcaaacgcgcgcgggaggcgggcctggccaacttctgaacaggaagcagttcgctcgcgcctaggttggcgcgggctgggaggtgttccagccctttaagatgttgcgcgtggtgagctggaacatcaatgggattcggagacccctgcaaggggtggcaaatcaggaacccagcaactgtgccgccgtggccgtggggcgcattttggacgagctggatgcggatatcgtctgtctccaggaaaccaaagtgaccagtgagcgctctggattccaggatccctacatactttttctttcccgctaacttttgtcccctgtcccatgtaattttactttcccagtttcctattcttagagtcctgtccttagacccaggtcccttccctcttaaacttccatttcccaccctagctagatcccctaattgcactccatctcctgtcttcagcaaactttagctccttctcgaaaccccatatctagtcagattcccactcattctccggccccaaactcagtcccctgaatttcctccttccatacgctgtccatctccccgccgccaagtcaaacccccgaattcttcatccctgccccaagctcagatcctctaattcccaccccatctttgaccccagctcagtctaatttcctctttttcacatttccacctcagaaccccagtaccccttatctattcccatctctcctcccagcggaaagtccctaattcccacctcatttcccaccccaagcttagatgtcctcttatttcttcaccctcttatctcccctcagaatcccctaattccttttccctccacccccagttcagatcccctaattccctctctcttacctctcacccttagctcagattcccaccatcctctcgtatgtccatccccatccccagcttcctcctatcgttcagacccccaggcttagctctgattctttccccttcccacctaattctccacctccacttcatagtctctaaccgccccccaccaagccttctaattctgatatcaatttcctctctgacatttcccatctttctaggtcctcctctaatcatggatatttcattcccgtcacccccaactctggctctgatgtgtgcaaggaattagcctacaactgtaattccaggcctttgtgtttctcggatgctagttttacctctgacttaatcttacattttttttttccaggggatgcactgacagagcccctggctatcgttgagggttataactcctatttcagcttcagccgcaaccgtagcggctattctggtaaatggggctttctgtggactttaaattagtgagggaggcagataggggaaaagggtttccaatatttgatgagagggtaataagaaatcttagacatttagtttacagagctaaagctgcataatagtaaattacatgaaatataatttttatggatagaattatcctactggacctcagaagtacagtagtagtgtggtgcttaattgtgtgaactgtggagccagacagcctgggtttgaatcatggctcatttcctagctgtgcaccctctggcaagttacattacctcttggtgcctcaggttcctcagctagaaaatgaggataatgtttaccttccggggctgttacaaggattaaatgaattaatccatgtgataataataattgctaatacgtcttgagcactcaccatgtatcaatgtaaaacacttagaacattctgtggcttttttagatgtaggaactgagactccagggtttgaataaggttgcccaagaaccacactttatgaagatgacttagatgacttgtgtggggacaattggagtgggacaggctgtgcaacaggctattgactgccaggtctgctcagagtgccctgtctgttcccaggtgtagccaccttctgtaaggacaatgctaccccagtggctgctgaagaaggcctgagtggcctgtttgccacccagaatggggatgttggttgctatggaaacatggatgagtttacccaagaggaactccgggctctggatagtgagggcagggccctcctcacacagcataagatccggtaatagctcatatctccctgctactgagcactgctggtgctactctttgagtgtgaagattctaaggcttgccatgtaaacatacatgcaccgtggagaagttcccaaatttgcctttcctggtttagtcctggctgggctactcagtgtgtgaccctggcaaatttttcccccctctgaagcttgagtttccatctctacaatgtggggctggcctagtgatccagctcttattaccatagacatctcaaaagcaacttagtgctgaactcagtgccccaggttgctgtctttctgggtgttctgtgtgaatagcagcaccattacctggtggtaatccttagatatccctctccctgccttatcagtagtcagtccccaagtcctgtgcatgccagatcatttgtgtctctttaacccctttcttttccatcccagacagtcacaaaatggaagccatgtggtatggggaagggacagaaggggaggtttgaaactgaccccttttgggggtttctcttttctccagcacatgggaaggtaaggagaagaccttgaccctaatcaacgtgtactgcccccatgcggaccctgggaggcctgagcggctagtctttaagatgcgcttctatcgtttgctgcaaatccgagcagaagccctcctggcggcaggcaggtactgcaagcctgggcagtaaggcttccttgagttggtcctgggtgcccagccctgtgtcaagctccattgaaagggatatggaccctttgtctctgagttctttcacagcatagttgcaaacaccaatatgcccacctgaataggctctgctcaaaacaaacatgggttttgtactctgagcacctattcaggctcctgctcttactcattgtgagccctagggctagtcttgcctctgttttctcttttgtcaaatgaatatatgaatctctaccctacacaatagttttaagggtaaaatgagatgagaatggtaaagtgcgtgggagcaaaggaaagtcttgttccagcggaggacaggaaagtgagggtgggttagagcaatcaaggggaggtggtatctgagctcagctttgaaggacaagaaaaatgcccattggctcctgattagtgaggcagtcatgtcaaacatggaacactgtcacctttggagatcagaattgggttggtcagatatgaaaggcagcaagtttgtggtaagattggagaggtaggctgttatgagttgctgttggctaggaagcctcaatatgggagagggcctgtctgagctcttgggcccaggaaaaagtatatgggccaggactgctgcacccctttctaacaatcccacattgtgtttttcagccatgtgatcattctgggtgacctgaatacagcccaccgccccattgaccactgggatgcagtcaacctggtaaggctccctctaggtgcctggccccactcctgactgattctgtttgtccagccaaccaaccctgagtttttggcccagggacagcttcctttatgggaaagcggagcttggcttgcaatactattcttatagtactgaggattggtcattcattcaatagacaatactgactctgcccatggcctggccctgagccacatactgaggactcaggagtcagatccagcccttggctcctaggagctctccagcatggtggtgggctacagacacatggctagccaattataggatggtattctcagggcagaggcacagatggcatcccagaaagctacaggagctcagagatgggattcctaggtgagctcggacatcaggacaggcagctgaaaatggctgaatcttaacagatgagtagaacagagctttgaagtagaaagcattctagcatgggcaaaggtttcaaggtgagaatttgcattgtgtgcatggggaaccacaagtccctttcttcttagtgacacaggaagggaggtgagtggcagaaggtggggctggagagttgttgggggtcagatttcaaggactgtgaattccacattgccttggtcatttccttaatacactgtatttcttgtttatgaactttcagtacctccctgttacctctgtgatgcagagaaaacatggagacctagcattcaaggctctccttggtctgtgacctgtctcttatttccaccttcagtgtccctacacattttgtcctctctagacaggttgtctcctgtcggcccgttgtaaaagttattctcattctggcttttctcactgtgccctgaattggtggacatgaccccctccctgtctttttgttatatgaacctcttatctctaagttcccctaggcccatggttttcagcccctaactgcatattagaacaaaaatatcaatatcttagcactactccagatcaatgaactcagaactctcgagtgtggggccagggtagtggcacgttctaaaagcccccagtgtgactttattgtgcagccaggcttgagaaccactgccctagaatccacaagccagctctcatcttttcttgccttatgtctcacgatgggggatcagtgatttatgctggtacagtcctactcagcactgggcttggcttagagaagggaccgtgggaatattccttgattaattcacagaagagctacataaatgtagatatggctcccagctgggaaaatgagcagaagtgagagaatgagagaatggtggtggtggtgtggtggggagcggagataatgctacaaagtgtgagccttcagtccctccctgcctcattcctcttatgcattcattcagtgtgttctttcagattcctgtgatagcatcatacatctttgtgccttttctacttagttcagaggtatcctagatctcttatgtatacctctttcattttctcctccaggaaaagagaactaatagtgccagctcagatgacttacacagtctttccaaaatagcagaacatacccactttctaccaggcttgctcttttagtcttgtcatttctgtaaatggcaccatcatccccttgattgcttcaacttaaagcctgggaattgtgctagtattgtctttctttcttactccacttcccacattcagttagtcagcaagtactgttgattctagctacaaatcatctcataatttcatgtttctgtctcctctggcacccaccctagtccaagtgaccatcatcttgcttgtgtgactatggcagccatttcctgctggtattctggtctccagtctggtctttcctcaagtcttttgggtacgcagcacactccctccacaggcccagcacagagactgttcttaaagttaggagcaccctccacctaggttactcttactcagcccccacacctcagctccagatcacttctcgaaaggaagcctccttggtccccaggagtagatcaggttcctactttgtccctggcatcatgcatggcacataataggtattccatgaacatttcttgcattgaatgagtgggtgggtaggtggattgaatggatggactgatggatgatggattggggatcagagcctaaggaagtattcagacctggatccttgcaggtcctcagctcaggaggtaggaatggtcattgagggctttgacacactagataaaccaaatagtgccagagggtttaaaggaagaagctgacagtcttcctaactcttaaccccagccctgcttcctagaggcaaacacttttaacttcctgttttccatccttttgaaaagcagttccaggaattgctttgagtaagcaaactttcagatttgccattgacggaccaatgcaagacaaatgcaagctcgtgcagagggaaaaacaagcatggtcttttaaatcagtaaggatgaaaatcagaatcccagctctgccaattccggactgtgtgaccttgagcagtagtcctcttgggacaaccaaattttcttatttgcaaaatgcagcagttagtctaagtcccttccagttctaggtatctagttctgtctctctctcttccaaccccctttcctcctcacctaggaatgctttgaagaggacccagggcgcaagtggatggacagcttgctcagtaacttggggtgccagtctgcctctcatgtagggcccttcatcgatagctaccgctgcttccaaccaaagcaggagggggccttcacctgctggtcagcagtcactggcgcccgccatctcaactatggctcccggcttgactatgtgctgggggacaggaccctggtcatagacacctttcaggcctctttcctgctgcctgaggtgatgggctctgaccactgccctgtgggtgcagtcttgagtgtgtcctctgtgcctgcaaaacagtgcccacctctgtgcacccgcttcctccctgagtttgcaggcacccagctcaagatccttcgcttcctagttcctctcgaacaaagtcctgtgttggagcagtcgacgctgcagcacaacaatcaaacccgggtacagacatgccaaaacaaagcccaagtgcgctcaaccaggcctcagcccagtcaggttggctctagcagaggccagaaaaacctgaagagctactttcagccctcccctagctgtccccaagcctctcctgacatagagctgcctagcctaccactgatgagcgccctcatgaccccgaagactccagaagagaaggcagtggccaaagtggtgaaggggcaggccaagacttcagaagccaaagatgagaaggagttacggacctcattctggaagtctgtgctggcggggcccttgcgcacacccctctgtgggggccacagggagccatgtgtgatgcgtactgtgaagaagccaggacccaacttgggccgccgcttctacatgtgtgccaggccccggggtcctcccactgacccctcctcccggtgcaacttcttcctctggagcaggcccagctgaaccaatggaggcctggggacatctggcatggtcacccctgcacatgatctgaggccagctccccttccctgagctgcctcctgcttctccctcaaagtctcctacccttctcttcctcttttaagccctctcttcctcgctttccttcctacctagctccttgttggtgagcttcttgtgccttaatcctgtgacccagccccttacaccactttccaccttcctgtccgaagtacacggacactagctgccccaggaagttgtgtgattttaaatcacttctgtctttgctggaaagtgtatttgtgcataaataaagtctgtgtatttgtttcagggttgcactttggacattgtggaggtactccataaagttgagtcagagaagctatctcaatacttggtttgccggctggctgtagcccaatgatgtaattc

SEQ ID NO: 46 - DNA, 28672 bp, Homo Sapiens
gcgcgctgcctcccgctctaggacccggatttaaagagacaggcgctccaaccgtcgtgggctgcccgcggcctgtaatgagcaagttccgaggcctacggtgagcgccggagccggagaggcaggtgaggggctacgcggcgcggcacggcgcggcggggcccggcgtggggaaggcagcgggcccggggcgaggagctcggcgcggccggggagccagccccccggctcctcccccgcccgcctgcggagccccggggcacaccctccgtgacgtggcggccctcccgggagcccagggggaggctcgcggctccccgggacccccacggggccgcgtgaggcggggaggccggcgcccgggctgtgttccctgtggaacccacggggccttctcgtaccctggcccggcgtgcgtcctcctgcgctgaaccgggagcgctcgggtgggactcagggagccttgatcacttcccgcctgcgtcccggacccggtggaggagcgctcctttctgcctcgccgggggtcgcggcctacgccgccgaccccactgtccccgccactctccgacagcggcgcgggaagcccttcgagaaaagcggcggcggccaggcctcagcgatttccttctcgggcccctgggctgcggcagttgtgagggtgcggaacgagggacagacgggtttcctcaaagctgcattgtgcctcctcgtggcccagcgcctcccgagcctccctcaagtccactcctttcattattggggccctagaggttgctctgtaaattgatcttctaggaaaagtgttgaaactcacttgttctgacctccttttatgggtctgccgtacttccacttacctcacctctgtggttcttaaactttgggagttatatagccctttgtgaatatcacgaaagtgatagacctcctccaaaaaaccgtgcatttttatcgaatgtacattttgtatacatttttagagagctcagaacagcctccctcccccacaaccagcgcattcatggattccttgtaattttcccaactaccctgtgaggtaggtattatttaccctgctttagaaataagaaaacagatgcagataaattaagagttttctccgaggtaacagtcagtaaactgtacagtcagacttgcactcccatcccttattccaggtccaccagctttccttcacatcatgttgcactacagtaagcaaagcctgctttttattataacgtgacagcaattttgcttcacagcgtgtgcagactgaacataattccagtatacttaaaactaggactataaaatgctttagaaaacatgaatataagaagatgctgatataatctttttccatttggattgatttatgagttcctgtgagtcttgctgcccagtgacttcagcattctctgattcaagttgctgaatgataaacaggttaattgcacatcggaagcctcttcttgaaagataacgacgtcaccgatcataataggagctgacgttaatgagagctcttgctgtgtgcccaactgttttaagggttttactcttagaacagctctttaagttaggccccataattagccacattttacagataaggaagctcaggaacagaggtaagaaacccatcaaggttatacagctggtaagtggctgagttaggatttgaactcaggcagtctgattccaggctctgcttagttgtctctcaatatagggattctaactcaattccaaatctatatagtggcttgatttctgaggatggcatatgtgttaaacttcacaataaaaacttcatgaacataatgtaatttttactggtgattaaaacgaaacttcagggccaggcacggtggctcatgtctgtaatcccagcactttgggaggccgaggcgggcgaatcacctgaggtcgggagttggagactagcctgaccaacaagaagaaaccccgtctccattaaaaatacaaaaaagttagccgggcgtggtggcgcatgcctgtaatcccagctactagggaggctgaggcaggagaatcgcttgaacccgagaggaggaggttgcggtgagccaagatcgcgccaatgtactccagcctgggcaattaaagtgaaactccgcctcaaaaaaaaaaaaaaagaaagttcaggatcttgtaatacttaaaggtcatcatccattatgagtatcatatgttgctgatggcctaaaaagagcttttatgttatttggattttcttcattgtgatgtactagatgtacatgtgtgcattagataattgaacatcctgctgcgagctggcttttcctgtatcagaactctttcatgctgtagagtagactatgaatgtaatactttggaaagtgtttgattagtcatcatggactatataagacgctggcctttggaaaattggaagcctatctccttgtttatatcttttttttttttttttggcctcctactctttcgtacagctatatgtctttggctttcaagatcttctttccacaaaccctccgtgcactcagccgaaaagaactgtgcctattccgaaaacatcactggcgtgatgtaagacaattcagccagtggtcagaaacagatctgcttcatggacatcccctcttcctgagaagaaagcctgttctatcattccagggaagccatctaagatcacgtgccacctaccttgttttcttgccagggttgcatgtgggactctgcagtggcccctgtgagatggctgagcaacggttctgtgtggactatgccaagcgtggcacagctggctgcaaaaaatgcaaggaaaagattgtgaagggcgtatgccgaattggcaaagtggtgcccaatcccttctcagagtctgggggtgatatgaaagagtggtaccacattaaatgcatgtttgagaaactagagcgggcccgggccaccacaaaaaaaatcgaggacctcacagagctggaaggctgggaagagctggaagataatgagaaggaacagataacccagcacattgcaggtaaggtagagaacactgctttctcatcttactggtgctgagagaaaaagggataaggagttcaactgctttctttctcttttttttaactttgctcttttagagatggggtctcactctgttgcctaggccagtgtttaatgttgcattcgtagctcactgcagctttgcactgctggactcaggtcatcctgactcagcctcccaagtagttgggattacaggcgcatgccaccatgcccagcctttaacgttttatttggaaataattttaaactcactgaagtgttggaagattaaaaatagtacaaagaacattcatattccttttacccatatttacctattaacattttactctatttgctttatcatatttgttcatgtgctgtctctctctacatacatacacacgtgtgcgtgcactcactttaaaccatttgagaataagttgcatacatcatggccctttaaaattcttcagtgtatataccttaagaataggatatatgacccttatgcgactataatatagctatcatcttcagaaaatttgtccttgatgtaatacttaaatctaccatctgtatactattttgtcaatggattgagtcataccttcagtagccttttcctgcagtataggatcccagtctaggatcatatcaggtgttgcatttagttgtcatgtttctttggcctcctttaatctgaaatatttccatagtctctcttttatgacattgatattttggaagaatagagtactgattactatcctcttttactttttttcttgtagcatataattcattactgtacttaactaatttgatacttaattgtcccatatttggccaattaggaacccctttacactgtcctctgtgtcctgtataccttcattaactttttttaatgtacttctttactcttgagcatagcaagatgcttttagtcttatcccgtatgtatccttccccagccctgaaattggtaatttctctggggattcctgttagtgggaaatgcccctgttaaagagtaaaacctggatactatgtgtccacattgtcatggggtatctgtttcttcttttttttttttttgagagtctcactctgacccaggctggagtgtagtggcactatcctgttagtgggaaatggtattaaagagtaaaacccggatactatgtgaacacattgtcatggggtatctgtttcttcttttttttttttttgagacagagtctcactctgtgacccaggctggagtgcagtggcactgtcttagctcactgcaacctctgccttccaggttcaagcaattgtcctgtctcagcctcccaagtagctgggactacaggcacttgacaccacacccagctaatttttgtgtttttagtagagacagggtttcaccatgttggtccagctggtgttgaacccctgacttcaagtgatccacccaccttggcctcccaaagtgctgggattacaggcctgagcgcccagccatggcatgtctgtttctaagccctttcagcagacagagctagaaaatatgtgcgtgtatatgcatgtaaaattcatacctatatatggctatatataacatgtttgcatgtacatgcatatttacatatgcatattttagaaattttatgccaatacccccaaatccagttagtcctctttgaccttcagtgtctgtaaaataatgttcatatcttcaacttagttctggtcaccataggaagacagttaacaatggctctaaaaatgggtatctgtccttgttctttgaaaggaaaaaagacttccgggaaagaaaactgtgcttcccatatactttattctcaggctccccatcccaccttgcactgccttagctattggcctcggcctttgttacttcttgacccatctctcatttggaggaagagaaatacaggtagagttcatgactcagataactaagcatctggaaattttccttcctatgctaggttgacatgctctgtgatcctcatttactttttgttcatctctaaattgaagctaattctgtggggttgggggttccctaagttttatccatcaaactatgatttctgatttcccccaaattgttatttctggagacttacatatgggataagaagtggagaatgttgatgaaaatttaaggtactaatagagataaatggtaactggatcttttgtctccagcatatccttcccttctgtccccacaataccctattacctactacccccactcaaaaaataccagccaccagccagccttgggctagtgctagggtagtgacttaacaagcaaggccctaggagcagttgatagattctttggatgtttttttcagagatcgttcactgaaggatattttatactcttttgggatcctacagatctgtcttctaaggcagcaggtacaccaaagaagaaagctgttgtccaggctaagttgacaaccactggccaggtgacttctccagtgaaaggcgcctcatttgtcaccagtaccaatccccggaaattttctggcttttcaggtaagataggttagggctactttagctgttatagtgctgcttttattttgtattctacctaggattctggctaaagagtgaaaattctgtgctatctcatctcattaataatttgcttctgtctgagcagagactggtaatggctaattctaagccttccgcttggtttttgtttgtttgtttgttttttggttttgggggtttttttgagatgaaatcttgctctgtcatccaagctggagtgcagtggtgcattctcagctcactgcaacctccgcctcctgggttcaagcgattctcccacctcagcctcccaagtagctgggattacaggcacctgccaccatgcctgactaatttttgtatttttagtagagatggggtttcgccacgttggccaggctggtctcaaactcctgacctcaggtgatccacctgccccagcttcccaaagtgctgggattgcaggcgtgagccactgcgctcggccagcattccacttgtatagcatttctttgtatactttaacctctatcgcagcggaaagatttgttttgtcaagactttttccccttgaaatagttacctgggccagacagagattattagaacctgtcttttacttccttgtgttttgataatgaaagaattttgagaaattgtttccctgaatatgcctagaaatgaaagtatgaaagaagggagatgtcatgcatggatctcccttcttgattcttaaaactgtttattcaaaacactggaacttcatggaacacaaaggaaggaaaaaaagatctgaaggatattgctatttgttgggaggcagtacagcctagggatgaagcttgcagactttggaatcagtgagctctgggttcaaatcccatctcctaaaggggaggactgtggctattatttgtaggacagatgaacaataaagtgttaagtttcctgttctcttcactaaaatacacacatgcacacacgtgtatacacacatatatagtttcttttatataaaatatagaattactatttcatagacagggattcaggaagactttgctggggcatgtggtatagataggagttgagaagatcaggatcatttattggccttacgtaaacagacagcattggactaggggcttttatatatgtagtttcatttcttcttcagttaaccctagacagtacttttatttaggaagtactttttattaggccctttttatgactgagaaagttgacgttcagggttatcatggagttagtatttgtactgaagtctgacttcagtacttgtgctcttttatactacactgtgttgctgcttttattgtttggagacattcttgtgattgactcagctgaagaaaataaataaagccaaaccacttggccttattttagaagtcatttggagattgaaagacattttatgtgattgaaagaagcctagacctgaggtcagaagacttgggttctggtccttgacagctcagatccctgagcacgtccttacctctctttagcctctgtctatgaagcagcagtggcctctcctaccatagtgctatgcacagggtgctataggagcacaggcagcaatatatagattactttcccctctgcttcagtgagtttgtgtatttatttgtttaagcttcatcatatctccatgcctcatctaccccatagtgttctcatgaggactgtaagagataacattgcaaaaacggtgcctggctctataggatttttattatttaaaaattctgggccgggcgcggtggctcacacttgtaatcccagcactttgggaggccgaggcgggcggatcacgaggtcaggagatcgagaccatcctggctaacacagtgaaaccctgtctctactaaaaataaaaaaattagccgggcgtggtggcaggcacctgtagtcccagctactcaggaggctgaggcaggagaatggcatgaaccctgggggcagagcctgcagtgagccaagatcgcgccactgcactccagcctgggcgacagcgagactctgtctcaaaaaaaaaaaaaaaaaaaaaaaaaattctgaggttggttggtttgttgtttgctggtaggccaaagatagagaagagtccaggtgatgataaggacagcatgtttctggaagggctccggtgttggggatggaatttgggaggagttgagagaaagagagtgttttagttcttgcaacctggttgaacattgacactttggagattttgtcccctaaaatcatatttagattccggatcagagatgaggatggatttataatttacaaagcccagacaagaaacagtgtacaacagcagttagcttagtaatggctctgccacaagtttgccgaataaaatttgctttttaaatggtcacaaggaggtgaaagggaatcaccgatgagttgcacataattatttttaagtgtctggaggaaatccctgccccttgaccaccttttgtaaaaatgtattattttttttttataactgctccttggggagcagggttttattttgacaataagaaaagaaaagttgaagcagcgaggggtagggatgttgagtgtactaatggaatctgactttcttagtagtgtctttgtcctggctctttcaacaaggaagtgggccaggaagtcatttgctcttctcagacctcagtccccttatcagtaagagaacattgaactagataatctttaaggcttcttccagctctgacaacctgtgatagcagtaatttcacattgtctaacacgtacttgatttcttacccctttctcatgccagcttttctgggatcagctttacaattgctctgagatccttctgaccactttttttttttgaggcaggatcttactatgttgcccaggctggtctcgaactcctgggctcaagcagtcctcccgcgttggcctcgcatagtgttagggttacaggcgtgagccactgtgcccagccagtcctgatcattcttggcatgactttggtctttattcttcagtaaagtgctcacataaagagatgcacatcagtctggtcttttgcttgggtctaaggaggccattgttcctttaacattatttattagctgtaagatttgggaaaattacttggcctccatttctttatctgtaagatggatataatgacatctaccccaaaagtctattcggggagattaaataaagctaaataccagcagaatatctgttagtttccttccttccctttctttcttctcagaaaggcagaatgaattcatctctgttgtttctccaacagccaagcccaacaactctggggaagccccctcgagccccacccctaagagaagtctgtcttcaagcaaatgtgaccccaggcataaggactgtctgctacgggagtttcgaaagttatgcgccatggtggccgataatcctagctacaacacgaagacccagatcatccaggacttccttcggaaaggctcagcaggaggtgtggcatgagcatcctgaataggcctttcctccggagagctcaaggccatggctgccttcctgggcatgtgagctgtatagttgcccgggatcccatgcttggtttaatgctgtactgtagtgctatctggaaattcttaataattttgaacaaggggcctcgcatttgcattttgcactgtactccacaaattatgtagccagtttttctcagagcactttggcatctgtcttcctctccccttattctgctcctaggaggccagaagaacccatcctatttgactagttagaaaatttactgtcctacatatttaattaggtttttgtgaaccatatacacagtttggaatagaatcttccaactctgtttctttcatttatctaacaaattgtcgatgagcatctctgatgtccttgtcactgggcacgtgaagtgaaactaaccactctgtccaacaagagttcatctgtaggctaaaggtgaggcagacacaatccaccagcctctgaactccatgctgtctcctactatagcgatatgcacagggtactataggagcatgggcagcgatatatagatatcttttggtctctgcttctttgagtttgtttgtttgtttatttattgagacaaaaaatgtggctgtgttgcccaggctggagcgcatgggtgcaatctcagctcactgcaacctccgcctcctgggctcaagcagtccttctgcctcagcctcccaagtagctgggactataggcatgtgccgctatgcctggctaatttttgtattttttgtagagacggggttttgctgttttgcccaggttggtctcaaactcctggattcaattaatctgcctacctcaacctgctaaagtgctgggatcacaggcgtgagccaccatgcgcggtctgagtttatttttttatttatttttgtgtgtgtgtgtgagacagtgtcttgctctgtcgcccaggctggagtacagtggtgtgatcacagctcactatagcctcgacctcctgagctaaagcaaccctcctgtcttctcctgcaagtagctggaaccataggcatatgccaccatgtccagctaattttttaattttttgtagagatggggtctttctttgttgccagggtggtctcaaacttgtgagcttaagcaattctcctgcttcggcctcccaaagtgctgagattacaggtgtgagccaccttgcccagccttctttgagtttatatatttatttgtttaagctctatttctcaagaagggttccttctgtctccagatggtttccacggtgatgtgtacctaacagtgaagctgctgctgccaggagtcattaagactgtttacaacttgaacgataagcagattgtgaagcttttcagtcgcatttttaactgcaacccagatgatatggcacgggacctagagcaggtcagaggaacgggagggagggtaggctacattccaggtggggttttgccaagccaggcacctgcagcctctttttttttttctggttgggacacatactgttttaggaaactgaaacccatttgagcaagcttccgttatagggggagctgaatgtgaggctatagctcttaatttcttaagtttctgagggtggaaaccatacaactgctgaaccacaaaggcctggttctcaaaaggcagaatttgagacttgccccctctgtctctcctggggcttttattctggactctttttttcttgcttgttttctcctataacttggctttaccaagctttggtttgtccgtgactctatccctggtaccatggcaagtttccatccccttctaggaattgtggatgggctagtgtctctaagaagtgggctagatatgttgagttgggataggagctatgattgaaatttcttgattcatcttcagtcctgggtcttgggggatacacttggccaccctagggttgcagcagtggcattttggtttttggagacagggtgacgtgtcagagacaatcagagtcttctttgagcagagcaagtctttccccccagctgccaagagcctccttaccatccaggaagtggatgagttccttctgcggctgtccaagctcaccaaggaggatgagcagcaacaggccctacaggacattgcctccaggtgggggagctgcctccgtcaaaccatgcccatagagagatgaactctcttgggaagggaaggttcccttggggttccagagctcttcaagaccaagttaaatgtgcttcatccccctaggtgtacagccaatgaccttaaatgcatcatcaggttgatcaaacatgatctgaagatgaactcaggtgcaaaacatgtgtaagtagcagctccgctgacagcctgagctgtcatttgttagctttgtttgttcccaactggtgtcaggacttttgagtcccagtcaggatttgaatcccccttccaccttcttactttctgtgagaccctgatctgtcacttgacctgtctctgcctccattttttcccatataaaatggagataacagtacctttctcacagagttcttacagttgaagtgtggcatacgttcagtgagtatagtatgagtctcttgcctactccagccccctcctcgctaaggcggcatccacataggcacagtatctcaaaagagctgaattttccaagagctttctctcctcttgtgaaagtctttagacaatagaacacaaccccttccctacagatgaggatttcttctgtgaggacagattgctgtccaaagccatggagtcaaacaaaggcagtggttttgtttccttgttcctgtaccccttggcaggttagacgcccttgaccccaatgcctatgaagccttcaaagcctcgcgcaacctgcaggatgtggtggagcgggtccttcacaacgcgcaggaggtggagaaggagccgggccagagacgagctctgagcgtccaggcctcgctgatgacacctgtgcagcccatgttggtgaggagtgctcccctgcctctgctttccagcctctccaagctccacatcctttgggctgagatcagatagggtatgagtgttgagagcacttgcaaattgactggagaagtttagggaaggaagagggaggtgcaagggggtatttctctgtaggaggcgaaggcaaaggagaagacagaggatctagtggaaagacctgagttgtaggcccagctacgccaccaagatgctgtagaatcttagatgagtgacttgcctctcttgtccttcagtctcctgtgtggatgacgtctgagactgcctgaggcatccccctagaatgatttatctgttatcttacctgaagacggatgtattaagtaacccctgagattctgtgacctactgcaaagtagatctgagagttggtagcagagccaggcttcctgtgacagggtgacttgggaagagggaggacacataaggaatgaaggctgactctgacagacatcatcttaggcctctgctcatttcgtaagaaatggggtttcctttccagtgttggttttcctgtgtgacagggcccaccacatatggtgccatgcctactgtgagattctttggatttttgagtgatgtacagtgctttttttgaaactgtcttgtttgtcatactaaaaccttggtttagggttttatgtttgagataggcaagtgttctctccctgctaggaatgtgggatagccagcatcaaaacagtgagatctccatcccagagatgggactgcggccacctgcagtagtggcctttctgacttttataaaaatgcctcctggagtctgttctatagtttgtcatttaaagactggcatgggttatatagcttagtggttaaccacacaggttttataggtgggcctagattcaaatctcattcttgccattttttagtgtaacttaagcaagcacctattctctctaaccttcagttttatcatccaaaaatgaaaacaatatttgtcacataggatgtcacatcggggatgaaatgagattatgtatgtgaagcgctcccaaaatggtagctattgttgtttgagttaggctagcacaggtaggcatgtaagtaggtgctccaatatctggaaaccctgtttgttgtagggacccacgatcactcaccctgccagcctcactgtcacctgcactctttaaccttagcttcacatacctcttttactgggagaactgatgtgttttataataagccagaggtcttgcaaggcctgaattattgagaaaagaattaaatcttgtttcactgggcttttacttgttgtacaatgaatagcattcatattcctcaaaaggcaagctcctatgtcagctcaggtgattatttcataggcagaatacaacattgcccagccctttccgttcccatcacctcttcaccagccttccctgagcgttaattgtgggcagtcagtcccaagacccaggtaactaccctcactaacccagttgcaaggtctctggctgtcgctgcttagcagcccctcattgaaagtctccaggctttgctttccccaccccaaggcggaggcctgcaagtccgttgagtatgcaatgaagaaatgtcccaatggcatgttctctgagatcaagtacgatggagagcgagtccaggtgcataagaatggagaccacttcagctacttcagccgcagtctcaagcccgtccttcctcacaaggtatgagtgccttcctttctgccaggaccgtctttcccctttctgcctctaacaacctcagggccagagtcccatagccattccagctgtggtacacaataagggtttgttttttatttgttgaatgaattaattcatttattcatttttggagtcttcccataatgaagggctgctcagcagggagagccaaagagccctgacttgggttcgtgaggatagagctccctggaacagtgatacttcttttgcccacagtgatattgggacagtgagctcagttggtgagttgctgtgtgtcttttgtgtttccatgtcccagatgcttcctgtgagctagactaaggcttatataccaggggctattgggctgtcattcattaatttgttcaacaattatttatcagatgcttacccattgttacagctggtggggatatagcagtggaaaaaatggacaaaagttctggccaccatgaagtttacattctgatgtaaacacagtcttatggggacatctaggagcctagattcctgttctaatcaggggtggcatttggaaccttattccttagcccttctccactcccaaggatactgtgagcctttgggagtgtcttcagggaaaagcagctggaacatctggctccggtagcttgtgagcagatggaattcctatctttgctatccttttctttcctaactcagactcagtttttcagagcctcagggggttcaggggaacatgttgtgtggcctgtgcttacctcagccttgccttcctgctggagcattgggaacaaagcagtcaggccatttgtttcatatgttcaagaggaaggctaagcagtggcctcattgtggagctttaatgcaggttcacgtgttctgtgaagcactgcaaatcactcaggagctgtttctggtgaggttggtgttaaatagacaccatctgtgacccaggaagaagtctgagcacacttttccagatttagtcctttccttaattttcccttacccagtattcactcatcctttgcctctcctgtgatttgggttcttaaagggctaggttagggattgaaggggaatggcatggatgtgctggcctttcctgttcctgctctaagcatcctgggtagtgatggctgtgggttcagggctcccactcagagaagacactgctcaagtttccttgctgcacctgagggagttcatttctacctttctggtttcaagtagtctgttctcccctaatccagtccccagcctgatagtcacacatcttctgcagtaggcactaatctctgcccacctaccctcctcctcctcccccgacaggtttaatctgtttcttccattttcctcaaaaattgtaccttctctacagcccatagaaagtgacccagcatgggttgacctcttcctgggcccggacagaagtactgaaacagatggcctctccctcttgtccaggtggctcgcaaggcctagctatatgttttgcacattagctgggccttccacatgttgttctatatcctgtctgggcccgggctttgccctccatggcatggtttgaggtccctgctgccatgtcatccctcaccaaagctccccttctgctttcaggtggcccactttaaggactacattccccaggcttttcctgggggccacagcatgatcttggattctgaagtgcttctgattgacaacaagacaggcaaaccactgccctttgggactctgggagtacacaaggtactagctcagggccatatgtgcaagaatgaatgagtgtgagtgagtatgtacatgtgggtgcacgctgcggtctgaaaagggaggaaatatcccttagtgtggcccttattcttcgcttctgacctgtttctggtttggatttttgtcttttgtttttctcctaaaaaggggctggtattgggaaccagtttataactgggttggtttccatttagcactatctgctcagtgcccttatggcccaggggcttcagagcagaaatagtactttttcatccggtgcctcagggggcctccagaagtggactggtactccttattttttcacactgacttttgtcctatgtgtacctactacctcattttcccttacagaaagcagccttccaggatgctaatgtctgcctgtttgtttttgattgtatctactttaatgatgtcagcttgatggacaggtgagttggctagcatctttaaacccagaaactgccaggaatctgttttcatttcctgggtgaggaagatgggggcttcaggttggaaaggagggtacagggaaccagctggcacatacgtttgtgctcaggagcttgccaaaggcaatggcaagagggagctgagaggaagcacaattgctacatgatcagttccccattcagtgtaagaaagagcccatgtgttgactccatctcttctctgagagcttaagtcacagaagaaacccaaacccccaaagaagtttctctactaaagcaaaatggactattgcagagaaatagactgtgagcatatggggtttcagtttatttctccaatggcacccctaggggctccagtggcacccctgggggcataaggcagatggttttcagctcagaggttttgatttcagaagagactgacaacaggaagctccggattataggggaggccatgggtgggaccatcttggagagaattagcagtcttgacttagctgcatccatatgcttgtgcctgagaaaccagtatcagccctttcctcacttagaaatgtatctctacccctgttcctcctgcaacagccacatccttgattggggaaggagaaggaagtagagagggaaggaattggtgggggtaggatttggggtttgggtcccaaggcctgtctcagcctgcctaccccggggttggccttgggatcggggcaaagcagggtgcaggggataaaaaatgagagttggagtcgtatttcaagtgggaccagaatttatacaatctgggctacaggccagttctcccttggctcgcttgatgaagtagaactaggaactacaactatgaactggctctatgccacagctcacaattttccatcttcggtcacgatggagcccttgtagcccttgacagcagaactgttacacatgaggtctttgatccatggcaaaccctttcttgaagtagcagttttatcattgtggcccttccttcctcagaattcctaataagggagggaggatcccggcctaacctcagctctcctgttctcctcagacctctgtgtgagcggcggaagtttcttcatgacaacatggttgaaattccaaaccggatcatgttctcagaaatgaagcgagtcacagtaagtgaagaccctatgctaggcagtgtcctagaagtttgaaagcagggcagagaactccttgggtcaactgcgactggaagaataaatcttaatgtcttatggagcctcctgataatgttggcctttgactattgcatatgttgcctgctagtcttcacccagaagggtagggcatggaaatccttcctaggtaagcctcctgtgtttcaaagccacagcagccctctgtttgggatgagaagcaacctgctttctaaccctttgtcccttatatttcaagtaagggtgtttccagtggacacttaactagtgtgtgaaaaggaacaacccccactcactcaccaccttctccactctcacaccaacttcagcatctctcttgtccctcagaaagctttggacttggctgacatgataacccgggtgatccaggagggattggaggggctggtgctgaaggatgtgaaggtaaagtggcctcgcttggcttctcctgtcgactcactcgcagccctctcccctgagcctttccagccctgaccaggagatggcggtggcagcctgcagtggttggggtggctgctggggaagtgtgggcagatgtgtcctggatctggaggactgctttgtgtgtctcctatagtgcctggagcctgagggctcttaccctgagggaggggcactgggctagatctggtgtgtagcagtgaaggggtgaacccatcctcatggagttgcctttctattctgtggtctctcttttgcttcccttcagggtacatatgagcctgggaagcggcactggctgaaagtgaagaaagactatttgaacgagggggccatggccgacacagctgacctggtggtccttggagccttctatgggcaagggagcaaaggtcagggtggcctctgccccctggggtggtactgttttagaaggtaccgcttgaggtacaggctggccttgttactggcttgatctgccagcatggccagttatgacttccgaagtcctaggatctagggccccaagctggcctgagtcacctcaggcagagctgcttactcggttagggagaagtcagaatagagtaccctatgctagcctagcagaaggacgcttaccaccaattatttcgtcagggcctgacagctttctcctcaggcaaaatctctttcctgactggaaaggaagctggagtctgaggaactaatacttttaagcaatctatcatgtgtccaacacagttcaatgccccagagcccaacaggttgggtgtgattatccctcatttacagaagaggaaattggggcttataaaggttaaaattacacagttagtaagaggtagctccaagaggtaaactctggcactctgacggccaggacccaaggtcctctccctggccctgggctcttgggactggcagagatggctcctccaacccacactcatctcacactcccctcccaggcggcatgatgtcaatcttcctcatgggctgctacgaccctggcagccagaagtggtgcacagtcaccaagtgtgcaggaggccatgatgatgccacgcttgcccgcctgcagaatgaactagacatggtgaagatcagcaaggtgaggaagggacctggttggccatggcctctggactggccgccatcactgagacagaggctgtgctttggggactacaggtatttctgtctccccagaaagaagggttgcagcttgctcaggggagcaggattaggccttataatctctgaatgccttcttgtggaaaatggcttgcatgcctctaggtcatacccactctgggctgggaggatcacatggctcaaacatcagctgtttaagtggcttcttataatctcattaccaagagaagggatttaagccttgttccaggttgggaacagcccaaagtagcatcttttctcctctaggaccccagcaaaatacccagctggttgaaggtcaacaagatctactatcctgacttcatcgtcccagacccaaaggtatcaacccagtggcttgggggcctccagctcatagaattagcttgcaggttctctagtgccatagagaatccatctcacctcgctgaaagtccacccagggataggggtctggatttccagctgagtgataggcacagggacaaccagacaactctgaggaattttgaatagaattctttctgcaatacaattgctttaaaaaaagagagagaagaagagagtacctatcccctcagcacaaagggtgtgttctagaagtaatctggcccaatcccttcttgtaccgaccaagaaagagatctagagaacaaacaggacttccctaaggttattcagcaacagcagcagcagaactaggacccaagtttcccagctgttagccaaagcttttttggtttttgttttgttttgtttttgagacggagtttcactcttgttgcccaggctggagtgcaatagcgggatctcagctcaccacaacctccgcctcccgggttcaagtgattctcctgcttcagcctcccaggtagctgggattacaggcatgtgccaccgtggccagctaattttgtatttttagtagagatgtggtttctccatgttggtcaggctggtcttgaactcttgacctcaggtgacctgcccgcctcagtctcccagggtgctgggattacaggcgtgagccactgcacccagccgcctttttggttttaattgttctgtattgcttctagctggttgggagatactttttttttttttttttttttttttgagacagggtctcactctgttgtccaggctggagtgcagtggcatgatctcatctcactgcagcctccgcctcctgggttcaagcagttctctcacctcagtctcccaagtagctgggattacaggggtgccaccacccccagctaatttttgcatttttagtagagatagggttttaccatgttggccaggctggtctcaaactcctgacctcaggtgatccacctgccttggcctcccaaagtgctgggattacagatgcaagccaccgcgcctggccaatacttgcttctccctttttttgagacagtctcgttctggagagcagtggcatgatctcagctcactgcaacctctgcctcctgggttcaagcgattctcatacctcagccttctgagtagctgggactacaggcgtgcaccaccgtgcctggctaatttttgttattttttgtagagacggggttgcgtcatgttggccaggctggtctcaaactcctgacctcaagtaatctgcccacctcagccttcctaagtgctgggattacaggcttgagccaccacgcccggccactgatactatcttcttaaccagtgatgacctgctggcttactcctgacagaaagctgccgtgtgggagatcacaggggctgaattctccaaatcggaggctcatacagctgacgggatctccatccgattccctcgctgcacccgaatccgagatgataaggactggaaatctgccactaaccttccccaactcaaggtagcagctcttaggctgtatatgtattctccaccccactgtccaggccttggagccttgggcatctagaccattcacatgtcctctgtcttctcctttcccccattctcctgaggcagagcaaggagggcaattagagagggagacaaactgctgctgggccaggggcacagcactagacctccttctccctccatctctgagtagagaaccttgcatttgcaaggccccactgagcagcctttagtctggggaataagagtttgctcctgttgccccagcaaagcctgctttgctgtacagagaacaatgatttgtaccctgattactcaggctatagggccatactttggaatggtgccaagggagccaactccttttccttgctctttatctttctcacatctttgttcccatatgcgcctaaaatacaccacacacaccacctctgaggccagactgggaaggcaatgaaaccctctgacattgtccctccccgcctcaggaactgtaccagttgtccaaggagaaggcagacttcactgtagtggctggagatgaggggagctccactacagggggtagcagtgaagagaataagggtccctcagggtctgctgtgtcccgcaaggcccccagcaagccctcagccagtaccaagaaagcagaagggaagctgagtaactccaacagcaaagatggtaaggatagggagggggctggtatggtgaagagggcggtgtgaggggcagagatccaagggcagggacccagtctcacattccagccctgagatctcatgattatctgtgtccactgcagtggacacagactacattcctggtgtgtgtccagccatgggccagagacccttctgctgggcaccctgtatctgctcagcaaacctgaatggagcagtaccctggggacagccagtctgaccagggaataagctacctttgagtaaagggcttagctgataactcttcactcccctctcacctatgctcatagcagagaaagcccctggtccttcccattactgcccctgacttcagggagcattatcagcaatccctaccctcttagttcttttgtatcatatgttttttagagacagggtctcactctgtcatccaggctggagtgcagtggcacgaccatagctcactgcagcctcgaactcctgagttgaattgatcctcccgagtagctgggactataggtgtgcaccaccacacccagcttcctctctgtcctgcaggcaacatgcagactgcaaagccttccgctatgaaggtgggggagaagctggccacaaagtcttctccagtgaaagtaggggagaagcggaaagctgctgatgagacgctgtgccaaacaaaggtgagggtaaaaacagcaacacaccacgtgggccagtttagcccaggttgtgttcccaaccttctgtacaagaagtttgaaagaggatgagcaaaggtgtttggggaacatcggctaaacctcttccctgcctgcagccactcctctgtcgtgggcagggtcagcaatgctgctgctcaccctatgtcctcttgttgccttgcagaggcggccagccagtgagcagagaggaagaactgtgccagcaggcaggagatagaacagcccggcctagccaggagagactgcagggactcactcagctgctggccccaagtcaaaatttacattaaagggaaaagaccagtctgggtgtgggaatgcagcattgagtttgtggtcagggtggaagcaggtccagcaagcagcgagtcggggagagggcactggcttggtgactctcctcccacctgaggagccttttccctgttacattttcttgtcagtcttgggtttggcaacatctcctgagcaattctttttttttttgagataagtctcgctctgttgcctaggctggagtgaagtggtgcaatcacagcgcactgcaacctccgctcactgcaacctccgcctcccaggttcaagcgattctccggcttcagcctcccgagtagctgggagtataggcatgtgccaccatgcccggctaatttttgtatttttagtagagacgggatttcaccatgttggtcaggctggtcccaaagtcctgacctcaagtgatccgcctgccttggtctcccaaagtgctgggattacaggcctgagccaccatacccggcctcttttgagcactttctgatgccaagaactaggtttagtactggctcaactctgggggagctgatgcctcaaaggacagatagagaagtaaacatatgattgacacccatgtcattgcgcccccacgctccccaccgccatccaggagtaagcatagaagtctcacagcacaaggcctgaactcggtccccaacagacctgtagaaacctttcccctctctcttcccagcctgaagtccttgaacccattgagagtagtaagcaggactcctgacccctcagtctagcaggttgtacagagtagactgcttggtctcaggggacatcactgagtctgggggcactgagtcagagccagctccgcctgcccaccatgactgggtggctcttatacacatgtactcttcccatctccaggtcccagatgtcgaggcctgtccactctccttttcccctaggcagggatggaggggcgtgtcagtcctgtataatttggagtgactggaggggtgggggtattgatgcatggtattccagtaaacttctctgcttgtgtcctaactctaggctccctcattctgtcccgtgctcatttgggtgaagacccatctgtacccagtgtaggtctgaccccaccctgacccctctgcatttgcaggtattgctggacatcttcactggggtgcggctttacttgccaccctccacaccagacttcagccgtctcagacgctactttgtggcattcgacggggacctggtacaggaatttgatatgacttcagccacgcacgtgctgggtagcagggacaagaaccctgcggcccagcaggtctccccagagtggatttgggcatgtatccggaaacggagactggtagctccctgctaggtttgctgtcttccctctccctcaggccatactctcctttaccatactactggactggactcaggctggaggcagatagacacagtatagggggaatgggcttgcttctcccaaacccaccagttctccactgtctcttctggaccaggaattagttgctgtgggtgccacagctgaagtcagtttgtcttgctggtttaaatagatctttcagagctgggtgctgggtttgccatctttttgttttctttgaaaagcagcttagttaccctttttataaataaaatatcttgcagttatctttgtcctttccccacctacacccccaataatttccctagagattaaggagtaaaggctgggctatggcagctctgtccacaaagccttctctcccatccttgcctgttcctttgtacttccaggctcattttaaagttgtatttaaaggactgccctcggaaatgcttctgtttagcggaacttgtattcagcctgacacgctttgccaggaacaaacctcatgtgaaagaaaacaaaatgaatttttttactttcttctctgtgttctcctattacatggtgaggatccccagtttgaagggaggggactagggtcaggtaggaaaatggggcctttatgaagaaaggggaggttatttgggccactcctctggagggatagagggctccaggaagatctgcatccccaaaacctggaaacaagactgttctttaagaataaaaatccacatggggcttgaggccaagaacagcccttgttgccaccaacatggagactttgtaccatatcccattcttagtgctcgagtgttccaacctgaagttgaagaagccaccctggctgcacatgccatcagccatgactgtgtatgctctggtggtggtgtcttacttcctcatgactggaggaataattatatgatattgttgaacccccaagtattggctgatgaacgtgggcatcagaggccagtagctttcttggcctacaaagtaaatggacagtatattatggaaggatttgcatccagcttcctgtttacaatgggaggtttaggtttcataatgctggaccagtcgaatgcaccaaatatcccaaaactcaatcgattttttttcttctattcattggattcgtctgtgtcctactgagttttttcatggctggagtattcatgtgaatgaaactgccgggctatctgatgggttagagcgcctttaagaagaaatcagtggatactggatttgctcctgtcaatgaagttctaaaggctgtaccaatcctccaatatgaaatgtgggaaagaatgaagagcagcagtaaaagaaatacctagcgaaaaaaacaggaagcatattgaagctcggactagaatttcttcttggtatcagagagacaagtttatcacagtatttttttttttcctgctgacctattgataataccaacaatgttgagtggcattttcttcttagtttttaatttcttaaagaaaatatactccatatctgcagggaaaaaaataaaaatccacacctgagaacagatccatacaacctgcttacaaagaacagctcctgtgctacctgaggctgatttatttgaagaacaaaaggaagagagacaatttagtgtagacaagtgctattcaatagaactttttgcagcagtggaaatatccataaatctgcagtatccaaccaaactagccacagacagctgctgagcaattgaaatgaagctggcacaactaaggaactgaagttcttattttaattcaacttcaaatggtcacatgtcactagtgactaccacactggacagtgcaggtgtagacggagttcagatcagactcctgaaacttaatggctctaaccttaggcaagttacgttaacatctaagcctcaatccctccaagtagaatgggtgcacctaaatcatagggttgtcctgttgtcctgagcaacattatgtaaagcacttagcccagagcctagcacatagttatctagagttgggaacgtcactcctggtgtgcatgtccagaccctacccgggagaagggcctaacctatgactttagaaccctcagttgcaggtgtgcatgttccagccaacactccactctgagtgcaggctcatcaggacaccatatggttgtaaactggctgccatgtcccaatccttccagctcttgagggtcagttctcaccttatgaacaaattaacaggctctggacctataagatcaaggaccactgcgccccctggccaccccaccgcccccccccaactttgatctgattgactttggcttccacctactgtttaaaatgtgtatgttgggggagtagggacagcacgggggaggggtttactttcctgactctagcccaggacatttggtgtttttgaataggcaccattcagccttgcttcagtattaggaataagatactttttattccatcctctatggagacaaaaagctgctcctcctttgagtactgacctacatagatttccatttctctcttcagcctcaggccaaacaaacaaccggacagggcagcagaacaaggctgtctcctcaggatcctgccaaaggcactgtcctctccaacctggacccagccccacttgcccttattggttgcttacacccagagtgcacactcacaggaaagggcctctgctggctgcaggtgatcatcttgtcccttctctgccttagtgtgtgttattgccatttcaatgtcagtggttttttatgtattttcttccagtctttgctgctgagatctgactgtatatactattttgtatcctttcatgtatttctttcatgtatttcaatgcagccctcaacatcatcatcataaatctctccagcagaatgctggaggcctccctcttctgaacctctacatgctgctggctggcatcaagcagaggtcatcactgggtgctgaacaggtcagctccctagggcaatgtgagcaaagtgttgtggctcatcctcgatcctttatgcccttttggcaagattcctttctcttctcagtcacagcagatggacacataatcttgttctcccaggggctgcattctcagtagtcttttccctgctccttgggcgcctggtcagggaggtttgtacaagcctgcgcacacacagcagtctgtcacgaggctgggccaaccttttttttttttttaaacagactcttgctctgtcattcaggctggagtgcagtggtgcaatctcagctcactgcaacctctgcttcccgggttcacaagcaattctcatgcctcagcctcccaagtggctaagacttaacaaacaggcacacaccatcactcgcagctaagtttttgtatttttagtagagaccacgtttcgccatgttgtccagactggtctcaaactcctggcctcgagtcatccacgcacctcagcctcccaaagtgctgggattacaggcgtgagccatggcgcccagcctgggccaaccttttctgagccatagtccagctgtactacagctgtatccaaaaggtaccatgtatctcccagggtaacctgaagacctaactgggcatactaactgtcctcagatttcagttctttaaggcccatctcttctagatcagtgtaaatatctgaactcacttggtgcttcaacccaattggtcttgggattcatcctttacctacccagctctcattctcttctaggttgttccatggcctcttccatatattacatttgtggtcttgagcaagttagttagttacaacaacactgagcatcttgaccaaggtcacttggcccaaccacaggctaatcccaggccatgtgcacatcccaggattagcttgtggtttatcagttgtcaatttttttttttttttaatacagggtctcactctgtcaccctggctggagtgcggtggcgatcagagctcactgcagcttcaatctcctggctcaagtgatcctcccacctcagccttccaagtagttgggactacccacatgcaccaccatgcacggctaattttttggtttttttgggttttttgtttgtgtttttttttgttttgttttttgagacagagtctcgctctttcgcccaggccggactgcagtggcgcaatcttggctcactgcaagctccgcctcccgggttcacaccattctcctgcctcagcctcccgagtagctgggactacaggcacccgccaccacgcctggctaattttttgtatttttagtagagacggggtttcaccgtgttagccagggtggtctcgatctcctgacctcgtgatctgcccgcctcagcctcccaaagtgctgggattacaggcgtgagccaccgcacccggcccttgtttgtttttttaagtagagacaaggtctcactacattgcccaggttggtctcaaactcctgagctcaagcagtcttcccaccttggcctcctaaagtgtggaaattatagcatgaaccactgtcaggctcttttgtcagtcctatcaacctctaacatcctcgcaccagacaggacaggtgtctgtattgaaactttattacaaaattataaagcagagctctgtaacaaaataa

SEQ ID NO: 47 - DNA, 32267 bp, Homo Sapiens
gagaaccaactcatctttattaaatgcatcgtgtgtgtgtgtgtgtgtgtgtgtgtgtgtgtgtgtgtatagcacatacttcaggcttgcggcaccaccccatagagctggtgaggaagtaacttctgcttctcattgcaactgtagatccatcggggacgaacgaatgccagggaggggttgtccatcagggcctgcagggtggggtggagtccatacgggaatgtgtcatcgaggggaggacggaggagatgcaaaggtgtgcccgggtctcccattctctgcctctttggtactcacctcctcaaagctgggatcccattcctgtgctgtgatcacaaactgaacccggtcactcatatagtcctcgagctccctggcgggagagaagaaaagaggtagaaggcacatcagggaatcagcactgacgtcctactccccagccactctcaatggctgtccccacactgtccccacctatgcgcctctaggttgcctctaggctccattctttcatgtatccatcttgccacagccacaatgaccagagctcccacagtggctaatcctcaggctgtccctttcagaagcaggggtaggggtagggatcctcgccatacagaagaggaaactgaggcaagcaatgcaccctgggctgccggtggtgggcaagctagcattcggattccatgacctgtgcccacctgctgggcatggcccttctccatcctcctgatggtcttctttcccacacccccacccctcccagcaggtccctgagcgttcccttggatccatcaccccttccccaccccagtccctggagactcacccattgaaggctgtgacgtatcggatgagtttccgccgctcgtccccagggaactccccgtaaagaaagaagtgcttgccctggaagaaatctgcaggagagaagggggctaaggtaagcatgaggccccaggagttcccaggcaccaaacaggagtgacgaggctgacccagcagctgaggagagggctgtccacatgtgggcagggattgatggcaggcagtggaccctgcccagcggcccatcagagcctcctggggaggtaggttggttggttggttggtttgctttaatggtagaagatacaatgcctattattgtgatttgtttctgaccgacaggctggagccacttacctctctctctctcttttttttttttaagacaaggactcactctgtcgcccaggctggagtgcagtggcgtgatcttgcctcactgcaacctctgcctcctgggctcaagtgattctcccatctcagcctccccagtagctgggactacaggtgcatgccaccaagccagactaatttttaaactttttgtagagagacggggtattgacatgttgctcaggctggtctcaaactcttgggctcaagcaatcctcccacctcagcctcctgagtagccaggactactgagtagcacaccaccacgctcggctaatttttaaaatgttttgtaaaggcgggggtcggggggggtctcactatgttgcccaggctggtcttgaactcttggactcaagcagtcctcccacctcggcctctcaaagtacggggtgagccaccacgcctggcctgcctggagccacttaatgagcttagtccaggctgaaaacgtcagtatctgccacttcttcacctttgctctcctttccaaccagtgcctttcttgttctgacctttggggtggctccttctttccattttaaggtgactctctaggccatcaatttgctgatgccactttaggggcttgggagaatcaaagcatcttcctgcccatcacccacgaggaactgggtggaaacggctcttctggaagccccagaaccacacctctgcacagcccgtgactgtctttcctctgctcccttcattctcgaagaagctctgcctccctgcccctcatcccacaactccctgcagagtttccccatttccttttgttcttattcttttacactggaaatgcaaacacacaatgtgtgcagacagcatccacgtccagagtgatggctgatgttaaagcagacactggtgtgcacccacccagggcctgacagagagcagtgcccctgtcacctggtgtgcccggcttcaccccagaccaacagaacggcacctgagcaagtgaagcactagcatgagggtggggccctcacccctgacgtgaaaaaaaggaggtcacacctggcacatggctgcgaggggagtggtcagaacaagaaatctggaggggagaaaaaggcaagtcacagagaggatgctgaaaggaaaggaacaagcctggcagaacctgaaggtgctgaggcagggagtgggttgaggaaggagaggggaggcaagacacgggggcagcagtgaccccagggctggccagggcaagtcccagctgagaactgagaagagaaaatgccacttcaggagggatggggggatttcccacctgggagctcagggactggcagatcaggaggctcctggtgttcctcactgtccgtgttctcatccgtggagcctgcatacgggtcttccccattctcctcctggccagggggcagtctgtgttccttctgctctgccaccctgggggtgccaagaggagtagagagtgagcatgcagagcagcctcccctacacccaaggccagggacaccccaacccccagccccagccctacctcctcagctcatcctctgtgtccccagaatcttccgccccattgtcctgtccttctgcaagtagaagctcagtcaatgcaaggctgccttgtctcctgggaagactggcagctctcccagtatggcacagacccaggcatctcatgcccccagcctcaactgccctccagatccagtcgtctgggcccccagcccctcctccctctgatccaggagtccaggccccagcccctcctccctcagacccaggagtccaggactcagcccttcctccctcagacacaggagtccagcccccagcccctcctccctcagacccagaagcccaggcccccagcccctcctccctcagacccaggagtccaggcccccagcccctcatccctcagacccaggagtccaggtccccaggctctcttccctcagactcaggagtccaggccccagcccctcctccctcagactcaggagcccaggccgcaggccctcctccctcagactcaggagcccaggccccagcccctcctccctcagagtctgacctgactgtaccccctcaatgtctatatcttcctggagcactggtgaggctgctttggtctcttcaggggttgggggcttctggggtgagctgggtccagctgcctgagtgggcttggttttggtctggggttgctaaggagggagagtgggtgggtgaggagggcaggaacagtgtgggtgtgttgggggggtacctgcaagaggcaagagtgggaagtttggggtgccacagcggactcatgtcatcctcccactacaccctcccccactggacagggggcatcagaccttctgaggaagcttgggggcttcatctccgctgccaccgctgtgagaggcctcatcctcctcactgctggaacctggccctgccatgaggtacctaggggacaaatcgggcctcagacaaacaggcccaagggaagtggggagggcgttcaggaggcaacagccattggcatttactaaaatactcactctagtgggcctcatggtcttgttcccagcccattctctcccagctcaggaaggccccagtgaacccagtcagtctggccacctgccctgcagacctgggtaccccctttcttcccctccctctttttttttttgagacagagtccattccatcgccaggctggagtgcagtggcctcatctcggctcactgcaatctctgcctccaggttcgagcgactcccctgcctcagcctccctagtagctgggattacaggtgcacaccaccatgccccgccaactttttgtattttagtagagacacggtttcaccatgttggccaggatggtctcgatctcctgacctcatgctctgcccccgtcagcctctgaaagtgctggaattacaggcgttagccaccactcctggccgcttttttttttttttagacaagatctcactctgtcacccaggatagagtgcagtggcgtgatcttggctcactgcaacctccacctcccagggttcgagcgagtctcctgcctcagcctccccagtaactgcgattacaggcatgtgccaccacgcctggctaattttgtgttttttgtgttgttttgttttttaagtacatacgaggtttcatcacgttggccaggatggtctcgaactcctgacctcgagtgatccacccacctcagcctcccaaagtgctgggattacaggcatgaaccacagtacccagaattcccctccctcttggggaagaaatgtctcaattcagaaaggaatgaaaaatcagaactttctcctttaagaatcaaaggcagtttctcattaggaaaatacccaccatttaaggggaaaatctcaaagcaaacacattttaaagactacaacactataatcatggttccttaagccactaacattccaggaaaaggattttcctagctctaacaacagtagcaggttcccgtccgggagggaggtggggggccagccgccccgtcgggggggaggtggggggccagccgccccatccgggagggaggtgggggggtcagcccccgcccggccagccgcccctccaggagggaggtggggggcgcctccgcccggccgccgccccgtccgggaggtggggggcgcctctgcccggccgccccttctgggaagtgaggagcccctctgcctggccaccaccccgtctgggaggtgtacccaacagctcattgagaacgggccatgatgacgatggcggttttgtggaatagaaaagggggaaaggtggggaaaagatagagaaatcagattgttgctgtgtctgtgtagaaagaagtagacatgggagacttcattttgttctgtactaagaaaaattcttctgccttgggatgctgttaatctatgaccttaccctcaaccctgtgctctctgaaacatgtgttgtgtccactcagggttaaatggattaagggcggtgcaagatgtgctttgttaaacagatgcttgaaggcagcatgctcattaagagtcatcaccactccctaatctcaagtacccagggacacaaacactgcggaaggccgcagggtcctctgcctaggaaagccagagacctttgttcacttgtttatctgctgaccttcccttcactattgtcctatgaccctgccaaatccccctctgtgagaaacacccaagaatgatcaaaaaaaaaaaaaaaaaaaacacaacagtagcaggttgacacttacatgggacttcctacatgccaggtagcacgtgacaaatactgagtcactgaatcctggggtaggtcctatttttggccccattttacaggtgaggagactaaggcacagagagattatttaatctgccctaagccacagggaaggtatgcagacacaaatgaatgtattagctccatttttctgagacatacatgttaagacccttctgcatttaatttggttgttttcaagctggtgaaatgctgtttaggtaagtcacactcataaaacggtgcctacaggagattcagaggatttaaaatgtagtagttcattaacagtcaatagcaggtttacttaactttttcttcaaagtgctctattcaaagattaaaaaaaaaactaaatttgtgcttattaggtatggagagtcatcctcttggggtcttccttctatagttgaatttttattttatttttattttttgagacagagtctcgctctgtccccaggctggagtgcagtggcatgatctcgactcacttcaaccccttcctcccaggttcaagggattctcctgcctcagcctctagagtagctggggctacaggtgtgcgccaccatgcccagctaatttttgtattttttggtacagatggggttttaccatgttggccaggctggtctcaaactcctgatgtcacgtgatctgcccaccttggcctcccaaagtgctgggattacaggcgtgagccactgcactcagccaaatttttatttttgagataaggtcttgatttgccacctagactggagtgcagcggtgcaatcatggctcattgcagcctgaacctcctgggctcaagtgatcctaccacctcagcctcccaagtatctacgactacaggtatgtgccaccacacctggataatttttttcatgttttgtagggatggggtctcaccacgttgcctgcatcatatagttatttttttttagtttataaatgagtacaagccagaatttttaaaaatataaaatgctttgtgaattctttttgttaagaccagttgcaaatccaacactgtttgtctttttccctttctttcatgccctccttaagctctcccaggcagataataacccaaatctggttccttctgccccagatatagcaccagcccatcccctcttctgttcctgaggccccagcctactcaggagtccccacctgcagcctccccttgacacttcatccctcccaacagagcctgcccctgcccccatcaaaccttctgtgactcccctctgctcacaagaggaggcctctggagctggatgggcttcagaattttgaatctttcaggttttagagaggcaaatggctggcatacagattgttacataaactcccaggagggcctgggggagcaccccatgatcaaacccactaatatttctgcagttaagaccatgacacacttaaggggataaaaaaaaaaaagtccgcaaatagcctcacattagttcaggatgactgcagcgaaatgagtttgtgctgaacctagaaaagaactttcagcttctagagatgtttggattcctgaataacagatgagggttctgtgaagctgcatggagcccagtgtgtagcctgggctccggaagccccttctgacctgagcccacccacctcacagcctcgctatcccccaaggcaaataatttctcaaatacaccaggtacaactaacttctgaacacactcaggccatggagtacaatccagtctcccctccaattcatggacctcagatatgagctagcctttgctcagtccaaagccttctgtggttcctaatgccccagtcccatttttcctgccacttcttgcccctgtgtaagctcagcctcacctacaactccaggcagacaacaggctgacctgaccttgtctcctctgcccagcatgttctctgcctctgttcagcctgaaaaacctctcttggaccttgaagacccctcgctctctgcgggccaccctgtggggcttccactgcactgttacaacaattctgatccctcatcaaagtgagaagccttcaagggcagggctcaatgactggatcctcagccttgcacattccagcctggcaccaagcaggggcttctgggactcattttggtttttgggttttttttttcttgttgagatgggagtctcgctctgtcacccaggccagagtgcagtggcacgattttggcttccaggttcaagcgattctcctgcctcagccttccgagtaactgggattacaggcgtgcgccaccaagcccagctaatttttgtgtttttagtagagatggggtttcaccatgttggccaggctggtctcgaacttctgacctcaagtgatccacctgcctcagcctcccagagtgctgggattacaggcgtgagccactgcaccgggactcactttgaatgaatgaatatggaccctaacacttgttctcccacccctgagtttttgcacaaactgctcctccagccttttctgataagcaggcttcacagagccctctgtgacctcccaggcaggtcctccttccctcatctggagtaccccagcccctgccccgctcctctcagtagtctgctggctctgggctgggaccacctgtgttctccgctggcaggccccagtctgactcccctccagattcctggcattgcccagcacaggataaggagcagggttggcgtgtgaggccttacctctgggagggcagccgccgacgcatgcggtgacagtccagcacccactccttacgcacgatgcggcctcccaggcctaggacctggctgtacttgggggtgttggcaaaggcacagctggtggggggcagaagtgaagatgccagttaggtgtgatctgaggggcaaaggggaacgagacaggggagacagacagagagagagagagacagacagacagacagatcatgagattgaggtgggagaaacaaaaagaggttggagaccaagggagagatgcaaaaatcagagagaagacaaaggctacagaatgcagtgagaaagaaagcaagtgagagagagagaaagcatgcagcatagtggacacagagaaagcacaaggtggaggagacacagggagctgggggagaaactgcagcggcgcagggaggggggcgcaagcctacatgaggtgcgtgctgtcccgggtccagtctggccgatacttggccccaagctctagggccttatctcgcagctcggagcggaaggggttctggaagccactcagcaccactaccacaccctgaaggatcttccccagctcctctgggccagctcggggtcgtctgggctcggtgccttctcctcggggtttgcctgtcactgccccctgtgctcgggcagggactggggctgtggctggggtacgagttggagctggcactggagaagacaaagagtagattaggttagcaccactgggggtcaacccccagcccctcctccctcagacccagcagtccaggccccagaccctcctccctcagacccagcaatccaggccccagcccctcccccctcagacccaggggtccaggcccccagcccctcctccctcagacccaggagtccaggcccccagcccctcctccctcaggcccaggagtccaggcccccagcccctcctccctcagacccagggatccaggcccccaacccctcctctctcagacccaggggtccaggctcccagcccctcctccctcagacccaggggtttaggccctcagcccctcctccctcggattcaggaatccaggcccccagcccctcctccctcagacccaggggtccaggcccccagcccttcctccctcagattcaggacagcaggctccagccccgcttcccctaggacacaggagcacaggcccctgtggaaacaagggatctagttagctcacatttaggtctcttgggaacagatggcgacagctgggctggtggtttgctgggggtcttcttttcttcttggttcaaatccaacttcctcttccctttgggagactcctggggctgaggggatggggatggattgaggcctccagcttctctcctcctccaccccaccaaagtctgatgatttcaccttggaggtgctgcctatggccctggagactggagaggctgaggaggcagcactagaagcctggagggtagcagctgcatagctaggtcctgctgggtcgctggctgtgactatgaagggagaaagtggatccaggatgagagggctgagccccaagaccctttcactcctatctatgggacacagaatattgttgccaaaacccaccagtgatccaggagtcccagcctccagacctctcaaccctcaggacacaagaggccaggcccaccttcctccaccctgagacccaggagtccaggactccactaccctcctccctcagacccaggaatctgagccccagccccctctaccctcagacccacgagtctaggtctcaaccctactcactcaggacccacgttgtccgagctcacctggggatgtcttgttgatccggctgaagaagagagcccccggcctcagagagttggcgctctcatcctcctccttcacacggaactggccaagcttggtcactgtcaccttctaaggtcccgcaaggtcagtattataggtgggctgctggcaggtgggggtggagaggcagggagaaggccatggggagtgacaggtacagcttacctgggacggggcctctgcctcatctttgtctggggggctatgaaaccgtacaaaactcaagccaaagggggagtcctgggaaaggaggggtgggagtcagggagtctggcccaaggacagaggccagggcccaagacccttttcactcagggaaacctcttcctggctccttccctctcatgaacacccatgttgaaggaggggccctggcgatggtgatgacaattataggattaagctgttatgactgagccctaactctgagtctggctccaagcccttttcacgcattagctctttgggcaattggcagagtctactaggtgtcccagcgaattcactgccctatgcacaaactcctgcctgtggaatgggagggagtgctgcgtgccacttccagaacacagaagtgttccaggctctctcctctgccagctggatgcagagccagaaaataggagaagtctgggtccctgcacgacctcataaggagaagccagctgacaggctaaacactccccaggacagttacctgggcaagaagcacacctttagtgtgtggcatcatcacatactccagtctcactgttaccacagcttttagcatcccttaacctacagcaaccctgtaaggatcaggcaatggaggcccagagagcgtaagtcacttgcccaagatcacacagctaaaaagtggtatagccaggacgtgaactcagtaatcagacgccagatctcctgatgttaactactaggcccactctactaggccacctctctaacaagtcagttcccctcctccgattcccctctgagatgctgcagttcacccttcctagattcctccgggagatgaaacttctcattacaggaaagatcccaaacccatttcagggaacgcagggacccagcctccccataatcccatgggacaccagctgtctactcctcccagccctatgggactcaatattggcccttatttccctccttgcccaggaccaaggactctgcaccctggctcccaccctaggtaccttgctgtagggctggctgcaaacaattttgacccggtcccagcgcttctcggcggctgcccggaccagcttgtcaggcccaaacatgcgaacgcggttggggtttgagccactgcggctctcggaaggggacatgaaagatgaggtgaccagaaggacctgggtgggagaagccacagtgcatgagaaccagggcaggttggcttagatgagagcttctaggggctggggaagagggcacagggcccacacaggggactgggagtcactagaatgtagcttgggcctagatgtctccagaccctttgtttctaggccttgagtcagtcctgccctgacacaggccccagagggatctctttatcctccagatgtgagcgacccttatctaaattctcccatggagtcttccatatctggcaatacagcgggctacatgtcctaaggaactttcccggcagagaatattcagtaaactggcacaatattcaaacaccttttggaaatgcacaggtgagtcagcggaaaggcaaggggaattactagaggctggaaatgagaaaacagaatccagagagtcaggcgagctgcactaagtattaagtgattgtttctcagctcaaacctaccctctacaactcatctctgtgatctgggcccgcacttggcaaaccacctttctgcttccctagctgatcgtgaccaggctctgccaatagggggggcaagagagagagtttgcaaggctgcaggagggaggaaggaccagcttctcgtgcattgcagatcctgtgagcatcacccccagttaagcttctgctgctgcagtggttcctgcctgcagcagcagatgaatccagtttgcagtgtcccaatacctccagaaacagcctcattcagcccctctcagcagccggtgggggaggaagccctcctcaaacgatctgaatttcagctcctggagccccacctcccagtttccaaacatctacgtttcaataattcctgctcctttcttttgttcccccaaccctgggagtggtagctactccctgcggttgcttctccctcatatcttagtcttctagtaacacctagttactggttctttctatcaaattatctgttaaaataactggtgtggttttaatctccgggcaaggaccctgactgacccggcagcactcatgttggtagtttgtcatggtgctgatcccagatagcaaataacttgattttatttattattattatttttttaagagacagggtctttctctgtcacccaggctggagcacagtggtgcgatcatagctcactgcagcctcgacctctgggtctcaagtgattctcccaccttggcctctgagtagctgggtctagagatgcacgacaccacacctggctaattttttattttttgtagaggcatggtcttgctatgttgcccaggctggtcctgaactcctggcctcaaatgatcctctcacctcagcctcccaaagctatagaagtacaagtgtaagccaccacacccagctagaacttgatctttaagggttatgcacgtggtggtgaaagagaacaagagagaaaacctaggctccaagcaagggagagtggcatctcagagatcctcaccacactgcatagaactgaggactccccaaaggcaacgcccacactagttacatgaaggggaaataagcctgtggaaagagtccctgggaggcctgtctgtcttggccttagcttggggggacaccaaagaagaggtgaaaattcttctcgggagaactcctcacaagtctgttctctcaaggaattgagagtagcaattcatgttagcaatctgcattgaaaaacccaagctgaggccaggcgcggtggctcacgcctgtaatcccagcactttgggaggccaaggcaggcggatcatttgaggttaggagttcaataccagcctggccaacatggtaaaaccccatctctactaaaaatacaaaatttaagccaggcatggtggcagacgcctgttgtcccagctactcgggaggctgaggcacgagaattgcttgaacccaggaggcggaggttgcagtgagctgagatcgcaccattgcacttaagcctggtggacaagaggccaggagttcaagaccagcctagccaacatggtgaaacaccgtctttactaaaaatacaaaaattagctggacatggtggtaggcacctataatcccagctactcgagaggctgaggcacaagaatcgcttgaacccaggagttggaggtgatggtgagccgagattgtgccactgcattccagcctgggtgacggagcaagactctgccaaaaaacaaaaaacgaaacaaaaagactgggcacagtggctcacacctgtaatcccagcactttgggaggccaaagcaggcaaatcacgaggtcaggagatcgagaccatcctggccaacatagtgaaaccccatctctactaaaaatacaaaaaaattagctgggcatggtggcgcgtgcctgtagtcccagctactcgggaggctgaggcaggagaatcacttgaacccaggaggcggaggttgcagtgagccaagattgcgccactgcactccagcctggcaatagagcgagactccgtctcaaaaaaaaaaaaaaaaaaaaaaaagatgaatgcagccacttttggttgggtatattttgttactgacttagtctcttttctaactgacatgctgtgaaattataaaattggacaataaagccttttgctgagaaaaacagaacataactatagctctctttgtgcacagctgattatgcaaaggaaacaagaaagacaattatacagaagggaagttttcttcctgaccttgactatacttgtttataaaaggcctgatttggagctgacagggaagctgcatttatcatctggtgactaacatgggaaaaccctgtcctactaaatacaaaaaaaatagccatgcatggtggcacaggcctgtaatccgagctacttgggaggctaagatggagaatcgtttgtacctgggaggcggaggttgcagtgaaccgagattgcaccactgcactccagcctgggcaacaggagcaaaattccatctcaaaaaaaaaaaaaaaaaaaaaaaaaaaggaaggagggagggaaggaggggagggagaatggaaggaaggaaggctcctgtgactttgggtttgtgcctttgatgtttttgaagagtagaggtcagtgatttttgtcagatatcacttattgtacaaagtatctgatgtttccttgtgattaatttaggttgcacactttggccagaataccacagaagtgatgtgtaatatacagtttattttgtatattgacttctcatcttgtgaccttcacttactaaaccttgtagtttgtctagatctcttgggattttctgcatagacaatcatgccatctgtgaaaaaagatagttttcttttttctttttctcaccttgtcacactgactagtgcaaagttgggcatggtggtgcaagcctgtagtcccagctacttgaggggctgtggaaggaggatcacttgaacccgggaggacaaggctgcagtgagctgagatcgtgccactgcactccagcctgggtgacaaagtgagacctcgtttcaaaaaaaaaagagtaggccaggtacacacagcagctcacatgtgtaatcctagcactttgggaggccgcagcaggtggatcacctgacctcaggagttcaagaccagcctgggcaacacagtgaaaccctatttctacaaaaaatatttaaaaattagccgggcatgatggctcccactagctacttggggggctgaggcgggaggatcacttgagcccaggaggcagaggttgcagtgagctgagatcatgccactgtactccaacctgagcaacagagtgagacccccatctcaaataaataaataaataaataaataaatacatatatacataaataaataatatggttaaaaaaagagacagtttggtattggcataaagaaaactatacatatcaatggaacagagaagagagtacagaaataaacccatacatatggttaattaattctcaacaaggagtcaaaatgattcaatgagaaaaggcaagtctttttttttttttcaaagtattttcagccaggtgcagtggctcaggtctgtaatcccaatactttgggaggccaaggtgggaggatcactttaagctcaggagttcaagaccagccaggcaatgtagtgaaaccccatttctacaaaaaattttttaaaaaattagccgggtatggcggctcacacctatagtcccagctactcaggaggctgaggctggagaatcccttgagtctgggaagcggaggttgcagtgagccaagatcatgccactgcactccagcctggccaacagagtgagactctgtcttaaaataaataaaataaataaataagcattgtcaacaaacatataaaaaagatacagaaaagggccgggtgcggtggctcacacctgtaatcccagcactttgggaggctaaggtgggcagatcacaaggtcaggagatcgagaccatcctggctaacacagtgaaaccctgtctctactaaaaatacaaaaaattagccgggcatggtggcacgtgcctgtagtcccagctactccggaggctgaggcagaatggcgtgaacccgggaggtggagcttgcagtgagccgagatcgcgccactgcactccagcctgggcaacagagtgagactccatctcaaaaaaaaaaaaaaaaaaaaaaaagatacagaaaaaataaaccttatcccctgcttcacacaatacacaaaaattcacttgagatgaaacagagatctaaatgtaaaatctaaaaatagaaagcttctagaagaaaacataggagacaggcagaataacagctcctcaaagatgtttacatcctaatccctgaacctggaaatgtggcagaaggcactttgcagatgtgatgaacttgaagatgttgaaatgggggagatgcccctggattatccgggtaggccaagtgtcatcataagggtctttataagaaaggagggctgggtgtggtggctcatgcctgtaatcctagcactttgggaggctggggtgggtggatcacttgagcccaggagtttgagaccagcctgggcaacacagtgaaaccctctctctataaaaaataacaaaagctagccaggagtggtggtgtgcacctgtagccctggctacttgggaggctgaggtgggagaatcacttgaacctcagaggcagaagttgcagtgagctgagaacacgccactgtactccagcctgggcaacggaaatgaaaccctgtctcaaaaaaaaatgaacaaaagaaaaagaaggccaggcgcagtggctcacgcctgtaatcccagcactttgggaggctgaggcgggcagatgacgaggtcaggagttcgagaccagcctggccaatatggtgaaaccccgtctctactaaaaatacaaaaaaaaaaagttagccgggcgtggtggtgggcacctgtagtcccagcaactcgggaggctgaggcagaagaatagcttgaacccgggaggcagaggttgcaaggagctgagatcgcgccagtgcactcactccagcctgggcgacagagcgagactccgtctcaaaaaaaaaaaaagaaaaagaaaaaaagaaggcaagagagtcagagttggagaagtaacaatggaagtggaagcaggcgttagagtgacaggagtgctggctttgatgaaggaagggtcacaagctgaggagggcagatggactctagaagctgaaataggcaaggaaatggattctcccctagagcctccagaaggaacagggctctgcctacacctagattttagcccagtgagagtgatttcagacttctgacctccagaacagtcgaataatacatttgtgtcattttaagccatgatccaaacttgctctcttccctgatgtgcagtttaccgccctgtgtctgccttctgtctcctccgtacactgggtgatcctccagagggcagcaatcaggtgtgactcacatctgccccatgtcttcccagccccagcccctgggggagacggtgatgcgagcatgaggggcagaggtcagtatgggatccatctcatagccctgcttacctcatagtcttgctccccagcgcctccagctgaactgcccaccagcacctccacgaaagctgagccatcattcccaatgtccacactgtgtatctgctcctccttctccaactgtgggcagagagagaggccactgtcagtgcctgctctgcctctgggctcactgtgggacctcaggatgaatctcctttggatcaccatgtccctgtaatgtcaattctgtgagggggcacaccagggttgaatggtgccatgtgtcccctccatgcagcacagggtatggcatggagcagaaactcacaaaatagtcactgaatgaatgcatacgcgcccacctcacacatacctgcttccctgacctctccagactccaccaggtcagcttatcacacactgccatagagctctccttgataagcacttgccagagttataactttattcaaatcatcatgcagacaaacagcacatgtcacccctcacccacaatcgcagaggactccaggaaacctccctgagggcaggggctttgtccgatcttgctcaccgctggttcctgggtttgaatcccagctgtgctgcacactagctgtatgaccataccagttaaccttttggagcctcagttttctcatctgtaaaatgggaatgaccaccatatctaggatcatgcacataaataatggccacagggcatggcgaagagtaggcaattatctgctgtcagtcaggaggtattattagtcagtgctagacaactatttgttgaaagaagaaaagagctacctataggagggctcatctcaaaggatctgccattcctgtctgacagatgaagatgcagaaagccgtgcgggccatgcgggcacgggaggcagttaggttgaggcaagtgtcctgccttccagtttggggctcttttattaggatcctagaatgacgcattattacaactctcaaaggtacctgggccaggtgcagtggctcaagcctgtaaatccagcactctgcgaggccaaggcagtggaccacttgaggccagcctggccaacatggcaaaaccccttctctactaaaaatataaaatatagccgggcatggtgacacatgcctgtagtcccagctcttcaagaggctgaggcacaagaatctcttgaacctaggaggcagaggtttcagtaagcagagatcatgccactgcactccagcctgggtgacagagcgagactctgtcacaaaaaaaaaaaaaaaaaaaaccaaggtacctagtccaccctacactgccctctcccacccctggtgatgacagatgctccaatctgctctgttgcctccctgtcagatcatctagacatcacctgcacactgctatcaacaggaacaccactgtatggaaggagggagcctggacttggggtgaggtaggcctgggctcaaatacagcaatgccatttccaacctgcacaaccttgggtgacgtattcaacgtctctgtgaggcagtttcctcacatgcaaaaagggaagatggtcattaacaaccctccctccttggccaggcgcagtggctcacgtctctataaccagcactttgggaggctggggtgggaggatcacttgaggctgggagttcaagaccagcctgggcaacatagccagaccttgtctctacaaaaattacaaaaattagcaaggcatggtggcacatacctgtggtcccagctactcaggaggctgaggaaggaggatcgcgtgagcctggggaggtcaaggctgcagtgagtcatgttcgcatcactgtactctgggcgacagagtgatgagaccttgtcttcaaaaaaaaacttaccctccctctgaaggaagttgagatgacacagaattaacaactataaccacaactgcggccaacatccgagtgcactgagcgctcctggtgtgccagactcctgctaataatacatgtatctactctcctgcaatggctctgccaggcagttgctataattatctccatcttacacatgagcaaacggaggcaggaagtggttatgtaacttcacagctggtgggtggcaaagccggaccggaacccaggcaggctggcaacagtccacgcgtgctcctccatcacaccactgacgtgctagaggaggaagatggtgctggaggaagggcctgcctaaggctgaggccggcagacctcctgctgactcccctgcctccaccgccattcccagccctgggccctgggcagtgtacagtgctgcctgggctcatgagatgtcccagtctgggccaggtgtggtggctcacacccgtaataccagcactttgggaggctgagacaggtgaatcgcttgaggtcaggagtttgagactagcctggccaacatggtgaaaccctgtctctactaaaaatatgaaaattaaaattagccgggcatggtggtgagcgcctgtaatcccagatactggggaggctgaggcaggagaatcacttgaacccgggaggcagaggttgcagtgagccgagattgtgccactgcactccagcttgggcgatggagtgagactctgtctcaaaaacaacaacaacaacaaaaacaacaataacaagaagtcccagtctgactgctccccaggccaggcttggtgactttccaccagccacaacggcctcccttctgtgccaagaacagtctggctccttcccacctcagggcctctgcacctgccaatccccctgcctagaccactcttccctcaaacatatccatagctgggtaaaagtttgccttctgtgcttcaggtgcccactcagatgtcacttcagaccataagtaacctacctcgccccctacctggtgccactctctatctccctacccgactttacttttcttcatgattactgcctggtgttacacagttacatcttttttgtttgtatttgtctagcatctgtctctcccgccagacttttaagctccacaagagcaaggacagtatcgtctgagttgttccctactgtgtccccaaggccaagaacagtgtctggtccttcccagctctgctgatttcctgctgtgtgatcctggagcaaatggtttcatttcaccccttgtgcctcagttttcgaacctatgaaatggggacaataacaacgtctatctcataaagttgttgagaacattcaaatccataccaagaatgagaaataacataccaagtgcctggaatactgcctggcaccgagcaaacactacataaatgtcagctgcgaatatcattaacacagcaggcctctactgcattcccaatggatgtacagacagacgcagaacaggcgcccagcaaccgtttgcagaagttactactcaagagttattaagcagtaactctggctctgtcctcccttaccaagtggccctgttgagccccttctctgctgcttgcctgggtgtcccatctgtcacaagaggatcatcatggctaacattttcggattctcaccatgtgccaggtgcttggtgtatgagtttcctgttactgttgtacaaattagcacaaactttgtggctaaaaacacaaatttggccaggcgcagtggctcacgcctgtaatcccagaactttgggagactgaggcaggcggatcacctgaggtagggagttcgagaccagcctgaccaaaatgcagaaactccgtctctactaaaaatacaaaattagccaggcgtggtggcgcatgcctgtaatcccagctactcaggaggctgaggcaggagaattgcttaaaccgggggggcggaggttgcagtgagccgagatcacaccactgcactccagcctgggcaagaagagcgaaactccgtctcaaaaaaacaaaaaaaaaacacacaaatttaatatcttacagatctggaggtcaaaagtctgaaactcggccttacagggctaaaatctagatgcggcagggctgcattccttccttccgggagcactagaggagaacgtgtctccttgcatcttcggcttctcgaggccacctgccttccttggctcacagtcccttcctcgtcttcaaagctgctgaaagcgctggcatcactccaggctctgcttgcatcttcacagctctggttccagctctcttgcctccctctttcccttataaggcctctgggggttacgtgaggcccaccagataatccagggcactctccccatctcaagatccttaatttaatcaaacccacagagctcctttggccattaaaatatttccaggttctggggatgaggacatgaacatcttttgagcaccactgttctgtccaccacacttggctaagcatgggccgggcatcactgaagcctcaaaaccactttaaatagaagggtctgttacgactccagtttcacagatggggaaactgaggctcagacaggtttaatcaatagcttacatggcacacaagctaataactagcagagtacttcggacgcaactgcctgactgcaaagcactgtccaataccaccactgttctcaactcctttctttccatccctgagtcaaactcaacatctttacctctcccacaatattcagcatagctcctaaatgtggtaggatggagatgcttgtattttaaatgaacaattcctactgcatatataactatttctactttaaacaggcactccctgacatttcttctttgtatataaaaaaagtcctggctaggagcactggctcacgcctgtaatcccagcaccgtgggaggtggaggcgggagaatcacttgaggccaggagttcgagaccagcctggccaacatagcaaaaccctgtctctaccaaaaataaaaaaagttagctgggtgtggtgacacgcacctcaataatcccagctactcaggaggctaaggcacaagaattacttgaacctgggaggtggaggttgcagtgagttgagacgagccactacaccccagcctgggtgataaagtgagactctgtctcaagagagaaaacaacaggctgggcacagtggctcacacctgtaatctcagcactttgggaggccaaggcaggcagatcacttgaggccaggagttcaagaccagcatgaccaatatggtgaaaccctgtctctactaaaaatataaaaattagccagacttggtggcgtgcacctgtaatcccagctacacaggaggctgaggccagagaatcacttgaacctgggaggcagaagttgcagcgaaccgaaatcatgccactgcactccagcctgggtgacagagtgagactccatctaaaaaaaaaaaaaagtggccaggcacggtggctcaggcctgtaatcctagcacttcgggaggcagaggttggcagatcacaaggtcaggagagttcaagaccaggctggccaagagggtgaaaccccgtctctagtaaaaatacaaaaattaaccaggcatggtggcaggcgcctgtaatcccagctactcgggaggctgaggcagagaattgcttgaacccaggaggcggaggttgcagtgagccaagatcatgccactgcattccagcctgggtggcagagcaagactctgtctcaaaaaaaaaaaaaaaaaaagtaaataaatactttttaagaatctgataaaaatgtttatacatggaggctggggtggtggctcacgcctgtaatcccaacactttgggaggccaaggcaggtggatttcttgagcccaggagttcaagaccaacctgggcaacacggcgaaaccccgtctctactaaaaacagaaaaattagttgggcatggtggcatgcgcctgtagtcccagctactcaggagactgaggcacgagaatcacttgaacctgggaagcagaggttgcagtgagccgagattgcaccactgcattccagcctgggcaacagagcaagactcaatctcaaaaaaaaaaaaaaaaaaaggtttatatatacatggtaacaacccaataaatgtccatcagttgatgaatagataaacattgtacagtatatttatggaatatcatccagttatttaaaaaactgaagttgtgatatatgctacaacatggatgaacctcagaaacattatgcaaagtgtaacaaggttaagtgtaaaagaccacgtatacatttataagtccagaatacgcaaatccagagaagcagaaagtagatcagtggttgccaagggcaacattggggagagaataagaagtgactgtttaatggttatgtggtttctttttggagtgatgaaaatattctgaattagagaatggagatggttgaagaacattgtcaatatgctaaaaaaaaaaaaaaaaccctgaaatgtgcactttatttatttatttatttatgttttttgttgagacggagtctcactctgttgcccaggctggagtgcagtggtgcaatctcagctcactgcaaactctgccttccagttcaagtgattctcttgcctcagcctcccgaatagctgggactacaggcacgcaccaccacccccggctaatttttgtattttcagtagagatggggtttcaccatgttggccagcctagtctcgaatccctgacctcaagcaatccacccgccttggcctcccaaagtgctgggattacaggtgtgagctaccgcatctggctgaaatgtgcactttaaatggttaaaacagtaaattttatgtgaatttttctcaaaataagagatgagtgctcagtatgtatcagctgtgaggataagagcacaagatgactatcaccgatggcctgggttcgtgtgcatgcagctttctcagggagacacagttctgatatgaactgttcctgaaacaaacatggcacaggaaggcaaagttcctgagatatattgctaaaaaactgtttcacatccatgaaatgcaatcttttcttttttttttttttttgagacagagtcttgctctgtcacccaggctagagtacagtggcacgatctcggctctctgcaacctccgcctcccgggttcaaacaattctcctgcctcagcctcccaggtagctgggattacaggtgcccaccactgcacctggctaatttttatatttttagtagagacagggttccaccatcttggccaggctggtcttgaacacctgacctcgtgatccacctgcctcagcctcccaaagtgctgggattacaggcgtgagccaccgcgcccggccatgaaatgcaattgtatgcatcatttaaaagaataaggtaggctgcgcacggcgtggctgacgcctgtaatcccaacactttgggaggccaaggcaggaggatcacttgaggtcaggaattcaagaccagcctggctaacatggggaaaccccatctctaccaaaaatacaaaaattagccaagcctggtggcatgtgcccgtaatcccagctactagggagattgaggcaggagaatcacttgaagctgggagggggaggttgcagtgagccacgatcgcactactacactccagcctgagtgacagagcgagattctgtctcaaagtaagtaagtaagtaagtaagtaaataaataaataaataaataaggtagaacttcatgcagtgtgcatctccaaaatacactgttacttgaaaaaaaacacacaagggaacagtgtatatactatgaattttttaaaaagggatggaggcggtaggtatatatgcttgtatgtgtacagaatgacccaggaagaccacccaaaaaaactgctaatggtggttgcatcaggagagaagaatgagggagcaggagttggggagggagcaggagttggggagggagcagggagggatggaaagggtgaggggagattttctttttagtgtatacccttttgcaccttttgaattttgcactatatgcatataatacccattcagaaagcaaatataataaaaccccaatggccaggtctttgtggctctgtctgtaatccctgtaatcccagctactcaggaagctgcctccaaaaagcttaaaaaaaaaaaaaaaaattagttgggtgtggtggtgtgcacctatagtcctagctactcaggaggccaagttgggggatcacctgagatcaacagttcaagaccagccttggcaacatagtgagactccgtttaaaaaagaaaatcaaatataaataaataaaaccataatagttatctcaatacaacagaatactatacagaaatgacaataggccaggtgcagtggctcatgtctgtaatcccaaggatttaagaagctgaggcaggaggaatgcttgagtccaggagttcaagaccagcctagacaacacagtgagacccccatctctgcaaaaaaaatacaaaaattagactggtgaactggcacatgcctgtagtcccaactactgaggaggctgaggtgggaggatcgcttgagcccgggaggtcgagcctgtagtgagctgagatggtgccactgcactccagcctgggcaacatagtgagaccctgtctcaaaaaaaaaaaaaaaagacaataggagtcgagcacagtggctcatgcctgtaatcccagcactttgggaggccaaggcaggtggatcactagaggtcaggagttcgagaccagcctgaccaacatggtgaaaacctgtctctactaaatacaaaaaattagccaggcgtggtggtgcatgcctgtaatcccagctacttgggaggctgaggcaagagaaccacttgaacctgggaggcggaggttgcagtgagctgagattgtgccattgcactccagccagaacaacaagacgaaactccgtctcagaaaaaaaaaaaatcacaataaatcatctacagctacactgaacgacatagatgaaatgaacaaacataacaagggaagccagataagaaaagtttataccacacgattccattttatatgcaattcaaaatcaggcaaaatgaatctatgctgttaacaatcaggacagtggttacccttgcaggggtactgacagaaagaacctgagggaactgctgggggctaggcatgttctgtgctgcatctgggtgtggagtacacagggctgcagtttgcaaagagtcactgagctgtactcttacttacaccttcacttcactctatgtatgttacacatcaaaaaacagtaaaaacaaatttaagacaccacagtggcgaactgagtgattagaaaaccaataacaatcaaaaatgaccataggccctattgctgatgaacatttcttctaaaaatgacacacctccagtgacacaccagagttatatctgggtcttgtccaagccacccctccagcccaggagtagttagcaaagaggttggcatttccctctgggagcaggtgatgaacagacaacagagcctgctgtggctactgcaaacaaccaggtgtgtggggctgtcataagcagatggctaagccccatgtggtaagatcgagattttgcataacaataattagaggagaaaatgcagggtagtagaagaacccacagatgtggccaggtgcagtggctcatgcctgtaatgccagcactttgggaggccaagacaggaggactgcttgagctcaggagtccgagaccaggctgggcaacatagtgagaccccatctctacgaaaaatttttaaaattagctgggcctggcggcacacgcctgtagtcccagctatctgggaggctgaggtgggaggattgcctgagcccaggaggttgaggctacagtgagccatgactttgcaactgcactccaacctgggcaagagagtgagaccctgtctcaaaacataacataacaacccagagataagcctactgccttggtggccagaaatgtctgcctttatcagttacgtcaaaagaatcaaaattagcatttgatgaatccagagtaaccccacaaattagtcattgccagatgcaatcagtcattccaaagggtctctgacgtggagtaagttaacaaaacaactgctgcaatgctgatctcccactcctgtgtgtggcccctgcagttgattgtcaacatggagccagcaggatcctgtgaaggcctaaggcagatcctgtccctcctctgctcggagccctccggtggctcctatctcacacctggagtaaaagctcaagtcctttcaatggctttccaggccttaagtggttttttaggggttcccagtcccaccctgttacctcatctcctacctctctccccctggctgactccaccccagccatactggcctccttgctgtcacaagccagcttcagagtcttttccctagatacatacatagctcatgttgctcaaatgtccccttttcagggaggccttcccggaccctactatttaaataaaaatccttgccactgctccagctccagctggggcactctcattccccttcattaagttcctccatagcactcatcatccaacatatgtttcactgactcatttgtcagtctttccctactaacgtgaaagctccacaagactgaatttcttttgtttttaagagacagcatctcattctgttgcccaggctggagcgcaatggtgcgatcatagctcactacagccttgatcttccaggctcaagtgatcctcccgcctcagcctctggagtagctgggaccacaggcataggccaccacgcttggcagatttttgtatttttagtagagatgaagtttccctgtgttgcccaagctggtctcgaactgccaggccttggcctcccaaagtgctgggattataggcgtgagcttactgcaccccactgagagtgaatattttttgtcttctgctgtgtactgctgtattaaaacagtgcttggcctacagaaggcacttaataaatacttgactaaataaatgagtgaatgaacaaataaatccatcatctactcccgagtctataggttctttctctgcactgacaacttccccacattctgtcttcagctccacatgtgatccccaactgcctcctggatgccacccctagaatgtcccaaagtcacatcaaacctggacatcccaactgaaacacatcacctccccaagctgctccctctggggtttaccatgttggtgaccgctgcaatactccctcagtctctcccaggccagagacaggttctgtctcttctgcctccagtcactctgtttccacagcaactggggtaacagaatgaaatgtgatttccctggagtcacttgatcataagagagcccagtggaatcatcacccactaagtaataaaaacacaaatccctccctctacacaaacacctacatgttgacagagcacttgtgcagacattatgtcaccgaattttcacaactccgggcttggatgtcattattcccaatggacacatgagaaaacaggttagagaaatgaaacaattttcttgaggtcaccgattaagaggaagagctgggggcttgaatctagatctcaagactaaaactgtcagcaatctgtatctatcacagtttaaaagactgaggtcaggtgcagtggctcatgcctgtaatcccaacattttgggaggccaaggtgggtggatcacttaaattagcatttggtgctcatttgccttgaactcctgaggtcaggagttcaagaccagcctagccaacatggcaaaactcggtctctattataaatacaaaaattagccaggcatgtaaattccaactactcagaaggctgaggcatgagaatcatttgaacctgggaagtggaggccattagttgacaggcactaaacactgacatcaattggggtggaccagatgatgttacagtaacaaaggagtccctaatctcagtggtttaaaacaaccaagttgtattaacttacactgtaataatgctgtgtaacaaatcatcctaaaactgagatcttttctttttttttttttttttttttttgagatacagtctcactctgtctcacaggccggagtgcagtgaaaccatcacagttcactgcagcttcaaccttatgggctcaatcaatcctccccgctcagcctccctggtagctgggactacaggcatacgccaccaagcccagctattttttataatttttcgtagagatagggtttccccatgttacccaggctggtctcaaactcctgggttcaagcgattcacccacctcgacctcccaacatgaaaactgagacttataccaacaagcattcttataagaatttgtgggatggctgctttggctgcagtttgggaggattcaggtctcttccatgagattccacagttttctgggattagcagtaacctggcaaatgttctcatggcatattatgggagcacaaaagccaagtgcatttaaggcccttgctgaagttagatgtgctgaaattccattaagtaaatcatatggtcaaactcatcaatggagcagggaaatatactccccctccagtgggagggagaggagtggatatttgctgaatgactgcccattcacaaaaggttaatttttccgtcaccctagcactatccacagagtgttctgctccttatagtcataaagcagcccccaggccaggaacaatggttcatgcctgtcatccgagcactttgggaggctgaagcaggaggaacgcttgagcccaggagtttgagaccagcctggcaacatggtggaaaccccatctctaaaaaaatacaaaaaaaactagccaggcatggtggtgcacacctgcagtcccagctactcaggaggctgaggtgggaggatcgcttgagcccaggaggtagaggctgcagtgagccaagccaagatcatgccactgcactacagcctgggaacagagtgagactctgtctcaacagataaataaaagattgactgtcaggcaaattgtataacttctttgggcctcagtttcctcatctgtaaaagtggggataacagagcctgcctcttggggttttttatgaggactcaatgagctaatccatgtgagtgaggtgtgtagagcagcgactgacaggtaacgttgaataatgccagctctcattattattattttattttttatattttgggggtctcactctggtgcccaggctggagtgcagtggcacaatctcagctcactgcagcctccatctcctgggctcaagcaattctctcacctcagactcgccagtagctgggattgcaggtgcacaccaccatactcagctaatctataaaattttggtagagatgacatcttactgtattgcccaggctggtctcaaactcctgggctcatgcaatactccagcttcggcctcccaaagtgatgggattacaggtgtgaaccaccatacctggctattattctttaaaaaaaattatttattttaataaaaatagagacagggtcttgatatgttgcccaggctggtctggaactcctgagctcaagcaatcctcccatctcaggctctgaaagtgctgggtttacaggcatgagccacggcatccggccagtttccccttctttaaagtggagttgattggcttagacgaccttcctggacaccttccagccctgagcccactggctgcaggaggcagagtacgtggcaatgattcattttgttccagctgaggaaactggaacccagaaagtagatgccacctgcccaggaccacacactgattcctgtggtcatcctggacttaatccttgggtctcctttcctctctgctgaggggcacagggattatgctgcccattttccgagtaaggaagctgaggcccagcaaagaaagtgactaaacccactgccagttggctcaggagcagaatctggaaccccggactccagactcctagtgaggaggaggtggggtggcaggatcacctgtaggaccacagagatggtcttctcgcctgccttggctgcccgccattttcggtaagtgtctgccttgagaagattttctgcacagtgagtctggaaacaacagtgggagaggagaattagggcacagagatgacagctaggcctccagctctcagatgattcctttgagtcctcccaaggcctctacgacccccagatttaagctctcccgttaatcccccgacactctgcctggagtttcccctacaacactttcccgtggaagttcacctatgggctctccaagaaagcttccctattcctccttttctctccggaagttccctagacgccggaacgtccctaattcaacatctctccacaattcacttttagcctcctggaaatccccccatgactctccttagacttccaagagaaccccaaaagctcttttaagagctatcctcattaattccctcacgtcttccaacctcccccatgcaggtccctcaccgagtcctggctgctgcaggacacgacatggcggaggcggatctccggcatgtcaacgtcgtgggcttcgcctggccagaaggatgaggtagagtatggggtccgaggggcagggagagtgggagggggcggggtgcgccctgcgctggctaaagtgcgcaagcgcgcgag

SEQ ID NO: 48 - DNA, 6363 bp, Homo Sapiens
ctcaaggagaaacagcgtttattgtggaggggagctgggcggggctcagccctcggagaactggcagtacagccgccccagcctcggctccacccatagccggaacgggatctccaggatggcagagaagccttcagccagcgttggggcctcgaactgcttcctggcagtggtgggaacagtgagggacagcctggatcatgtggcccagccagtgcccctgccccctgctatccccaacagtacctgtagccatacatgaccatgtctgacacggggatatgagaggagtccgtcatctctcgaaactgtggggaacatcagaggggcggcaggcccaggggtcaggggaggaggggggtcagggggtgcagcccggggggtgtccgggctgagcgggctcacccggttgttgtggcgcgcctgctccagagtggcggtgaagaggaagcagcggcaggggacgcccgcggctcgggcacactggacgtacctgtgggggaaggagctggatgtgcaggccccgcccaccccgccgcaggccacctacggccccgcggtcacgctacctggcgcggctcgcggcgtctgggtttgtgttgtcgatggcgacccgtttcccttgcttcagggctgtctcacacgtggtcacacagcgctgccaggagcctagcgtgtcctggggacacgagaggtcacaaacagatcggcagacccagggggagagaagaccccgagcggggacggggaggcaatgatggaggaaagccgccccaaaccagttgagaggtggagatgggaactttataatagatttggggcggcaaaagcctggtcataccctgttcacgtggacatatccggccgacacgaggtgcttcttgagaaaggtggacttcccggctgtgtggggggcagtgtcggtgggtggcctaggacccaggcggggctcagggcacgcgcacaggaacaggacacttacccccagggaatcccactgcgacaaccacctccgggctggcgctcaggagggccctggactcggggaggcagagaggccctgagcgggagacagtcctctgcgaggggcgggggacacgcgtgagatgccgtccccatccccgggagccctcccatccccacccccacccccgccccagggcctcaccggatcaaaggctgggagctcgaagccggctgctggccacttgagaaagaactcctcaggcgtggcgaagggcaggccaaggttgagggcaaactaggggttgaggacgaacatcagacacaggccagggtcgggctcgggcgcggggcagggggcaggggcctcaccaggcgatcggcgcaggagaagtctttcttcttccgccccggggcccagttggccgggcgtccggctgcgtctggaacacacgggacaccccgttcccaccagctcggagggaggcgtcccagcccaccctcagcagcctccaggcccttacctcccacaaagatgctgtccccgatggatatgggcgtgccgtcgttggcctacgggagacggtagtgaggaggcccttcccacaaatgtccccccgcagcggtagcgggtccctggggctgcttcgcctggtctgtgccccacatcaggaatcatcccccgacctttcatgtcctcactctccagccactttgcaccgtgctcctggccccctcccccctccgtggtctctccacacagccccctccctccaggtctcccgacttcacctcctcccgttccccacgcggccaccggagggcacccaccctgctacagctccagcctccggcgtgccggcgcctcccaggttccccctccctcagggcaaaagcggggccctccctgtggccctgccctctcccctccctcgcttagagccagccgcatgggcctcgctgtccctaactagcccaggctagggactgcctcagggcctttgcacttgctgtcactcccacaaggggggggaccgctttccccaggtgtccacctggctccctcctttccctgccttaggccttttcctctgatgtcacctcctcagaggccatccctgcccaccacgggtgatgcctgctttctccagctccctccctcctgctgttttacacgccagtctgcccatccgcctagagtcaccgccctcgccgtgagggccctgctggagcaggccgtcccgctcactgataccttcagctcaagaatgcgctaaacttcagaacaaatgcacacacaaacgaatgaacgaaggaatgaacagcttccctactactctgatgtagaaagtctgaaagcactggtctcgtaaaccaacatctaagatgtcacagcaaaaaacagaaggagggagcgagagaggacagaggagtaaggaggccccaaccggaggccggggagcccaggagtgaggggctggagtgaggaaaaggaggggggccgggcaggctgcaagactcacctgctcctgcagatggtcccacatgcccgtcaccggcttccggtacaagcctgcgtgcgtggccaccagcacctgtggatgggagggggccaccagctttagctccccctcaagcacctactggatgccaccccagcccagaatttgtagctgatgatgggttcctatcagcatcacactgcctgaggcctccgccccgcttaccctggagtctaaagccctcgctctggatctctgtgcccccacatagctcccagcctcccttccagccatacctggaaggggacccccagcttctccaccacagcctccaccttggccttgaactcctcggctggcagcttcccgcgcccgatgctcatctggttggtgaagatcaccagctggggagcaaagggtgtcaccagacgctctgctcaccagggccttggtctgactgcggtcggaccgccacgtgcacgtgcccatgcagacaggcggctgcacataccttgtagccctcggcttccagctctcggagcttacggggaatctctgggtacaagatcctacggcaggtatgaagcggcaggggtgacccggggccagaggtggactccaggcctcactcactcccttgttttgcctcttatcacctccagtcactggggccagtgggaaagaccttcccagagcgtgtggtgatgagcgtcccgtccagatcaaagccagccacctggtgtcaccaaggaaagacaaacagcagcactgtgatacctctgaccctcctcactcacaggctgactcacaccaaccctgccaggcagggtgttatcactgccatctcacagatggggaaaccgagtcacagagcacctccatctcaagcatccgtgatgcctctgagtggggcccgacatcttaaccttactgtctcctgttactccttatgacgccagccccaggattacagtctttaaaatgggggttaatgtcttacccagcctccttcttcccctggccttcaccacctcggtgggctaataaccgtgaaaataaaagcaggagcaaagctttgggtgctaactgcatgtcaggaactatgccacgtgctttttttatggattcagcatcgtagagatgagacacatgggactcagaatgtggtggtaacagcatttgaactcaagtctctctggacataaaaaatcctcatcgtaatagctcctactgagacagtcatggtcattgctgattactgggtggtcactgtgggtaacgcaggagctgacatatatcattctccccactgcttaactgcttacaacgatccctgcatttatcattaggcccatttctcagaaaagtaagtagaggctaaaaagttgagagcacgcaacaaacgtgggattgggtcccagtctgtggcggctccctcagccctcggcgtggccctcaccttgccctggggtttcaccccagctgcggtgaacactagcaacttctccaagttctcccagccggggtttgacttccgcatacgcttcttcggcagctcagcatctctcttctcatcttgggacaccagaggggtgccaggcggagtatctggctgggattctggtgtgcgggtctcttcccagcgcagggtcagtgggtggaggccattgaccaaatacagtgtgtcccccacccccagagagccctccaaccccggcttcaactcctgggtcccggtagttgaggggttaactcccagctgcagaaagagagggaggagctgggactggctccgcccccaccgggagcttcctccaatcaaatacccagcggaaaaatcagcccttctccaccactatcagacccttaggccccacctcttcactttggaacgggctttggaacggttacaggttttcagccttgtccgaatcttttttttttttttttttttttttcccctggagatataggcttgttttgtcgcccaggctggagtgcagtggtgcaatcttggctcattgaaacctgtgcctcctgggttcaaacgattctcctgcctcagctacccgagtagctgggattacaggcacccgccaccatgccccgctaatttttgtatttttagtagagatggggtttcgccatgttggccaggctggtcacaaactcctgatctcgggtgatccgcccgcctagcctcccaaagtgctgggattacaggcgtgagccaccgcgcctggccgccttgtccaatttctaaggtcttggacaggtacccaccccactgaaacaggcaacacttctttctttactggacacatccccttctctcccagccatattttttcttttctttttttgagacaggttctcgctctgtcacccaggctgaagtacagtgtggtgatcactgctcactacacccttgacctactgggctcaagggatcctcccgcttcagcctcccgattaggaactacaaggacgcgccaccattcccgctaattttttagagagacaggtttcaccatgtcgctcaggctggtctcgaactcctgggttcaagcgatccgcccgcctcggcctcccaaagtgctgggattacaggcttgagccaccacgcccggccccaatcagattttcctaatgtaccccttcactgacggcttgcaattcctccccaaatcccatccccaggccttgctggcccttgcagaggcactgatacctgtttcactgccactgtccgggtctcaggatctgcgaccagctccactgaggattggaggggtggagtcaggatttgcatccttgtgtgattgggtccctcatttctggggagtgtggcctgcttcaggctatagcatccagggagtaagaggcagtttatttctacatgggattggctccttgacatgcagtagccagatagtggcactaggattgcctgacactggtccttgcaagggacagggaggtacttttctctacagaattggtttcctccttgacaaaaaatgtggctagatataggtccggggcttggcctgttaccatccatcccaacctagcgacatttacttttctccacaggatcatttttctcttgacgaaggtcgtcgcctgtttctggatttcccgatggcctgagcatcatccgcgcagtgaacatcctccctaaatcggctcgatcccctctcccccaaaggatctagctaattctaaatcaagcacaaactttatcttcctgtactccctagagagcaccttccgacttcggggctggctgcaccactgcaatcccgcgtagcagccaagcgtccctctggattgttcccgcttttgcagcaggccacaccccctccagctcaggccccgctcaccttgagttctggagcacttccggtccgtaacctgggtcaggggtcccctgcccaggaccagggcttgcccgtccgagggcaggaagatggggggcgctcccccaggggggctctcgagccacaagcggcccggggcctccacctcgcccatcctgggtgccggcctggggagcaggtaaacgggcttgagcggcgcacagccccaatttgctgcaggaagtcccgcctcctcccacatccactagaaagtttccccaccattaactgctccggaagtcccacccgctcgccttccgcgggtcgacccgtttcccaggcgacgacgcgtgctccatccctccccgagttgcaatccccactttccagcgtacaggcagagagcctcgcacatgcctccgccccgccccgtactcacccgggaccgcggcttgggctcacggccacttccgaccagggaggtcctgcccgaggtgccccgcctgcaacccggccggcggcggtcggttcctcgg

SEQ ID NO: 49 - DNA, 112604 bp, Homo Sapiens
gtgaagctgcgctggggccgggctctgagaggaccggcgcagccgcggggagcctttgaggccctccctcggtgttttttcccagggcgtgggcttgccccgcgcgtgtctgtggagggcggaaacagcggaggggccagtctcctggcgaaggggcctaatccttgcccgccatgtccgggggcttcgagctgcagccgcgggacggcggtccccgggtggccctggcgcccggggagacggtgatcggccgcgggccgctgctgggagtaagtgtgggcgggggcttagcggaccccgagagccgtggagttccgcgccggctcctgaagaccggccctagtcctggccggtttccccaccgcactggtccgccggtccggattttagaagtttggggccgcacgtttttcagttacctttaagccaattcacaaacatttctttatgttgcttttaaaacactgactgtattaccattattatcttatccagggattggcaaactagtgcctgggggccaaatccagcctatgtttgtatggccccatgaactaagaatgattcttaaattctgaaatgtaaaatgtaaacaaaaaatctactaatttttcagggggaatagttgctccaagggttgagggtattgcggcttgtcttgtaaagcctaaaatatttacagtagtgtctggtcctttacagaaaagtttgccaaactgtgatattacgtcttctaggctaatttcttttaacctttggtctcctttgcagagctgtgtggaccttatttatttatattatttattatttccagtaaaatgagtagctaacccttcataagtaatgtgtatagcgttcgtgtcattggtctaaggagacattacctataccaacatctttaactgtctcaagaccgtatcagttagctatttttattatcctcattgttcagatgagaaaattgagccatacatacattatttaaagtccatacataagcttttggacacataatgccacaaagctaaatattctctaccttctttgggagaggtttaggaataagaacatttgcatattgcattctggaattctatagatctcttaagtacatctagttttctattttgttctttaacattcaacatttcttgtttggtgctcactgtgtagaacattttgcagattctagcactgtggggcatacaaagatgaatggaacatgggtccctaccctttaggagttttctcttgggaccggggagacacctgtgtcagtgagctaacaccaaggagtaaggagtgtgtactgttgtcctggttaacttccagagtctaaatggaaccattggtacttgccttaggtcccttctgggagcagggaaaggagtggtagtttaagattgtattatggaagctggtcctaaaggggtgtgtgtgtgtgtgtgtgtgtgtgtgtgtgttgtgtgttgtgtgttgtgtacatgcacatgtgcatgtggtaaggttattgaggaagtagatattcaattgctgttcatttttttactggacaagtgattatttaaatatttaacatcatttctatttttttcatcgtttgttggcctatacaaacactggaaggaactgtctggaggctttatttttcttttaaattcgtaggtttgaaacttaagagtatgtgcttaatctagtaatcatatgtctggtgactaacgagttttgacttgcttaagaaattgtcaccagtagagtactgtgggtctggttaaaaggtggatgaattttagggccgtggtttagaaacatggcaacagattgcagaccgtttcattatttgtagcttgttctttgtgttgtcgacttgctaatgtgagatgagcctatttggtatctgtttttaaaaatggtaaggagtgaaagctgggcaattacctggtcaagattttgcttttccttttgaaataacattcagggatgagattcttttgccaaggttggcgtgtatcagaagtggttatgaatgacatcctaagtgtgttaaaggaaaaatttggagaacaaacaaatcgccttgtagttttttcgattttggagctgacagatgcactcgattcttctctgcactggttaaaacacaacataagggctcctgtttccaacaacagcaattccagtgagatttatttttgtattgtgagagagcgaagactgagttctaagtggaaaactcagtaagttcattgtaaattggaatcggaaacgattaatataaataaggatgattttgaactttcttaattgggcatgtttttctgagacaagcttcacaaaccttgatggccacacaaacataaaagtttataatctgactgtgtaaaatagtcttggtagtaaaacagtttgacaatgagaatggttttgtatttttatggtggtaggaaaacacaacagagaaacctgtcacagagaacaaaggacaatgaaatttaatctttcttgttccctttgctttcatgtgagtcatcagagaaccccaggtctttgtttactagattttgattctgctccatgattggcatcagttagaaggttttacagcaggattaatcttcagagaacttgagttaaaacagccaatccaaaagattacatattgtgtgattccatttatataacatcattgaaattgcgaaattgcaaaatttcaaaaatggagaacagattagtggttgccaaaggttaaaaaattaggcagcagggcagaagggaatggatatggctataaaatagcaacatgagggatatttgtggtgatagaaatgtgctttgtctggactgtgtcagtatcaatatcttaggttgatatattgtactatagttttgtaagacgttaccattaggggaaactggataaatggtacaagagatatttctatattatatctttcaactacatgtgaatctaccattatcttaagaaatttaatttaaaagggttttacagtacgacatgtcaagcactgttaggccaaagtatttgctttatgggttttaattaaagctgttacactcttaaatgaaatctactatttctgatttcagatttttcttattttgttttgacagcagggattatatgacacatttctttatgatctattttcctcctaggaaacaagatagcaaaagatatctagtgatactttctcaatgtagatgtaattaaattgactgctttgattaaaaggagaagagtcctcagttgggggaacagggaaggtcataggcttcagtatagactcttcaggtggcatcagttcaccacttctaagaatgttgtaaatgttctacaaagtttacacaaagtaaccatcccctgacctggcagctctatacttttaactgcttgttgcagaatcctggctgtcctggaatgctgttcctacctgctccaacataggtttcttcccttacgtttcttttatttctagatttgcccttccctcattttattatttagcctacaaccagtgcctagcacacagtaggcctttaacacgtgatttcttccttccatttcggcatctcagcctctcattcactctaccctcaaaaagagcctaattgtgacttagatatgaaaaagggttatcattgagttttgaagtgaatttaaatatagtaaagatgcagtcctaccaactgctaaatcttgagtagcattcataatgaattaagttttaacatttttcctgttttgttgattgataattcgctaaattcaggaaatagctgataaatatatactatggttggatgggagggagtataggagaaataaaggtgaatgagaaacaagtctttgctctcaagaaacttatagttttgtagggttaagagacaaataaacaagtattagtaactaaataaggctacaacctcacatggggactggcgccaggctgacacttggagtaagcgaagtgggagggaagaagaaaaacaacacagggacagtgataaatgacaacagttctgcctcagtgttgggaaggccacaaggagagggtctctatgcaatccctgctactttcccctattcccagttggtaacagtgtcatattgtttttttaagaatagtaagaaatttgaatttttagatataatcactgatttttaaaaggtcacatttttattaaaagttttggttaaataccatgagtctgttgatgaagagttaaattctataaaatatttcaagagatttattctgagccaaatatgagtgaccatggcccgtgacacagccctcaggaggtcctgagagcatgttcccaagatggtcagggtacagcttggtttttatatattttagggaggcatgagacatcaatcaaatacatttaagaaatacattggtttggttcagaaaggcaggacaacccaaagcaggggcttccaggctataggtaaatttaaacattttctggttgacaattagttgagtttatctcaagacctaagatcaaaggaaatgttcaggttaagataaaggattgtggagacgaagttttattttgcagagctctcagatagcggacttcagagatagcaggttgtaaaatgtttcttatgagacctgaaagagtgcctggctcttaattgattatctcctggatctggaaaggaaggaaggaaaacaaaggggaaagggaattctctatagaatgtgggtttttcccacaagagactttgcaggacagttccaaggtatggcaaagaaatatattttagggtaaaacattttgattttcttccttgttatgcctgagtcagactggaaagtaagtcacgttatacagggttaaataaaactcatctgatgagaatttatggtttgtagggcatgactccccagaccccttagaaaggaatttgggcaagataaaaaaaaataataatcagagcttagtcctcaagctagacagaatgatgtcacagggtacagagaggtataagaaggaacctgaagttaagaggtgggatcagggaaagaaagcttcatgaacttggtagcatgttgagtttgactgtggtgtgttgggacagttagaattttggtaggtggagtgggtggtgtaaggaagggcttgcgtggtttaaggctctaagatatggtgtgttggataattgggtaggtgttgaccaggcttgtgggatgatcacattatgtcaatgatcccgtttaacttttacaaacattgttttttaatatattagtttttaaaatagactttattttatggaggagttttaggttcacagcaaaactgagtggaaagtacagagagttcccatatactctctgccctcttacatgtacagcttccccgactatcaacattctacacagtatggtatgtttgttggaattgatgaatccacattgacatgtcattatcacccaaagttcatggtttacactggggttaactcttggtattgtacatcttatgggttttgacaaatgtataatgacatttatctaccattgcagtataacacagagttgttccactgccctaaaattttctgtgctctgcctattcatcccccagaggctccccaggacccctggcaactactgaattcttttactttctccatggttttgcctttttcagaatgtcatagagttggagtcatacagtacataaccttttcaggtttcacttagtaatatgtatttaaggttcctccaagtcttttcatggcttgatagctcatttctttttagtgatgaataatattccattgtcggtttatccattcacctactaaaggtcatcttggttgctttcaagttttagtgatcatggataatacaactacaaacatttgggtgcagatttttgtgtgaacgtaggtcttcaactcatttaggtagatactaaggagcacagttgctggattggatagtaaagttgtatagtaatagtatgtttagtgttgtaagaaaccgccaaactgtcttccagagtggctgtactatttgcattcccaccagcaatgagtgacagttcttgtcactggacatccttatcaacatttggtgttatcagtgttttaaattttgatcattctaatagatgtgaggtaaatcacttttcatatgtatattttgagtggacaaaaatacagcagtcaacacagaagactcctgtgattgaatatgtggttatttctccctaccaacaagcaagcggtcacttttacagcagacatcaactgggtgtcctctaattcaatttaattctgacaccatctatctggagatagcatcagctcccacatgttgagggctcagttcccaagatttccccccacttctgatggcaattgcaagccccaagttgttttacctgtgcttctgaaccactggatgtaaaccagggatcccatggccctttccttgggctctattaatttgctagagcagctcctagaactggtttgttataagggatatgacaaaggatacagatgaggagatgcatagggtaagctatgggaagggatactgagcttccatgctctcaccaagtgtgccaccctccagaaacctctacatgttcacctgtttggaagctttcctaaccctgtcccctttgggtttttatggagtcatcgttatttagtcatgattgattaaaccattgggcattagtgatcagctaacctttagcccctctcgtctccctagaggaggctggggcttggggctgaaagtcccaattctctataccttggtctttccagtgactagctcccaccctgaagctatctaggggctgctagatgtcacttaactcattagcatacaaaaagacatcacttgggagattctgaggattttagtggttatgccaggcaacagggacaaagactatattttacaattatatatatcttcccctgaattaatgccttcaaattttcatcccccatttactacttaccatgaatatgctatcttctcacatgtcttcatacttttgtatgagttcctttctttggtaatttggttctgtaggtagtgtctgggtatctgtatttttttgagatggagttttgttcttgttgcccaggctggagttcaatggtgcgatcttggctcaccacaacctctgccttctgggttcaagagattctcctgcctcagcctcctgagtagctggaattataggcatgtgccaccacaaccggctgattttgtatttttaatagagacacggtttctctatgttgatcaggctggtctcgaactcctgaccttaggtgatctgcctgcctcagcctcccaaagtgttgagattacaggcgtgagcctccgcgcctgggtagtatctgtatttttaaaagctctgaagatgattgtattgcaaagccagagttaaaaactacttctagacacactaagtagagtacttggcacagaataggtctttaagaaatgtctgctgaaccgaactgaataagcaaaataactacttagacacattaattttccaaagtcccaagtggtgctttaaacccacttttgtcttcttaagctttccttatgtctttacttactatgttgcctctgtcatcatatattaatgatgaggatgatgttctcacacttgtgcagcattcactatgtaagcagcattgcaagccaaacaggttggatgagttgaaatttcagtgacatcatgatagtcagcacaatttcatcatattggctaacaattcaccagccttgaattagagctcaaaaagcattggatttgctttttaaaatctaaagtgatgcatattaatcagtattgtgaattaggtgtttgtgaggttgcctgataacctaccatttacaccattattcttatgggaaagcatattcacaagttccaaagaacatttcacatcaaatatattaaccttttaaagagaacttgatttctgaattgaagtgtttatggggagtctctgggcaaaatcaagtctatttcttcataattgccccttcttaacatcagaagttggactttgtacattccaaatacgataatgtcaaacatcttatatcaactacttttgctctgttgaagaataagaccgacctcttatcaaatattatggcagagtctcagcatagatgactgagctctggaatgcatgctggacttggcactgggaagatatctagataagacaattttatgatttgtagatttctttatagtaaccagtctggattcagtttaagtcttttatatatatatatatattttacttaccctctgctccacaaaagtagaaggaaataatctaatgaaattatgtctaaaatagatcccatgcttttttttttaggtttatgcatttcaccataatactggctcaaatcctatactagatgactttctgtttttctctaccatgaaaatttgaatttgtctatttttgtctgttgttgatacagcaaactagataatcttttgggaaagcactgtaaattgtgaagtattgtgtaaagtaatgttttttgtgtgtattatgctctttcccaattttgcaagattatatactcaatgtagaaaatgtaggactttcgcctgtaatcccagcactttgggaggccgagacgggcagatcacctgaggtcaggagtttgagaccagcctgatcaacatggtgaaaccctgtctgtaccaaaaatacaaacagccggctgtggtggtgcacacctgtaatctcagctacttgggaggcggaggcaggaaaatcgtttgaacctgggaggcagagattgcaatgagctgagattgtgccattgcactccagcctgggcaacagagtgagactcaaaaaaaaaaaaaaaaaaaagtaggaatttcaccaaaatcaagtaagcaggaagacaaaataagcacttcgaagtcaattaccaagagataagcactgtaaacattcaatgtagttctttcatgtatttaatctgtgtacataggtatatatattttattcagtgtatatattgtgcaatagttaccactgatttttaattaatattatactataaattttattattaatattctgaatagtattttcagtacaaccttccagtggcttactgtcacacttaaaacccaaagtcctaatgggtatgaggtttccttttggagtgatgaatacatcctggaaatagaagtgatggttgcacaattttgtgaatacagttaaccctgaacaacatgggttttgaacggcataggtccacttctatgcagattcaacaagtatattggaaaagtttttgggagatttgtgacaatttgaaaaacctcacaaactctatatttaaaaaacattgaaaaattaaaaagatatgtcatgaataaatgaaatatatgtaggtagtagtctattttatcatttactaccataaaatatactcaaatctattataaaaaggtaaaatttatcaaaacatacacacacaaacacagagtgtacatagtgccatttgcagttgagagatatgtagacaaatgtaaagcataaaattcactgtaatacatactgtacttctgtaataatttctagccacttcttgttgctgttttggtgagctttactgttgcaggtatctgcttacgacaacgtgtgatgtgaatcatctcagcatgagcagttcaactctccagtaaattgtatatcataataaaaacagatctcagctgggtgtggtggctcatgcctgtaatcctagcactttgggaggctgaggtgggaggacagcttgagcctggaattcaagatcagcctggacaacataatgggactccatctctacaaaaagtaaattaaaaaaaaaattagctaggcatggtggtacatgcctgtaatcccagctactcggaggctgaggtgggaacctcacttgagcctgggagattgaggcagcagtgagccatgactgcaccattttactccagcctgagtgacagagtgagaccctgtctgtattagtctgttctcacactgctaataaagacataaccaaaactggataatttatgaaggaaagaagcttaatagactcacagttccacatggctggggaggcctcataatcatggtggaaggcgaatgaggcgcaaagtcaaacgtcttacatggcatcaggcaagagagcttgtgcaggggaactcccatttataaaaccatcagatctcgtgagacttatttactaccctgagaacagtatgggagaaaccaccccatgattcagttatctccacctagtcccacccttgacatgtgggattgttacaatacaaggtgagatttgggtggggacacagccaaactatactatatcactctttaaaaaaaaaaaaggtgatgtctcatgagtcttgtatttttttattgtgtttagtgcaataccgtaaaccttgattaacacaccatgggaccatgggacctatgtgaaataccactagtgatactggaagttctcccaaaaagcagagaaaaataatggcagaaaaaaaaaagaaaagaaaaattacaagaaaaagttgaattccttgatatatacagtagattaaggtctgcagctgtgttgcctgccatttcaaaataaatgaatacagcatatggacgattgtaaaaaaaggaaaaggaaattcatgaagctttcactgcagctatgccagcaggtgggaaaaccttgtgctttttgtaaaacacctttttatcttgtattgaaaatgcaatttttatgtggatagaggcttgctataagaaaaacatacctatagactctaatatgattcaagaaaaagcaaagccattatgtgacaacttaaagcaaagggagggtaaaagatctaaagctcgagaatttaatgccaacaaagaatggtttaataattttaaaaagatgtttggcttttaaaatgtcaaggtaacagaaaatgcagtgtctgctgcccaagcagcagcagatgaattcccagatgtcattaagataatcattgaggagaaaggatgtctgtctgaacaggttttttaatgtagatcaaagtgccctactctggaaaaaaaaaatgccacaaaggacagttattagtaaggaagagaagtgagcactgggatttaaggcaggaaaggatagccagttctactgttttgtgcaaatgcagttgggtttatgattagtactgcccttatctacaaaggtgctaacccctgagacttggagggaaaagataaccaccagctgccattcttttggttgtacaaagagaaggtgtagacatgaaaatcctttttctgaattggttctgtcaatgctttgtccctgaagtcaggaagtaccttgccagtaagagactgccttttagaattcttttgaacaatgcctctggccacccagagccccatgagttgagtaacgaaggtgctgaagtggtctactttcccccaaacacagcatctctaattcagccactagatgagggaatcataaggacttttaaggctcattatacacagtactctatggaaaagattgtcagtgttatggaagagaacctccctagagagaacatcacgagtcccgaaggattacaccattgaagacaccattgttgttatggaaaaagtcatgaaagccatcaagcctgaagcagtaaattcctgctgaaggaaactgtccagatgatatgcatgacttcacaggttttatgacaaagccaatcaaataaattatggaagagattgtggatatggccaaaaagtcaggggtgaaggatttcaaggtatagatattggagaaattcaagagctaataaacactaattaacacaagacaacttgatggagatgaatgcttctgagccagtgccagcaatgaggaagacatgtagaagcagcagtgccagttaccaaaccaacactaaacactgtggcagaagggttacgtttattcaagactgcttttcttttacaacatggacctttctatgatacagaccctgaaactaaacaaatggtggaataagattggaactgtataaaaactttttttttaaagaaatggaaagcaaaaaagttaggcaagttatcatgtattttcataaagttacaccaagtatgtctgcctttcttgccttcccttctacctcctttaccttttacacctttgccaccctgagatagcatgagcagctcttcctattcctcctcctcctcagcctactcaaggtgaagacaatgaagatgaagacctatatgatgatccacttccatttaatgaataatacatatattttctcttccttacgattttctgaataacatgctcttttctctagcttattataagaatatactgtaaaatacatataacatgcaaaatatgtgttaatcaatcatttataattgattaaagcttccagtcaacagtaggctattggtagttaagttttgggggagtcaaggttggttcccctaacccccatattgttaaagtatcctgtaagtttattgaatttgtttatcagttttaagtgttcttttggtggagtctttaggtttttctagatgtaagatcatgttatctacaagcagggatgattcaacttcctcctttccatttagatgccctttctttttcctttttttttttttgttttttgagacggagtttcactctgccacccaggctggagtgcggtggcatgatctcggctcactgcaacctccgtctcccagattcaagcaattctctgcctcagcctcccgagtagctgggattacaggcgcccaccaccatgtgcagctaatttttgtattttttgtggagatgaggtttcaccatcttggccaggctggtcttgaactcctgaccttgtgatccacccaccttggcctcccaaagtgctgggattacagatgtgagctaccatgcccggctgttttttttttcttacctaattgctctggctaggactaatagtactatatttaataagagtggtaatagtggggcatccttagcttgttccaattcttagaagaaaaggtttcatcttttcccctttctgtatgatgttagctgtgggtttgtcacatatgccctttattgtgttgaggtatgtttcttctatacctgatttgttgagtgtttatcatgaagggatgctgaattatatcaaatattttttctgaatctcttgagatcatatggtttttgtccttaattctgttgatgtgatatatcacatttattgatttgtgtatgtttgaaccattgttgcatcactgggataaatttcacttgatcatggtgtataatctttttaatgtgttcttggattcagtttgctagtatttttttgaggatttttgaatctatatgttcatcagggatgttgacttgtaattttctttttgtttgtgtgtccttgtctggttttggtttcagggtaatactggcttcatgtaatgaacttgtaatagttcctttccctttaattttttggaataggttgagaagaattggtattagtcttttttaaaagtttggtagaattcagcagtgaagccttgtagtaattcctttaagtatttcttgtagggcttgttgagtggtgacggaattcccttagtttttgcttgtttgggaaaacttcatttctaaaggatagctttactgggtatcatctgggctggcagttttgttttgttttgttttgtttttgtttgtttgtttgttttttcctttcagcactaaacatatcatgccattttctcagcctgtaaggtttctgctgagaaatctgctgttagtctaatgggcattcccttttatgtgacttgatgattttttcttgttgtttgtagaattttctcattgtctttgacttttgaaaatttgactataagtgccttggagaggaactttttgggctgaatttatttgagaacttttgcgcttcctgcatctggatatccttctgtctctcaaggcttgggaggttttcagctattatttcattaaataggttttctatgccttttccatattttcttttcctggaattctcataatgtgaatatttgttcgcttaatgttgtcccataaattcaatcggttttcttcattctagtatatacttttttcttttctttgggttatttcagaagacttgtctttaagttcggaaattcttctgcttgatatagtctggtgaaggcttgattttattttttattttattctctgaattcctcagctgtaagatttctgtttggttattttttatgatgtttctctctgttgaatttctcatttagataatgaattatttttctgattttggtaaattgggttatctgcattctcttctatcctgttgactttcttaaagttattttgaattctttttctggcattttataaatttctttttttttttgtggagtctgctattggagaattaatgtgttcctttggggttgttatgtttttttcatgtttcttatgtccctatattgatatctgctcatctggtggaatagttgcctcttctaattttatgcagtagctttcacagggaaagacctattcctttagatgggtcttatggtgtctgacaggtagagtacattggcttaggttctgagtgagcacagttgtatggtctctgtgcagtttcctcagctgtaacccatattagtgatgtttgcaagtgcctcagtggcctaggctgtggaagtgtgtggtggtagtggtggtgtgactttgccagagatgggctcgccaggctggttgttgagccaggggtatgcatgtacacatagtgagtcagctggcttggagacagggtcactgagggcagggctgctaggctacttctcaggctgagggtgctggtgtgcagagacctcagggactggctctctgggctgtttatcagacttagggtgcagacatgttgtggtttggctgcttagggtctggcttactgaggaaagagccaccaggctgtttatccagctaggagtgcaggtgtgggacagtttggctggcttgtggagtatgtccgcctagggtggttccaccagactgtttcctcatttgggggtatggacacacaatgattaggccagtttggtggcatgcccactgggggtggtctgctgtttctctggctggggtgtgagctcacaatggtttggctagcttggggaagtgcgtaccaggggtgggctgctatgctgtttctgcagctggaggtgtaggcatgtggtgttttggccagcctggggttgacttccccactatgcagtaccagagtcatgactgtccctgggcccaggctctcagtaactggagtcattgcattacagtccttcatgtggtctttatggaatgatggtagagcctcaaagctagagagacacagtggctattggcccccagagcaggacgccctccagcagtggctctggtttcaagaagatgctatgctgtagcagcttaggtcatgcaagggtggggagcgcataacacgagctcctactgtggagtaatgtagctttgtaaattccaggtagctctccaaacagctcaaggcttgtaaggactgtgggattctcctgtagtaaggactgcaagtttctgtggctggggccctgtgcttaccattaccccataagaagtccctcctggctcccagccagtctcactggggagatgggacagcagaggcagggtgccttgcacctcttttcatcctgcttttgtgctccacagggatcttgccactctcttgctgcacttcagtgctttccctcagacaatccagttgaattgtagttgttgattctgtgtttgggtccctttttggggggcaaaggcacgcattgggcacctctagtcagccatctttctgattttattcatacaagataatttttataaaattaaagtataaagtattatataattatcttaacctttcctgtgtaatatagtttatactgaaaaacaaataatttgtactataatatacatcctgtgtactatatttgtactataatatcctgtgtaatacagtttatactaaaaaacaatttgtaatatagtttatactgaaaaatgaactattttctgttcttatatgtacaggaaccaagttacatgagaacattgaattaatgcgatatattatacctgtctatgatgttcagaaacttctctagaaaagcattttacaaaaaattaacttgtgttgtctatattatatgtagacaaaaaatgaaatgaaaggtaccaccctattctatttcaagatccagtagcttttctgcttttactttattcagggttgtttctttcgtttttagaattttgagaattgcagtcaaacaaacagatcacagactttgatacaaaatatctaagtatttctgctcatcacataagaaaatctccattttgtttgacttcaataaataccaaaaataagtatttggtaacagatcataaagagttcttttatgttttcatgtgtttatcttttcttctggtataatcttcatatcttaaaactagagaagggacctgtatgtatattatagtagatgaagtattctagtaatatttaaaaccagaaagtcaaatataagggatccacatggtatcactacaaaagtggtataagaatagagagacctgttcacattcaagaaacaatattaagaatgcagtttagggctgggcacggtggctcacacctgtaagcccagcactttgggaggcagaggtgggtggatcattcaaggtcaggaattcgagaccagcctgaccaacatgttgaaaccctgtctctactacatgtaaaaaaaaaattagccggacatggtggcgcatgcctgtaatcccagctacccgggaggctgaggcaggagaatagcttgaacctgggaggcagagtttacagtgagcctagattgtgccattgcactgcagcctgggcagcagagcgaagcttagtctgaaaaaaaaaaaaaaaaagtttaaggccaggcacagtgactcatgcctgtaatcccagcaccttgggaggcccaggtgggcagatcacttggagccaggagtttgagaccagcctggccaaaatggcaaaatcccatctctaaaaaaaaaaataaatacaacaattgttagaggaatgtatattaatcacagttgcttttgactacaagtaacagaaatttgacaaacagcaatttaatcaaataaggtattgatttttcttctgtaatatgcctgtgtgtgtgtgtgtgtgcgcacatttttttctttctcctgaacacagttgaaagtacatacatgcattatggcagttcactaaatatgtcaacatgtgtcacctaagaacaaggacatttctatatagctatattctgttattatattctagaaatgtgtaactgtgccataaattttaatatcccatactcggttttgtacatcgttttcaataatgcactttttgcatttttttaaaaaaaatcaggatccagttaaattttttttaatttaatctagaacggttttcttgccttttgtctttaatgacatcagtgcttctgtgagtccaggccagttattcctagagtgtcccacaatttttgtttttccgattgtttgcacataatttgattcacattaaacatttttgttgaaaatattaagtaggtgatgtttattcagagtaccacattaggaagcacatctatcagtttgtcctcctgtggtgatgtggtaagtgtaatcaccttggtaaggtggtatctgccagatttcgcagttaatctaccatttcctttgtcagtaatctgtggagtgatactgagacttcatgaatatttattcccaacagacctttttcttgttgggaaataaacatccttttatccgttcctaacttaatttttacattgatagttagaaaatagtgatttttctggttctaccattttttctgctttagctggcattcttttataaagaaatgcatctctcccagccttaccctctgataatactggaatacagcacactgaatcacaaaataatccatgattcatatggaatcttttttattatctcttttttttttttttttttgagacagggtctcaccctgtcgcccagactggagtgcagtggcgcgatcatggctcactgcaaccttgacctcctgggctcaagcaatcttcctacctcagcctcccaagtattaatatttgggactataggcacatgccaccctgtccaactaattttttactttacgtagatttgtatggaatcatggattattttgggattcaatttgctgtattccagtattatcactattttgatgctcgaattgttctaaatttggtcaatcagagtttttttgcactggtttctctgtccttctgacatgcacccatcaatttttgagcatttctttgtcctctggcacaagaagatatcctaggtccacattatactttttgtgcttcagacctggaatgtgacatttctcaaaagagctctggtttctttcagtggggaatggtattttgaagccaaaatctatactattggatttatttttttcttccaagtgtcctccttctccctgagaagtggtgccttttctgagcttgctatacctggttccacatatttttatgcctctcttttggattctctattagcttggcctctgcaatgttggatctgaaatgtgtttttagtatttcccagtaaaagtgtgacttaattttttttgggagtgatacctatgcttcagcacccctagattcccactccctctctcctctgtttctgtcatttgccacctgattttctctgctccagcataggttctggggcttgatcttctgaaactggcatttctcatctctcttacatgtaagttaaagtttttagtaatctccatctcctagttttacattacatatgggatgggatatgggtagttttatttgctctatttgttgatttctttgaagaatgtgtgttgtgattagaatttaggtgactataattattctataaaaattggaattcttcaatttaactttttatggctttctaagatgtgaaatatctgactttcagttgaagttttaatttaaacttggtgactcttggtaatcagtaagtaaacttgggcaagccttcagtatattttgaagtaatttatgccatttgtcctaccctaaatggcctctaaccagtgtattctttttgagtccctgggtttctttgctttttagtagcctttctctttccacttgcagaccaacatcagtcattttcttctgttgtcagtgtgctgtctactaaatcctatccactttatgaatagagaattaagaatttggatgacatatcttgttagacttaggtatgccattagataagcaggaccaaatgaaagcctgagggcctcttggagctttatttaggatctgaatctcctctgaatgtctatttggttattaaatagccatttctgccttatttccagttctttactgtgttctagtttgacagttaaactgggtaaatcatcttaaaaacaggttttgctttaggtttcatgtaatgatattgagggatgcaatacaacgttaagagcatgaatggttctggaatctgattccttaggttcagatcctggccctactacttattggttgtgtaactgagtagttgcttaaactctctgtacttccattttctcacctatgaagtgaagtataataatagtatcttcacagattttgtgaagactgaaaaagatgatacatgacaagtctagaatggtgctttggtgttgataattgattgttattacagttgatgtattaataaataataaaaatgtgttggatattcactctgtataaggagcagtgataggctgttaaataaagcagatcatcagatctttaggataatctgtttgtcacttgctccccacccctctccgtatatcaatcgtgacattaaaatgttttaatgataatttattaaacctttatgcttcccattgagaaagtgcaaatggttattttattgtgtattcactatttagggttttactttaaaaggaacactataaatgtctgagtgatgttaatttcaaagattgtttatagcattctttttgtattctataaagacacatagcttgtaatgaaattacactgttgtggagttatgtgtccactagaggtcacattatacttttatattacttaaaatgtcttttatcttcgtagtgtcagtgaagcttacttcaaagaaagacagagataggaaaagttcatgtattgcttcctgaaaaaatacagtttaaaaaaggaaagaaagaaatttaagatggactgttaaaggaaccagctttatatgccatagttttatatttgatagcttattactctgttggttagaaaattggttcgtagtatggaagtaacaatgagattttggtacccaagtcagaaataggaactgcttactctcagccgcattttttgaaattacttttgaatgattacatgtaggtacagtcatgtataaatgtgttctacatttattatctttttttttttttttttttgaggcagggtctcaccgtgtcccccaggctggcatgcagtggcacgatcatggctcattgcaaccttgacctcctgggttcaagcaatcttcatacctcagcctcccaagtattaatatttgggactataggcacatgccctctgtccagctaattttttactttatgtagagatgggggtctcactgtgttgcccaggctagtcttgaattcctgggctcaaggagtcttcccacttcagcctcccaaagtgctgggattgcagccaccacaccctgcctattacctatttttattaaaaggagtgtggatttggagtgctgcctacttggagagtgacctacccaagttacctaaattctctggactttcaatttctatgtaaagtgttaataatagctatggcaatgttatgttgaatcacaacatttaagtgaaagttctgtgcaaatgatgcaatgagtcatcagataactgctgttgtttttagcctactaaggtacaatctgatatacctaatgctaaatgacgagttattgggtacagcacaccagcatggcacatgtatacatatgtaactaacctgcacattgtgcacatgtaccctaaaacttaaagtataataataaaaaaaaaggtacaatctgggaaaaagaaaggaatctttaaatttttagcctctttttttctgaaacaatagattattagtttgtacttacttcttggatagccattgtggctaacaatagattgtgaaaaattcattcatgtgatactcattccgatgcttgatattactgtctatatgttacagccttaagtgtggaacagctatctggttaaaaaaatgagtactgactcctggcagtttcacattttttgtggaactaataggtttaattgagtttatgtgttggtatggtctattttttactgataattttggtccttatgcggataatgccaacattcaagtgctgaatatcaaggttaccaagagatgggtcaggtagttatggtgttattgaagttggtgcttaacatgttttcattatctatcaatcaaccacaaataaaaaaggcaatcttaactattgtatttacagtgaaaagggaaagctttgattggcactgtcagcatttaacatgcaaacaatttttgaactttggtatgtggaaatgattgtgagcctaagtagaacactgttggctcaaaacaggaagcaaatagatatttttaaaaaatgctaatttatttcttactgaaaatgtttggttttcactattccccttcttgccttcctgaactcttaactgctgctgatggccccagagtttgcatgcagttctgcctgatctgggtctctttgaccccaaagcctatagtcagacccttttacacttaccagatcctcgagcatgggatctcttccttttaaaacctttatcatcatgacatactatatgtttcttgtatttgaaatgttttctggtaagtacatattatatacagacttttcgtattttatgaattttcttggtaagaatccccagtagatgtctgtcatgaatggaaactatcatgcaaggttttgggatccgttagattctaggcttgaggctctgttgttgactcttccatgactttgggcaggtttttttaatctcattatttgttaaatgaggacaatcatttcaatatacagttgttgaatgaatgatatatttcatatctagtctactgatttcagaaacatcgccaagggtttcgtttgcctttttgttttgttgctttttaaggaggtggctattcttaatcttttaatttttttactgtatagataacagacaagagagtatccagaagacatgccattcttgaggtggcaggtggtcagctgcgaatcaaaccggtaaatatgttattaatgattcattttaactttcatctcttaccctttcagttcccaagcagaggtgcctattttctaaggttatgggaatagggaattaatgtcagaatatacccttctcattgccagaaaataattaggagataaagatctaaactgtgaggaaaactacatattttctcataggacaatgccacatttacctaattagaatttcaatgaaagatgactgccagttcatgtatatattatgatttggtttaaaattgaatactccaaataataagaaagcccataactattaatggttggttttttgagctggggtagtgaccaaagtaacttaaatgttatagggttatattttaacatattctctatcactctgtatagagttgaatatttctaaaacttagactttgttcaacttcgaggtttgaaaaatgattttaatttgaaagtttttgttgagggctcgaattttaattgcttgctttatagtttactgctgcgaaatcactgatgatatgcagggacagccagtttccaagaatatacaatgtgattattccttttcatttgcagagtctattgtgtaagagaatgaaatacgtacataagggtccatttattttagactagatcgtatggtggtaaaatttcatggaattcattaatttataactttttaaaaccaatttgtattttcatattttatataccactgcctgttaaatcattagttctttcttttacacagatagtacttgcttttattatcctatgtttaactgtttgcaaatttggaaagcatctttttaattttagtacttggaaattttttgaataaaaaattattcaatgtattcaccttatctcaaccttgaataaataatctttaaaagagtttatgtctcatcttcattctgcattatcttattgtcttgaaaaagtgttaatatctggagtcaacacttctttaggagccactgtatttaccattagatattcatctctgtatcctctccagctatcttattcttctgagatgacatactggatcataaggcccttgagtgtaggaactctgactaatctttgtatccctagtgtttagcatagtgcctaagacatagtaggtatttaattaatatttgttgaatgcatgagtaaacgctgtggtgagaactatctatggcatatctaggagtgggaacatggtagatttttacaaaagtatgttattctctagtgcccaatttctaataccctgccaatgaactaccatggcctaaaataagtttttttgttgttactaaagcacattaaaggaaagaatagagggatcttgaaatatagaaatgattattttttatttatatagatttagggagtgcagtgcagttttgttacatgattatattgtgaaatggtgaaatctgagcttttagtgtaaccgtcacctgaatagtgtacattgtacccattaggtaatttctcaaccctgtcccacctctcacactaccacccttctgagtctccagtgtctgctctgccactgtgtccatgtcagcacatttattttgtgaacaaattaaccagtggaattgtggacaactcaatagatatcagattttctctttacactctttgtttactcaatgataagaagaaacccttcttataacaaaattgacatggcattaaatttttttatatcaaaaataggtgattagaaaaccgtcatatttactaatgcatgaatattttaaacatttacattttttctcagtgttaatcaaggacatttatattttaaaatgttttataaattggctttaataaaggtgcttagttggagttgtgtctatacttggctgaaaattattcagatatattttgtacttttgtggctattcaaaagagtactaataaggctgggcgcggtggctcacgtctgtaatcccagcactttgggaggccggggtgggtggatcacgaggtcaggagatcgagaccatcctggctaacacggtgaaacgccgtctctactaaaaatacaaaaaattagccgggcacggtggtgggcgcctgtagtcccagctactctggaggctgaggcaggagaatggcgtgaacccgggaggcggagcttgcagtgagccgagattgtgccactgcactccagcctgggcgacagaacgagactccgcctcaaaaaacaaacaaaaaaagagtactaataatgtaaaataaatatgcccaaattaaaggtgattttattagttgaaaatcttaccttgagttaaattttatccagtatgtactgagccaaatttctatgtgagattttagcagtgttcagttataaaaaggctcctttttaaaatactcttcacttttactgggtctttaattagatggtacgcagatcataaaaccactatgtatgacattaacaggtgtcttttgagcacaaaactgtagtagaaataatactagaagctagagcaaaaattcctcatgaccactagatataaaactaaaatttggaatgatttatttaagttatacctctgtttatgatcttttaaatattatttagtgtaattttgtaaactttcccataaatgtgatgtttagacatgggagaaaggtagctcttttttatcctttttcgagtacctttttttgacaacttagaatgtcatagccttctggagaacgtctgatcttaaatactcagcaaattctagaatgggaatgagagcccaggttctttgaactctgtagtatttttttgttgttgttatgtttctgaagtcaggattctcttggcattgggtgtcttttctttaaaaaaatttcttcaagttacaactaattgatgatctgtcttaacaagaagttttagtgccttcagttgaataatattttagaactgaaagcaaccttagatttggacttatgtatgtggaaatttgactgggccagggctagcattgcgtatcagtggggaagaggagtttttatcagtaaatggtactgggacagttatctgtttggaaaaaaaaattagatccctactgcagacccaaaaatctactccaggtagattaaatgtgagagtcaaactataaaactcttagaatataatatagggaaaaacccttatgactttagagtagggaagggtttttaaacaggatataaaaagcatgaaccataaaaacagttggtaaaagccaatgaaataaaaataagaaacttcgtttatcaaaagacactataatgaaaatgataactacaacagggagaagatatttgaaacacatgtaattggaacacgtaattaggccattcatgcattgacataaagaaatacctgagactgggtaatttataaagaaaaaagatttagtctgtgtgctgtggctcacacctgtaatcccaacaatttgggaggtgaaggcgggcagatcacttaaggtcagaagttcaagaccagcctggccaacatggtgaaaccctgtctctacttaaaatacaaaaattagccaggcgtggccaggcgcggtggctcacgcctgtaatcccagcactttgggaggctgaggcgggtggatcacgaggtcaggagatggagaccatcctggctaacatggtgaaaccccgtctctactaaaaatacaagaaattatccaggcgtggtggcgggtgcctgtagtcccagctactcaggaggctgagacgggagaatggcatgaacccaggaggcggagcttgcagtgagctgagaccacaccactgcactctagcctgggtgacagagtgagactccgtcccaaaagagaaaaaaaaaaaattagccaggcgtggtggtgggtgtctgtaatctcagttactcgggaggctgaggcaggagaattgcttgaaccccagggggacagagatagcagtaagctgagatcgcaccactgtaatccagcctaggagacagagtgagaccccgtctcaaaaaaaaaaaaaaaaaaaaaaaaagaaaagaaaaaagatttaattggctcatgggcaagctttacaggaagcatggtgccatcatctgctaggtttttggtgaagccttagggaactttcaatcatggcagaaggcaaaggggaaataggcatgtcacatgttgaaagcaggagcaagggagagggagtgaggggaaggtgccacacacttttttttttcttcgacttttaagctcagggatacacgtacagggtgtgcaggtttattacctaggtgaatgtgtgccatggtggtttactgcacagattattccattatccagctattaagcccagcatccattagctattcttcctgatgttctccctcctcccaccctccactctttagtaggccccattgtgtgttgtttcccaccctgtgtccatgtgttctcatcattcacctcccacttataagtgagaacatgcagtgtttggttttctgttcctgcattagtttgctgaggataatggcttccaactccatccatgtcccttcaaaggacatgttcttgttccttttcatggctgcagagtattccatggtatatatataccccattttctttttccagtctatcattgatgggcatttaggttgactccatgtctttgctaagccacacacttttaaattactaagtctcacgagaactcatgcactatttggaagatagcaccaagccatgaggtatccccacccccatgattaaaatacttcccaccaggccccacctccagcatttgtggattacaattcaacatgagtttcaggtggggacaaatacccaaactgtgtaattcttcccctgacctgtcccaaatctcatgtccttttcacattgcaagatacaatcatgccttcccaataattctccaaagtcttaactcattccagcattacctgagaagtccaaagtctcacctgagacaaggcaagtctcttctatttatgagcctgtaaaatcaaaagttatttacttctaagaaacaatgggggtataggcattgggtagacatccctgtttcaaaacaaagggtctgtaggcccaacacaagttcaaaacccattagggcagtcagtaagtctcaaagctccaaagtaatctttgactctgtgtccatatcctgggcacactgatgccaagggtgggctcccaagacctttggcagctccacccctctggctttggagggtacattctctgaggctgctctcacaggctggagttggtagatatactatgtttgggtctagaggatggtggccctcttctcacagctctactaggcagtgtcccaagtggggactctgtgtgggacctcccatcccacatttattctctgcactgccctagtagaagttctcttgtaagggatttgccgctgcagcaggcttctgcctggatacccaggcttttccatgcatcctctgaaatctaggtggaggctgccaagaatccaccactcttgcactctgtgtacccacaggcttaacaccgtgtgagagctgtcaaggcttatggcttgcatcctccaaaatggcagctcaagctgtatgtggggtcctttgagccatggctggagccagagcagtgggaatatggatagcactgtcccaaggccatgcagggcagcagggccctgggactaacccatgagatcattcttctctcttaggcctctgggcctgtgataagaggggctgccatgaaggtctctgaaatgcatttgaggccttttctccattgtcttggatattagaacttgtttttttgtttgtttgttttttgttttttgagatggagtcttgctgtgtcacccaagctggagtgtagtggtgtgatttcagctcactgcaacctccacctcctgggttcaagcagttctcctgcctcagcctcccaagtagctgggactacaggcgcgtgtcaccacgcccggctaattttttttgtatttttagtggagatggggttttgccatgttagccagcctggtctcaagctcctgacctcaggtgattcaccagcctcagcctcccaaagtactgggattacaggtgtgagccaccgtgcccagcctgactttttttttagttgtgcacatatctctctagcaagtggttgcttcacagcctgcttgaatccttctcctgaaaaagctttttatttctctgccacgtggctaggctacaaatttatcaagcttttgcactctgcttcctatttgaatatgtgttgcaactttaagtcatttctttgcttatgtgtttgagtgcaggttgttagaagcagccaggccacttcttgaacactttgctgcttagaggtttcctctaccagattccctaaatcatcattctttaggtcagacttccatagatccctagggtgtgaaccaaatgcagccaagctctctgctaagacgtaacatacttgacctttgctctagttcccgataagttcctcatttccatctgagacctccttagcctggacgtcattgtccatatcactatcagcattttggtcacaaatttgctgatcgtttggtcatttaaccaatctctaagaaattccaaactttctctcatcttcctgtcttcttctcagccttccaaacttttctaactgctgcctgttagggagttctgaagtcacttccacacttttacatatcttcatagcaatgtcccaattccagtaccaattttctgtattaggccattcttgtgttgctataaagaaatacctgagactgggtaatttataaaaagaggtttaattggctcacagttttgcaggctttacatgaagcatggtgcctgcatctgcttggtttctggggaggcctcaggaagcttacaatcatggaaaaaggcaaaagggaaaccagtacatcacatgttgaaagcaggagcaagcgagagagaatgggagggtgatatggtttggatttgtgtccctgcccaaatctcatgtcgaactgtaatctccagtgttggaggagtggcctggtgggaggtgattggatcatggtggtattggatttcccccttgctgttctcatgatagtgagttctcacgacatctggttgtttaaaagtttgtagcacctcccccttctctctctttctcctgctccagcaatataggatttgcctgcttcccctttgccttccaccatgattgaaagtttcctgaggcctccccagccatgctgtctgtacaggctacagaactgtgggtcaattaaacctttttttttttttaaataaattacccagtcttaggtgaaaacagactaatacagtgtgggaggtgcccactctgtattagttaaatgaccagatctcatgagaactcattatctttaagacggcaccaagccatgaagcatctgcccctataatccaagcacctcctgccaggccccacttccagcattgtggattgcaattcaccatgagatttgggcagtgacaaatatccaagctatatcaggagtgctatccaaaacatatgacagatgcctttaatcaatgagaaaaaaataaaaaatccagtagaaaaatggactgaagacttgagttgcacattagaaaccagactagctaataaccatgtttatattaatatagtttaataaaatgcccattatcttgaaatagattgatgtatttattcagcagcttattgtagctgcactgtctacaaggtgcaatttaaagacatttagagaatttctaacactgattttaattgttaatggaagtttaaagatcttgaaaatcagaatgagatggacaagtgacttctagttcattcattttatcttaatgtttgttaaatatcacttattctctgttccctgatcagtcacaaattctttgatctactaaagcaagttatctatacaagtgtaataaaatgtcaagagggaaattttagttaaaaatctttgtaaaattacataaatgaatatggcaaatgttttgttatgatgatcccttctgtatactgcatgccccaaattatatttaagtgattaaatggttttctgcttttctttaacttggaaatccaaacttaccaccaaataaaaaaatagctttgacaaggagagttgaatgcaattagggcaattactaatttgtacttttaaattggatgactttctgccttttttccctctaatatttctcctacaaaaaatgctgtagctctccagcagttctaggaaatagtgcatgaggagatgatgctagctcatgaggagatgatgttagcttttttatatttcatctaaatttaatctacagcctagtatcagcagggagaaaagacattacaaaggcaaactgatgatgatgttctttgtaaatgactgtatcaccagtgattggttatgccctcagggcgaattcatagctgtcagtgcttttatttcattttaataaaatcttactcacttggggtcgtggatgattgaggcagtagctctataagttgcagtttttcttttttgccttttattattgaccctcaaaatatacgtctttgggtggttgtgtttttttattgcacaaagttcccgaattgagattgtttttcttctcatgaaattaaaattgtacttgtgaaatatctggaaaatcctataataatagcctttcctcaacttattttgttaaaaaaaaaagctttccaaattaaacaaacaaacaaaacactgaaaataaggtgctttttgggggtatacatctatcattctttagtatttaatgataactctaagagaaagctataggaaattgatttgtattttagtttcattttttgcagggataatgcatcctttgcaccacttctaaagttatagcatgatctgttgaagttttaatttataatctcatgaatttgttaaaaggcatacaccaacaatgtctctcatgtaggtagttatatcttttaatcatggtgaggttgggtttgccaatattttgcctgctcttgtttgcttttagaatcaaagttaaacttgtctcattgaagcagttgggagtccttaacccttttgtgatatcaagaaaagtttgaatattcagaaaaatctttaaatccactggggtcttgttttgggagggattgaaaagatttttaattattgattgtacttctgaaatattacaggtccaattcaatctcctttctctaataattaaatactctcaagccaggtgcagtggctcacacttgtaatcccagcactttgggaggccagggcaggtggatcacttgaggccaggagtttgagaccagcctggccaatgtggtgaaaccccattgctactaaaaacacaaaaattagccagttgtggtggcgggcgcctgtagtcccagctactcagggggctgtggcatgagaattgcttgaacctggaggcagaggttgtagtgagtagagatcatgccactgcactccagcctgggtaacagagcaagactctgtctcaaaaaaagaaaaaataaataaatactttcaaacaggctgcacatacatacacgtaaacatactttaaaaaaatctatttggtgttattaggtaattgtctcttttggccatatttacaaatgtattcctataaagtatttacagtattctgttatttttcaaaacttttattttttgtgtaattatgccattgttttcattcctaattttttggtgtgtaatcttcctttttgtttattaatattgttaggtttttgtatactttgtaactttttaaaagctactttttggacttcatgtacgtatagcattttagttggagtatatgtagtttgacattgattttttaacttattcagtgagtaatatgaatttaggtttacgttagaggatcaaacattagacttgagtatcatttttactcttcattttggaatctcctgtattaacagttttaggaaaaggaaaagatgatcatggaccatactcatgggttcactttctttgtggctggatttgctgactgccaatatttaaccaagtataatttaaatattaagtgctttccgctgaggaaaacatactcaaacagaatattgcgtgatctctgggtttgtgatgcttttgtaaagaaatgtagtttccttaagtatgttaccttttccagtcttaaacaatgttatgcctttgtatttaacatcctagcctttgtaagtttgggaccatgtcagtatttaacgttgtttagagactcatctgaagttttaaaatgctcatgaatgagaagaacatggtcttagcctataatcagaagcaagcgtcacttaaagaatattcagagttcagaccaaagctatgtggattcctgttctgactcttgcttctcctgttagttcaacattcctgactctgatgaccatgacatactcaaggaaagggagccttcgcccaaaaggatgaggaatacagggcacgattcccaagttcagcagcggacacaagctcagagcctgtcaatttgtcatgtgcttgttgcactcaaaagctcaacctgccaagagccagaggacagctttgagagagagaaattaggagtggctgttagcatggtgaaagatttctaaacattgtttaaattgtaacttgaatttaaaaatcaaacattcactactctttttaggaatacaatattgcataaatcacactgcatctccattcttatgcaatcttgtgtatagtttgactaataaaataatggccgaccaaatttgtgtcatctctgttttaaatttctacctctgctctttatctccaagttttattttaccgctttcttgtaacagatttaaaggatagaaatatgatgtatggccagattcttatgaaattgaatggtcagaactaggtggattatattcattctgtcttcaaagatgtgtcttttttgtggttgttattgctcagcatatgtccattcccagggtggtaattactttgctgtgatgtctccagaggaagtctcatttaaactgatgaaatagatagaaggaagggtaatagagatcggtgctctctataagattgtacttaaaaaaaaaaaacaccaaagatctgcattatgtagattgctttgtcatatcctaaagcttatttgttttaaaaacccagtgatattatgacaaaatgcctatttgacttatggaaagagccaattttagcttgaatctagttagaatttttaaggcacctcataataggtcctttttgttttttgaagcaactcttgttatctttgctaacatggaaatagtggcaaacataatataaaatagtggatattgtaatagttctaactttgagatctgtttactactttgatttgaatgtggatggtcttcatagtgggagtttcatttaaacaaataagacaattcctctttcaggaggtagaaagaaagctgtgttgtttgcttgagagatttgattagaatcttccttcctatatgtcttagttcattttgtgctgcaataacagaatacctgaggctaggtaatttataatgaacagacatttatttggctcaccattctggaagctgggaagtctaaaatgctggggccgcatctggtgagagcttttttgctgcatcataacgtggtggaaggcattacatggagagagagcatgcatgagagagtgagcaagagagggccaaatttgcatttattacagacccactcgcgagataacaaagttgctcccgagataatgaatccactcttgtgataatgtcattaatccattcatgaggacatttcccttatgacctacatgttaaaggtcctacttgtcaacactgttgccttagggttggagtttccaacacatggactttgggggacacattcaaaccatagcattgtagtttcttattttttaattgtaataagaaattagtaggagaaaataaatggtaaagaaactagccattgtcaggaaattagtgcatttcggatatggaagttgggggactcagtttctccatactaagaattatttttcatatttcttcttgtgatgtctagttgtctctattaagcaaaatagaagactcttttaaccagttagttgataactttgcttttttcctttgagtcctggagaaatgggaggtataccatagcttcttttctctttaatatataaataataattatggtacttataagagttagatttattaaacttttaagtctaagtttatgcttaaatttttttgataccaaaattatgaattcatatttaattgtatttttgttgtaattttgagttacaacattattgtattatattcttttttaaatttaattatattcttttttaatttgttagatacacacaaatccatgtttttaccagtcttcagagaagagtcagctcttaccattgaagccaaatctatggtgctatttgaatcctggagacagcttttctttgttagttgacaaatacattttccgcattctctctataccctctgaagtggaaatgcaatgtaccttaaggtaagtgcctgatgaaatgagagtaagaatgttatttttaatctaattcctcagccatcacaaatccttcggtaggaaccagtagaaaccattaaactggagatagagtaggtgtgtaatgtgtgtgtacgcatgtgtgtgtgcatgcctttgcatgtgtgtgtgttttgtgcacatgcatgtgtgtatctgtttctagaaaacatttgactttggaaacttactatgcgttgatagcagttgctcccacaggtggtgtcttttaccattgtattgagaatgtattttccatctaacagtattcaatatagttaattcgaaattgactaccttttcctcatttttttagctttttgaattttattaaggtattaacttctgacttacacttgtctaactcctctttcttataaaaatagcagaaaatatagaacagagaaactgaggaaatgaggtattagaataaatatactgatgtctggcttacagttaaaattcatacactagtttttttagtcagaagattatttggcttcatttcagcttttaaattatagaatggataaactagacttatagaagtagatggacagaattatgcggagtatgttctctgatagcaatagtattaagtcagaaatcattaacaataaaatagctacacaaatatacaaatactttgaaattaaataacacatttctaaattacccttgggtcaaagagaagtcatagggaaattggaaaacattttgaacagagtgatactgaaaacagcataaaaatttgtgagatgcagctaaattagcccttagggggaagtttatagtcgaatgcctgtattagaagagaagaaatctgtaaaaccagtgatctgtgcttctactttaggaggatagacaaaaagcaaattaatcccaaagaaaatagaaaaaaagaaagtaagaactagaagtcagtgaaatagaaaatggccaaaataaaatcagtaaagctatgggctggtttggtgaaaagattaataaaattggtgaaactgtagtaaggcttactgagaaaaaagtgagaaaacacaaattatcagtatcaacagtagaagaggggatatcattactgctactacagaccttagaagaataatgaggaaatattacgtaaaactttatgccaataaatttggcagttaaaatgaatgggtacatttcttaaaaaacaaaactgatgcaggaaaaatagaaatctgatgaattctatattcattttaaaaattgaattcataatttaagtatttcccataaggatcttcactaatgaattctattaaacttacaaggaagaaataatgccaatattattcttttttctcaaaaaataaaagaagatatacttcccaactcattttatgaagcttctgtaatttagaaactaaaatcagacaagattttacaaaaaaccctcaaaactacagaccaatattcctcataataaagtatttacaaatcaaatccagcaatatgtaaaaaggataatactctattaccaagtggggcttgtccaagggatacaaggttagtttatcgtataaaaatcgaagcaattcaccataacagactaaagaactatcattttaatagatgctcaaaaataattttgacaaaattcaacacctcttcatgatttttaaaagttttgagaaaacaagaaaaagaaggaaacttttttcctacaaaaaacctattagtgaaatgttgaaagttcttcccctaagattgggaatacaacaaagataaaatatatcagatttgaaaggaagaagtaaaactgtgtttatttgcagatgacatgatttgtatttagaaaatccttagtaatctaccaaaaagaaaagcaagccacaaaagtgtctattatatgattacatttatattaagttctgtaataagtaaactaatctgttaaatagaaatgtaatcaatggttgtttccaaggggattgactagtaagaagctacaaaggagctttttgtttggctttgtttcagcttttaaacaaatatggacatattctgtgtcttgttaagggtgcagattatgtgggtgtacgcatttgtcaaaactaatcaaatttcacacttcagatatgtgcatttcatatataaattatatctaaaaatgcttaaatgtaagtggaaaaaaatgtcaggaagttgctttttagttaaatgaaattcattaatcattgcttactactttaaagtacatgtctttttctcttatcatacatgtatgaagcgtgctatttaaactagctgttgaaatgagacatgtaaagaactgatttttttgttacaataaactttcataatagaattacatacttttttcaaaaattaggaaaatgtgcatccttatgaaacacaatatggtcattacctgataacttatttaagctattatatgtctatttaaatttcatttatattgattcaaattagcttattcccttagtgtgaaagaccagtgtctttagggcaagtgtcacactttaaatttatcaggttatgggattagtgaattttgaattttttcgtattgatgaaactgaaaataaacccactttcacagcactgtacttttctcaggctatttaaaccttgggttctgtcatttgctagaagggctcacagaactcaggaacagtttacttactagattacggatttattacaagtgctatattacaggatacaaattaacagccagatgagaagatacatagggtgaggtctggaaggatccccagcacaggagcttctgttccagtggagtgttggggtacaccactctcccagcacatggacatgttcttgttcaccaacctggaagtcctctgaactttgtctttttgggtttttatggaggcttcattacaaaggcatgattgagtaaatcattgaccagtatgattaagtcaatctccagccccttttccctccctggtggtgaggctgggagttcctaccctctaatcatgattggttttcctaacaaccagcccttcatctttagaggctttccaaaagtcacctcattaacatacattcaggtgtggttgaaaggggtatattgtgaataacaaaagacgctcctttcacctgtttcagagctctagccaggaaccagaagtgaagaccaaaatatgtatttcttactatatcataccatcacaggcacattcttgtggtttctgccattagctaggtcctgtagcttcttagtgaatatttagtttcctattgaagcaaggacagtacttctgtagtcaggtaatgatgagttaaccctagttattagattagaagccatgaggggaggtgggggcagatcttgaattgcagtatcatcatgagagatgtctacccgggggaggcagctgcctgatttccagagagggagagtccactgtctgctagcaaggggaagtggactatgtattagataggaagcattgaaatacacttctagacgtttcttgatatcgttggggttttcctgtttttgaactagctctgttttgcagggtcaaccacataaaaacactgcttactgttgtacaagctttacatgtatgaactttttattctccataataatctctatgaggactaggtattgttaatatccctatatgacagatgaagaaattgggacacagaaggtttaagacttgcccaaggtcacagcttaatacatggcagaggtgggatccaaactcaagccagctgtttccagagttgatgctcttactaactaccctctgctgtatgagaatgtttactatagcactcatttgaattgtgaaaacacctgcagaaaggctaaataaatttggtgtagtcctataactatatgaaagagaatgaactaagagagagctcaggttaaaacatggataaatctccctaccataatgttgagggaaaaaacccaaaaaggttataaacatataaaacatacataatttctataaaataatggatgcatatatacaaataatgaaagtataaagacatgcataggaataataaatatcaaattcaggctaatgtttacttttggagaaggaatgggagggaaggagcaagattgaggctgggcatggagagggcttgaattgtatttgtaattaatctggagcaaatatgagaaaatgtttctatcggggtggtagatacacaagtatttatattcatagatatgtagatagactacatatattctctatatatttttgcatgttgaaatatttaagacattaaaaaagaatagaaaaaagcttatatgctttgtagaagttgttaggactcctttgccataattcttttcttccagccagtttgaatttaagaaagggatctgaaccacaaaccaaccatagaagagcttgtcatttctttaggttttccttttactcacattaaaatgttttttatatagtatttagattctgtataattagtcctactcattacctactttgaaggaacatttaagtctatagatgtcagttctagtttgttcatttttcactcttttctctacatatgtgtctatgaaattattctgccaggagtaccaaaactcatgcttttttgagaagtcaaagagaaaaccaaataaggagaagaatacttggttttatattttagtaaattaaattatagcacatttcacttagaagcactaatattaattcttcctccccaatagtgggtgcttaataagtgttggttttttgaatgcattaatgaaatatctgaggatattaaactgagtgataatgtgataagtataacattttgttttcatagctgaatttcattgctgatgaggaagtatgacattttcactctagggagattatttattttcagacacttatgaggaaagtaaagtaaatcctttgttatactgaattacttttttttcaaattgttgaaaatctaagtatgtagattccatataaataactactaattttaatcattgatattgaagaaacaataaaatggtgatgaaaatgtcatgatagtatgataatatgcaagtttcaaattcatttataattatttaaaatgtagttttagatccagctcattcataatagtagcatattttatattaaagatatgaaaatacataacataaacaaaatttggaatatatttgaaagacttaagaataacttaattgccaaaacaatcttagaaaaaaagaaaagagttggagggttcacacttctggatttcaaaacctactatgaagctacagtaatcaggacagtcctggtgtaaagaaagacatatagatcaaggaaatagaattgagggtccagaagtaaacccctacatttagggtcagttggtttttgacaaaggtgtcaagacaattaaatgggggaaagaatggtcttttcaacaaatgatgctgggacaattgaatatccacatgcaaaagaatgaagttagtctcctgctgcacaccatataaaaattaacttacaatggatcagaagtctaaatataagcactaaaactacaaaactcttagaaaaaaacaggtgtaaatctttgtgaccttgcattaggcaatgtttataacaccagaaacacaagcaaacaaaggaaaagtagataaatgggacttcattacacttaaaagttctgtgcttctaaggacacagttaagaaagtgaaaagatttagtgccatccccatcaagctaccaatgactttcttcacagaattggaaaaaactactttaaagttcatatggaaacaaaaaagagcccacattgccaagacaatcctaagccaaaagaacaaagctggaggcatcactctacctgacttcaaactatactacaagcctacagtaaccaaaacagcatggtactggtaccaaaacagaggtatagaccaatggaacagaacagagccctcagaaataacaccacacatctacaaccatctgatctttgacaaacctgacaaaaacaagaaatggggaaaggattccctatttaataaatggtgctgggaaaactggctagccatatgtagaaagctgaaactggatcccttccttacaccttatacaaaaattaattcgagatggattaaagacttaaatgttagacctaaaaccataaaaaccctagaagaaaacctaggcaataccattcaggacataggcataagcaaggacttaatgtctaaaacaccaaaagcaatggtaacaaaagccaaaattgacaaatgggatctcattaaactaaagagcttctgcacagcaaaagaaactaccatcagagtgaacaggcaacctacagaatgggagaaaatttttgcaatctgctcatctgacaaagggctaatatccagaatctacaaagaactcaatcaaatttataagaaaaaaacaaccccatcaaaaagtgggtgaaagatatgaacagacacttctcaaaacaagacatttatgcagccaacagacacatgaaaaaatgctcatcatcactggccatcagagaaatgcaagtcaaaaccacaatgagataccatctcacaccagttagaatggtgatcattaaaaagtcaggaaacaacaggtgctggagagggtgtggagaaataggaacacttttacactgttggtgggactgtaaactagttcaaccactgtggaagacaatgtggcgattcctcagggatctagaactagaaataccatttgacccagccatcccattactgggtatatactcaaaggaatataactcatgctgctataaacacacatgcacacgtatgtttattgcagcactattcacaatagcaaagacttggaaccaacccaaatgtccatcaatgatagactgggttaagaaaatgtgacatgtatacaccatggaatactatgcagccataaaaaaggatgagttcatgtcctttgtagggacatggatgaagctggaaaccatcattctcagcaaactatcgcaaggacaaaaaaccaaacactgcatgttctcactcataggtgggaattgaacaatgagaacacttggacacaggaaggggaacatcacacaccagggcctgttgtggagtggggggaggggggagggatagcattaggagatacacctaatgtaaatgacgagttaatgggtgcagcacaccaacatggcacatgtatacatatgtaacaaacctgcatgttgcgcacatgtaccctagaacttaaagtataataaaaaaataataatatacaaaaaaagaaagtgaaaagacaaccacagaatgagaaaatatttgtaaatcacatataacagacttatattcagaatatctaaagaatcctcaacaatgcaaaggcaaacaacccaattttaaaatgcataactgatttgaatagacatttttccaaagaaggtgtacaggtggtcagtagaacatgaaaaaatgttcaacatcactagtcacagggaaatgcaaattaacaccgcaatgagataccactttacatctactaggaaagctataatcaaaaatataataacaagtgttggtgaggttgtgaagaaactgaactattatacattgtggtgggattataaaatggtatagcctctttggaacatattctggcagttcctcaaaagtttaaacatggaattactgtgtggctcagcatttccactcctatgtatatacccaaaagaattgaaaacctatgtccacatcaaaacttgtacatagatgttcacagcagcattattcataatagccaaaaagtggaaataactcagctgtccagcaactgttgaatagataaacaagtattgtatagtcatacagtagaatattatttggccataaagaggaatgaaatatttacatatgctacaacacaggtgaatcttgaaacattatgctaagtaaaaaagctagacacgaaagaccacatactgtatttcatttatatgaaatatgtagaaaatgtgatctttggagacagaaggtagattaatggttgcgaggagcaggaggaagaggcaataggaagagattgctaatgcatatggaatttctttttgaggtgttgaatatgttctaaaattagatattggtgatagttgcacaactctgttaacatactaataaccactggatagtacactttaacaggatgaatcttatgactatatggattatttttcaataaagcagttataaaaaaggataactcaattacctttactagactacatttaactttccaagttttaattttttatttaaaatattctgtagtgatgctttataaatcctgtgatagttgattactcatagatgtatttgaagataaaataaaaatatatatcacagtgacagtgttttatatttaaataaatgtgtagtagaataatttgtacttgtactttttgaataaaatgttaaatagaattttgttctgaaattttttttgttacgtttattgtgggtaactattaataaaaattacatatggactatagagtgtatatgaattcatctcagacttatgccacaatagaaaataaactagaaatggaattgatgatgttacttaattcctaatactataaattgtgaaaaatcatcaaactactattgaatgtttcttaatatttttcatgttaaatattaagaaaacttgaaaaaaattataatttggaagtacacctgtaacctgtgagtaaaacaggactgggtattgtagtggagtgaactttcatagctaggacaatcagacatttccaagatatgtctccagcacctggcacagtgtttgacacacagtagaagttttaaaaatattgattgaatgaacaaaaaatgtgatgctgcatagtaatttactctaagtaaattttctcttttggctgattcttgccattgacattgaaggctgcctttgaaggagattattccctgtataagaaatactaaaacgaacaaataaaacaagcggttaattagacttttctcagctagacacacttctaaaatcttatatctttagtttttaaaaattcacatttaatgaggacaatttacacacagtagagttcatcccttttaaatgtgcaattcaatgcactaaaaatgataatatagtcatttaaaatactactagagtgagatatagaacatttccatttccccaaatgttctctcctggctctttgtagtctgtcccttcactccacccccaatccctggcaaccattaatatgatttctgtccctgtaactttacctttcaggatgtcatataaatggagtaatacaatataccttttgtgtctggcttctttcacttagcaaaatgcctttgggattcatctatattcttgcacacatcagtagttcattccttgttatttctgagtagtgtttcatctatagtttcaaattttcgaaaagacaaattcgttggatcatgtctatgcatacataagtattaataacccaacaactttggatgaccttactgcatattgcagaagtatgaggtaattggttctgctggcatgtcccacatgtgaccatggatgttcctgttccagaacatttagcttgcagctatactacaagtttggggatatttcataagtagctctttaatacttccctgaacttcagtagcagttatgtgtcaacttaaactcaggattttatttattttttctccaaacgtctaactagcttagctgatgcccttgcagtttacattatctctctagaggctgggtggtgatcttaatttctgtggaccatctggacaaatattaaataaagagctcttaagccttgacagaaatggctgccacacatctcaaaaataattgtggtttctaggcccatgatttggaaagattgatgtattttatggcaatacagcaggtaggaaataaagaacatattctagtctatatattctagtatactataatctgctttttttggttttgctaagtctgagtaaagggacataacttagatgtagttctaaggcagcagaagtgtgttaaatttaaaattaaagaccagtttctattttatcttatagaaacagtcaagtgcttgatgaagataatatattgaatgaaacaccaaaatcccccgtgattaatttacctcatgagactactggtgcctcacaactggaaggaagcacagaaatagccaagacccagatgactcccacaaatagtgtggtgagaaatttgatatctcatccatttataacatgttcttcaagttattatgaaggcagaaaagacaactgaaattaggcctattatgacaatattgccagcatttatctacttttgctgattttaagttaagctctagagaatatggcagtaatccaacagttaaactaatagaaataatttctttgttcaagaaattttatgaactcagtctacagttgcatatgggtattttaatggtagtattctgcaaagcagatattttgcaaattcattcaagatgtgtgattatttttagtaatttataggtgtctttttagtctttcctaggtgaaaatagagactgcaataagcagcagccaatccttgccgagaggaaaagaatccttccaacttggatgttagcagaacatttaagtgatcaaaacctttcagtaccagcaatcagtggaggtaggtttttgtttctactaatgctgactttaaaggaaacattaaacagaatttgaaagcttttctgaagaaaaactataaactagttctatagagatagagtagaggttgtgtaagtgtatagcctagcctagtttttttagttgtgaacatgaagtctaaaacataggctattactttatgccatttatcaaataccaccctaattttttttcatttaacaagtgctattatgtgctagaattatattaataaagacttccaaacaaacctcttggtgctatgtctaggataaaaggccagcacaataagagggtttaatttgatttttaaaaatgccagacgaattgatatactttcaagtttactgattcttttttctgccatctctaatttgctgttaagtctatctagtgaattattcattttagttattgtacttttcagttctggaattcctctttggttcttttgtgtaagtttatgtttctccgatgagattccccatttattcaatcatttggtgtatttttctataagtctttgatcatatttataatagctgcgttaaagtctgcatctacgtacaactttgccatttcagacttagtttttattgactgcttgttttcttttatggggtcacattttcctgtgtattctgtgcctagtgattttctattgatactggatattatggatgatacattgtagaggctcttgattttgttatgttcctctgaagaagtatttttgttctgatagcaattaatttggctggattcagagcctaccctgtttcccctgttatgtatggcagctgcagtgtctaggtagttccttcactttccagctgctgcgtttttctctgggtccttgggccccatacaaatgtagtttaggagtcagccaagaatttgggtcaagtttttatgtaggtttttgctcttgccccttctgtggctgccttccctccaggattttatcactcacctctgcctgttctcctagcctcaaactctctgctctgaccatttaaaccagtaaggttgcagctttctgccacgtgtgacttggagaaggccttcaggaaaaaagtcacaagttcacaaactttatagattatagttaattttcaaccttgacacttctccaactctgcctctttggtcaatctccagtgcctacagatagtttgaaaaatatttttttcctgaatttacaatgattttattggcagtaattactttagttatgctgtttttccattttaccttgaacattgttttttaaaaattaacagcacaaatgaatacacattttagttagaaaattactactcagtgctttgtgtattctgcacagtggtcatagaagtcttctaaagttttggatcacatatattatgtacagaatatatcttatttaatggtagtttggattatactaggatcaaagtgttctcatgggaaaagtgcactatactttatgtgttaaggggcatgtggtttaatctggagaattttccaatctaagcctaagacttttgcagtaagttattctactacagttgttttcagttcttcccacccccacagttacttcatgtgtaatatatatatatatatataggcaataacatctgtgtatgtgttgatcctcaatttgtaggaaggaaatggggaattgtagtggggaggggcagacactttccctcagtagaataatttctctgataaaagaaagacttaacttgaccaaaaattggaccaatgtgagctggtccctgcaaacaactccttttctttcagaattgttttgtactgcaactgcttctgtgctactgcttataataatagttcaacatgtatttcatttcaaatacgttttctttcccttggtagatgtcccacataaaatatgaagcacgtttttgggcacttctctttgaaaatacgaatgagagtaatttgacattggtctggaatatcgcatgtgtacaatgtacttaaaatgctaaagcttcaaaataagatagaagagtctttggattcaggtaatctttttataaactaagaccgtgggagaagtactttataagaacaagattaggttacttaattcctttaaagacagtttagtactttagaacagtttagtacctgaatcctgctaattaaaagttaaaacaattagacttattctgtggtgctgttattttttaaaaaattgttttgtttgtttaagtaataaatgatggggatcaataggccaatatgagagatttttaaaaattaattcgcaggatgcattttggtttattcagacatgagtaactttcatatgtcttttgcagctttaggaccataactgtggttattggtctttatgtagattatctgaaactaacttgatattttggaacctttggaatccttaggaacaggacaaataacatgaattcatgttatttgacttatccaagatcatataataaatgccagagctgtaactgagacctagctctgactaactttaaagcccatgtactaaggcatatcactgtatagctgcctaaatttactctttatatgtttggtttttgtttgccttttttgatctgcccttgcgatctctcctggatcatctctcagtttaactctttaatcctttatatgtaggggaatttttgctgttgtcaggctttttcatttttcagccaatacagtttattattattattatcatcactattatatatatattttttatttcaacaggtttttgtgaaacaggtggtgtttggttacatggataagttatttagtgatgatttctgagattttggtgcacccattacccgagcagtgtacactgtacccagtttgtaatcttttatccctcactccccgacccttcctcccaagccctcaaagtctgtggcatcattctcatgcctttgcatccttataccttagctcccacttataaatgagaaaatacaatgtttggtttttcattcctgagttactttacttagaataatgctctccaattacatccaggttgctgcgagtgccattatttcattcctttttatggctgagtagtattccatggtgtatttgtatatatatagagagaacaaatctggaggcatcacgttttatatatataatatatataattatatataatgttatatataatataataatatattatatatcctatataacattatatataatatataatataatatatataatataatatataataatataatataatataattatatataataatatatgttaatatataatatataataatatattaatatataatatataataacatgttattaatatataacatgttaatatataatatgttattaatatataatatactaatatataataatacgttattgatctataacatattaatatatgttattgatatataatatatcaatatataataatgttattgatacataatatattaatatatgttattgatatatataaatatattaatatatgtcattactatataatatattaatatatgtcattactatataatatattaatatatgtcattactatataatatattaatatatgtcattactatataatatattaatatatcattactatataatatattcatatagtaatatatgttattactatatattaatatatctatatattactatatattaatatatctatatatgttattactatatattaatatatcaatgttattactatatattaatatatcaatatgttatcactatatattaatatatcaatatatgttattaacatatgtcaatatatgttaataacatataacaatatatcactaatatatgtaattaacatgtaacagtatatcactaatgttattaacatgtaacaatatatcactaatatatgttattaacgtaacaataatatatcactaatatgttattaacatgtaacaataatatatcactaatatatgttaatatataactaatatatcactaatatctactgttaatatataacagtaatatatcactaatataatgttaatatataacagtaatatatcactaatatgtgttaatatatagcagtaatatatcactaatatgtgttaatatatagcagtaatatatcactaatatgtgttaatatatagcagtattatatcactaatatgtgttaatatataaccgtaatatatcactaatatgtgttaatatataacagtaatatatcactaatatgtgttaatatataacagtaatatatcactaatatataataatatataacagtaatatatcattaatatataatatatcattagtatataatattaatatatattaatatataatatatcatatacaatattaatatatattaatatataataatatattattaatgtataatagtaatataatatattatcaatatatattactaatatataataatatatcgttaatatataatagatcattaatatataatgttaatatattatgaatagataatatatcagtatataatattaatatattaatatattatatattatttaataatatataatatattaataaataattatatattaatatagcaatatattaatatatgactgtattatattattaatatataacaatatattatatattatataataatttattatataatatataataatatattatatattatataacatattaataatacataataacattaataatatataataatgttaatatattattatattatatattaatatataataatatatcaataatgtatcatgaatatataatatatcaataatatatcatgaatatataatatatcattaatatatcatgaatatataataatatatcattaatatatcatgaatatataataaatcaatatatcatgaatatatatcattaatatatcatgaatatacaataatatatcattaatatatcatgaatatatcattaatatataataaaatattaataatatatcattatataataaaatattaataatctatcatataataaaatattagtaatatatcattaatatgtaataaaatactaatattatgtcattaatatgtaataaaatattaatattatatcattaatatataataaaataataatatatcattaatattaatatattatataatattattaataatacataataatatgctattaatatacaatatctgataatatattattaatatataataatatataatatatgattaatatataataatataatatataattaatatataataataatataatatataattaatatataataatataatatataatatataaaacatataatttgacattttatatatatataaagacttgaccaaaaattggaccaatgtgactatatatttataatatataaatatatattatctatatttattacataatatattatatattatatatcatttatatataatataatatattatatgtatattgtatatataaaatgtcaaattactctcatttgtattttcaaagtgaagtgcccaaaaacatgattcatattttaagtggtacatctaccaagtgaaagaaaatgtatttgaaatgaaatacatgttgaactattataagcagtagcaaagaagcagttgcagtacaaaacaattctgaaagaaaaggagttatttgcagggaccagttcacattggttcaatttttggtcaagttaagtctttcttttatcagagaaattattctactgagggaaagtgtctgcccctccccactacgattccccatttccttcctgcaaattgaggatcaacacatacagagatgttattgacaaaaaaaaattacacatgaagtaatatatataaatatatgtatatatatatatattagtttctttatctactcattgactgatgggcatttgggctggttccatgtttttgcaattgcgaattgtgctgctataaacatgtatgtgtaggtgtctttttcatgtaatgacttcttttcttctgggtagtcagccagtagtgggttgctagatcaaatggtagatctacttttagttgtttaaggaatctccacacggttttctgtagtggttgttctattttacattcccaccagcagtgtaaaagtgttcccttttcaccacatccacaccaacatctattatgtttttgatttttaaattatggccattcttgcaagagtaaggtgataatgcactgtggttttgatttacatttccctaataatcagtgatgttgatcattttttcatatgtttgttgtccatttgtatatcttcttgtgagaattgtttattcatgtccttagcccactttttgatgggattatttgcttttttcttgctgatttgttttttcttgtagattctggatattagtcctttgtcagatgcatagtttgcgaagattttctcccactctgtgagttgtctgtttactctgctgattatttcttttgcgtgcagaagctttttagtttaattaagtcccatctatttatctttgtttttattgcatttgcttttgggttcttggtcatgaagtcttttcctaagccaatttctagaagggtttttctgatgttatcttctagaatttttatggtttcaggtcttagatttaagtctttaatccatactgagttgatttttgtataaggtgagagatgaggatccagtttcattcttttacatgtggcttgcaaattatcccagcaccatttgttgaatagggtgtcctttccctactttatatttctgtttgctgtgtcaaagctcagttggctgtaagtatttggctttatttctgggttctctattctgttggtctatgtgcctgtttttataccagtaccatgctattttgctggccgtagccttgtagtacagtttgaagtcgggtaatgtgatgcctccggatttgtttcttttgcttagtattgctttggctagacttgttttgggctgtcttttggtttcatatgaattttgggattgttttttctagtcctgtgaagaatgatggtggtattttgatgagaatttcattgaatttgtagattacttttggcagtatgttcattttcacaatgttgattctaccgatccataagcatgtgatatgttcccatttgtttgtgtcatctatgatttctttcagcagtgttttgtacttttccttgtagaggtcttttacctccttggttaggtatattcctgttttgttttttgtttttgttttgtttgtttgtttttttgcagctattgtaaagggttgagttcttgatttgattctcagcttggtaactgttggtgtatagcagtactacagatttgtgtactctggttttgtgtcctgaaactttgctgagttcatttatcagttctaggagttgtttggatgcatctcttgggttttctaggtatatgattatatcgttggcaaatggtgacagtttgactcagtgacagtttgactcattgactctttactgatttggatgccctttattttttctcttgtctgattactctggctaggaattccagtgctatgatgaatagaagtgttgaaagtggacagtcaatatagttctaatttattttattttttatgtctcaggtactagttcttggatgttgtcatgagtttcttaggcctgggctaaatttttttaaatgtccattagtgatggagaagtaaatatatttaggcaaaggctttcagagtctcctctttcttgatctccagttatctctgttctttcagccttccaggccacaagactaatcataactcttaggttaggatactcctggtagattgaaaaaggagcttttatatttccactggtatcatgctattctatagagctcttcttcctgcatcttctaagctaccaacgtgaagttgtaaaaagtggcacatgctgatgaagattgaactagtccccatactgtttggcttgcatttaattttgtactgtgaatattttcaccatggcaatttgatgcagattataaatattgagcatttatacattattgtaattggactacagttcaaaatgtacttacatttatgtaaagtgctagttattctgtttactttgtttccagcaactttgccaagttatttaattttagtagtttttgaaccttatattttctagctgtagaatcatgttatctatagaattaggataattttggctcttctgacctatctactgctttcttttcttgtctttttagctgaaccctataaactttaaataaaaatggttaaaattggtctgttcttattcctgattttaatagaaattctcttaatattttagtattttaaggttgatattagattctgataaatagtcatatcatgtttagtatggttcattttatttttactattttttcaggaataacttgaattatttaaaaatgttttggtatagaaatagttttgcattttcatgtgttaatgtaagtaatgatattggtagatatcctaatgtaatatactatgcttgtgttcctggaataagttcaatcttatgatacctttttatttttatactctgttagattaaatttgctaatatttggtttaggacatctcttatctatattatggttagtccgtatttttctttatgtatgccttctatgtgagattttaatgttagagcactgaattatttccatatacggtcaggcacaatttgaataattgaaaaattatgtttcttcatggaactctcctgatctgggcctgatgcctgcttttagtagttgataattctggcagaggaataggtaagttaggccaggaaaaaaaagaagaatgaaacacccagaaacagataagaaaaatacgtttaatttataaacacatatcagttcaaactgatggagaaaggatatattattcaataaatgatgttgagaaaattggctttccattttgaagaaaataatgttaaagtactactttatgccatattcagaaacaaatttctattgaattaagtcttaatataaaaattaaaacaaggcatttgaagaaagtatgggaaaaatattttgattatgcctgtacactttcttaagatgatagggaacctggaatcctaagggaaaaactggtagatttacctaaataaaaaggaaaaatacttctatgcaaaagacactgtaaataaagtcagaggcaaataatagcctgccaaacaatatactgagatatattatctaccacacttataaaagaaggtttttaaaaaattgtctacttagtaacaaaaaagataaaactcagtagaaattttgggcattatgtgtgacatactacagaataataaatacgcatagtaaatattacgactttactatcaggtaaattgaaaataactagttaccattttttgttcattaacttatcaacatttaagcaattgataatatccactgttggcagaaaggagtattatcgaacattgcttgtggaggtataaattagtatagcctttcaaagtcacttgtagtgtcttttaaatttttaaatatacaatacactttgatccagaaattgcaatcctaggtatttaaaccacagaaataatatttgtacttttagtcctgtatatgtttatgcatatgtatttgtagatatatttgcttaaacataggaaaaattgagaaatatacgcatgcaatagttaatatagctgtttgggagtagttcctctagaaggtaagattggatggatgtatttttaatgatacatatatatatataattgagctattgttcatgtagtattagtataacagctcatataagtgccattggtaatagttaaaatcaagctgttttgtattaatagttaatttcttttatatttctatcatttaactttaaataaaaatggtcaaacctattttggatttcagaagaatatttgccataccagatataaagactgttgtcagccattttaagctattcattttttatatactctttgtgaagagcattttaataatatcaaaatggcttctcatgcagaaaaaaaaaattagctctagtccctagaggtggttgatagtaaggaatttggagttttgaaaaacttgagtattttaaatatatatattttttaattttagaattttgagtacatgtgtatcacttggaatatataaactaccatttgtgtagaagctgtgtcttgtttaatttactgtagttcttagcataatcagcaataccactagttcagtatgtcacttggtttaattcataactgttacagcatttggtcatttgttgtaccaagctactcagtcctattaagtcctgtttatgacagtttccaaaaatgatatgaactattttctaatttagattcatgatgaatatttaaataatttagttaaaatttagttattagaatagtttatgcctaagtttgataatatggacagtattccattggcatttctttcctgaacttaatgagggaatgttatttcaggctacttgaatgtcctttagaactggactaagcaaactacagcccatgggccaaattaggcccactgcctggttttgtaaagaaagttttattggaacatggccatggtcagccatatatgcattgtctgtgactgctttcatgttacaaaggcagagttgagtagtagtgacagacactgtatggcccacagagtttaatctgtttactctctggctttttacagaaaaagtttgctaatccctgctttagaacatggaataatgactacagattgctttatatacctatatcctggctcttaagggaatctttggacaaattgtttatgttcaaacttcatttagtcagaaatatttattgagcatcagttttgtgctaggcacagttgaaggtactggagacaagggaggaacaatgaacaaggcatgtaaagtttctgccttcatgaagacatcactctcgagtagaggagaaggacaatttgccatggacaattatgaatttgttaacaaaatatgatagtgtcttaggtttgccaactgcattaaactttgggtattttatgggatacaatgtccattgttattgagatttatttactttatcagcaaagtctgtagaagtcactctcctgtttgggttattttgggtttgcctgtaatcccagcactttgggaggctgagacaggcggatcacctgaggtgaggagttcgagaccagccttgccaacatggtgaaactctgtctctactaaaaatacaaaatttaaccaggcatggaacagtgcacacctgtaatctcagctacttgggaggctgaggcaggagaactgcttgaaccagggaggcaaaggttgcagtgagcagagattgtgccactgcactccagcctgggtgacagagcaagactctgtctcattaaaaaaaaaaaaaattagcttaagtttaattcctcactgtggatgttagggtttaataagtagtatatgtaaagttcattggatagctataagtcagattttctgttagagaaattcaattctacaattaaaaaaataacatgtatcaggtactctgctagatagtttacatatcttacttcatttacttttcctaataattccatgaattataattcccattatccagatgatgaaaccaaagttcagaaaggtgcgatgaaatagttaagggatggagcctccattggcatctcagcctggtagaatgcacggctggagctcttggccattttgctgcttaatgcttactgagatttgcacataagtgtttccaagttagcattactataaatggacctttaatcttacttgcccttttatcctttttattttctttctttctttttttttttttttttttttttttaacacagaggctcgctctgtcacccagactggagtgcagtggtgtgatctcggctcactgcaacctccacctcctgggttcaagtgattcttatgcctctgcttcctaagtagctgggactgcaggtgcacaccaccacacctgcctatcttttgtattttcagtagagaccgggtttcaccatgttggccaggctggtctcgaatcctttttcttttttctttttttgatatggattattgacatttgaagatacagaagataattttcttctttttctttatgtgtttaaggtaatgtaatccagggaagtggaaaagaagaaatctgcaaagataaatcccagctaaacacaacccagcaaggaagaaggcaattaatttcatcaggaagttcagaaaatacatcagcagaacaagacacaggagaagagtgcaaaaatactgatcaggaagagtctaccatttcatccaaggtgattttaaaaaattcattatttgattgtttttttgttaggtgttttagatagaaattaatcatatgctatataaagagaaatcaaaactgccttttattgttgagtttatgaagacaaaactagcccaattttttcagacttactgaaactaatctttaatatagtatttgttgaaaagttagaaattttaggaagtggctaactatggcgaccgccacggagcagtgggttctggtggagatggtacaggtgctttatgaggctcatgcttaccatcttattttggaagggattctgatactctggataatcagacttcttttctctaagacttacaaattacaagaacaatctgatcttacagtcaaggaaaaagaagaactgattgaagagtggcaaccagaacctcttgttcctcctgtcccaaaagaccatcctgctctcaactacaacatcgtttcaggacggagtcttgctgtgtcaccaggctggagcgcagtggtgcgatctcggctcactgcaacctccacctcctgggttcaagccattttcctgcctcagcctcccgagtagctgggactacaggcacaagctaccatgcccgcctaatttttgtgttttcagtagagacggagtttcaccatgttggccggaacgatctcgatctccttttttttaattaaaaagtaaactttaatgtcgaaaatgcaaacttggggaaggcagaaagatcacacacaaggctgtcacttcacacttggaaggttgcgcagtagctgggcagagacgctcctcacttcccagatggtgagggggccgggtagaggcgctcctcacttcccagacggtgcaggggctgggcagaggcgctcctcccttacaaacagtgagggggccgggcagaggtgctcctcactttccagacagggcagtggctgggcagaagcgctcctcacttcccagatgggacggtggccaggcagaggcgcttctcatttcccagacggtgaggaggcggggcagaggcactcctcacttcccagatgggatggtggccaggcagaggcgctcctcatttcccagacggtgaggaggcggggcagaggcactcctcacttcgcagacaggatggtggctgggcaaaggtgctcctcactttccatactgtgaggcggccgggcagaggtgctcgtcacttcccagatggggtggaggccgggcagaggcggtgctcctcctcaattcccagatggtgggcagctgggcagaggcgctcctcacttcccagacagggcagtggccaggcagaagcgctcctcacttcccagagtgtaagggggccgggcagaggcagtcctcgattcgcagacaggatggcagccgggcagaggcgctcctcacttcccagacagggcggcggcctggcagaggcacttctcactgcccagacagggcagggcccgggcagaggcgctcctcacttcccagactgtgaggcagccgggcagaggtgctcgtcacttcccagagagggcgggggccgggcagaggcgctcctcactgcccagatggtgcggtggccaggcagaggcgctcctcacttcccagacggtggagtagccgggcagaggcgcttctcacttcccagacagggtggcggcctttcagaggcactcctcactgcccagacggggcagggcccgggcagaggcgcccttcacttctcagactgtgaggcggctgggcagaggcgctcgtcacttcccagagagggcgggggctaggcagaggcgctcctcactgcccagacagtgcggtggccaagcagaggcgctcctcacttcccagacggtggagcagccgggcagaggtgctcctcacttcccagatggtgcaggcagagatgctcctcaggtctcaatctcttgacctcctgatccgcccacctgggcctcccaaagtgctggattacaggcgtgggccaccatgcctgccctgctgtctcttctttctcctcctaagcagctgtcttagtctcctgaattttgatgttctacttaacaccctcatgttcttacgcatgttgccctgctggaggcgtccttctctttgggaagcctgacccaccaacagtgcctcaggagatagacatggaagcttagccggtgggggcctctcatctctctcccacctcagttgcaggggaggggttggttgcagctgcagtggtggccccgacagttttcttttgcgggacctgtggccggcagctctgggtggagaagacctacttgatccaagagctgcaggatccttgggctgcatgtcctcccccaccgtcagcaagcctggagagctgggcaggtggtctttacccagcaccttcaaggccgccttctctggccacagggagcagcccggaactggggcagggagcactgttggaagtgggtcaggcttcccaaagggaaggatgcctccagcagggctgtgtgaactggcgactccatggcccttggagtagaaactcactgcatgcacctgggccttgtcagtctggttgttttctgtcaagctcttgaggtggacatttccctccaagggcctgggattgtaccaggaggaagtgaggtttccctgagtctccaggggcctagaggtggaggctgcttccccattgctacaggggccccttttattgtcctcctgctcctgggtctgtacctggtctttcacctccgttgcttctttgggctcttctgccctcacctccattttcgggagcctggctgggatcacctgctcatctaatgaaggaagttgaaggttaaacttgcctctgagacgagggatcctcacggggctgaggtatccaaacatcctggagttgcgagcagacagcacgggtttcttccttgagggggggctccagacaacaggaggcaggaccctctgtggggtgcccgtgttccaagggataagacacagcctcataagggtgccgtcccacctgcctggaaaagaaggcccaagatgtcgctgacggttgaagaggagtgggaaacagccaaagagtcctggggcaggcacaggtgcaggagccgcggggtgagcccggccagctgggaaggcctcacggacaagacgagcaggttgccgatggcatggccaggacctgcggcggaaccaggaacaaaatacgcttagtgagttgtccattttgagcgagttgtgcacagacgaaactaagggtcagaagcggagaggatactcctaagtcacccacttctctgtggctgggtgcacactgggcatctgggagtttatgacatcaccatggggctggtgacagagccagggtgtggaggagtgcttaggagcccagcgagggtgcctgcaagaggagtcagagggcaaagggtgagacccttccaccggtccagctggactctagcctcagggacgtcctgctcctgggggcaggtgtgtggccctggatgggccccccgtggggctgttgggggtgtggggctgatccgccagagcccttctgcctggcgcctggcccaggtgctggctggcacccagtggccctgtcttggccggccccgtcccccgggttacagggccagaacctggaagcagagcgcaggaccagccagatcccgccaggctcccccggggcctctccagtgcctctgtgccgcctggagccaggcccgccttctccatggctgctgtggcctcaagggccaccagcctcgctccgcaggtttccaaagagaggacgcggtgccctgacctgactggatgcacctcttaccacatgcctccctggcaggcagggtctccactttttacaaatttgcctgagaccattcctcaggtcattcaggtggtcatggcccagccaggctttgaacccgggctgtgcgattccacagctggcgctctggcctgtgtgcctcatgatcatggatacagcatctattcttattttttcctgtagtcctggggtacttagcaccatggcatatctgtaataagcacatgcacacctcgaaggaggtcttcacttcaacatacaagttgaccatggcatgctctgggctccagtcctctacaaagatgtagggcaggaactaccagttgtcagcacagcaccatcccacattgctcttctaatggagcctttcaccccagatgttctttctcgtctgatgggaaggatccaagtatgtaaagattatgttctagatcagctttggtctgtcctaaaagaaatttgccagtggattattccatatggataaaagtcagtttctctggtcttcctggaatgtgtctagaaagcaaatacattatttacaagttcatagtagatcaatgtattggattaaaatatgataaacataatttggttgttgtgagcatgccagcttggtcaactattcaccacacacatgatgccctaaatataactctaggttttcttatgcccaagagagggacatactcttgggtgtctggactagggaaacatgtatgaaaaaccatttggccactctacatcttgttattggagaattgaaaccatctatattcaaagatattattaaaaggcaagaagttaaaaaaaaattttcagactggaaaaaaaagggaggaccacttgactctggtcataatttggcacctccattctgaaaacctgacttctcttattccattggttgttctcagattgcatttaaccaccattttcttgctaagtgtgatgagaaaaacaaattgatgggataattcttaagagcctattgtaggatcacttctgggctgacagtatttctagaccttctttcctctttcaatttttgctaactcactaggatggtttggctgaaatacgcattctgtaacactgggtacttaaagaaaatgaggactatttattggaagtacttaaaaagagagagaaagatagagatggccccaggacagaaagttcaggcatgcttcctctctagcgagaggtagcttatgatgacagttttcatgatccttgtagtcccatggctgagctctgtggatccctgtcttagtctcaggtaaaaccaaaggaagaggattggtcatggaagactgtgcaccgaaatgattgaaatgccaacatctaccttagaggttagtcttcgaatatattctcctcactcctaccctctctcccagagagaggaaccagcttctcactggagcctgtcttccagctacagaagtggggcctggtcgctatacactcagttcctttgctttacttatggaggcaagcttaataaatgaaaacaaaatgttttctggctcacatatattttccataaaacttattaaaacaaaatttgttttgtataaactttgagcccttatgtactctattctctgaactctgaacatgtcaattgacgttgccttttttcaagagaaattattgtgttcagaagaaaatctgtagtatacgtgttttcctctgtttatcccaacccataaggtttgataatcacaagaaaaactttgagaaacatcttaattgatagattatagagaggagcagatccaagatattcaagctatttgtgaggttttgatgacatcaagggagtattacaaccaggtccgaggaatgcccaagttctatttggccagttgcttttccttcccttccttgtgaggaagatttacctcttctagcacaggaaaaataaggcttaaattttcatgatcctttatgcagggctctctggtaaagctgagccagagaatatgacttagactgaaaatcccagcagagcctttccaaaccccaccctccatccctgcccagtttgagtctgaacactgaacctttagaacagctagtcctaaagggatagctgtagtgcagagcaggtgagagagaaaacaagaggctaggttcacctatctattctaatggcaggaggttgccagctacaaaaaactaacaacagtttggccaggcctacatttggatcaatctacttggaaagaattacattctcttagggaaaagtaggagaatcagtggagagaagggacaaaaatcacttatgcccaactagaccttgtttctgagattctgattcatttggtgtgtggagcctgtgcatcagtggtatcttaaactctcccaattttagtgtcccttcaaaattaagagctactgttgtatcatcattgaacacctcagaggaaactgaggcccaaggtcacattgttaggaaacttggcttcaaatgtaggtattttcattttgggtataatgaatttttctaccatacgtattagactatgtaaagagttttgtgactgtagtaacttctcttcataagacagttgtcagaaatagtctatatttttcatcagttcttgtatgtctttctacaactccttcccagttatgtgactttctaatttagatgtgaaaatgagggtacttgaattgattaactttagtgaaaaggatggttgccatggtttgagtgtttttatctcctctaaagatttatgttgaaacttaatcctcagagcaacagtattgggaggtgggcctaatgggaggctgtttaggttatgagggctctgtgctcatgaatggataatgctgctataaaaagggattgtgaagctggatgcagtgacatgcacctgtagtcccagctacttgggaggctgaagcaggaggactgcttaagcccaggagtttaaggccagcctgggtgacgtaaggagacctcatctctaaaaaaaaggtcgggggcttggcttgtagaagtgggtttacactctttcactcttctgccatataagggcacagcattcatcctttcatgcccttccaccttccctcatgtaagaatgcagtaaggagcctcacaccagatgctggtgccttgatcttggacttcccagaccccacaactgtgagataataaatttctgttctttataaattttcaagtttgtgatattctgttatcacagctacaaaacagactatgtatttcctttataatctatattatattataatctaatgagaactcttgtaaatgacagaaggaagcctaactgaaacaacataagcgaaaatagtatggtaaagtgttttaactgtctattgctgtgaaacaagctactccaactcttagtggcttaacacaacatgatcatgtcagtgattatgattatattctgccttataattgtgtgggttggctggggtcagctgggcaattcttttatgacatgtttttggtgtcagctgggcttcattcagctgagaactcagctgaagatgaagcatctgtgatagctttactcgtgtgaatggtgcctcagcaaaggttgatggaatggctgggggctggctgggcccacctccctccctgtaccatgaagtagcctagactgagcatcttcacctgacatctgggccccaagagagtgatgtcaaagctgttagatcttttaaggcctagaactggaattgtaatttttgctgaattcttttggtcagagcaagttaccaggtctcatagggtgaagacagcagtgtgaccagttcatagagaagggcccttgaaatgttttcagtcacagaggtaatcctggcagctcactagaggagagattggaaaagaacaagataaaagacttggaggtaagggaagagattgtggcattaacaaagtgaagaaatagagaatctaaactagggcagtgactttaaggatggtaagaagtattggattataaaagtattcaggaataaaattgtaggacttcttgcttggatctggggagagagggcaagaaggagtaaaaagcttctaaatttctggctagcatgaatagatgaaatatgttggcagaaactatggcagagaactcagaggcagaatgtcagttttgacatttagagtttgaggagcatagaacattgagaaagaaatgtctggctatatgagtttgaagctcaggagtgaagttggggctagaggttaggagttttagtctttagcgttagtcagtgttaatgggattgagacaggacttttaaggtaatttgtcaccacagacattcttgccaggagcagtttggaaacagcaataaattacttgatttaaattgttctaggtggaagttctttatcttgtcccttctagtacataacactcagatggttgaggggcaggggaatggcttgtttgagaagttaaccggctattttaatagccttaataatacattcccaccacctccaaacacccaggtcaccctctaccagctccatgctcttccgtccctcaggtctctaacatgtatatttacattgtaggggatttggccactctatcatgagtcgccagccttccacatttagtcctgcccattttcatctaatgtaagaaataagcaatgtgggatgcttaggaaatatagagctctctgcctttctcctacttcttccaagtacagagcaacttccatgtttcctgttccctcactcgtcagttcagtgacttactctagctcctgagctttttaattggcacagtgcaaatttatgtctcagcaaacttacaaattactgcatgtaatggattttggggtcatttataaataatttaaaccatgaatgttaaattcttgaatgccaagggtgtactataaatcaatatttcatggagttccataaagagcattatgatttccagcttttgtgcctcttaaaatatattcgagaacccctgatccatagtattgatatttgggactttaacattcctttctcttttagaataagttaacatgttaaacctattccttgtgaggatttaaaaataaaacaaactcttctctaattcatggaagtagatggagttgaaatatgatactatggattttgttatatttcattttcattggcttattttttatttttaaatggcaacataatagatgcttattgtcaaaaatggaagtatcagaagcatttgaagtaaataatgaaaacctccatttgcctcatccttcgacctcattgcgttactaattttttggtttgtatccttctaactcttttcatttggatttacacagatgaatgcacacatagatatataaggaattttttttaaaagctaaatggtaccaagtatggatattattcttgttcagttaaaaaatatctttaggtgtgtcattattattttaatgtctgcatagtatttcatagtaagaatataattaatttatttaaccacttccctagctgtgctctttttttttttttttaatgtgataagatattgagtgggattgtttccttgtcccagaactgctgctaaggctcaaagctgggaatagaagtactaataaagtatcccatgttaaggggccctcagcagtaagaaacagccctttccctttatggtttattgaaaggtatgaaaagcgattgccatcccaaccccctaggcttgatacaaagggaattgagaggccaaaaggttttaaggttaagagaagtgcagtgtttatgggggaaattatttcttccttttctaaaatcaagagaagaggggcattctaagataattacttgtggagcttggaaataccagcaggaacaagagatacattttattgaacatctgttagccagtggatttgctgatctgctccactgctacctgaaaaaggaaaaagaaaactggggagaactgacccagggggaactgcctagtagggaggtgggttaggattgcccaattctcactcgagagttccagttgctggtacagaccagttggtcctggagttggggggttgagattggggtgtacttgtgcagcgtgggagcaaagagcgtatgttttagagagacatgacatgaatgttgccagtgtagccaaaggattgctttccccataggttatctgttactatacaggaaccatgataagatctaggttccttttttcaaggcagttagtcagtttgggtagcattttaatgtactgtttcttaaaaaatgaaatatcttcttaagaaatttaagctattgaatattaggtcatgtaaaaccagctctttttcagatggcatccagcatacatgagtctttagttataagtggaagcaaacattgatgtgtatctggtatgttgttatcacatcctagaaatggttaccaggagaactggggtatatctgagcattgtttctactccacgggaagtataagtaattaaggggtcatttttaacagaataagaccaggcttattgtttgtgctgttggtaagtacaaattataaaggttctgcagtgctaatgagagtatttatttggttcaaagcaccttcagtttggttaaactcaaaactttattaagacaaatttaaaggaatcctatctttttccaagttggtcagaacatagctttatgcaaaattttccgtgagggcaaaacagttttgtcattcagctatggtaaaatcatgattacatttagagggcagaaataaagtattgcagtagcttagaagaaattataaggggctaggcatggtgtctcatgcctgtaatcccaacactttgagaagccagggcaggcagatcacctgaggtcaggagttcgagaccagcttggccaacagtgaaaccccgtctctactaaaaatacaaaaattagctgggcatggtagcatgtgcctgtaatcccagctactcgggagcctgaggtgggagaatcacttgaacctgggaggcggaggttgcagtgagcagatatcgtgccaccacactccaggttgggagacagagcaagactccatctcaaaaaaaaaaaaaagagaaattataaggaccgtgcatgttaagaacatgactcattgttgaacagtgacatttaagagaagttaaagattcaaatgaaagcaaatgtcttctcttatattttatttgtattttctggttatttttcactgaatgtttgacatgattgtaaaggtttgatacaactgtaaatttcttttctttccttttttttttttctttgagatggagtcttgttcttgttgcccaggctggagtgcaatggtgcaatctcagttcactgcaacctctgcctctcaggttcaagcgattctcctgcctcagcctcccaaatagctgggattacaggcacccaccaccatgctcaactaattttttgtattttttagtaaagacggggtttcaccttgttggccaggctggtctcaaactcctgacctcaggtgatccacccgcctcagccttccaaagtgttgggattacaggcctgagccaccgtgcctggccaaatttcttttcaaaaaactaaaaatgttttaagttattaaactaagcgcatagaaaatagtggcatttaagaactttaaaatgtgaatcttgaagttttaagtttacattttgcatggatcttgtagttttgtgctgttatgctcatatctttttaaaaatgtttcatttatttctgatgtttttcatatttgttttacaggaaatgccacaatcattttctgcaatcacattaagtaacacagagatgaataatattaagactaatgcacagagaaacaaacttccaatagaggaacttggtaaagtttctaaacataaaattgccactaaaagaacaccacataaagaagatgaggcaatgagctgttctgaaaattgttcgagtgcccagggcgactcacttcaggatgagtctcaagggtctcattctgagtccagctctaatccctccaatcctgaaactttgcatgcaaaggcaactgattcagttctacaaggttctgaaggaaacaaggtcaagaggacatcctgcatgtatggggcaaactgctataggtaaaatgaaattacagtaacatttaattccattattttgatagcgtgtagctatgtagatacatgctacagtatattaaaaacttaataaaacccactggcctaaaggttaggggctttatcgtgtttctactatttgtacttcctcagtatattttctagaaaatccttttaaggcttttaagatacagtgggagaattaaatgttttatatatagacatgctgactaatgtgaggatctgaatactggggaatccagacatgaagactgaatcccccagatctaaatacctgttatttagtcttttcttaaatattagagagatggcttcctacagagttgttgtctacaatataactataattttaagttgtatttaggtgtcttttctttatatttttgtaatggtgctttgaatcatcatggtaccctgtaaaacaactgaatataataatcctggattgatgggttgctcctatacttgcttcatttatttacactgccctatatactctaatttcttattttgagaattcaaattataatctcttagttttaggctatactttcatccatagtgtttatagtaacatgtttataattacataaccctatttcagaaagatttcttgccattccaacttgccaaaccaaatatcctagcaatcctttccagtagtttgtcttctgtgtcaataagacactagtcagcatgtatacatataaaacattcagttccccccactgtatcttaaaagcctatagcaggattttctagaagatagatatctttattgcaatagtatattttaatatattctgttaatttcacattcatattctctttaaaaggtattgccattttagcacttgaataactcatattttaaaatttgaatagttctgatttatgctttttgaaacatttttgtatatatgcaatggctttagttccacatctggaccataatgtaaaaacttgcagaatggaagtatatataccttctgttaccttggattgtattagtttgccagggctgccataacaaaataccagattgggtgcttaaaaaacagaaatgtattttcccatagttctggaggctggaagccctagatcatggtgtcagcaagtttgttttctcctgagacctcttttcttggcttgcagactgccactttctcactgtgtcttcacatagcctgttctctgtacatgtaccttcctggtctcttttccacatcttgtaaggacaccagttatattaggttgggccccacccttatgacctcgtttaaccttaatcatctttttaaagcccctatctccaaattagtcacactggaaattagggcttcaacatatgaattttgggaggtggggaacaatgcacttcataacacaatttaaaagagaaaattcataatggtcatctcaatagagaaaagtcatatgataaaattcaacatcccatttatgaaaaaaattcttaattatataagaatagaaaagacttcttcagtttaatcaagaatatctacagaaaccaacagctaacttcatacttaatggtgaaagattagagtttctcccatgatgttgggaactaaccagtatgtctgctatcaccactcctattcaacattgcagtagagatcatagccagtacactaaggcaaaaaaaagaaataacatgtagagtagaaaggaaaaaataaaactgtaattatttacaggtgacatgattgtataattttgaaaattcagaatctttttcttattatactctgagttctggaatacatgtgcagaacgtgcaggtttgttatataggtatacatgtgccatggttttctgtacccatcaacccatcatctaggttttaagccccacatgcattaggtatttctcctaatgctatccctccccttgcccccacccctcaacaggcaccagtatgtgatgttcccctccctgtgtccatgtgttctcattgttcaactcccacttatgagtgagaacatgcagtgtttggtttcctgttcttgtgttagttggctgagaatgatggtttctagcttcatccatgtccctgcaaaggacatgaagtcattgttttttatggctgcataatattccatggtgtatatgtgccacattttctttatccaatgtatcattgatgggcatttgggttggttccaagtctttgctattgtgaatagtgctgccataaacatacattagcatgtatctttatggtagaatgatttatattcctttaggtatatacccagtaatgggattactgggtcaaaagatatttctggttctaggtccttgtggaattgtcacgctatcttccacaatggttgaactaatttacattcccaccaacagtgtaaaagtgttcctatttctccacatcctctctagcacctgttgcaagaatcaatattgtaaagatatatatttcctcaaaatcgctctgtaagtttaaagcagtctttatcagaatcccaatagggtgtatgtgcatgcgtgtgtgtgtgtgtgtatgtgtgtgtatgtgtgtaagttgacaaactgactttatagaggaatagcaaaggacgtagaactctgaatacaatcttcaagtgcaaacttgaaagacttacatgaccagatagaaagccttattataaagctaccatatataatgcagtttaatattggtgcaaggatagataaacagtaatcagtgcaagagattaaagagttcaaaaccaaacctacatgtctgtgtttatgacaaaggtaccactgaagatctgtgggttaagcatgaactttcaatgagtggtgtttggtaattggatattcatatgaaaagataatgaatcttaactcctgccttatacctatcacaaaataaatctcagatagatttttgtaaaacatataaagtacaggtagcagaggataacatagaatatattcatgacattgggcaaagatttcttaagcatgttataaaatgaagtaatcataatcatgttatccagttgatcagttggacaaaattaaaattaaaattaccctttatgttatatttaaatataatattagaagggtgaaaaggcaaggcacaaagtagatgaggatatttgttacacatatgtcaaagaacttgtatcaaaaataaataactagcaaccaataagaaaatgacaactcagttaagaaaaaaaaatgagcaaaaggcactgcacaaaagagaacagtgaaatggccaataagcatacaagaaaggtttaatgcttgttagtcatgtagggaaacacattttaaaagataatactacagatcagtggttgtcaaacttttaaaagtgccagacagtaaatatttttggcttcatgggccgtacagtctttgttgccactgcttaattatgctgtcacagtgtgcaagcagccatagacagcacaggcagtgaagatgttcatactattcaaggtgatctacagaattaatgcaatctctatcaaaatcctaatggttttttttggcagaaatagaaaaaattattctaaaatcatgtgggatctcaagtagccaaaacaatcttgaagatgatcaaagttggaggtctcacacttcctgattttaaaatgtattacaaagccacagtaatccaaacagtgtggtactggcataaagatagacatatagacaaatggaatagactagagagcctataaataaatcctcatatatatggttaaataattttcaacaatggtctcaagacaaatcaaagaggaaaggacagatttttttcaataaagagtgctcagaaaactgcatattcacatgcaaaagagtgaagttggatgcttgccttacacttgttttcaaaatataacttaaaatggatcaaataatctgaacatataaaactataaacatctaaaactacaagactcttagaagaaaatgggggagaagcttcatgacattggatttgacaaagatttcttggatatgacaccaaagcacagacaacaaaagcaaaaatagaaaaattggactttttaaagttaaaaacttctgtacatgaaagaacaaaattaacacagagtgaaatgacaacctatggaatgggataaaatatttgcaaattatatatctgataaggattaatgtctagaatacataaagaactataactaaacaaccaaaaaacaaattacccaatttgaaattggggacagaacttaaatagatatttctctaaagataatatacaaatgaccaacaagcatattaaaagatgctcaacatcactaaacattagggaaatgcagaccataaccacattgagatatcacctcacacctattagggtggctgctttcaaaaacgaaatgaaaaacaagtaacaattgttgatggggatgtggaaaaattggaacctttgtgcattgttgatgggagtgtaaattggtgtagccactgtgggaaacagtatggtagttcctcaaaaaaattaaagatagaattaccctattatatagaaattccacttctgggtatatatccataagaattgaaagcagaatctcaaagagttcatagcagcactatattcacaatacccaggaggtagaaggaacccacatgtccatcaattattgaaggaataaagaaaatttggtatatacatatgatggaatattattcagccttaaaaggaagggaaattctgacacatgctcctatgtgtatgaaccttgaggacattatgctaagtgaaataaaccagtcacaaaaagataaatacttcataattctacttgtaggaggtatctagagtagttagattcataaaaacaaattagaatggcagttaccagtgcctgtggggaaaaacagaaatcagaatggtggattccggggaggacaggaggagctgggaagttgttgtttaatgggtatagagttttcagttgcacaagttgaaaaaattctagggattggttgcacaacaatgtgaatatacttaacattactgaactgtgcacatagaaattgttaagatggtaaattttatgttacgtatatattcttagcacagtttaaaaaaagcagtaggccagatttggcctgctgttcatggtttgccactctctgctataaatactgccatgtgaaaaaacaaaaaagaaacctaacagtgctaaatgttggtgaggttgttgaaaaactggaactctaataacctactgggagtgaaaattaatacagtcattttggaaatttggcaatatttatcaaacctgagcatatacataccctgtgaccattcttaactatatccccaggaaaatgcatatagatgtgcatcagaaggcttatacgagaatgctcattgcagtattacttatagaagtcaatacctgaaatgaacccaaaagtttatcagtagtaaaatggataaattataataccatcatcaaatggatgatgctattactacatggtattgaaaacgtacttactgctacatgtaacaacatgaattaatcatataaatataaaagggctggttcaaagaagtgcatactagtatatattttcatttaagttcaaaggcagacaatactgatctgttgttttataatatcacttcttaaagtatgatccagagatccctggatgtccccagaacacgtttaagaaatctgttaagtcaattgtattttcttttttttttttttttttgagatggagtcttgctctgtcacccaggctggagtgcagtggcacaatcttggctcactgcaacctctgcctcctgggttcaagcagttctcctgcctcagcctcctgagtagctgggattgcagatgtgcgccaccaagcccggctagttgtatttttagtagagatggggtttcaccgtgttggccaggctggtcctgaactcctgacttcaagtgatctgccctcctcggcctcccaaagtgctaggattacaggtgtgagccaccacagccgacccaaaagtattttcataataatattgtgactttttgtgaatgcctttttttactgccattcactctctcacaagtgtacagtggagtttcccagaggccacaagttatgtgttgttgttaatgattgaatgcagaagcaggcatgagaagccaaatgccttctctaaagtagagattaaataaatttccatagtataaaacaataattttttcttggaagttaataattatttatgttaagacatgttattatgataatatgtaaagggtttattattgttctatttaagtcaataaatgcactttttcaatttctcatttataatttctaatagggtaaatatcctatataaacaaaagctctctggagttttaatcttttttttagtgtaagagtcttgagaccgaaaagtttgaaaaacacttttagaagttaggatagttacctttgcgtagtaaatggatttagtgattgaagagggcacatgggacctttctaggatgttggaaacgttctgttttttatcttagcagagggtacaatatatgtgctcattttattaaaagttttgaaaagctatatatatttatgatatttatgttatatgcttacatacatatgtgtcatatatatagtaatgtttgcaagttgtctattgatatcatggctcatcacatgacaccagaaatgtagtatgttactgtgagagtcctgtactgagtttatgtcatcaactttatgtcatcaatttagcatgttgatgtaatctgcgcttatgtcatcaatgtagcatgttggtttatgttcaaggatagccagatgtggattgtctggtttcctgctatatccactaaaaatctagaatatcctattttttttttctgacagtatatttgtcgccctcctaggaagaatcctgttcattttcaacattttagccatcctggtgatagtgattatggaggtgtacaaatcgtgggccaagatgagactgatgaccggcctgaatgtccctatggaccatcctgttataggtatagaaactgaatgtttggctgcactccttttctttcttatctctgttacttatctaggagaaactgacagcagcttgttatctcaagccttttaattttcatttttaaacttctgtagattacaggttttcatgttggtaataggtaggatgatatttcttttagctaattctgaattactgaagttacacatctacgagtgcctgaaatttttccttatttccaactttctgtaatgcaaattagatcacttaaaagctgttgatgctaccccaatatacacttaattcactctgtatgtcctaggtgtgacatataaatctatttgggatgttatctctgcatccctctgcttcctcaacttttactactccactattcttgccaacacagaaagtccaatcctaaaggaagagtaagaatacttctcctctcagttttcatggcatcttgtccttgtccgtatcatgcacagagtaggatttatctcatgagattatgtttgtttctttatcagaacatcttttcctacaggcagcaagtatcttgacagcaaggactctcatctttgtatcttgcaactttgcttaatagatgaatgaacttgaaatgaaacaaactatcaaagaaaaaagtagtgatttcagctttacagagctttaattccagacagccatctttcttagataattttaaatacagattgctgaacctactgggctatttgaagttgtttctatttctgtgattgtggttttcaatgagaaggcaaagtaagtttctaggaccagaaaggagaatgacttatactttttttgaaaggtaagtgttcattataatcaactttaccaataaacttgaaaatttttggagaaattaacaaattcctagaaaaatacaactttaagaaacagatacaatcaaaaattgagttaatataagagaaattgaatatataatttaaagctttccacaaagaagtgatagatctgtttggttttaatggcaggttctaacaaacatttaaagaagaagcacttcatttttacacagactactccaaagaaagtaaaagagggtgtatttcccaattcatgatgtgagaccagcacaagtttgataccaaaacccagcaagaataatacaagaatgaaaaattataggataagcttacttttgaacatagttgtaaatatcctgaggggagaaaagttatgagaatcaagtgataaataaaaaggaaaatataatatgaccaaatagggtctatctaaggaatgcatgttttaatgttaaaaaataaattcatttaccatgtcatcagaataagtagaaaagccatctccatagatgattggaaagaaaaaaacctgacaaaccaaaatcagcattcatttatgaaaaaaacttgttataaagtaagaatagaagggaacttctttaatatcaaaaagaatatctacaaaaaatttatagcaaatattatacttaaaatattaaaaatttcctttctgaaatcagaactgagacaagaatgcctgttattaccacttcagttcatcattatgtggcgattcaagacagtatactaagacaagaaaaggaaaatggataaggattgcaaaggaagaaataaaactttgtgttaacagatggtattattgtatatgcagtaaatacaaagtggcccactgatgagttataaatttagtaagtgcttaggatgcttactggatacaaaaatcaatatataaaaccaattgtatttgtatattccagcattaaccggtaagaaaataaaattttttaaagattataacatcaaaaagtaaagagtccttaggaataaatataaaaggcgtagaaacctctatgaagaaaactataaaactttaaatgtaaaaatgagaaaatgtttttcagaaagacctaaataattatgaagatcaaaatgttcatgattgaattattcagtagtgtcaaaataccagttttcctcaaatggatttgtatacaaactgattcaaaatcatattagcttttataaagaaatttacaatgtgattctaaaatgtatatggattacaaaggataaaaatagccatgacaatcgtacataatgaagaataggtggcaggatgtgttatactttatagttactaaagcagtgtggtatgggcacaaagataaagtaacatgaccagaacagaatggtacttcaaaataggcttatatatgtaaggtgacatatttatgaaaagggacgttgcaggtattgagaaaaatgaattttttcaattaattataaggggataagtagatattcatctgaagaaaaaataaaatttgacccttatatcacaccatagtcaaaaactgaattccagatgactcatagtactaaatgtaaaaaacaaaataatatagctttatttttttttgtttgtaaattacccagtctcaggtatgtctttattagcaatgtgagaacaaactaatatgccatctaaatttattgtaattacttattttacaactataaatgaagtcaggattcaggaattacacttaacttatttacagttaaatctccaatatctaacagactgctgacttacattagatagatgttcaagaaatctttgttgaataaaaaatggatccagagactaaaatggaatcaactgtgccttttgttccactttactgtttaagaaggaaggtaagtttagataactcaaaacattactgacaaaactctgcagtcatctgaacaaataacttccagatgaattggtgtcttctctaacgtaattaaaaataatatagctttaaaaataaatataagggaattgtttcatgatctcagagcagggattattttctaaaacaagaaacaaaaattaattaaaatgaaaaacatttaattatttgactacattaaaagtaaggtgtttttaatccatcagtacacaacattaagagaataaaaacaaagcacacagtaagaaaaaatatatttgcaacccacataattgacagtagcatatatctagaacacatgaaaaaatattttaaattgctattgctttttgcttggtaacatacatagcctttttgcccaaaaggaaatccaaatattaaacacatgaaaaaatactcagtgtcattagtaatcagggacattagacacacatgcacacacacataaacatataaccttgaagtaactgttttctcctatttattcattcaacaaattcttttccaaagaatcatcaaatgccaagtgttgatgaaacagtgttgagatgtacttgtagaacaaacatacttttatatatttatttataattttggaacaaagccacctttcatagctcatgttgtatataattcgtggcactgtggtgatatgccttttcatttgttaaaaaaaaacttttgtaatggagaattttatccataaacacaagtggagagaatgtagaataagttctagtgaaatccatcacctagtttgtgcagctatcgactcatgatcaatattgtttcatcaatccccaaaccacttgctaccccatccctgtattattttgaagcaaatacctaaccccatatcttttcatcccattttatctatgagtatcttagggtgtatctctaaagataagctctaaaaacctaccacaacactgttattaaataaatctttaatattattcaatatcctgtcaagtatctacatttccctatagtgtcattttttttaacagtttatctgaatcaggatctgcttaaattctacatggcaaaagatggccatgtctcttaacttatttaatcaataggtttctcttcattttttccttgctatatatttgttgaagaaagctaatcatttgttctgaagaggattccatcatttgcattttgttgattgtattttcaggatgtcattaatcacatttcctgtatttcctaataatttatagtttgaactagagggttgatcagatatcagttctaaaaattgtgaaagttgcctggtcctttgaatattatttccctcttagtctctaaaatgtttttacctgaaagtctactttgatatttataaatgtttgagaattgctctaatatctattataattatcattattgatttataatttaattccatatggttatatagcacacactttggaaattaaatctttggaaatttattgagatttgttttggcccagcatatgggtgacttttattgaacatatggtgtgcacttacatgtgtattctctagttgctggaagtaaggttttataaatgtcgatttggtcaaatggttatagtgttgttcagaattttttatatatttgctagttgatttttttcctgtggtggttctactagttactgagagaggaatattaaaaccttcactatgattataggtttgtttatttctctgcttaattctgtcagtttttcttagtactccagctgtaaatttgtcctcagtgaaaaagccataaaagtgggaaatttactcagagctgtatctttcttccacatattgactctccagtttctgtttgcttttggtagctatccactaccttctgattattgtttttaatattttttccagagtgtaattgtaacctgtcggagtgttggtccgatataatctactctgtcattattgaaagtggaatccttgttttgtctaatataatataactacccaaggttatgtggttagtgtttgtgtaatatcttttttaatccttttagtttcaacttctgttcttatatttaaaacatgtcttttataaagagcatatagttgcttcattggtttttatttttaatccagtctgatagtatctgtgttttaggtggaatacttagtccatttacattttttttgagatggagttttactctcttgtctaggctggggtgcagtggcgcaatctcggctctctgcaatctccgccttccaggttcaggcaattctcctgcctcagcctcctgagtagctgggattataggcacccaccaccacgcccggctaatttttgtatttttagtagagacggggtttcactatgttggccaggctggtctcaaacttctgatctcaagtgatctgcccacctcagcctcccaaagtgctgggattacatgcgtgagccaccacaccaaccccatttacatttaatactattaatgatatattttaattttttcttttttgtatttgttttctatttatcctacatattctttgttttttattctcctctttttgacttattttggattaaatgtttttcattctgtttttttctcctctgttaatttttcaatagccacactttatttccataggcatctgtgacttattacaatctaccttactgttggtgcttttaccatttcccaaacagtgcaagaaccttacatcactttaatttcatttacttcctcttttgtctttttaaaccattgttattatatagttatacctctgtacattaactcacaagacattgtaattattgtttaaaaattgttttaagcatcaacattccctttatttacatatttattattttgagtgccctttatttcttcctaaacgtctatcctttcatctgggatccttttcttttagttttaaaaacttctttgcgtttttcttatagtgaagatctactaaaaagaaattctttacatttttgtgtgtctgaaagtgttcttattttaaatttttaaaggctgttttcactaggtatgtaattctagcttagcataccttttcttttatcatttatgtcatgccatggactcttgcatccatagtttctcttgaaactcagttgtctatattattattgccattatatttttaaatcaatgtgcctcttctttcaccactcttaagatttttatctttgcctttagtttttaacagtttaactaacgtgcctaggtatatttttctttgtattccatcctatttgggggttcactgagcttttttgcaagttaatgccttttattagtttgaggagactgcttggctattatctcatcagatattgtgtctactctattttatcttttctctttcttgtactccaactaaacatattttaaaccctttgaccatgtcccacatgtttcttctagtctgctgttaagcccattcaaagagttcctaatttcagatactgtattttccagttctaggatgtttatttaattcttcttcttctttttttttttttttttggccaattctaattttggtggaactatccatttttaattcattttccccaattttctactcttttttaaaaaacatattaatcttagttcttttaatgttcttatttatgaaccaacatttctggttctgcttcttttttttttttcttgattgttgggtcatatttttctgcctctttgtgtctagcaacgctttattgcaattctaacatattttaatgaaaagaactataggtaccctagatgttgtcttccatcagtaaggataccacctctacttggcaggtaggggctagtcatctctgtccagtcagaaatttagatagatagtagctagtttggagttttattaaaactcagtacacttttgttttatttctgcttgtttggcatggcttttcccgacttttatgtgagaggcaagtctgtattcttagctataaaactttcctttggcgattttgagcttagcctattagcctactacccatgcatcttaaattttggttcatttcttgaggggaggctagttatgtttgttgcaaataccttccctccagtgggactttgtctctgaaacacgacttgagctggatatttcacattgccttttttgaaatttcagaccctcagcctctcacacctctcagggaactcaacaaatatttcttgggaaaaatcagctttgtgtttggggctccatttgtttccagatggtcatgacaactctatgagagctctttctttgaatagtttctccacttggtttaaatcttatccttaaccaataccaagaattgacaaatatcttcagggaagaaagcagcctgtgattgtcagcttacaaaggaaggactgtcattattaaatctctggaattttagataatctaaaattttcattgctctcacaattctgtcataaaagtgatttttacagcctatcaggcttttttttcctgttgttaaaaagagtattctcctaccatgaggtcctacattcttttcagaagcaaaataaaaataatgcctattcttcagaagaataaaaacaaaatacaaagccttgcttaggatagtaatgtcaaaaattgctgtcttcttgtcatcagtctttttaaaataggtcagagaaggggctagtcaagagaaacaactccaaaaccaattagcttacatgtgctaataaaaactttcatgtctgtagatacgtgtagatgtatacgtatagatatggtgctttcttcacctactgaactgctttgtgtcctgattctggttgcagataaaaacttacatttttttctcttgttaattttaattacagttcagagagacttttagagaatgttagatatgattgattactctgcctactgctttaaaaataaggggatgtaaactaagaaagattaaatgagctgtgtaagaccccaaagctggtgagataaaaccaaatctcttccctcctcgagaccagaatttctccatggcattgcctgactccacgactgttagtcttggctttctaaagtatcactggggggttgtcttttcagccaaatgtcaaaataatattttggagttttaaaaataatatttggagttttcaaagtacctctagataaggaactttgaagaaatcataaattttccaggtcagcaaaataatagaaatccttacaaactgtctgttgtcacatgatcattattgagcaaaaaacatacttaatagatttattttgtttcattgctgaaactaaaccaatgttcagtttagttatattataatcagtttactcttttaaaaatattgatttgtgagagtatattatttttgagggtatatttgtgaagtatattatttttattagctatatactgtttagtgctagaaaatatgcccagtgtatcagaattataaaatgtactaatttagtttgcttaaaagtgagttttcatgcatatgcatgctaggtttttcctgtagccacagaaaaaaatattgaagttccacagatcataaaataagccatcaaaatgagcaataaatgattatatttagaaaaatggaaagatatgtattccaaagtagagttgtgataagcctgttttccatgacagatgacatatttggaagagagatgaaattcatgagctacaacatgtttacttgcttttttatctttaaaaatttgccttcacaaaacagtgtaagaattattctgaagtaaaaacaattattcccttaagtgtaatgctaggttgatttcatattttgttattattattattttgcttcccagtcctaccttttaatcactggaatgtgtgcaagtcagtttccttttttatacacctaggtgatctcagatgttgtatgccatgttagataatcttactattatactacatatcaatgcctacatttatatggtagtatattgtatttccaagtattgtcttataggttcaaagttttatcactgtagagcaagtatgtaaacataaaaactgtacgtatatgggtatatatttcatttgtagccattccatcccatgagtaaaatgagaaaaaaataggatatggatcatatatgtaaatgtataccatagtaaaaataaagattaccacagccctgctaatatagcaggttgatctttagaaaaggatctgtaattattaaattttacttgtactacttatactacaggcattgttaacattttctgtgacttgttatacttttttaaatctaacaaaattaaattcaacatgaaaaaatggtaatttgaaagaactaattggtgttttcatttgaagtatcttgcctgatgggaattgagttgaatttgtggattactttgacagtgtgatcatttttacaatattgattctacctatccatgaacgtgggatgtgtttccatttgtttgtgtcgtctatgatttctttcagcagtgttttgtagttttccttgtagaagaaaccacctccttggttaggtatattcctaagttttttttttttttgcagccattataataggggttgagttcttgatttgattctcagcttgattgctgttggtgtatagaagagctactgatttgtgtacattgattttgtatccggaaactttggtgaattcttttatcagttctaggagctttctggaggaatctttagggttttagaaaaaaaaatcctaaaattcatatggaactaaaacaagactaagcaaaaagagcaaatctggaggcatcacattacctgatttcaaactatgcgataaggccatagtcaccaaaacaccatggtactggcataaagataggcacatagaccaatggaacagaatagagagcccagaaaaaaacccctaatacttacagccaactgatcttcaacaaagatgtttgtgtttataaagtggggaaaggataccctattcaacaaatggtgcatgaataattggcaagccacatgtaggaaaatgaaactggaccctcatctctcaccttatacaaaaatcaactcaagatggatcaaggacttaaatctaagaccagaaactgtaaaaattatagaagacaaaactggaaaaacccttctagacattggcttagacaaggatttcataaccaaaaacctaaaagcaagtgcaataataacaaagataaatagctgggacttaattaaactaaagagcttttacacagcaaaagcaacagtcagcagagtaaacagacaacccacagagtgggtgaaaatcttcacaatttgtacatctgacaaaggactaatatccagaatctacaatgaattcaaacaaattagcaagaaaaaacaagcaatccaatcaaaaagtaggctaaggacatgaatagacaattttcaaaagaggatatataaatggccaacaaacatatgaaaaaatgctcaatatcactagtgatcagggaaatgctaattaaaatgctaatgatcagggaaatgctaatcaaaatactaatcaaaaccacaatgcagtaccaccctgcgcctgcaagaatggccataatcaaaaaatgaaaaaataataaatgttggtgtggatgtggtgaacagggaacacttctacactgctggtgggaatgtaaactaatacaaccactatggaaaacagtgtggagattccttaaacaactaaaagtagaactatcatttgatccagcaatcccactactgggtatctacccagaggaaatgaagtcgtcatatgaaaaagatacttgcacacgcatgtttatagcagcacaatttgcaatggcaaaaacatggaaccaacccaaatgcgcatcaataaacgagtggataaacagtgcaaagaaagtatgatggaatactactcaactgtaagaaggaatgaattaatggcactcacagtgacctggatgagattggagactattattctaagtgaagtatctcaggaatggaaaaccaaacatggtatgttctcactcatatgtgggagctaagctgtgaggatgcaaaggcataagaaagaaagatacaatgggctttgggaacttggggagaaagtgggaagggtgtgagggataaaagaccacaaattgggtgcagtgtatgctgctcgggtgatgggtgcaccaaaatctcacaagtcaccactaaagaacctactcatgtaaccaaataccacctgttccccaataacctatggaaataaaaaaaatttaataaaaaaaggtatcttgcctgtcaactaatttattctttttgtgctgtccactgctgtttatcagaagactcactcagtttaatggatttcattagtttaaggcacttgtctgaattagaacattggatacttaatgtccagtgattgctgttcttccctctgactcattcagttcctctgatgaataataggattttatgcagtgtgtattcctgttcttacttgttgaattaagcacttatcttagaatataaacacactgatatgaatggagtctattttcaaccaacttggtgtaagaatgtaaagtcacaatcatgtaccttgccttggattacaaaaccttaggctaccatgtgtcatgcagatgaaaatgttggtgtcttgatgtctttcagaagctagtgtcctattttttaaaattataatgtcttctgagagggaaggccttaggaggtgtgtcagttatcaactataagtgctctcagtgtaatactgaatctgcaacatggcctgtgtagtgtgacagaacacaatgttttaccacaagcacaattccattttctcaagacatatatgtgatggtgagtaaatcaataattttttatttgctgatcctgatatgatctaaaattttttgctagttcctcttttatttttgaaaagtgttccaagttgttgtaatgttatcttaattgacagaaagtacaatctgtccctggtatctgcaggggattggttccaggaccccagggcataccaaaatctggggatgctcaagtcccttatgtacaatagtatagtatttgcatatatcctacacacatccttccatgcactttaaatcatctctagattccttaaaatacctaataaaatgtaaatactatgtaattgttattgtactttactgtttagggaactatgacaagaaacaaaagtctgtacatgttcagtaaggatgcaatcattgtagacctaactacattttcagtctgcagttggttgaatctgcaggtgctgaatccagctatgagggctgactatatctgcagatgtacacttcaagctgcaagataatgatttttagaaaccacttaacaaaaaataagaatgtgtgttgtttagtataaatccagattatatttcatgaagcaaaaataaatcttcataaggagacctctagttatcaggtagttaagattttcagaatcagtcatgtgatgctatcaatctatttgtagttaagaatagtcaaagttggctggacgtggtggctcacacctgtaatcccagcactgtgggaggctgaggtgggtggatcacctgaggtcaggagttcaagaccagcctgtccaacatggtgaaaccccatttctactaaaaacacaaaaattagttggtgtggtgatgcaaacctgtagtcccagctactagggaggcttaggcaggagaatcacttgaacccgggaggtggaggttacagggagctgagatcgcaccactgcactccagcctgggcgatagaatgagactccatctgaaaaaaaaaaaaaatagtcaaagttgatagcaccttaatccatttttataggttctgcatatatagaaagtaacttatcatcatttgccatgcttacagttctttaattgtacataagaatatgatcttggaaaaaaactatcttaaatattaatcacttgctacatagttttacataagactccgctgtaatttttttaaacttcatttagaaattacagtaacaacatcaattatattcatgtagctttgacaaaatttactggaatgtcttccgtggttttgtttttcatttaatgtgcattaattttcataataataaatttgttcttctttgttatatttactgttaattacacatatataaaaattttcagagttattttggcatacatagtaaattgtagtaattatcaggtaacaaagtgagtactttttactattttatgctggtttacttgttttttatttaataaagaccatatttaaacattttcctttttcttctaaattttgaaacctagatttttgataatgtgggatttatggttttgcttcaggttttaaaatacatattgaatttcaaaaatgcaagataaaccattttgttttgataggacaaaaatatagtatgttcatttctccactgggtaaatattgagcatctaaaatgttctagtcactgatctaggagcttatgtaaaacagttctgttttttttctcttcagcttttattttgatttctggggtacatgtgcaggatgcacaggtttgttacataggtaaacatttgccatgatggtttgctgcacagatcaacccgtcacctaggtattaagcccagcatccattagctattcttcctgatgctctccctctgcctacgccccgaccactcaccaccgacaggacccagtgtgtgttgttccccccagtgtgtccatgtattctcattgttcagctcccacttgtaagtgagaacatatggtgtttggttttcaaacagttcttcaggttcatttacaatcatggtgttaagttagcaaatctttggaagtaaataaaactaaaaactattattctgttgttgctaccagtgtctagttaatctttaggtacttctttatgacaaagtgataaagtgtttttaaattagcagacttaggttctagttatggttatgctaattctgtagcatgactttgcatcagctagttgattttcctgggtttcagtttcttgtgaaaacatgaaaaatacagaggtggattgcttgtgctctggggggtcttgattcactgtggagagatctagagcagagagcagtgtcttcatattcataaagtcagctcagttatgtgcctgctacccttccttagccttcttttctgtctcctctttttcttccctacttgtaaatattgcagagccacggggctcagttctcagatctcttcctttctgttcttatttcttaggcgagctaattcaatttaatggttcagatacatatgtttaagtgcctccactttgtgtaataggtagatcaaatttaccacctctaagtcagaactcttgatttttatcatgaaaacaactctttcccaagtgttctttacctctgtaaatgactccaccattcacatagtattcaggtgcttcaccaagaagcacctttgactcttctctttccttcacatcattcattcagtctatcagcagtccttgccattccaacctttaaaatatattaggaacctgttcatttcttaggtcctctacctttgccctctaccaccccagtcataaccaccatcctctcttgcctggaatactgcagtagtttcccgatatccctgttttctcttttgtcctcatgtagttcattctcctcatagcaactggagcaattctttaaagataagtcgtttcatggtatcttcttactcataactttccagtggcttcctataacaaactgtcatggcttacaagttccctgacttcatttcctactattttcatttttactataccccttgaagtgtatcaatcttcattatgtttttgtgttttacccaatatcctagcttgttttcacatcagggcctcagcaaatataaagacatttgctatttcctcttccttaagtgttcttccttcagatatgtgtgtgatatacctcctcagaaatgccgtctctgacctctctacctgtatgttcaatcactctctatatccttctctttatttttcttcatggcaatcacttcctgaaattataaatatatatttgtttactgtcttatccaccagcatataaaccccatgaaagcagaaactctctgcttgtttactactgactgagtctctggaacctagaacagtgcttggcatatagtaggtattcagtgaatttttattgatagacagtttgagtgaaatggatggcaataggactgttttatttatttctatttaaacatggtttgtaggagcatcatcaggaaatattagggtcaaattttccattggtttattataattacaaagatttataactttgtcataatggaaaaatttataaactactatgttccttacagtatttaaataagctattacctaaactttttgttacttatgcacctacatcattaaaatcagaataatgtttttgaaaatacatattttaaaatacagcagctcacaaaaatctgatgtggttatggttatatagctttatgtttagatctcaaactgttaataattaacaatgaaaaaaacaaaaaggactttgagaccggctgagttacagaaaatgccatttgagaaaaaggttgatgtaaatcttttatgaatgagctctgattaagtaatcctcttcattgttaggaaaaagatctggtggaatttggcattgcccttgaaagttatttcaaatgctcgtattcccccaaagagttgtacagagttgccatttagctttgacttagagttacatgcaaaaggtattttgccttgttatgaaataactgactttcgaaaatggaatatgcatagacagatgttagaaaatattatataaatgtgtgagatatgacagggaaaatattcagcaggaattttatatattattgaaggaaaaattcagctatttaatattaattgacagtgacttttaccagcacataggatttctagccattgttgaatatcctaaagtaaaattgatttttatgtctatctgaataactgatatctctaaaatgcttaatagcatgcagatttttatacacactactttaacccttggaacaatcttatgtgaggtagacagtgttatccctccttttcagatgaggaaagagagttggttcaaaggagttgctgtaacttgtacaaccaataaacagtggagtttgaattaggctcagctctcctgatcttgaaatctgagcccctttcacaacataatgctagtgatccaaagtttaaattgccagatgagaacaggcccaagacactgtggcatctacatcttcagcatttgtggaggactcttggtgtttctggttgaactgagtgattgattgactagagctaagtgtcttacaatgcggagcagtctgtatctcaggaatctgattgcaatagagtctgattaatatgagtgtcatattttcattgtttcctgaggaagtaatgtgcgttgttaatggcaggaaattctgacatattttagtcttgggtttgtgtaagaagatttaatgagtactttgattattaactttataggtgtgagtgcagagcgatttcagcacattgacagtatctttaacctgataagaatagccattccctggaacatatcccacagaaaaactgtttttcaaagggtagatttctgaaaatcattggaatctatagattagggtttactaaaaataaaaaattataagtgttagcattaactcgagaaagttttagtccagaaattattagaaactgttttttgtactccaaccaatgagaattttaaacttctggtttgtgttgcaaatgatggaatccatgtaagtgtccatcagtggatgaaggggtaaagaaaatgtggtatatatacacaatggaatacaattcagccttagaaaagatggaaatgataccgtttgtgataaggtagatgaacctagagaacattatgttaagtgaaatatgccaggcacagaaaggcagttaccacatggtatcacttatatgtggaatctaagaacttcccactcatagaagcagaatagtggttactagaggctggaaggaggggtgggttggagaggtattggtcaaaggatacaaaactcattttgaaaacttatgtgtaagcttaatttaaaacatgtttttgaaggaaaaaggttgattatattctaatagatggactgatctgtgaaaaatgtaattgaaaaccagctggagagagatacttttgtaggtgctatgaaagatattaaaaagtttaagaaaaatctcatgccctccagccgctgatttgacagatgatagagataatgcatacatgtgcaagtgtgtgtttgtatgtgtgctgaaaatttagatgacaggacaagaaatgacatggtaggtaccaagtggtaaatatagacaatatattctggagctatttcccagtgattattaaagttactttcatgaaagcgatatgatttgaacttaggtagtagtatagagttagaagaatatacttggcaaaaaagctatgaacaagttcataaaaatggggaagaatcacaaagtactcccctagagtagaaacaaaagattgagctgctaataattggcactgagattatgaaggaccttgaaggaaaagataatttaagaatgtagcttttgaagactcaatttagcatttaaatttttatgtaaaccaaacatatctaaaatttgtttttgagtgtgtgattttgtgtgtgataaactatcttttctgtttgggctcattttcttgttaaagtccatctattctgtgagttctgtttaccatcaaagagaataaataccccaacagcaaatttttgagcctgtcatagatactcttttccttcattttcagtgaaatagctggcaaagttttatcgatattatttcttttgctttaggttggaagttcagtgtccagttgaaaaacaccaactcagctagtttcttctggtctgcattacagtattttacctgtctttttatgaaaagagcacgttctaggaaaggatggaagattctcaaagaaacaactttccccttctaaggcagatgaaaacctgtacatgtacctaacattttttcccctttttaaaatataaaatttcacattacattttctgctcttcctttttggaataattaaatgtaacacttctttcatagttatttgctcatttattctgaaatgacttgccttttcctaagtaggatgtgaggttggtggatgcagatggtgcatgcgagtgcaactgggaatgttttccaggataatagagaatgaggaactaccttctgaaacttttaagttgaaccccactcccccactttgtgatactctgtcttcactttctcttcttaaaaagttactctcctttttaatctttctagcctgacaactgatgtcagcagttgtttaatcggtatttggtgcttaaaccatacttgagtctctaactccttaggtttcattactgtactttatttaaaaagcctgacatttagttacttgagcatttctaaagcagcttttgaagtagcaaacaattaagaccatattcaacttttcaatgatcctacttaactgttaagggcaaagcaggaaaagagaactgcttggtacccgaagcaaacatatattaaaagaaggaggaaaagccttaatctcaaatgattatagatagataataacagtaagacacccatatagaatgttaacacttgaaaaatcttgatgaagatatatggaatttcagtgtactagtcttgcctgctttttaaagtaggtatgaaattttttcaaaataaaatttactgaaaatctcaaatgactagtaaccattttttctaaagtaaagatgaaaaatatctttggtattaatgttccccatttttatctttctccgttcctgatgcccagcactaattatactttaataaagactgaatttaattaagtcagtgacctgcaccagcatggtcagtaggaaagatcttcccacaaatcgtcaccatagctttgttcatttgcagctgtcttcatcacaactaagttgtacagcttattttattttcaagtttaaatttctttttcatcaaaaggtcaaatttgggttagttatgctaaacacacaatcttgtatagaatcttttttccagttttcaaagctgttgaattaggaccttaattaactgtggagttacacttttgcactgtgtttaatacttgcattgtaggaaaagttaccagaaagaagagagattagggatgagtgtcacactgacacaaggcctggcatgtaataagtattctgtaactgtttcttgagctaataatgaagggatcaaaggctaacattatttatttaacacctaccaagcccttagattaaagacttattttgcattatctcatgaatcctcacaacagcttcttgtgagtatgggttctgttgttatctcccttttacatgtgggaaaactgaagctcagacagcgtgcagggaggtggctgagtcaggattccaatggggtctttctgactatagtcactaacctcatactttcaatcatagcatttctacctatagaatgtttacttcgtttgagagtcacttcataagaaagagggtgtttggctgtggtttgagaaggattaattgtaattaatcttggctgaggagagaggatcactcttttcttggtttttgaattaaaactgttgtccaatatgatagccactagccacatgtggctgtttacatttaaatatgaattaactaaatacaatttaaaattcattttctcagctttgttacccatatttcaagtgcttaacagtcacatacagttagtggttttattggacaacacagagcaaatttccctcatgacaaaaagttctgttggatagcattacaaagattccagggttatcagttgaaactcttgaaagtaacactagttaaaacctatctcggaaaatagatttcatgattatcacagctctcaaaagcaataacactctatttttcttggttttatcaagtaatttaaatttatgtatttataatacttcctattgcccaacaaattatgatggagggacaggaaattaggatgggctcaatgaccccatacctgcagtcctagctgtactcaagaggctgaggtgggaggatcacctgagctcaggagtttgaggctgaagtgagctatgattgtgccctgcactctagcctggataacagagtgagacctgtctctaagacagatggattgatggatggatggatagttagatagacagatagacagatagatacatacatacatacatacatacatacatacatacatacatagataaaagaagttaatatttggagcaaatatagtaggcagtgctggaaacaagaagacaaatatttttcaagcagatggttctatgttgttagaaattattttactttgtttaccaatatcacaatagtatcgaaggcacggaggaaaaaatgcaatatttttaaagtataatttttattatgaaatattttaaacacactatacttttttaaatggtgaaaaagcagttggatacatttttttacaatagactcataaaggaatttataagtggaaaatttaatcgcctgattatttcagagatattttaagaatgtagtccataattttgcctggacgtctttcttaatatgttcgttacccaagttggaaagcacaaacctgggggtgaacttcatctccttaggctcacattgctcatctgtcacctggaggaggcaagtatctgctctgagatcattcctagtacatatttacatcctatgactcatagactaggttcggggctagagatccacttcctgagactggccatttttctccactgcagtagatgtggaattataaagttgaatgggaggatttatagaaaaatttaaagtcatattttacctgttatatactttttaaaaattgccttacttgccctattgaaaagaaagaaaatgaagaacgaatgttatttagcctgagaaagagaagatttaaggcttgacttagttcctgtgccctaaaagatatattataaggagtatttcctatcttcacagaagatgttcttatttttcagtgaagaaagtgcttctttaatgtctaccttgctcctgcccccagactctgtctccttaggggcaagaatgtgtatctggttaaatattttatcctcattgcctgcttagagccggaatatagtgaaacattcagccaatacttgctgaatgaacaaatgaacatttgtcatgtaaaaataatcactcctgacacaggtatattcgaaagttgtcacctcagcacatatctgttgttagtgtaccccagctgtgctttgtcagttccctaagaaaggggtaccagtcagtttggtcatgatgaatctgttgccttggattttactgctgggatatttggagaatgtcttgtacatatagggtacccaaacatttgtttaactaacaaaataatagaagggatcataagtacgtataatcaaaaatagatcttcaaacactttttgtttgattccagaatatgttttttttgtttgacttcagaatatgttatctgaatttatcaacaaaattaacttttgtgttttttcataacaagtgattggtgttcttttgaaagaatactgttttctttagattcaagaagagccttagaattttttaatactgtaggcacatatgtacttaatacatatttgatatttgtgtcatagttttggattctattttatatttgcatatatgtgatacatgacagtttaaaaatatgatatattatggaaatatatattttgtcttttccctctttctagagtataagttcttgaggtaagaactttgtcttcttcatcactctatctttgcatctagaaatgtgcttggcatggagtaggcacacaggaaatattgtaattaaacaacaaatgctttttcataagaggcctattgggtcctaagtttatttgtaagttagtcagtgttctggtttagtgtaaatagtcatcaacttttagtaattggaagactagctcttatttttgcattcttctttcaggaagaatccccagcacaagatagaatatagacataatacgcttccaggtaagtaagtttacttcagaaaattcaaaatgaaacctttaaatgattttcctattaaacctagtttccagttattatgaaaatattttaaaatctctgcttctgtgaatttgttgaattgctgattttaatgatttttcttatattaaaaaaaaacacaactgtgacccttttgtatagcaaatgctttccccattgtccacaatatatatttgccttgtatctcttaggattcttttgtttgcaagtacctgaaagcaaaatctcaaactggcctaaatgataattgacttctgtaactaaaacgtccagagctagggctggatttagataagctatattgctttggctcattaataatgtcaatagtgtccccaaagacccaattttttccttcattctgtctttagaggggtcattatcatcctaaggctggctcctcttccaacgagggactttatgtgtccttattcagctgggacgataatcacccgtaaggaatacaaacaactttgaccctcatgattcctaggaaaaatcagaaaattcactttttattactggattagatcacagtcttaaccttgatccaatcaccatggccactgattagtttgtaccgctcctgaaaccagaatggagtcaccttcatcagaaccatagccatctccaataaaagctagagctttgaggaagagaggagggggagagacaccagagaagcaaccatcaaatgtccttctgtcctacttacctcaatctgttttaccttctgtttgttatgcttctaaactgtatttttcttctttaataaaatctggctttttcatatcattcatataatacagaggctgattcagcgcataatatttctgctcacagaatgagaaaataaaatgcatactatccaggctgcactcacttgcatttatatgtgcatacaaacagctgacttgtaatcaagtaagtgatgaaagtaaatgatttcactgtaagggaattccatttgacatttcttattgaaacacactttagtgctttagtactccagacataaaaatattccctttatctgagctaacatagtatggaggttacatgttatatattatactttctttactgtggtcatatctcatggtgtggcagttatggtagtttaataaagtcttcctttctagaaataatgtaattgtatttgattaaaagtatatattgttgacaaattatagcattgtcccatgcaagagcatttgacacatttatataactttatagaaataggaaatatttatctaaaaactatgactacacatcatatagcatagttaaaaatatctgaatttttgttgaaaaatttcttgaaattattgaagtattttttgaatgaagaacatattttaggacaattaactttttaaaggaaaactttattgaaaagcatttttaatagaagtatagatattttaaaggaataagtttaaggctataggtttagtcatatttttaatgtactttcaaaagttgctatgtggcaatatagtcagaacatctcttaccctacaaaacctaaaaattggggattttgagtatttcaaatattaaatgttgaggtatcattgtatttttctgatttagagatatctaatacagaattctaacatacttgtttttcttgtatcccaaatcattaaaatttaacagtacccccaaatgttaatctcagctatgtattgattcatttactcacacattcacatattcctttgttgaatgtcttccatgtgagcaaagctacagagagatgagagccggctcgtaattgtggttatgggaaccagctctgggtctcccaacttgccgtgagatgctctgaaatctccagggaaagggagggagtactttctgctggggattatcaggtagacttgatatgagaattttaagtaaaagttggcctttaagatggtaggatttcagtcacctttgtttctttgctgtgtgggagattggtataggacatcacaggcaaagtgagaaatagatcaatcaaagacatcaaggtagaagtgttgtagttggagttagcaagtggatcattttaattgatgtggaaagtctctatagctactgtggctgatgctaaaagggtgtattgaagctagattatggaagctctcaacagccagaccaaagacatgggcactttggcaaataatgatgagccaatattttaccaaaatcaagctggtgaatacagtttgaattagagaaggggaagcctggagattagttaggtagaataaagggttagaactagggcggccatcatgaacatggagaggttggattggatacaagagggatttttgaaggatgaatcaagaggatttaccaactaatcagttggctgtgatatggggatgaggtaaatgaagtcaggatgactcaggattatagtacacattatcaggagactggagaagacacatgatagagaatagggtgaactggggagttttgttgtttttgctttcatttaaacatgttgaatttgaggtgggggtatcataagaacatatataacaagataatacaattattaatatagtgccaacattaaaataactacattaaattcttactctttaatttctgatttgtaatacccctaaaacactttcatctatagggttcttctatacatgtaacagtttatatagtgcattctgtttcttgtaggttggactcctgtcatttgttaagtttcttgtatatataattggtttaaaattttatttaagtctccacactttttcgagtgctacaatttttgcacaagttattgaatgcaaaagtaaccagtaccaggaagattttgttttattcttttttttttaatatatatatatatttttattatgctttaagttctagggtacatgtgcacagtgtgcaggtttgttacatatgtatacatgtgccatgttggtgtgctgcatccattacctcatcatttacattaggtatatctcctaatgctatccctcccccactccccccaccccacaacaggccccagtgtgtgatgttccccttcccatgtccaagtgttctcattgttcagttcccacctataagtgagaacatgtggtgtttggttttttgtccttgcgatagtttgctgagaatgttggtttccagcttcatccatgtccctgcaaaggacatgaactcatccttttttatggctgcatagtattccacggtgtatatgtgccacattttcttaatccagtctatcattgttggacatttgggttagttccaagtctttgctattgtgagtagtgccgcagtaaacatatacgtgtgcatgtgtctttatagcagcatgatttatattcctttgggtatatacccagtaatgggatggctgggtcaaatggtatttctagttctagatccctgaggaattgccacactgtcttccacaatggttgaactagtttacagtcccaccaacagtgtaaaagtgttcttgtttctccatatcctctccagcacctgttgtttcctgacttttttatgattgccattctaactggtgtgagatggtatctcattgtggttttgatttacatttctctgatggccagtgatgatgagcattttttcatgtgtctgttggctgcataaatgtcttcttttgagaagtgtctgttcatatccttcaccccctttttgatggggttgtttttttttcttgtaaatttgtttgagttctttgtagattctggatattagccctttgtcaggtgagtagattgcaaaaattttttccaattctgtaggttgcctgttcactctgatggtagtttcttttgctgtgcagaagctctttagtttaattagatcccatttgtcaattttggcttttgttgccattgcttttggtgttttagacatgaagtccttgcttatgcctatgtcctgaatggtattgcctaggttttcttctagggtttttatggttttaggtctaacatttaagtctttaatccatcttgaattaatttttgtataaggtgtaaggaagggatccagtttcagctttctacatatggctagccagttttcccagcaccatttattaaatagggaatcctttccccatttcttgtttttctcaggtttgtcaaagatcagatagttgtagatgtgtggtgttatttctgagggctcttctgttccattgatgtatatctctgttttggtaccagtaccatgctgtttaggttactgtagccttgtagtatagtttgaagtcaggtagcgtgatgcctccagctttgttcttttggcttaggattgacttggcaatgcaggctcttttttgttccatatgaactttaaagtagtttttcccaattctgaagaattttattcttttttagctgcctcacctgttgacaacatttaaaggaaattatcatcaatattttatctaattattggggtcctcctttctggcctctattattatgtgatatgtattattctaggtgattgataccatttgtgaaaatttagaatgttccactgatagctactttaaggtttctctatttctacaattgtatacatgtatgtgcttatatatacttttttattcagaagttgaaactaaaagatccagaaagaaaactattaaggaggcttagtgggatttacatgaaattctataaactgctgcttaatgtgtggaaagctaagagaatatggaatatgagaaagcctgatgcaatggaattataaaaagaaatgaactttatatataataaagtagatcagaaatatacaaaataaaatatgaataccaactagttgcttagtgcatttaaaaaaattactctttaatagtaaaatgaagcgttattaaaaatgtttgttcttgtagatatagtaaattttcatctttaggaatattgaggcaaaatatttatttacttaataaaaattaacatcctaattagtcctaagatttaatagaaagtaaaagaaaagaaaacatgaagaattatcaatgttaagctattaatctgctgtgaagcacctgtcatcttagatgtaacaccaaaaaactttggtaaaaatctgcagtttggctgggtgtggtggctcatgcctataatcccagcactctgggaggccaaggcaggaggatcgcttgagcccaggagttcatgaccagcctgggcaacagagtgagaccacatctctacaaaaaataaaaaaaattaaccagttgtggtgatgggcacacctctgttcccagctacttgggagactgaggtgggagtatcacttgagcccaggatgtcaaaaatgcagtgagccgtgattgtgtcactgcactctaccctgggcaacagagcaacactctgtctcaacaaaacaaaacaaaacaaaacactgcaatttgaaaagatttttctccatgcaaaatcaacatttcttctggcatgtatgtcacacagtatactctgcagtagtttgaagacttagttcttgggataagaactaacagtgaaattttaaattgtaaaagaaatatcagaaaaacatttagaattgtcattctcatattacaaattcctctgcatatataaaaaaatcagaaattaccacattctaatcccatatagtaaataatatgttgttttaaacatgttaaagagtttattattttttctaaaagttatttttcatcaccatggtagatcagcattacccatcagggtttacaaaccagtgacagcttatttctccagtgctggcttcaagtagtcaagctgtcaatccctgtccacatttcattttacttcactgatttgtagagaaaataaaggttcctgttgtggccttaaaattagaactctggagttagaaatatctttgtgatcatttaatgtttgatgtgtagtttaaaaagtaatttccggccaggcacagtggctcacacctgtaatcctagcactttggggggccgaggcgggtggatcacctgaggtcaggagttcaagaccagcctgaccaaaatggtggaaccccatctctactaaaaatacaaaaagtagctgggcgtggtggcgggggcctgtaatcccagctactcaggaggctgaggcaggagaatcgtttgaacccgggagacagaggttgcagtgagccgagattgtgccattgcactccagcctgggcaacaaagcgagaccttgtctcaaaaaaaaaaaaaaaaaaagtaatttccattaggttaagtgacttgttcattgtcatgagttcatttataacacagatagttggacttctaacccctggtctagtcctctttctcttaaactgtgctattttaaagagtctttttgttgggtaagatgtgaatgcacattatcacataacatgtcctaatgatatctcaataagacagtttcctttcagattcagaaatcacttaacagctttacaataaaaacagataaaaagccggaacaacttcaggttctcatagacaatcaaatgagagcagcagtaactagcaggaagaaatttataagcattctaggcaaaaatagagaaaagacttatttctttcaagtttacctggacttagaagtgttaacccaaattaaaaaaaaaaaaaaaggaagctttctaagataaatttacttgggaatattgtaatgagaatacgtgtgttattgtaaaaatcagtattcagagtattttccaggtaagtaaagtttaatttttttttttggcccagttacactgaaaggcagaattggatatttctctaaaaacaccttcagactctactagcaattttttaaaaaggaaagtcatctaggtagcatttgttttatataacatttaaagttattaattgaattttccacagtataatctattaaataattggtcccacaaagataatcacatgtcagcatttataaccctgttatgaaggatctgtgtgacaccactaacaggacacagagctgaattctagagctgactttgtgctcatgtcatgacttggctcttcaagtgttttcacttaaagtataaaagtacctgttcatgtgagttaaggtggattacatttggctactagccacgttgaattctgttacagatggttttgttagattctggacttcctgtaagaagaacatgaatgtgtaaaggtaaacataaaatgtaagtgatgacagatataaacttttttctgagtaaacaaacaaaattcttccgattaatgtggtcttactgcctcaacaaatgaggcttcttaataagttgctaaatatttccagggttcactgaggcttcatttagcagaattaaagtcttttatgtaattcattatattgactggcaggctagtgatcaaaagtgtaggctaaaataagagtttctgtaaaactaaagatgttcagtagttgatttgcaaatggttcatttattcattcattgatatattcaacaaatatatttattaagtgctcccacatgttaagcgctgttgtctgagctaaggacacagtagaaacaaagccctgctcttgcagaattgtacacagatgggcagtggacacacaagcaattatttgttgtcatgtgttgataattagaagaaaaataagctgtgtaggaggacagaatagcaagggtgtgtacatggtatggggaatgccatgtcaggatggtaaaagaagcactctgataatttgacattggagccaaagcttggaggagggagcaagccaggtgattatctaaggaagaatatgccaggcgttgggaatcatgaatttaaaatccctggtgatgaccatgcttggactgttctaggaatagcaaagagcaaatagaattggaacagtgtgagtaaacagaatggcataggatgagatcagaaaactaccagtgggctagttgagtagagtcttcaaagctgagacctgtaaataaagactttagattttatttagagtgagacagaaagctattggaaggttttctgacttttttttgtgaagaatagactagaatggaagcaagagagccagttaggaggatattgtattcaggaagaaaatgatagtattggggccagggcattagagtggatgtgatcagaagtggtggatttactttgcaggtaaagctaacaggatctcttgaggtattagatgttgggttctcggtgagggatattaaaggatgactacaagatttcttgctaaaacaactagatggttggatgattagagaagtcatatattcaagactgataaatagaatgaccagatctgggtaaagcaactaaagagttatgttctggaaatgttatattccaggtgcctgtaagtcatccaagtacagataatgcttaagtatccagataaatgagtctggaattcagggcagtaggtcagggcttaagatgtgaatttgggaatttaggacataagactggatggaatcatctaaggagtgagttagagaagaggttccagctctaaaatttagagattaggatgatgaggaaaatccagcaaagaaaactgagaaggagcagccaatgaagtgagcagagaacctggagttgtttcacctttatatctgtttttcttgtaaagctggtaagtgatttctgaatctgaaaggaaactgtttattgagatatcattaggacatgttatgtgataatgtgcattcacatcttagaaaaaaaagttatgtgtataaggtatttccaagaggaaaatagacaaaaatagagatattgatgttctttccttctcattccctttcccgactgcaaactgccttccaatttttaaaaaatgcattttattattttaaaaatatgggtaactgagattagacataaaacatgccctcaagatgtttacaggagctgtatatacagatatatgtaatgcaagattttccttaaggaactggtgagcttcctactataatgataattgggcaagttattatattgcctttttagccttggctaccaagaatcttggggataaatttgatgctctatttttaataattgtgttaaaaattgaggttatcatatgtgtattctgctttttatgtttttggtttctacctttattagcattttattattataagctgtctcaaatcctttctggaatgcgtactgatattaagaaaaatataaatatattgggctataagggttaaaaggacagatacattacttcctttgtcatttttctcatttttcccaattcattgactttatttttaaaattataactatatgttgcatgtgaacattttagaaagatgttaaccaaagtgtatactaaagtacagacattaatgtttttaacctatacatttgctgttcattagggactgtcctctgccattcagatttctagatgaaatcttcctaattgtttcttaaatgttccacactgtcctagagtctttcactgctttattttaaagcaactctgtagctcgctgtggaaagagtaagatcggggaagaaatgaatttggagacagaagaattctagtattataatattacttagaaatctgtaaattctaatgtctattattatggcattcctagtcttactgaaacatgaactgtaagaatatcttagacctataaaactaaactttccaaagtatctaagctcacgccctgatgtgtcagcaagcttttgctaggtttgctgtgataacaaacatttctaaatttcagtgccttataacaataaatacacttatttaagtgtatttctccttattgcagctgtgaattggctgtggccctgtgccatgtgtattctcatcttggaatccaggctgagggatcagcctctatctgggacatgctgttcttgtggcagaggggaaatggcaatagcagaaccagagaaagagtcttaaagcatccttttggaagtgacacacactatttccactcacatttctttgagcaatcactgagaagtgaggaagtataatcatatcacaggaaggggcagtgaataattgggacaaaaatacattctaccacatgggaagatgggatgttgtgaatatgattatgagattaaggaaccattattattaatctcatgggtcattttagtttcaggagcctcatggtaggaaaagttagaataataaataacaaagcatcattttagtgccgtttccagaaatttgtagtggtaagctatgcattaataaaattaatcctctggatgcagaaagacattttataggtagatgtctgtcatcccaggttgagtggtgattgatgtgttgtgtaccaatcttctgttttgcagtgagaaatgttttagatgaagataatgataatgttgggcaacccaatgagtatgacctgaacgacagctttctagatgatgaggaagaagactatgagccaacagatgaagattctgactgggaaccaggaaaggaagatgaagagaaggaagatgtggaagagcttttgaaagaagcaaaaaggtttatgaaaagaaaatagtaactaacttctgtagtcatatctgccttacatttactttttctttgtgggaaaacatttatgaactaaggaggtacttaagtgacagttattttccttcttttgatagttaatgacttttactactgactctttacaaatgagacattgaaacgtcagccttcagtataatagatggaattttttgttgccttgccttttctttcctacttaaagcatctggaaataggaagacagagaaggtagagtaaaaatggatattttttatgtactttgtatattggtaataaaaagtaaaagccataggttgcataaaactttggtctttttaaatttttttccaaagattatggagtactctgcaagtataaccaggcaaagtacatgaaaacatgcctcttttcattgttactgaagtaattctgtaagcagaaccaggctttaaaaaatgcagccattacataatggcgttttttttctagtaccttagatgtgagctttgcaatttcacttactacttttatccttcaaaacttgggaagattggttccaaatgggtactgaaaatagattcaactaggctgtagaagagaaatgttcaccatgtagggaatgttattttgtgttccacatctgcaatttactgtatgtttgaatttaaaagtaaaaaaactcaaaaaacttgaccttttttttcaaactaaagtcctagctgattattttaactctcagtgtgctgtctttatattaagaatagagaaacgacataactttctcaaatggcattagttttgccttagtttttttgacctcagatgaaagtagcaagttgtttgccagttgaaagttcaagattctggcctcccatatcaagaagaaaccacttattctccagttttacaaagtatctttctgtatttctgttctaaaactactttaagccctataatgctcttcatattacgtgactttgaattgttaaaatgtagtttagaatctttaataacagttgggttgtgtacacagagcaggagatatttattgaaatcataaatcactaagccaaaagaatctttgttaaatgctattattttctactctaaaggaacctaaaaatttatatcttaaaagatcaaaacatatttataataatattttctcattgctttaaaatatatctcccagtaattatacaatatttaatatttacttaaactggaacaagaataagataaacatttctctagactataacctattattctgatttttatctcttattgttatttgggaactatttttccccttataatgtccctttagccttggtagtataacaaatctacgaatgtaatatttaacttattctcatccctgccactaacttaatccttgaagtgttacataatctactcctaggtatatacccagaggaattgaaaacatttccacataaaaactgtacacaatgtcaatagaagcattattcttaacagccaaaaagtataaacacccaaagtctatcaactatcaactgggtgaatggataagcaaaacgtggtatatctgtgcaatggaatattatttggtcataaaaaggaataaagtactgatacatgctacaagatagatgaaccttgaaggcaagtaaaagaagccagacacaaaaggccacatactgtatgaactcatttatatgaaatttccaaaacaggcaaatccataaagacagaaagcaaatttgtggttgccagggacttggggaggaagaatggggagtgactgctaatgagtataggatttccttttgagtgataaaaatgttctaagattagatggcagtgatggttgcacaactctgtaaatatattacaaacaatgcattgtacactttcaaagggtagatttcattgcacgtgaactatatatttcaataaatctgtcacaaaaaagtaatgcaaagggtaataccagtcttttagaaggaaaaaaatatttaatatcaaaggatattcttcgtagtaatgtaatagttcatggtagctgcttttaacgatacagttttaatgcaactttcataatcatcctgaagacacttttgagtataactattgtataaataaatgtatagcttaattga

SEQ ID NO: 50 - DNA, 14864 bp, Homo Sapiens
ttgttttttttttttttttttttttccaaaaatgggcggaggagagtagtctgaattgggttatgaggtcccctgcggggtacctcacctcagccattgaactcacttcgctggccgtgagtctgttccaagctccggcaaaggaggcatccgccgggcccctccccgaagggcggggtccacggcatctcctgcccagtctgacctcgcgcggagccccgttctctgggaactcacctccccgaagctcagggagagccctgttagggccgcctctggccctagtctcagaccttcccaagggacatgggagtggagtgacaggacgcactcagctcgtggccccactgatgagcttccctccgccctatgggaaaaagtggtctcatacagaacttataagattcccaaatccaaagacatttcacgtttatggtgatttcccagaacacatagcgacatgcaaatattgcagggcgccactcccctgtccctcacagccatcttcctgccagggcgcacgcgcgctgggtgttcccgcctagtgacactgggcccgcgattccttggagcgggttgatgacgtcagcgttcgaattccatggcggcgcggcggcgacggagcaccggcggcggcagggcgagaggttcggagctcaatatcgcgggacggcatgcggggggcgggcagtcagaaaggaacgatgccacctactgtgacccccttccccttccagctccctataacctgcacttggctaccaaaccagttggggtgctaaattttgtaaatttcggttttcagagctttggggattacataattgtgcataaagccttgcggagctgtaacaactaatgtgccagtactgttgttaatacctaatgtcatccaatttacaaaaagtaattgtaaggcacaccattattttatacacaacaaaggataagcactgaaaatggtgaactgtgattcactgcttatgtcatccattgtaagatgcatcccagttccagagagtaaaatgcgagtcttagacctattgagatacggtattatgtgtataatgttcttaaatgcataggtgcaccctataaattaggttctattgtacttctctagaagtacagtattgtacaatattctaatattggagtaagtgaagtaggaagagatcaaatacttctccaagtttccacagagaaaagcagcagagctaggctctaaattaggcacagacccttgagcacttaactaacctttatcccatacggcctcatgtatgaggtgggtatttgggggacattgggacacaagtaaaacagataagcaggcctcaatctatgagcttacaagactcctgggactcccttttattttgttttatttcatttggctagaatagcaatttaggaagaattacacagactgttacacaaaagtagtgtgggacagttgttattgcctctgtaaacttagaaaattatcttaaaccggcggggtgaggtggctcacgcctgtaatcccttgggaggccgaggagggcagatcacttgaggtcacgagttcgagaccagcctggccaacatggtgaaaccctgtctctactaaaaatacaaaaattaactgggcatggtggtgcacgcctgtaatcccagctactcaggaggctgaggcacgagaatcacttgaacccaggaggcggaggttgcagtgagccaagatcgcaccactgcagtccagcctgggcgagagagtgagactccacctcaaaacaaaaaaagagagaaaattatcttaaaccatttctttaaaagatttttttcaatctttaaaatctacacgtattcgggtgtgtactcattctttgctaatttccaaattctgtagcattaaatgaaagcaaaagagttaataatggcaacacggctccagaagactcttcccctgccaagaaaactcgtagatgccagagacaggagtcgaaaaagatgcctgtggctggaggaaaagctaataaggacaggacagaagacaagcaagatggtatgccaggaaggtcatgggccagcaaaagggtctctggtaggagtggatctggggatgatatcttgttatttcaactcctatttcgtccttctttcagggaataattaatttctctatcctttgggcataccacagcactaatctactgccttgaatcttcattttcatgtatttgagatggattggggtctaaggaaagaccaggattggttgggcgggcaaagttaatcctgacaagtttctgttttaccacaacagctgtttttgattcccataaagtagtacctatctgtctttcctcagaatctgtgaaggccttgctgttaaagggcaaagctcctgtggacccagagtgtacagccaaggtggggaaggtaagagactctggaaccgatcttcagtccatggatatctcagagagcatcctttgttataaggactcctgtctgggatgctgttagtactcattttaggaatcctctccaaaatatgatgagtgagtagttttctctaatggcaagagataggagtggtagggcttggggttaataatcagggtgttttttaacatggtgtgttagaccattcttgcattgctgtaaagaaatacctgagactaggtattttataagaaaagaggttcctagaggctgtacaggaagcatagcagtatctgctcctcaggagaccttaggaaacttttactcatggcagaaggtgaagcgggaataggcacgtcacatggcaaaagcaggggagagagagagagacagagagaaagggagagagagagattggagaaggtgtcacagagagagaaagagagaatggggaggtgtcacacgcttttaaactaccaaatcttgtgtgaattcactcactatcaagaggacagcagcaagacagtggtgctaaaccattcatgagaaatccacttccatgattgaatcacttcccaccaggccccacctccagtactgaggattacaattcagcatgagatttggaaggagacaaatatacaaactatatcacatgcgtaccttttgtggttgccatcagccttctacacctcattctctttttaaaccagaaaatggtatcattgttaagggaaaactgttttcttgttctaatgagaaactgtaccctggaatggcatgagttactgatgaatggggaaaaaagaaggctacctctggaataagttttctttaactcagttagaatcttttttttttttttttttttttttgagatagagtctcactcggtcacccaggctggagtgcagtggtgtgatctcagctcactgcatcctccacttcctaggttcaagtaattctcttgcctcagcctcccaagtagctgtgattacaggtgcccaccaccacgcccagcctgggctaatttttatatttttagtagagacggggcttcaccatgttggccaagctggtctcgaatgcctgacctcaagtgatctgcccaccttagcctcccgaaatgctgggattgcaggcatgagccaccatgcgcagcctaactcagaatcttttgtatagttaaaaaaaaggaagcatgttttcatttatagtaaggttacacccaggttactggtagaacataggtttgcaattctttccttgggagatgaatgttgatgttgctgtagaatgatgacttgagccataagaaaatttagagcctcatttaggatgtcagggctgaacctatactaatgttgattttttctctctctccctttctaggctcatgtgtattgtgaaggaaatgatgtctatgatgtcatgctaaatcaggtaagaggcaagaagaggtggcaccattatatttatgagaccatcttcttgataattattgatgatagcatcacagtgttcagatctttaaagtcccttttttttttttttttaaattttgttttttctttttgaaatggagtctcacttcatctctcaggctggaatacagtggcacaatctcggcttactgtaacctctgcctcccaggttcaagcaattctcctgcctcagcctcccaagtagctggggttacaggcgtgcaccaccactcccagctaattttttgtatttttagtagagacaaggtttcgccacgttagccagggtctggtctcgaactcgtgacttcaagtgatccacccacctcagcctcccaaaatgctgggattaccaggtgtaagccaccacgccttgcctaaagtccttcatatgtgtgtgtgtatatatatatatatatatatatatatatatatatatatatatttttttttttttttttttttttttttttttttttgagacagagtcttgctctgtcacccaggctggaatgcagtggtgcaatctcggctcactgcaatctctgcctcctgggttcaagcaattctccagcctcagcctcccaagtagctgggactacaggtgcagtgtctggctaattttttggtatttttagtagagatggggtttcaccatgttggccaggctggtcttgaacccctgacctcaggtgatccacccacctcaccctcccaaagtgttggtattacaggcatgagccactgcgcccggcaagtcctttatattaatattagccattagtggttaaacacctgagtactcagccctagcacactcttatcagatagcagagtcctctgtgagaagatttttttttgcaaatttcatatcatttattgaaattgttaactctctgttcatatccttttgcacattttttttttttttttaaacagacaggatcttgttctgtcacccaggctggagtgcagtttgtacagtcatagcccactgcaaccttgaacttctgggctccagcaatcctcccacctaagcttcctgagtagctcggacttcaggcgcatgccacaaagcctgactaatttttaaattttttatggagatgagaatctcgctatgttggataggtggtcttgaattcttggcctcaaatgatcctcctgccttgtcctcatgaggcactgggattacagggatgagccactgggacaagctgttttgcacattttctaaagttattggtccttttcttactggtttcgaggaactttatataatatggagaatagccttttgtctgtaatacaaaccacttgtgttttccagatttgtcatttaccttttggttttccttatagtacactttttgcccatattgaagttttaaattttttctgtagttaaatttattaatttttcctttttaaaaaattttgggtttttttttttttaattttagagacagtgtcttgctatgttgctcaggctggccttgaacttgtgacctcgtgtgatcctccaacctcagcctcccaagtagctgggactacaggcatctgcccccaagctcagctttctttttaatcaacctttttctcttgtttacctttgtggttttgagtagataatacatttgcctcattaatatatttcctggatatgacttcatgtttgaatttattgatccaacatatataattttaacaaccaattagtatttatttcttactatttcttctacttaaaataccacgagcagatagaaaataccttaaggttagccaggtgcagtggctcacgcctgtaatcccagcactttgggaggctgaggcgggcggatcacctgaggtcgggagttcaagaccagcctgaccaatgtggagaaatcccatctctactaaaaatacaaaattagccaggtgtggtggcatatgactgtaatcccagctactcgggaggttgaggcacgagaattgcttgaacctgggagacggagtttgtggtgagccgagatcgtaccattgtactccagccctgggcaacaagagcaaaactccttctcaaaaaaaaaaagaaaagaaggaaaataccttaaggcagccaggtgtggtggctcatgcctgtcatcctagcactttcggaggccaaggctggagaatcacttcaggtgtgagttcaagatcagcctgggcaacatggtgaaaccttgtctctacaaaaaaatacaaaaacaccgggcatgggccagctactttggaggctgaggtgggaggattgcttgagcctgggaggttgaggctacagtgagctgtgattgagccattgcactccagcctgggtgacagagggagaccctatctcaaaaaaataaaaaataaaaaccataaaaacatttacaaaaaaattttttaaaggaaaagaaaatatcaagctgggcatggtggcttatgcctaaaatcccagcactttgggaggccaaggcgggcagatcacttgagttaggggttcaagaccagccttgccaacatgttgaaactccatgtctactaaaaatacaaaaaaaaattagtctggcatggtggcgtgtgcctgtaatcccagctactagggaggctgaggcacaagaaattgcttgaacctaggacacagaggtggcaatgagcggaggttgcaccactgcactccagcctgggcgacagagcaagactctgtctcaaaaaaagaaaatatcttaggctcctttttgttctaacatctaatgaccttttttttttcaccagtgggctaaggtcgtacaatggctttagaatgtgagcaagcaggagatagaggtaggaaggggcagcatgcttaacaaaaaagaatgcctccatatccagggctcggccatacaacaccagctgctatgccttatcatggacttctctctcttcactctgagtgatttacttacagatacctctttttagatactggccatattctctctcagtatctccaagtcaggtcaggttaggtatgggacggatgtggcagtggttttgcgtatcccttgtcccctcccattattgccctgctctcagctcattgtcaaatttctgcagctgacaaacaaaagctgtgagtagaactgtcaaggagtaagtcatttaacagttgagcataacaggtttagacctttggagcatccaaattgttttcatttgggaaataattattgggagtggattgggagctggaaaacacatatagcttagaaaatatctaaatagggagctgaggcaggaaaaaactggaggagccattcaatgtaggatatttgaggttggatagagggttttaggaagcttctaggctcccactttaattcctaagaatccaaagtttaatgtataagccctatttcttctttatatctttaatcttacaggaatctaattttcttgcctgatgctatccttttccttatggaaataactggcacctgtgacgaaggatgagtcattggtttatgtgatttccatttgcaaaactccttttttttgtttttgttttcactcaacatagaccaatctccagttcaacaacaacaagtactatctgattcagctattagaagatgatgcccagaggaacttcagtgtttggatgagatggggccgaggtaatgatttttattgagattttatgagttggcattcagaaagtcagaagcagcttagtgggtggccaaaggattctctgggtttaaattgggtcagtagaggctctgaagtctgggagagccttaggaatcaagttgagcatcttgaaattggggaatggcaggcatcctccttagagttcccactggaaaaactaagagcagcccattgagtctgaaaactcttctatagttgaactgctagtagtgctcatagactatggcagttagcaagtaacttgtatcaacatgattagttccctaaatcctttcacctttcccttctccctttcctgcctgtttgtcagatgttaagcagagagatcttggagagctggcctgttactcttagggaactatcttatgtgtggcatttcctttgcagttgggaaaatgggacagcacagcctggtggcttgttcaggcaatctcaacaaggccaaggaaatctttcagaagaagtgagtgctgaaaagtgactacaaaaaaatataccctcctcttcttagatgtatattctctaaaaaatttttttttagacagtttcactcttgttgcccaggctggagtgcaatggcatgatctgagctcactgcaacctccacctcctgggtttaagtgattctcctgcctcagcctccctagtagctgggattacaggcgcccaccaccacgcccagctaatttttgtatttttaatagagatggggtttcgccatgttggccaggctggtctcgaacccctgacctcaggtgatccgcctgcctcagcctcccaaagtgcgggattacaggcgtgagccaccgtgccctgccttctctaagaattttataagtgtgtggcttataaaaaacttttcgttttataggtgtgatttggcctaaatgttaatgtcttttcaccctgacattctgtggttgaaacaccaaactgcatccttagtgattaaatcaaactaataccttgaaagtcactaaaaacagaagaatctaatatatttaacacatgactgacaaatttaggaaatttgggataagtggagactatcctgggatagataatattcaactaggggctgagcacggtgatgcctgtaatcccagcactttgggaggttgaggcaggaggattgcttgaagctaggagtttgagaccagcctgggcaacaaagcgagacccctgactctcccccaaaaaaaaggaaagaaaaaaagagaatattcagttagaatttttaaaactttatgatatagatgaagaactttctggagaattggagaacatgtttctttcagggaaagagattagatggatatcttttgtttgaaatctcaatggcttttgtggtgtttgggaaggacaagcattgtttttcccattttttaaattccatttgtctccagagcttttttgtccatttagtgtcctcatttagaattagactaattttgatttatggaaagttgatgtgtaaaggagctcagtgctggaaaataaattctttggagattttctgtcttgtaagtccatcttcatagtagacctttatttgtaaagttttcttacaccttggactctacagattccttgacaaaacgaaaaacaattgggaagatcgagaaaagtttgagaaggtgcctggaaaatatgatatgctacagatggactatgccaccaatactcaggtaactctcactatacttttcgaaagaaacacatcttctttttttattttattttttagaggcaaaactgtgctctgttgcccaggctgggtggcacaatcatggctcactgcagcctcaagatcctcaggctcaagtgatcctcccacctcagcctcctcagtatcaggaactacaggcacgtgccactctgcccagctgattttttttcttttttttttgtaaagatgaggtttcactatgttgcccaggctggtctcgaattcctgggctcaagcagtcctcttgtcttggcctcccaaagtcctgagattacaagcatgaggcaccacacctactcctgtttcttcttactcagggtaaagcagaatagcttagatcattcctggactgggacaggccaggatatcttgaatcctttctacttctcacctcaggggtgctctcactgatctttgtaatcccaaagggacagtaagaatgaggatagaatgtgcctttctagtcttggctctgttatttactaaggttcttttttttttttttgagctggagtttgattcttgttgcccaggttggagtgcaatggctcagtctcagctcgctgcaacctccagctcccgggttcaagcgattcttctgcctcagcctctcaggtagctgggattacaggtgcccgccactatgcccagctaattttttttgtatttttagtagagacagggtttcatcatgttggccagtctggtcttgaactcgtgaccttgggtgatctacccgcctcagcttcccaaagtgctgggattacaggcgtgagccatcacgcccggcctactaagtttcttataaaatcttaggccctatttccagacgtttattgtttttttcgtttttttgtttttgtttttttttgatacggagtctcgctctgtcgcccaggctggagtgcagtggcgcgatctcggctcactgcacgctccgcctctgggttcacgccattctcctgcctcagcctccggagtagctgggactacaggcgcccgccaccacgcccggctaatttttttttgtatttttagtagagacggggtttcaccatgttagccaggatggtctcgatctcctgacatcatgatccgcccgtcttggcctcccaaagtgctgggattacaagcgtgagccactgcggctggcaccagaagtttattgttatggaccaagagaggagtgataaaaaatcaaactgattaaacaattaacatttaaatttgttttcacttctggatatataccaccataaaaaatttaatttagataaactgaggtataccaggatgctgaaactgtccggaaacagtcacatatccaaaaaaatggagaagttttagtcttttttaagatgggaagatctgagacataatagctgtctttacacactgacgtcatgaggaaagccttttttttctagacttattctgagttgtaaaatgtgggaggcagaacttggatggtcaaccctctatatccatggattcaatgaactgagaatcaaaaatgtttgaaaaattgcttctgtactgaacctgtacagcctttttttccttgcttctcattattccctagacagtgcaatataaaaactttacaaagcatttacattgtataatattgggtgttataaggaatctagagatgatttcttagattgtcttgtgttttgtttgttttttgctataggatgaagaggaaacaaagaaagaggaatctcttaaatctcccttgaagccagagtcacagctagatcttcgggtacaggagttaataaagttgatctgtaatgttcaggccatggaagaaatgatgatggaaatgaagtataataccaagaaagccccacttggtaggacttcacattttcttctgcattctctccttataattcctagctcctttaatggatactttattatcattatgatttaaagcttgctcatagtactgaatgaagaaaatgggatttggggtgacaggttgtatggagggaagaggaactattttgaaagttgaggctgggtgtgatgggtcatgcctataatcccaacactttgggaggccaaggcaggtggattgcttgagcccaggagtttgaaaccagcctgggcaacatggtgagaccccatctctactaaaaatagaaaaattagccaggcatggtggtgtgtgcctgtgatctagctacttgcgaagctgaagtgggaggatcaccggagcccaggaggttgaactgcatttagctgtgtttgtgccacggcactcagcctgggcaacaggagtgagaccccatcttaaaaacaggaaaaaaaaaagttgaaagatgaaagtcttttttagggaaggatgttaagtacagttcactagatgggatcctagtttggagtctgatctctgggtgggcctgcagggaagctgacagtggcacaaatcaaggcaggttaccagtctcttaagaagattgaggattgtattcgggctggccagcatggacgagctctcatggaagcatgcaatgaattctacaccaggattccgcatgactttgggtaaggcctgtgctgttacttcactttgttcttctacctatacatatcccctgtatccatcagcagcagctataatcttttaaatcttttattcctaagaaaatgatcgtcttgaataggtacagaaacaaaatgatatataggtagcctatttaatcagcttacaaatatgggatgcaatctcccggcttgaccacagccatattctctgacaaagtggaagttaccaacccaagagagaatgggtctagctatccaaccacccaagtaaaacaccttcaggcatatcacccccttttcctatttgagtaactaaaaccacacaaacaccatttctgtgaactcaagtgatattagatagacaaaataacattttacatttgttgattctgttttctggtttacatccgatttctatttcttttatagctttatagagccccgtgacctagaaataaccctgagtggtcaacaggtctacctgtgcttctagatagaactgtatccaactgttccctgttgatatcaatataacttatttttaaatgattttataaaaaataattttaactctagtctcaaaagtcaaaatccacatagttcatcttataccgagtatatatttaatattattttatatatttggaagttaagatctctttacagatctctttctctctcaaatggaaaacctgtttctcatacctgttttctaaaggacctatctgtcattttctatttttagtcatgcgccttttagccacatgtcagaaagctcattatgggttatatctctgttcttagactccgtactcctccactaatccggacacagaaggaactgtcagaaaaaatacaattactagaggtgagatatgtatgatttgagaagtattatatcccttataccagtgtcctcccacattgattctatatctcatcttctcaggctttgggagacattgaaattgctattaagctggtgaaaacagagctacaaagcccagaacacccattggaccaacactatagaaacctacattgtgccttgcgcccccttgaccatgaaagttatgagttcaaagtaagaaaaatgatcatttattttcatattcttgcacccttaaccacctcccccatcccactgttctctaactacttcttgtcaagagcaaattgtcaattagggcagactttttatgtactagggatttgggaaggccaagcttttcctagctgccttgtaagactgtttgggagcagaaaggtctgccaagttatatcagaatccccaaattcttcagttcagctcagtctcttgtagagtctacatcagcctttttgtcttatttttcacaggtgatttcccagtacctacaatctacccatgctcccacacacagcgactataccatgaccttgctggatttgtttgaagtggagaaggatggtgagaaagaagccttcagagaggaccttcataacaggtctgagtctagctttgcgtttggaaagacactccttgcccgaaagtacagctgtagaacttataagagggagtcagaggaaggtgttggcttttttatgcttatggcctatctgtgcagaacaacagagtacaataatattggcttttccttaggatgcttctatggcatggttccaggatgagtaactgggtgggaatcttgagccatgggcttcgaattgccccacctgaagctcccatcacaggttacatggtgagtgaaattgaactctgggaggagcacaggggaaagggatacagtaatgttctcagtgctttttttcctagattaggattagatggttcccctccccaagagttaagccagctcactgataaccttgtcatctcttactgtgtccctctttctttaaattcctaaagatacctcacctttccctcagaaggcggaaattcacaggggcttctaccctctctagaacagaattgtgaggggaaatggagaagggtctatattgtgtttaagggaatggaaaaacagggtcagtggtatgcaccttctctctaacacagtgggttagaagctgaccttggtattcatgtatatatttcagtttgggaaaggaatctactttgctgacatgtcttccaagagtgccaattactgctttgcctctcgcctaaagaatacaggactgctgctcttatcagaggtgagacaggagtatgtctgtgatctctagtttattaattccagtttttttccgatgagaaaagtttgaccccagaaccaagaggtttacctgggatagcttgagagaggaccaagtacaatttctagtacattggattcctctgctggagtaggggaaaaaagtactgatgggattttctgtttggctttggagccatctaattcttagtaggatatgggaattcaaaggttttttgctttgcaggtagctctaggtcagtgtaatgaactactagaggccaatcctaaggccgaaggattgcttcaaggtaaacatagcaccaaggggctgggcaagatggctcccagttctgcccacttcgtcaccctgtaagtactcagaaccaggaggactagaagactccttttggccagataagactacgttctctattgcagcttctgaaccagagactgatgttgacacactttttttccatttggcaggaatgggagtacagtgccattaggaccagcaagtgacacaggaattctgaatccagatggttataccctcaactacaatgaatatattgtatataaccccaaccaggtccgtatgcggtaccttttaaaggttcagtttaatttccttcagctgtggtgaatgttgatattaaataaaccagagatctgatcttcaagcaagaaaataagcagtgttgtacttgtgaattttgtgatattttatgtaataaaaactgtacaggtcta

SEQ ID NO: 51 - DNA, 6586 bp, Homo Sapiens
gggcagcccggcgctagacccaacggggatccaagcagccccggggagagggaggctgcgtctgtatccgggcccaaggtcaccgcgcgaccggcagatgcgtgctgcaggccccggccacatgagcagcgctacggacgcgactgccccggccttggatatgccagatcgagtgtccacccgtccgtgggactggtcgcctgactcggcctgccccagcctctgcttcaccccactggtggccaaatagccgatgtctaatcccccacacaagctcatccccggcctctggcgattgttgggaattctctccctaattcacgcctgaggctcatggagagttgctagacctgggactgccctgggaggcgcacacaaccaggccgggtggcagccaggacctctcccatgtccctgcttttcttgggtgagtgtcctatggtcctgcccacggcagggcagggcaaggcctggtgggactggcctttgccctctatcagttcaaggccactgatccggagttctggctcctcagaactcttgagtccattgggaagggcttctacagctctgggttctaagctccgggaggataatctggccccaagaatcctgcccccaggatcctctgcccaccctcccccatagctcggtgactcggcccggcaaccatgccagggctgaactagctgacacagggggaggagccccgaagtggaagagagagagcctcctttcactttccctacccctcaggacacacaggtgagctgcagagggtagggagccaggcagaccctgttgaccagagtgggcagactggacagagtcctaaccttgcacttgggactggggaaaggggtgtttctgagtgacaaagagctgggtgtggtctggggctgggaatgccgtcagagtggacacaggatgcagtgggaggccaccgaagggccaacccggggtggggcaagttggtgctgtgctggcccagggcaggggtggggactgagagtgggtcgttggggatgaggagaccatggaggcctaagggcctctctgtgccccaggacagccatggctccaaagccgaagccctgggtacagactgagggccctgagaagaagaagggccggcaggcaggaagggaggaggaccccttccgctccaccgctgaggccctcaaggccatacccgcagagaagcgcataatccgcgtggatccaacatgtccactcagcagcaaccccgggacccaggtgagctgcagtccccagtcaggcccagagcctgcccactgataagcacaaacacacccaggccacccccttaggactctgttctggttttggagcccaaggcccccaggtaagcgccagagcaaggccatgttctcctgaccccagacatcagggctgtgtcccgtcaggtccaggcgggtcacatctgcccttcagaccccatgcaggcctcctcccaccgcacttagggaaaggctgtgactacatcagtctcctgggcgcttgcccatgtcccctcagggcagagccatgtccctctcagattcccccatccagggcccagctgtgtcccccccagcaccccccatacctccatgtcagggtttagccatgtcctctcacaccgcatcccctagggaagagcagtgacccccccaagcttccaagacagggtccctctgactcccactgccgtcagactcctgtccccatcagagccctctcggtgtacggccaggcaccccatctgaccccagccagcctgccccccacctcccctctggcccaggtgtatgaggactacaactgcaccctgaaccagaccaacatcgagaacaacaacaacaagttctacatcatccagctgctccaagacagcaaccgcttcttcacctgctggaaccgctggggccgtgtggtgagtgccctgcctgctctgcacatactccccagggtcctcaaaaggccacagctactgacttgggggggcacctcccaactgtcccagggcactcagcacagggcctggcccgacacacaggccagcaaatgctgatggtgggcatacccctgaaggctgtcggttgcagggagaggtcggccagtcaaagatcaaccacttcacaaggctagaagatgcaaagaaggactttgagaagaaatttcgggaaaagaccaagaacaactgggcagagcgggaccactttgtgtctcacccgggcaagtacacacttatcgaagtacaggcagaggatgaggcccaggaagctgtggtgaaggtgagatggccaaggaaggtgggcaggccctggactgagggaggggactcgttggagagttcccgctggttgggctctgccactgcccagctgcgcagcctcagccacagaactcccctctggcctcaggctggctggtctctgtctggtgtcacgccctgccccgctgctcctgcccacatgtgccctctatcttcaggtggacagaggcccagtgaggactgtgactaagcgggtgcagccctgctccctggacccagccacgcagaagctcatcactaacatcttcagcaaggagatgttcaagaacaccatggccctcatggacctgggtgaggggtgagaggcaggcagggtggcaggggcctcagggtggcagggctgtggggctgagtctccccactcccctgtccccctagatgtgaagaagatgcccctgggaaagctgagcaagcaacagattgcacggggtttcgaggccttggaggcgctggaggaggccctgaaaggccccacggatggtggccaaagcctggaggagctgtcctcacacttttacaccgtcatcccgcacaacttcggccacagccagcccccgcccatcaattcccctgagcttctgcaggccaagaaggacatgctgctggtgagggctggcaggggtgcgggcaggcagtggggcactgaacagacagcctaggcgagcgagatgaagggcaggtggccaagaaggcccagaaggatggactgcctgggcaggctgacagacgggtggggaaggctgggcagacagatagggtggggagggacaggtgggacacacaggtggggtggctacaataccagtcatgtgagagaggagaggggaggccagaggtcaagtgggaagacaaactgccagggcccatcatcctaggtgctggcggacatcgagctggcccaggccctgcaggcagtctctgagcaggagaagacggtggaggaggtgccacaccccctggaccgagactaccagcttctcaagtgccagctgcagctgctagactctggagcacctgagtacaaggtgagttgggccccacagaggggccaggctatcagtgggcactgtccctctgcccacctgccctcgaggtgcccagaggaatactcgccctcagccttctcttcctgtgtctccagggcctgaggagggcttgggactgggggaagaaaaatgggggattagctcctgagcctcccaccctggcaaccagcttctgctctccccacaggtgatacagacctacttagaacagactggcagcaaccacaggtgccctacacttcaacacatctggaaagtaaaccaagaaggggaggtgagggaggttcccccacctctcccccatcaccactgtgccttaggaagatgtccttggctaatcggtcccttagcaaatcgtttagcagctctggtcagtttctgccggccatgagtgcgcgtgagtaagcagagggacactaggccttggtcacaagcagcagggcaaggcgactgagtgctcgggtggcatcactcccatttctcacttcctctccactcaggaagacagattccaggcccactccaaactgggtaatcggaagctgctgtggcatggcaccaacatggccgtggtggccgccatcctcactagtgggctccgcatcatgccacattctggtgggcgtgttggcaagggcatctactttgcctcagagaacagcaagtcagctggatatggtgaggtgcccctctgggccaagccctgggagggttggcactaagatggattgggcccagtccttggccactggaaattcatggtgaatccaagagaggaatcctttaatggttaatgactacagtgctcagtgggctgtcctgggctttggtggcggggggtcttagagaaagtgtctgatggtcagggatggcttcctgggggaggcaatacagataggatgggtgcaccaaccagacctgggagggggtaaaaggggagcctttgagccaggtgtggtggcatacacctgtagttccatctactctggaggctgaggcaggaggaacgcttgagcccacaagtttaaggctgccatgagctatgatcacactccagcctgtgtgacagagccagactccatctgaaaaaataaaaataaaaaagaggagacgtcaaggcaaggggataggcagagaggctgggaggatgtgaggatgtggcaggtcagggcttccaaacacttcctgatactggagctcagagcaatgcctagccgggggcagggtgggctaggggcccagaacgatcgaggaggctttatccagagagtgatggttagcccagctggacttgtctgtagcaggatcccagtggctacagctgtggagaggggggcagcagccagaggctgcagagaggccatcctcttatccaggctggatgtgatgggtgcctggcccaagggctgggaagtgcaggggagggagcccatgagaggggcatgtaggagatgggatggggagcgtgtgggaaagggtcaaggctgtctccagtgacttctgagtttctggccaggagtgtcctcaccaaaatgacccccccagaccagctcctccacccaggctgtccccatcattggaggccaccacccagctggccaagagagcaaggaccaaggattcatcccagaacagatggggctgaagttctaggatgcctgaggtcaccaagagcaaggggtccaccaggagggcagaggggcttaggaaagagtggcggggtggagggcttaggagagccagcgcgaggaagtcccaggtaggggctgatgatgtcaggagcaaagtcagcagagcaggccagggagaaaagcccctgccacgggtttggtcactgggaggccattgctgaccttggtgaggacagcagagggtacagatgcctggccatagggagcacagtgaggtgggagggagcaggccgggacaaggagggagtgacggttgggggagagtgagccttttcttgctggagcagcaaagccagaaggaataacatcgcagcagagaggggccccacaggtcagcaggaggcaggctgagctgcccaccggtgcctccctgtgtcttgcagttattggcatgaagtgtggggcccaccatgtcggctacatgttcctgggtgaggtggccctgggcagagagcaccatatcaacacggacaaccccagcttgaagagcccacctcctggcttcgacagtgtcattgcccgaggccacaccgagcctggtgagtcctcagaagctgtacagcccaaggagagaggtggggccgagataggggctgggacattttcagggagggggctgtgaagagggacaaaaagaagcttccctgtcgtcactcagtttgtcatttgacaaacatccactggttcaacacatcattcctgggcatcccggagggcttcaaaaagaggagttgttgactgagcattgaaggattagtacaagtttcccagagagaagtcggggaggacaccccaggcagaagccccagcccctgcagtggtttggaggtgggcaaggtggaaatgagcaggcgtgccctgtgacagacatggagagcatagggggcaggacttactcgtaaggcctgggaccagtgacccctgggccaccctggcccttgctgtgccctgcagatccgacccaggacactgagttggagctggatggccagcaagtggtggtgccccagggccagcctgtgccctgcccagagttcagcagctccacattctcccagagcgagtacctcatctaccaggagagccagtgtcgcctgcgctacctgctggaggtccacctctgagtgcccgccctgtcccccggggtcctgcaaggctggactgtgatcttcaatcatcctgcccatctctggtacccctatatcactcctttttttcaagaatacaatacgttgttgttaactatagtcaccatgctgtacaagatccctgaacttatgcctcctaactgaaattttgtattctttgacacatctgcccagtccctctcctcccagcccatggtaaccagcatttgactctttacttgtataagggcagcttttataggttccacatgtaagtgagatcatgcagtgtttgtctttctgtgcctggcttatttcactcagcataatgtgcaccgggttcacccatgttttcataaatgacaagatttcctccttttttaa

SEQ ID NO: 52 - DNA, 5444 bp, Homo Sapiens
aaactgttaaaaatgtttttattttttagtaagcaaaattttacgaaaagtcagattcacccgtggagccagaaccttctttctcacgggaagactgtggtaccagtgcgtgttggtcgggtggttcatcattagtaagctcccgtgggccagcggcagcctgaccaccgccaccctcctggaggggcttttcccacgggaatccttatgccggaagacaaagtctctgcaggcaccgaaggagacagaggcaatggggctcccaggggccagttctctttcatcatctcggtgctccccgatgtggtcacagccatctttatacctgcaatgagaaaacaaacacagtgcataaaaacaaccctctcctgaaactcaccagcaccgccagccctcgttttcctcacagtgtgaaacagcactctgcatggctgtacctgccgttgtttctgcgagggcttgaggtccacagtgggctctaagataagccaacgctgaagaggtctgttgacgtatttgttcatgtgacttatttattattatttttgagagggtctcgctctgtcacccaggctgaagtgcagtggcacaatcatagctcactgcagcctcggcctcctgggctcaagtgattctcccacttcagcctcccaagtagctgggactataggtatgcaccaccccacctagctaatttcttttcttttgcagaaacagtttcaccatgttacccaggctggtctcaaactcgggctcaagcaattcactctccttggcctcccaaagtgttgggattacaggcatgagtcaccacgtccggccagttcatgtgctttaaaactgaagacacccaaagccaaaatcacgtcttactgtagttcccctggccagtctatgtaaacctttatcacatgattttgccctgcactcaaaggccatactctgcatagcccggcccctgcccactgctgagctcatgccatccccttctttccctcattcactgctttccggccatcctgcagcatttttgcttcacagacactccagagtccctctgctctccctccagatgtctgtggctggcactctccatttagttatcagctcaaacgcactgcctcagccctcctctaaccaccccatctgaagtgaccttcccttaaacccacccagggttctccaccagggtgattctgccccaggggacaggtattggggggtgggggacactacttgcaatctagtggatggaggccagggatctgctcaacatcctgcaaggcacaggtcagccccaacaacaacgaatgactgggcccaaaatgtctgcagtgctgccgttgagaaaccttgccctaatcgcaaacctctcagccattctcagtcaaatcggcctgtttaattttttgcaagatggttatcactgtctgaaatcgtctagggtcaggcatagtcgttcacgcctgtaatcccagcactttgggaggctgaggtgggaggatcgcttgagcctagcagtttgagaccaagcctgggcaacatagaaaaaccctgtctcaaaaaaaaaaaagaaagaaaaagagaagaagaaattatctcattcagctgtttgttcaggagttaatcacctctcacttcctactccgggatgagctccaggatccaggaagaccgagtgctggcgctattccactcttagagccccagtgtactaagaaatgatttgtaccaatgaaccaaatagggtggaaccctaaacacttccttttggaggagacagaagacttgtaacattgagtccactaaacagggtgtcacctgttgatgagcacaaagttgaaggtctgtccagtcaccccagagacgtgatcccggatgcgctctagaactgggatccagggctttggagacagcgtgaggcctgaaaatgtgtaggtcagcccagcgtcgccatacgttgcctgcttcctgggcacactgtgccacttcccgaatacctggactctggccagtgctcctgtgcagaggaaacatggcagttcctttctacctgacccccatctagaaatccagatgccccccccaacccgcactgccatcaccagaaatccagtgccccacatacatgctccctgggtattcaagattgaaagggaagtaaggaataacatttccccgtcattccatgcaatttaaacccctcttcaatcatcattttggcttgccccaaattttctttttgttttgttttctttgagacagggtctccctgtgtcacccaggctggagtacagtagcacaatctcagcgcacttcaacctccacctcccgtgctccagcaatcctcccgcatcagcctcctgaatagctgggaccacaggggcgtgccaccatgcctggctaacttttttgtaagctcactgcaacctccacctccagggctccagcagccctcctgcctcagcctcctgagtagctgggaccacaggggcatgccaccatgcccggctaactttttttgtatttttttgtaagacacagggttttatcatgttgcctagactggtcttgaactcctgggctcaagtggtccgcccacctcagtctcccaaagtctgggattataggtgtgcaccactgcaccaagccaactgccccaaatgttcatgtaagaacagtgactcttgttctacaaggagagaaacatggtcctgggccatttttttagtgaacactgtaacttaactgccttaactacagtaagggcagaataaagaggctgaaattggaacacgataaagttagtttacaggctaggatagcttgtcaactgtagggactaagggcatgtgaccccatgaaagatggggctcacactgctggggtctcttgtgggcatttctttttttaaagagatggtgagccaggcgcgctggctcatgcttgcaatcccagcactttgggaggccaaggcgaggatcactcaaggccaggagttcaattaacagcctgggtaacacagtgagacctacagataatttaaaaattatccaggcttggtggtgtacatctgtggtcccagttacttaggatgctgaggtgggagaatcacttgagcccaggcggacgaggctgcagtgagccaagatcgtgcccctgccctccagcctaggtgacagagcgagaccctgtctcaaagcataaaagaataaagtgacgagggggtctcactatgttgcccaggctggacttgaactcctggcctcaagtgatcctcctgcctcagcctccagagtagctgggattacaggtgtgtaccaccgtgcctggcctgtgggctttcgttttttgttttgttttgttttgagacacagtctcactctgttgcccaggctggagtgcagtggtgcgatctcggctcactgcaacctctgcctcccggtttcaagtgattgtcctgcctcagcctctcaagtagctgggactacaggcatgcaccactacgcacagctcattttttgttgttgttgttgtattttagtagagatagggtttcaccatattggccaagctggtctcgaactcctgacctcaagtgattcgcccgtctcgggctcccaaagtgctgggattacaggcgcgagccaccacgcctagcttcctgtgggcttttctatgcctctctgccagatccttgtgtcctcattacaggatagaggtgtggttctcaacatgtgctccccagaccagcagcacctggactctccttagaaactaaactaaaccacaggggtagggtccagcaatccaagtcctgccaacagcaagtccaccaggtgatgctgagaaccactggtgtggagaaattacctggttatttgccatctctcctatgagaccagtgattctcaaaccctgactgcccatgagaatcacctggaagctttttaaacaaacaagtggtcagcctgcactcggagcgattctgattgaagtgctctgcagtagaacccagcacgtttttttactttgttttgtaaactttcccagaagatactcatcagtagccaaggagagattcactcgagtcatctgtcagctcctagtagacaggcaatccagtttctttcaagtttatgtcccaagcacctaaggggcttagcccagaggtgctcagagaatattggatgaatccattagtgaacccatcagtaaataatggatcctgagttcagatttctccaaacatacgatcattaattgcaccaaacaagccctcaatgcacacacacacacacacacacccctctgcttacctgtaaaatattctacttctttctccaactcttggaaaatctcatctgcctcagctttgccaaacaggactgtgtaactgcagtccaggccctcagcccgaatgtgccgccagctagggcctgctgagtggcctccattccctggggcctctctcctgggcctcttccttgtgctttctttgtctcctcccaacacagctggctcttctccagttggctcttgctcctcctgcttcctcaaaaggcccccttgagcccctttcaccaggaatctgtccatcctgtccccacaggaaagaagggacgtcagtggcgaggccaagacagaaattgctcaagttctatccccagtgcaaaaatctgtttgtccaaggggtctcacagcaacattcctagtttcacattttcattttaaagtttaaaaccatgtcctagaaaggaaacagaagatgttaaagccggaagggaccctagggacaatctgatccagggtctcccacgtccacctgtgcatcagaatcagctggctagcttgcaaaaacccagaggtctgcactccacgcctgagcacctgaatttttaaagaactacctcctgggaattcgcacgccacagctaaacttagaaactacaatccaaaccctcattttgcagaaggggaaactgttgcccacagaggcgaagaggtttgcccaaagtcaactgtccacccctttaaggaggaaggacccataactgacctcgctgccccccaccagtgttaaaatagatcagtctagtgatgctcaagtggatacgattcagaagcgagacgcaaagaggttaaacacgggtaaaccgcacgcaaaattctgatatcactgcaacacgtccgtggggtgggggtggcaagagtgctctagcatcgcagctccggcgcagatcggaatcccgcagtcaccctggtggcctcgtggtgggaaagacgcgccccagcgaatcggtcgcgtcacttccggagcacgctgggaactacggcaggctagggcgcaaagagagcagccgggcggccccctggtgccacctgctggcctcccgtgtgtggcaagcactgccgctttcccgttgatcacctgttgggccact

SEQ ID NO: 53 - DNA, 39469 bp, Homo Sapiens
gggagttgctggagtcggtgcttcactcttaaggttccgatcacagactgcggagtgggtcaggggctgcgagggctgccccaagtcctaccgggtttgcacgggcgcgcccggctccgcccgcaagtgcgccttcctgacttactgctgggtgcgcggggctgggggtgcgagtaccacccctgaagtctcttcctgggcgacctccggggcctcattctaggcctccttaaagagaaggatctaaattaggaaaaggaagtgcccttatccacgaccaagctcttccacctgcggagctcgcttagtctgcacctcaaccgtgcggaaagtgactgccctgtttactgaggaaaaactggggctcagaaaggtgaagtcatttgccatgggccatgcagctgggaagtgacagatctggattcaaagcgagttctggctggcgccagagtccttgtattttacagcactggttctcaagctttatgtgcattaagaattcctgggttgagggtggcgttagttaacaaattctgggactctacaaattgagtagatctgggatggggctctggaatctattttcaacaattgttccctggcaaataacatatggctccccagtgaatggagcaagaaggtgagcaagtcgtatcctctgcggggactgtaggtaattgtgttacgcttttagggcctcaattgagagaacatgtcaaacgggagctcctgggattggagaattggtatttgattgtcattaactcttctgggcagatggcagcctctgcgtctctccacctattaaatgaaatgaattacatgcttatcatctgggggaacttgttaaacacacagattcctgggcctggctcagctctactgaatcagaagaggtgggagatgggacctgggaatctatagtctaagcaagctattaatataaaacgagcttttacctttgagaacttgaggtgtgaagctttcttaggtagaagcataaagaaatagattacagatgtggaacatgtggcttgaatttccttgttgttttggtagctgtacgtgcttctgcatttgctgtaggctaagcttttactggtacaactgtcaaattagtattattagccattatgaggtggatttatccgttagctggagacaggagtttaatataagttgaatgttaatctgtctgttgttgatttcctgagtggctttgggtgcatcattgaactttaccgtccacatacatacctgcattgtgtcaaatcttacactgcttgttataaagacaaatacctgtatccatcctaaatcagattttctgaaggtgggccataggtattttgaacaaacttccagggaagtttgatgcagccagtgataatggaatatatgcttggaaacagtcttagccgatttctcaatgtccatgtaggtgaaaatgggaatagtacagtttccttatattctactcttggggactattaagaggaatgtggtttataataggtcctaattttagaatttcttaaaatgcactttcttgtgaaagaaacaaaagtactatggtaagattacaaaaggtgaatgctaaagccagcagccccaaatgactaggcttcttgaatgaaatgttgtgatgacataaactgattttacatggaagctctattgccattgagagtcttctgcctgaaattaattatgccttaggagtaattgttcacaatcctaactaaaagcactgttttgttttgttttaataaacagataccatggagtagtttgaaacaggaacaaaatcttctgaaagctcggagcagaagcctttttggtcaacatggaggaaaaaagacggcgagcccgagttcagggagcctgggctgcccctgttaaaagccaggccattgctcagccaggcaagaatctgtagggattttgtgtgtgtgtggatatggacaactctcattctcttttatttatatccttttggtttataatggacttccatttcaattgacgtcaaggaattgtttaaaatgtggctgatattttgtccgattttgttgatggtgagctaagggtgggtctttaatgttcctcatatttagtccacaccctcaaacctttcagtatcttctgttgactttaccagttagtttctacatgtcatagagatcatctccaagtgggctttattggcccttgctcagtagaaggtgctgagaacagactttcccctggtttgaggctgtcccctctcttgcttcagctaccactgctaagagccatctccaccagaagcctggccagacctggaagaacaaagagcatcatctctctgacagagagtttgtgttcaaagaacctcagcaggtaaattcatggttttttcttcaatagtgataaaaatttgcttagaaaagtgatattcacacagtagacactcaaataaataatgactgaataaattcactaatagcagagcagaagaactataataataatgaaatgagaaatatttcagttcctttctatgtctggggattcttcgtagtctgctcccagtttatggtcacatgttattcccgtatttttggcaaggaggttacaccataatgagagcttgcttgcattggttatttgagctccagcagtcctaaaactgtgctgtcttcagtgctattgcacttcaccatctttggaattggattaaaatttcagtttttacaataaaatgcctgatttttagcccttttttcccatgaggaaaaatgtaggaaacagtgaagatttactttttaataatgtggaaaagttaaaaagttgggtttcttgccatagtaacaaccctataaataattattaaaactccttattttatagcatattttctattttaaaaaatcttgtcaagatttttccagagctgctggctgctaggaaaatttattctattaataattgtatcttcttttactgtctactagcaaatgtgaagtagttttaagaagagtggagacaagggtctctagtgggttagtgagaagttggaatagaaaagagatagtttttaactttattttgaccagaaatgggaagatatggtaagtcagtatccttgaggattaagaacatcccagaagtaagatccgcctatttccttgcaggtagtacgtagagctcctgagccacgagtgattgagtaagtaatttgctgtcttcctgtaattgttgcccacagtgaaatgaagagcctggaatctttcctcactgttttttctatctggaagagaatggcccaataagtgtcttaactgtagtctgggatattcccatctcaaatgtctttaaacttgatcttttgagaagactttctgaatttgctgatagtattgaaaatgcaacaagatatccatatgttaaactttgacttgtgtagatttcctggccctatttcaccgatatctgtagacagtaagctaaacctctcaggcaaagacagagagggatttttcctgagtcattgaagcatggttctttgagaagccattaattgcctcttttttttttttttttttttactagcaatgctatgaaagctgctagtgctgtagatgagcttacagtccatttattaaaaccatgtaattattccagaacaatttaaatgatagtaaacattcttcttatattgatctgtgtctaaaatgttcttgtccaaagttggtgagagatgctttgactcctctttttatgcttgtcagttttcatctgatgtagataaattgtcagtagaaactattcttttatcttagcaaattagcatcagatatatgttcttgcccatgatcaatctgtttgttatgctgtttgactgcttgcagattggcttgtatatcttagaaaaagtcgcaggctaatagtctttggttgtttattattttttatttttttggaacaggctgtcactctgtcactcaggctggagtgcagtggcataatcaaaactcactgtagcctccatcttctgggctcaagtgatcctcccacctcagcctcccgagtagctgggaccacaggcacacaccaccatgccttgctccttttttaaaaaattttttgtagagatgggatctccctatgttgcctgggctggtttcgaattcctgggctgaaatgatcctcccacctcagcctcccaaagtgctgatattacagggatgagctaccatgccaggcctttggttgttttaaaaaaacaagtgtgttagtgccttcattggtgaaggagaataaacaaaaccatgaaacatgttgtaagctacagatgtgacattcggccccccagaaacaggcaattgtcggagaaaaatgacagaactcattcctacttggtcctagaatctgttaattctcattatctaaagttaactatgctaggttttaaaaaaatagccggaaatgtcttccatatttaaagtgagccatttctgaatgtgggccaaaaatacaccatattgaaacattttgttctctgtatactcagggaaacattatagacgatgcatgtagtaaatatgtgtgacagctatgcctgctatgcctacattttggctgaaaggcactcatacatctacttaaaagcctagctcagagatcatgaaccactaactcccatgacagaaggtgatgtgaaaactgccccttcgtgttctctataacgtgtctctctctgagaaggatctgacacaattgtcttgatagatatacctatccagtctgtgtcacttttctcattatgggcctcaccacctggcagttctgcaacagctttatacatttccacatttgattaaatttagtaaacctttattgcccatctgctatgtgcagacactgggaagcaataatctacctattccttgcacctcaggaccccacagtctataaaataaaatagacatttaatcagataaattgtaatcttgtacatcatgaaaaaatagactgtaaggtctagtggtaacacagaggatgagaggttaatattatttgcctggattaaaggtcaggaaaagtttaaaggcggtgatgctgaagctaggatttttgaaaggtgaatgagagttttccactggaccaaagctggaggtggattggattggggatgccgggtgatggggtggcatttcagcatggaaaagcatggagttagaaacgtagtggtgtattcaggagattccaagcagttgattgctgctggaggatgatgagtttatgggagctgtcagaagatagagctacattatgaggaccttgaatgcagttttggggtgccattgaaggattttaatcagaagaggaacctcatcagatgtgtatctctgaaagcaacagaagcccagagccctgagatgtgcttgctgcctgttaaatgtatcccctattccacattctccagaggagtgctctatttgaaacctctttgtgcaatagattcctggaccatatctgcctcaattatgggtaaaatataaaggagtagaatcagaattgattttatcccagtttttgtctccatggcctgatactgtcacagttccattccagtgccattaatgatataccatgatcttctcagtggtagaagaaggtggggattatgcctctctcataactaaatgactttggtgagccaggactttggcagttcagaaggataactcttccactgggtatagcatattgttttgcctcaaactaacaagtctgtttcctttgtttctttagcagagagggtgtgtatgaaatcagcctgtcacccacaggtgtatctaggtaagcaaatcctcacaagaagtgaccgtaattatcactgagttatagtctcttaaaatagtttactcccctagagaaagaaaatgtagtacatatacattatggaatactatgcagccattaaaaggaatgaaagcatgtcctttgcgggaacatggatggaactagagatctttatcatcagcaaactaacgtgggaacagaaaaccaaatactgcatgttctcacttgtaagtgggagccgaatgatgagaacacagggacacacagaagggaacaatagacactggggcttgtcggtgggtggagggtgggaggagggagaggaacaggaaaaataactaatgggcactagacttaacacctgggtgatgaaataatctgtataacaaacccctatgacaaaagcgtacctatataacaaacctgcatatgtaccccaaacttaaagtttaaaaaagtctactcccttatttcaaataggtaacttctgccccttaaattcttggggagcaaaaatttgataatatctcctttttattagtatttctagcatcaaaatattttcaggtatagttcctaacctttctgtcagatatagtagctgctatttcccaagttttttagatgaggaaatgagacctaggaagattgaatatttttttctttttgagacagagttttgcttttgttgcccaggctggagtgcaatggtgctatcttggctcactgtaacctctacctcctgggttcaagagattctcctgcctcagcctcccaagtagctgggattacaggcatgtgccaccaagcctggctacttttttcgtatttttaatagagatggggtttcatcatgttggtcaggctggtctcgaactcctgacctcaggtgatccacctgccccaccttagcctctcaaagtgctgggattacaggtgtgagccaccacgtctggcctgaatattttttcttagtgccacataataacttgacattagaattgcgcctagcctggacttctgtgctgtgagtgctacattatattattatacttcatgtatattacatattgtagattattgtgtataatgttacaaattgctacactagggtaaatttctttttttgtttttttttgttttgtgttttgagacagagtctcactctgtcactcaagctggagtgcagtggcgtgatctccactcactgcaagctccgcctccagggttcacgccattcttctgcctcagcctcccgagtagctgggactacaggcacgtgccaccatgcccagctaatttttttttttttttgtatttttagtagagacgaggtttcaccgtgttattcagcatggtctcgatctcttgacctcgtgatccacctgccttggcctcccaaagtgctgggattacaggcatgagccactgcgcctggcagtctttctgtttttgagacagggtctggctctgtcacctaggctggggtgcagtggcacgatctcagctcattgcaacttctgcctcctgggctcaagccaccctcccacttcagcctccgagtagctgggattacaggtgtgcgccaccacacctggctaattttgtatttttgtttgtttgtttgttagtgatggggtttcgccatgttgcccaggctggccttgaactcctgggctcaagtgatctgcccgccttggcctcccaaagtgctgggattacaggcgtaagccaccatacgtggcctaggatagatttcagtagttaaagcatatactatttagggtatattaggcattagtcattgttttaaaaacatttaaaaacattgaaacattaacatcgccttaatgcatgagtatactaattgtcactataaaataatgagacatttaaaacaaatagaacttacacatctagatgaatttcttcagaggagcttctgctggaacaatggctctgccatggttataaccttttttggaactgttattttaaagcaagtcactcaagaaaaccagttttattgttttggtcatatctcattgttaactagatacggcttcaggtaagctttggctctttcacaaaatcagatgcaccttcaaagagtgaagatttgctaccaaggcagtttaagagaatcttccgtgggctttcagaaggtatcttaagaaagatatccaaaattattttgagctgcgttggcattgttgaaataaacacatattcagtgggagaaagaaccctcattagctgtgtttattttgatacagtcataatgagctgtagcttttcctagaattagcatagtctcagaagactaccaattgtttaaataaaacagggccaggcattttattagttattcttttttttttcttttttcgagatggagttttgctgttgtagcccaggctagagtgcaatggtgtcatctcagctcactgcaacctccacccccgggttcaagcgattctcctgccttagcctcccaagtagttggaactacaggcatgcgccaccacgcccagctgattttgtatttttggtagacggggtttcaccatgttggtcaggctggtctcgaactcctgacctcaggtgatccacccgcttgagcctcccaaagtgctgggattacaggcttgagccactgtgcctggacttattattctatttactcttcacagtgaatctatgaggttgatgtcatctcaggttacagatgagaaaaccaaagttcagagaggttcagtaacttgcccagggtttcacagctaagcagtactgaaatactgtttgaattatgatctataaaagccctcacctatcatccctttatccttcattgcctcttttatttgtcccaacatgaaaggagtttattttatatctggagcctcatgacctgggtgatgttaggctctgcttgctgtgggagctgtggtaagatgatttcatgtacccattagaggctgcatccagattaactgtttccactaacatttagagtctaacttatcttttccatgttttttggttaacaatgttcattctgcacccagggtctgtttgtatcctggctttgttgacgtgaaagaagctgactggatattggaacagctttgtcaagatgttccctggaaacagaggactggcatcagagagggtaagtagatcccagaggtcacagttggtgctgcgtgttctccctctctggaatgtttcctagtaccatcacttctgctcaccaaagctagtcttaaacagaaattcaaaacctgagatcctaagaaagtagaattagccaaaaaggacagggaagagtattccaggcaggagaaacagcaggtggaaggcccagagatcagagagaacatggcaggaggatagaggtgagagttcaaggaaccaaaggaaatttggttggctgaactatggctgacatacttatctccttttgtgtttgttcactgacttgcttcaaatggtgccaactttttcctttcttcatagaaaattacagagctttctttttttcttatcctattttgcatacattctttcacactccttgctgactttgtattcttctttaacttttgccagaagagtccagtctcctctagcttcagcatctgtactctcctgagcttgtaaaagtgacacggcagtttgttacctgagttggaacctgaatctctgcgggcatccacaagccaacagtgcctgttataccacaggcggtcacttgggggcgtctgtactctagcatcgaatttttttctggcacattgagtgaatttaaattttctgtaaagaggcaaagtatatatagttgtccctcagtatccacaggggattgttccctgtggatactgaaattcatgtatgctcaaatcctttcataaaaactatcatagtggctgggcgtggtggcttacgcctgtaatcccagcactttgggaggccgaggcaggtggatcatgaggtcaggagatcgagaccatcctggctaacatgatgaaaccccatctctactaacaatacaaaaattagccaggcatggtggtgcgcacctgtagtcccagctactcgggaggctgaggcaggagaattgcttgaatccgggaggcagaggttgcagtgagccgagatcgcgccactgcactccagcctggtaatagagtgagactccgtctcaaaaaaaaataaaataactatcatagtatgtgcatataacctatgcacatcctctagtatcctttaaatcatctctagatcacttataatacctaatacgatgtaagtgctatgtaaatagttgttatactgttttttattgtggtattgttatttgtaatttttatatattttttgagtatttttgatccatggtttgagtatttttgatccatggtggatgtggaacccacagatatgaaagaccaactgtactggcttcatttttgttactcatgcatcagaataggagtcagctttctctcagccttcaggacagccttctctcaactcccacagtttctgcagcagggcttttggtgacagacatggctttgattgttggctctttcattcaaagtagttgttaattttaagcaaattacagttaagtaactctctgatccctggttttcttatcagtaaaattaaattaataacaatgtctttcttataaggtggttgtgttaatacaatgagataacgcatgagattgcctggtacatagtaagccttcagtgagtattagctgctgctattattattattattattgttcttattgttgtggctgataccagttatgggaaaaagagtagatctatggataactgcttctctaaattggaacatcaaagccttctgatgaaaatcagctgcatgccacagttggtcagggcactttttcctcccttgaatcaaaaaggtttacacaacattgcacacatgaatgagcagtttgtcttgtttctcacatggatgttggtgccacaaatttctgcagacaggggttcagtctccatattctgctttttgagaccgtccctagtctgagccccactgttccccagtgtgactctttgccctctcttgtttatgtcatcactaatacaagcaagtcacccacattctcatctcagagcctttgcccatgtggtgtctgccaacatagtggtttctcttgtccattctacttgcaaagtcccatatcttctgtgaaggtggaactttgggtcacagcccattcttacttttcttttgtatttctcatagcacattgcaaggcacaaagttggcactcagtagtaacaccttaaatagcattaaaccatttcaaaggcctgtattttctttcttagatataacttatcagcaaccaagacttacagcatggtatggagaacttccttacacttattcaagaatcactatggaaccaaatcctcacgtatgtcaacatattgtcattggtatggttttatagactatatactatgtgttgagtgctataaaataacaacaaattaccttgcagagattcatgctggttcctagttcaaaaaacctctctgggttgaaacattgagtctttgtgcttgtcatccttcatgtgctagaggatgagaaaaaactagaactagagtaaactgaaccagagtctagcatttcaggaaaatgaactatttcttctcctaatatccctctttcccaagcttttctagctgtattccttctgtgtacaccctggtatgcatttgctgtggggctgagtccttatgactgacgagtgaggtcaatatgcctttttctgtttctcaggctcttttgctatttgtgaaaaaaaatctgatgtttttcttgttaactttgtatttattctatggctgcagttctcagacttccgtctgattttgctttggcttgtttctgctgctgcttttgcttttaaaaaatttccatgaaagtagatgaagatattctagtatataaattaagctcatccaggggatagagttaaggtccaagaaatagctccctgtttagttcctggaatcttgcctttggcaaataatgttatgttttattgaaagagactttgaagaaaatggagttttgcttatggcattgggatacacagaaatgtgacacatttcagagcttctagaaatttgtaattgcaagctaccactttactaaaatttcagggagaaaacattgactgagggaacatggccttttcacgtaaggagatagctgcatgctttggtttcaagggctgcatttagaatgtgagccagggaagtgccgagaccctttatatctgaggttgattttgaaacgtggagataatagaattaggccagtccaacatagcctgctttccttgtttctgtcagagttaatttatcttcttgtcagtagtcatagcagagaatttgaggattaaatgggctgtggggaagttctttctcattcattctagttaatcttttaaaacaagatttctcaacctcagtagtattgccattttgggctggataattctttcttgtgggtctatcccttgcattgtaggatgtttaccagtatgcatgacctccacctgttagatgtcagtggcacccctcacccagctgtgacaaccaaaaccaactcaagacattgttaaacatctgggggggcaaaattgcccctggttaagaaccagtgggaataaacacaggatctgctgagtaaagtagcctcttattgtccgacattttgggaacattttgacaactcttcaaaataatttatgacaatccttttttttaaatgttggtagtatgtgcttattgaaaatttagaaactgcacataaacaggaagaatattaaaattcttgataattctaccccatgttttggttccaatcttgttattttagacaaatatacctagagaatctttttttctgtaacaataaaatagtccaggtgtggtggctcatgtctataatcccaacactttgggaggtcaaggtggaaggattgcttgaggccaggagttcataaccagcctggacaacataatgtggtcaaattagaattctttaattcagatttggctggctcataactttgcctttattggtgatatatttagttcatttatatactgtcttgaacaaaaaagagctaccctttctcagatttttatttatgttcattttaaatttagatatagggtcttgttatgttgcccaggctggtgttgaacacctgggctcaagtgctcctcctgcctcagcttcctttaatagttgtgattatcggccacaccccgacctctcagaattttttaaaggtggattcactaatgtatgtatatatatgttgggagtacttgtttagtttaaaaattgtcattacctgaagcttaatatcccgtacaaaataagcaatttcagtcatgggtttttaaacttgttttagtttttgttcaaactaaatctcacatgagcccagtgtataaaacagatcagagccttgactggctgggagtcccaccaacttgacctctcctttcttctcctgtagacccagaggtacctctgaggtacctagaactctatacaacactgtttgaaatccactgaataggtcctttcacttctgtgattcatattttttgtattcttttcctaaaatgtcttttaaggataaaatgtcttcactgaacagtgagataatgctgaattttaatttagacattcagttctgaggcatctgaatatagagtattggttggagagtctaaattaatcctctagttcattatccccttttttcttccttttctcactgtttcagtaccaaaaataacccagaaaaaaaatacctacttagaaacataacacaaactttatgctatctcagtattcagtccctgagcaagtcagggaagtgctaattagattcccagtaacattggagaaaaaagcccatcttcctcctttacattcttgtttttcttgttaagcgtgtaattctagcatctgatctttatcgctatgaagataaatttaaagctgtaaagtaaataggaaatacagcctgctgacattattattggaatttcactttggaatttattctcttgaacaaaggtttatttaatatttttgttttatgagtgtggatctcatgttatgtgtttttctaccacaataaaaaaggagaacaagagataaagaaacttccaacttctggaggcttcttgagtctccccaggtgtcccattagccaactatttgttgtttttgctgtttattttttaaaatcctctgcttagaatataatattataatgtagtatccacaacaaggaattccatctttaaccatggttttcacatcagagtaaagctgagtgattatgtaagcttccctggcagttttacctgacaaccatgggatatacttaataatagtaacaataatattccttcctttgctgaacgtctgtttcttcactgcgaaacatataacatgatatggtttggctgtgtccccacgcaagtctcaccttgaattgtaataatccccgtgtatcaagggcagggccaggtggagataattgaatcatgggggcattttcccccttactgttctcatggtagtgaataagtctcatgagatctgatggttttataaatgggagttccctgcacatgcgctcttgcctgctgccatgtaagatgtgactttgctcctcctttgtcttctgccttgattgtgaggcctccgcagctatgtggaactgtcagtccattgaacctctttttgttggtaaattacccagtcttgggtatgtctttattagcagcatgagaacagactaatgcaatagacattcaaggagttccctaaagtaacagttcttagagtataatctgtagatccctggagagggttcatgaaaccttttttgggaatctacaagtaaaactattttcataataatactaagtctgtatggtattttcactgtgttgggtttgcactgatggtaatggtggataaagctgccagcaccttagcatgaatcaagccattgtcaccaaactctgctagtagtcattgtgttcgtcatcatcatgcgcttccagtgtaaactttaaaaaatgccagtttcatttaagaatgtctattgatgaagtagtaaacattattcattttattaaatcttggtctttgagtatgtgtcttcccaatagtcttcttaatgaaattaaaagtgtacctaaagtactccagctacaaactaaagtgtgattgtttgagctgtaagctgaactagctacttttgttgtggattgtttttgcttaaaatacaacgggcagaccgactgtggttattcaaacttgagtatttggcagacatttcctcataaatgagtgacgtgaatgtcacttcaaggaaaacaatggacaagattttttttactaatgataaaagttaggttttcaagcaaaaattagaattttagaaaactggtatctgccactattagggttctctagagggacagaactaataggatagatacacacacacacacacacacacacacacacacgtatatatataaaggggagtttattaagtattaattacacaatcacaagatcccacaataggctgtctgcaagccgaggagcaaggagagccagtctgagtcccaaaactgaagaacttggagtccgatgtttgagggcaggaagcacccagcacgggagaacgacgtaggctgggaggctagacaagtctctccttttcacatttttctgcctgctttatattcactggcagctgattagattgtgctcaccagattaagggtgggtctgccttccctagcccactgactcaaatgttaatctctttttgcaacaccctcacagacacacccaggatcaatactttgtatccttcaatccaatcaagttgacattcagtattaaccatcacagtcactttgagcctgacttcttcccattatttaggcttttctgctgagatcagtggtaatattgttggatgagaattttttttgttattttataatgaaatgtgtcagcatttagaagatctgtgtaacttagtgaactaatattttccagatgaccagtggttgatgttacaaaaccatacaaggttaaagatttattcaaagtgtaggctggaccaatggctttattatttttttttatttaaagcattttttttttagagacacagggtcttgctctgttgcccaggctagagtgagcacagtggctcaatcctagatcactgcagccttgaactcctgggctcaagcgatcctcctgcctcagcctcctaagtagctgggacaacaaacgtgccactgtgcctggcttattttttatagagaggggtctcagtttattgccctggctgacagtggctttatatataaaataatatgaaaagtttgacatggtttcagattccatattgcaactaacctttaagaagtcagcacctgttagtggaaccgcgactgctccgcagagctgctggtatgagcgcccgtcgccaccccacatcccaggcccagccattctgacaagaactagactttgggctccttgagaatattcagttttgtaagttttaatatcctctcaccatattcagcttaaaataccatacttaatgattatccttggcaagacaggtgtgaaaggattgctgttgtattacaatcatggtgcaaaaataccagtcaccagtgagggtatacaaataccccttcaaattaattatggctgcctatgaaaggaggttccctacgtgtcctttgattccgacattcatgggcagtgacactgtgaatgaattcaagagtgaagatggggctgttcatgtcattgaaaggcgctgcaagctggatgtagatgcaccaagactgctgaagaagattgcaggagttgattacgtttattttgtccagaagaactcactgaattctcgggaacgtactttgcacattgagggtcataatgaaacattttccaattgctataccgttcaccctgaaaatgaagattggacccgttttgaacagtctgcaagtttagatattaaatctttctttggttttgaaagtaccatggaaaaaattgcaatgaaacaatataccagcaatattaaaaaaaggaaagaaaattattgaatactaccttcgccatttagaaggaggcataacctttgtgccccattggactccaccttccatcacgccctcttcagagacatcttcgtcatcctgcaagaaacaagcagcgtccatggctgttgtcatcccagatgctgtcctcaaggaggggctgagtggcgatgccctcagcagccccagtgcacctgagcccgtggtgggcatccctgataacaaactagatgctgactacatcaagagatacctgggcgatttgactccgctgcaggagagctgtctcattagacttcacgggtggctccaggagacccacaagggtgaaattccaaaagatgagcatattcttcagttcctatgtgcatgggattttaatattgacaaagccagagagatcatttgtcaatctttggcgtggaggaagcagcaccaggtagactacattcttgctacctgggccgttccacaggtccttcagaattactacacgggaggctggcatcatcacgacaaagatgggtggcccctctgtatgctcaggctggggcagatggacaccaacggcttggtgagagcactcggggaggaagccctgctgagatacgttctctccataaatgaagaagagctaaggcgatgtgaagagaatacaaaagtctttgtttggcctatcagctcatggacctgcctggcggacttggaaggggtgaacatgcgccacttatggagacctgatgtcaaagtgctgcggtggatcatcgaggtggtgaaggccagttaccctaagagactgggccgacttctcatcctgcggtcacccagggtatttcctgtgctctggacgctggttagtccatttattgatgacaacaccagaaggaaattcctcatttatgcaggaaatgactaccagggtcctggaggcctgctggattacattgatagattatttcagatttcctgagtggagagtgcatgtgcaaagtgccagagggtggactggtccccaaatctctctactggaccatggaggagctggagaatgaagacctcaagctctggactgagaccatctaccactctgcaagcatcttcaaaggagccccacacaagattctcattcagattgtggatgcctcttcagtcaccacttggaattttgacatgtacaaaggggacattgtctttaacatctatcactccaagaggtcgccacagccacccaaaaaggactccctaggggccccacctctccaggtgggaacaatgtgcagctcatagacaaagtctggcagtggggccgtgactacagcatggtggaattgcctctgatctgcaaaggagaaggcgtgcagggctcgcatgtgaccacgtggccgggcctctgcatcctgcagtggaaattccacagcatgcccgtgtgcaccatcagcagcctgccccaggtggatgatgtgctcgcgtccctgcagatctcttcgcacaactgtaaagtgatgtactacgccaaagtgataggctccgaggatttcagaggttccatgacgagcctggagtccagccacagtggcttctcccagttgagtgcaccaccaccttctccagccagtctcactccagctccatgatttccagctagtgccgcaccacctgcacctagtgtgcagaggagatggccgcccctcctcggacagccagctccaccctcccgccgagcagagacattgtatggactcctctcacctctagagagcaaatagctctccagatggtaaacatagtcatttcatcccaaaactatcttggcaggtagttttaactctgatcctaccttaactcaacagccatagattttgtatatgttgtgcacaaaatcaaaccagagcacaagggctctcttgaaataaaagtagtttctataccaattaaaagattgacgtggtctcaggaaaaaaaaaaaaaaaaaggaaaccagtacttgttgagttttggtataatatcaaagaagaatatctacagttatttgaaaaggctgtaaactacatacctatgtgaagccaatttccttcatatacttcaataaaaacaacctattttaacagattgaatgcagaaacaaatatgagaatcagctctcttctattaatttagatattaaaaatttgcaaaacagtgtcacccttctcatcaattattcaattatttgtgttggaaattatagttatttttcattaaaatgttgatgttaacatgtaatggatttgtgattgcattttttttattttaatttaattttttttttttttttttttttttttgcgacagagtctcgctctgttacccaggctggagtgcagtggcacagtctcagctcactgcagcctccgcctcccgggttcaagtgattcttctgcctcagcctcccgagtagctgggactacaggcgcatgccaccatgcccagctgatttttgtatttttagtagagacagggtttcaccatattggccaggctggtcttgaactcccgacctcgtgatccacccgcctcggcctcccaaagtactgggattacaggtgtgagccatgttgcctggcctgtccttgcattttaaatgaattaaccagtagttgaaaatttttttagttttaattttaaatatcataaaaactgacggctgtaacccatataaacaaaagttctttgggctcctcaataatttctcatgtaaaatttgagaaccactgttctaaaggaagctttgtaaagtactcgagatttctgggagaaaagcattctagcaagaaccaatataagctatgttgtttgtagctcccaagtacaatctaaggtcaggggtcatagcttcctgtaatatacatggcaagacagttccaaatatgaattacatcagtgaacccagtgcccaggaggcagggccgtggaacctgtttaagtcttctgtagttgatggctcatatacttgtcaagagcatatcatgattctcattctttagaaaagaatgtttttactctttaggttatgttttttggaagttagccactctggaaatattaaagatcatttttaaaaagcacttctccccatcaggataaaataggaatagaacgaacagagggccacccagcaggaaagttgtttcactcttcaggcttcagtctgggtctgctgactacctagtgacatatcggctttgctgctccacttaccaccttaatgacttaccaaggtcactgccctgaagatactgatgaaaatacatggcaaaggccatgtatttgacatggaaaggatgagatggttagatagattctggtcctcatgatattgctgtactaaatttagtacttttataaaattgcagagatcaacttgcttcaaaatagaaatgatgggagggaattaaactacttttcttgccttctgtttattgcattccatgtggtttgcttattacatgccctggttataacttggctgattttgccctttcttttctgtttttccatgcggctgtcattttgtgtgtaatgcgactgtcttgcccttttcttggtctgtggattgcagtggcaccctgtgctgcgcacactaaagaaccgcattgaagagaacactggccacaccttcaactccttactctgcaatctttatcgcaatgagaaggacagcgtggactggcacagtgatgatgaaccctcactagggaggtgccccattattgcttcactaagttttggtgccacacgcacatttgagatgagaaagaagccaccaccagtgagtattctctttttcttatgctcttcctgcctcttattagtctgtggaaaaagtagaactcctaaaagcttctactttcagatttcgagcatgggaatacacattttgttgatgaaacattttcaagtgactacttccccatggttaacttttgacttccaaagtgctccttcattcatttacaagtccaacaagaattggctgccttatgctaggtgctggcggctcatttcattgatgataaactccctgtcctcctggagatacagtctagttggggtagataaatattgcctattactcaaataattgcaattgtgatcaatgctgtgaaggaaagccttagaagaatgactcaagctagtgggaggctaaggaagaggaaggaggctaaggaggacgtccctgaagaaacctttattttaagtgttcttcatggtaatatggccacttttctgaaagggagcattcacatatgtttgttccttcttagccttctcctgaaatacaggtgaatctaactctttcagagagaggaaactcaagccagattatcagagatggtgatctgtccacattcaggtagaaaaacagtgaccaaaaaattaataacgatataataacttcagtttccaccccagcgcttacctcaattatgtgacatttgaggaatactagggttattaattttttaaaaaatcaaaactgtagtcccttacgactaagaaagatagtaatgccaagaaaagagccaattattttattttcagtgtttgtgtctcttcctaaccagcattcctgatcattcagcttataatgttaaaccagacccagtcggtgtggaaggccaaccaacaggctgtttttttgtttgcttgttttttagagagggagtctcactctgtcgcccaggctggagtgcaagtggcacgatctcggctcactgcaacctctgcctccccagttcaagcgattcacttgcgttagcctcccgagtagctgggattacaggcgtgtgccaggacccctggctaatttttgtatttttaggagagatggggttttgccatgttggccaggctgttctcaaactcctgacctcaggtgattcgcccacctcggcctcccaaagtgctgggattacaggcatgagccactgcacctggcccaggctgatttttgaatagacctaagccagaccacatcattattagttcttgtgtcagttcttcgtcagatatacttccataagaatacagttaacagactgagtgttttcctggtgtgtattgggtttccatgcatggtatttttaaagcatattgtgtgattttgcatatatgccattaagtaccttttgttggtataatttccattgattaggctttctttggttatgtttacataaaaagtttgatcattgttaggggattggtagttgccggtgtttttttaagtgaacttgctctctaagccttcagttacattggcaagcagccttctcatataccaaggagtaccacttgagaatcagacaaaccagcttttgctatatttgttttagatatgattatacttctgtacacagctttcactcagttaaataccaagttcacatgtgtgaaaaattcatcctgcccttagtaagactcctgttgcataaatagtagagagacactgtatcagtctcattatttaagttcagaccctcttctcaagccggatgtatggaacctcagcttgttgccaggagtggtcctgagaccgggggccgtagcagtgaatgagtaagatgaaattgtctttctcctcctggagctcatctagcatatgctagcactgcgccttcctcctagagttatccttctggcctcctgattggcaaataagctatagtatatatagcctttggtataataatggtttttagttcttcacacttactttctttgttgctcagtatttaagtattcagttactgtttctttacacacatatattcaccaccaccatgcccctttttaaaaatttgggcctatttatagatttgaagcttaagaattccctaagtatgctttttggataaatcattttactgtacaagcaatttccaaatattatgcattcacaatattctggtgcccagaaataccccgtttcttctcccctccagagagctgaatttcttcattttctcatataaagatatgacatatggtgatcaagagctatttcttggtagtacacatcagttatgttatagggtaacatgtagatggagagcataactactacatacattgttcctgtgggcaagcatttggaacagcgctttatcctgccgtgccccatgctgtagctttctcttctcctcagccttcttggagcctattttgatgaacatgaatgataatacaggccatgaaatactcagaagtggtaaagtccacataattgtctgccagtggcaagggaatctgcgctatgacgatggtagctgatttgattaaaatactgatccaataagtaagaaaatttgcctgagattttaacaaagttgcctgaggaaagggatttgggaagaaatataaacatgttggtacttcaggttgttgactgtagtaagttttggcttctggcctagtcttaactatgattgaatttcatgcagtttttgtatatcatctcaattctggcttttgtttaagattgggaaattgaatattaatatgtttgaaattataatcacacatgagtaaaaagtgaccttttttccccagaacctgtaaagtccatttttgtgtaaacaggatacaagtttaaacttttgaagattccttcaggtctcactaacggatttccaaaaacctggggctctacaaatgtagctaaactcgaagtgcagaaccctttctttgagttgatggccttggaaatataccttaaagtgcatcatctttatcttataaataatccttttttccaaaggattgaaaggaagcgattattgcacatttttgtctacttttctttataaactcaggtgatgagaacatgactcatgattcatacagcccaaggtaaagcataatttaaaaagtaaaaattaggttagtcttctgtgtgggatttgtaggagtctgacttcctgtaactcttagagacctatctcagtgtgctactacagattgtaattttcatgtctgtcaccgagacgttcagggtttattagaggttgtgggagggaatctttcaaactcctattagctttgacccatcggaggagaagttaatgcctatttgacttgagtcacagtttcgcatctcaggcggacatggaagagtcatgagatttcctgcactttgttcaaatgtgcagttttgagacagaaaagcgtctgttttgggccactttcaaagagaaatagtcttgattttttaaaaattcaaattcctccacccttgcagcagctgtttattttgtagtctggcaccttgagcagatctccattaactgctgatctactgaaagctgccccagttccacacactgtattcctaacagtttctctctgtgctgagacggtaaggagatctttgtttcgtaagcaccagtgccctctgattcatgcatcagctcagtcagcttcatgtagacatcatctctcggattaaacatttcactcctccaaggtgccggttttttgttttttgtttttttttttcactgtcctgtggtccaagtctgccaagtgctgctcattcattttgattttagagtaaattaccctttcctttaatgatattactgtcattcctcaggggcatagtagacttgtttaagcttgcttttacattcattccgattccttttttgtttagttcaaatcaaagactaagtgaagggcaccttatctatattctggctgttgtcaggctatattgtcttaagactgtcataaagcttatcaaatatacttcagtagaccttttttattctatcaggctggcattattaaaggttttctatacttcttgtcccaaacccagttgtacttttcaaactacattgtgttcctgtttgcaaagattagtctggttcttttcccagctagttttaattctatactgaaaaaaacaagctggaaaaggaactacaaaagccatttggcaggctgctatttctctgtcggttaccatggaaacagtgatggctggggggtgttattagataatagcaggaagtttgtgatgcactggaggtttagatgccaaaagccttgtttttctagcaaattacctctggataaactgtatccttcatcagctgaattctgcaaatgttaggggctcctattcacctcagggtgattgagctacagcaagttgagccctctaaccactcctctttttagcccttgtgaagaatgtgaatcctgtttgtattgccaggagagatgattgtaaaaccaagtctagcggtagagactatgagagcacccaatgaattggaggtcctagtgtttcctttgctaattggttgtgggttttttgtacactgctgggaagagtggagtataaaaaggtcagtcaagtcataaatactgatattttttgtaagactttagaaaagaagatattggaatccaaaataataagatactaaatagtgtaaatttagaagttagataagctagtactatgcaggatttcatagagtggaaacaacccacaccttagccagcagccccgctgctgctattccagtcatctatccttcctattaatccatctggtgattatagcacctactctaagagattacaagaaatacttgaggctgggcatggtggctctcacctgcaaccccagcactttgggaggccgagatgggaggatcccttgagctcaggagtttgagaccagcctgggtaacagtgagaccccatctctatttttttaaagtaaataaaataaatacaagtaaataataagtaataaaaagaaatacttgaaatcaattgttgatagccatgatcatttaaaaacactttctaatgaaattttaaaaattgggttgtatttcctgtttctatccctgatgttgccaaaaagcactcaactgtcttatttgtacttattccttttttgtaaatgggattgataattggtagctacttcatggaagtaatcaacaagttttcccatgaaagttgctgtagtaatcagtgaatttttaagcttttgtaaatggtagatgctatggtgacttttcagatatggaaactgaaaaaggaaatagcaatgaaactaaactccaaggtacccttggtctgtgaaatggcattcattgaaagagtatagggaagcctcagggagggtaaggtggcctgtggatcataaatggtaattgggtttttgagttcccatctctaggaccatttaatggtttggagagtgtgagggtgagtagagagagagagagtgtgtgtgtgtgtgtgcgtgtgtgtgtttaagcagataaagattggtagtcctgataagacttgaattatcttcagacttgagatcccttaggagttggagtcctcatttgcgtccttggggccttgtctcaagctagaatccatgccctgactcccactgggaataattgatttttgcaacaagcctcccagttttctattactagtgacagcacttttagtttcagtaggacaaacttgtgtttccttgtgaaactaagtgattcattgttgtttctgtgtgtaccatgatttggcttgcaaacctggctttttttaaactttgccccagtggtagaggtttttctccccttgccatactcttaaggactattcctaagccatctggtatctggtgatttttttcatctttcacaagtcacattttcatggaggatggctgtctcaccgaggcagagaagagcaaagtgtgtttcaggaagggaaaggaggccctgccctggagcagagtgagccagcttgaggagtgtcacaggtggtgagactgggagagtgggcaggcaccagggcatgcagagactcatgagcctcaggaaggagcagattttgttttatgtccatcagggagccagtgaggtgtataaagcagaagagtgacacggtctgattggcaattttaaaaggtcactattgctactgcatggagcctggactagaaagaaacaaggaggccaattaggacattgttagattttgtatataccttgggaccaaggtagagaaggagaaaaagggatgattcaatggcatgagctcagaggaacagggatttttattctctgcttcagaataatgatttgaaagtgttattgaggagtaaggagaatactctatcacctggctctgtgagccactggatggagagccatgatcaccttccacctgagagggtttcagggaatttgcagtcttccagagatagccagatttcaattaggatgaggaagcagagagaaccttcagagctcattgagactgaagatataggtgagtttgctcatctttgaatgggaaatccagaggacacagtggaagggtgcaggagggaaagagttccgggggattgtgtctgatcagattatgtccaggaacagtttgggaatgagtgttctggtattaacagatggctggagaggcttgcacttctgctagtgactgggctcagctggaggtgaggtatggcggaatgtgttctcatatgctttcagaggatgaagggcatttgtttctggtgctagcacctgagatagaagctctttcaagatagcagttcttttaagttgcattttttggaaatattatattgccaagaatggaatgttcatcacatgatctcttctgatttcacatgcacattcagtgtagctggaacagctacaactgtgagtgtaaaaccaggtttgtttttgctcaaattcggtaacttcttacccccaccctatccctagtattattgcagcaataagtctgaacagtaaacgctgtcagcaggtatttcattcaatttcattgacatttcaatgtgtgcagtccagaaggaaaggcagtagtccgcctggtagtttgtgctgtcgatgcctgctgagagagcttgtgccgcagccaacaattgcccaggcctcccaaacgctcttaagttagtgagacattggtgaggtcccatgtcattgagcttttaatatcactgggtgtgcctggtataggatgattgattgcaccagtcctttctgctcacctttctcatttgcctcgccagaaccttccaagccaaataaatgccaaaaatcaggaaagagttttagaaaaactcaaagatctgtatgtgccaagtaaactgtttcgaaccaataacctcagtgacttaaaatctgtgtttttctagctggcttcttactttagcagatcttatttcagaaacagcttctgtttttaaagtaatgtacttcagatcgatgctaggatgtcatcagttaaagtgtggtttgagtcagcagaataactctgcaaagatgactttgtggggtcccagctttattctctctccatcatttctgtaattaatatgttgtgtttatgtcagattttaaaaatattttaccactatgaacaagaggaccagctatgttcttgtatcagcactagaggaacaactttgcagcccaactgtagctccaagcttaggtgatccatgaaacagtctagacctcagctgggttctcaagggcaaggcaacaccacagtttgggaaaacaagctgaaaagaaatgataaggaaaaaaagaggacattactggcatagccataagttgggcaatagggcaaataaatgtacgtttgatcctcagcgggtaagtagctgtaacacaggctagcatttagttttcaaatatcatttcagtctgcaaaaaatgccatgaccatccttatcaagcacctccaccctctgtctgatccttagaccagcgggctagagaaatctcttttacctattaccatcgtgaaaaaaatgctttgcttgaccctgcagatatcctgacatcttgggctttttcttgtttttgaagcacagattcaggaatgagttgtctgcatctgaagtctcccctttctcaaagcttaactcattattgacacacctgctgtttcgctccatcccaccactctgctgaaattatcctcataccgttgacctcaaatcaagtccaccagcctgtcctcagtcatcatctctcttccttgtaatattggtcaccaggatgcatcacctctgtgtgtgaaacttgcccatgtattacctgcgttttcttcctctgaaatactgtcttgttttagaattcccaaacttttctcattgctatttttctgcctcctttaaggccttttcttttacattcaaccccttaaatatagacgttcaagatttctttgattctgttattgttctctacattattttttaggagattatgaactggcagtagattgtaaataccatatgggcaaggtccctttctgtcttatttatcattacattcttagcatttagttctacatatgttgattgaataagcaaataaataggatctcattagttcttatagctttaaccattccttctttggtggggtgacttctgaatctcctatctccagctttgactttcatctgaagttccagtcatcactttccacatgttcacgagacatttccacttaataacagcacatgtggcttccaccctgtaatgataaaatcagattcgtattgttctttcagaaaaactccacacttgctggtaagttcatttatgttcatgttaacctaaccattctcttggtcaggttaacaccgtaagttattttcagctcttccttgttcctttgtttctcatatattatcaagtcccaagtcatctgaattctttcttgaactatctaaagaacccatctctcttacagtgaccatctttatcccaggcactttttaacccatgcctacagtactaaaatgactttttttttcaccctgatgtccttaattccaatctttgctccctctcttctgtccattacccagatgtcaggtattatttccaggaacagttctttcctgcctctctctcactgtcttctctcattctcccctctccaaatattaattaaacccctactatgtgtcaggtattatactatgctcagctctggggatatagcagtgaacatgacaaacatagtccctgcccttatgggggttacaggagctagactataatcaaataaacagagagaaatagttacaactcatggttagagctctgaatttttattttagaagatcactgtggctgctgtgtgaagaataatttgggaagaggcaagagtaggagactaaaagagtaggtggttgtagtcatcgcagtgggagactgctagcttggactaaggtggcattggggatgaagagaagttaatgggtttgaggtatatttctgaggatgaatcaacagaacttgccagtaatatgttagatgtgggggtaaggatccagactcccaggtgtctgacttgagcagtggtgagtggagttgctgtttactcaggtggaagagaagctgggatttctgcatttgattttgtccctgctggaggagttccttcttctacgtgcaaaatctgaggtgcctgaggcttccaaatgttaagtaggcagtcgactgtgtaagtctggagttcagacaacaggcctggctggagatgtcatttgggaattttggaataaccgcaatagtaaaacgctaataataaataacaagtgtatagtgctgactgtgcctggctctgctctaacttctttattgaattctctgataattttatatagttgatgccattattatttccattgtacagatgagatgactgagactcagtgttaaattacttgcccaagatggcttagacaactatttgttgaatgtggaatcgaattaaaactaataatatagaccatatgtaaaactgtggaattgtacattatcattcagagaaagagaataaaaaagggagcggccaggcgccgtggctcatgcctgtaatcccagcactttgggaggctgaggtgggcggatcacaaggtcgggagttcgagaccagcctgaccaacatggtgaaaccccgtctctactaaaaatacaaaaaaaataggcaggcgtggtggtgcgcgcctgtaatgccagctacttaggaggctgaggcagaagaatcgcttgaacctgggaggcagaggttgcagtgagtcgagatcgcaccactgcactccagcctgggccacagagtgagactccttctcaaaacaaacaaacaaacaaaaaacaagaagggagcatagagcctcaaaggttgagctcactgctttcatcactttgttttccacctgaaaaatcttaatttgcttctgttggaacaaaggataaaatagaaactccttacccagattgccaaatccatacatgatcttagcccagggagatccatggactctcactgttcccgtatggttgctccattctactaagttatctctttgctttccccgaggcttgctctccaacttcttaacttaaaagggccccctatagcgtgaaggctttcctgatgcctccagtgcagaaattaataatagttactgtgtgccaggtgcttcctgtgaacctgtaaaacaagaaacaggtagcaggcttctaccttgtcctttctgctcatttgtgttttgtttttataagtgtcttcttagtacagagatggaggtttttctattttgctcatctaaggaatcagagatgatgtggaaaaccaactgcctcactgttatctgagatcagtaatttggaagcatattttgctttgaatgactttttctgattgagttaggggtgagatgaagaatgtgataattttttaaaatcatggcatttattttttaaaatcttaatatattaaacaatacagtttcagatacaaaaaaaattactgcaataaaacagttgaggtgtatttccattgtgcttcccttccttatcaggaaagtacattgtccactgagagacaggatggatggcctctcccagctctacacaaagcacaagcctactggctctcctgggccttggttaatacatggaacaggctatgttttctaaaatgttgtagcaacactcataagtcaaccatggttcaaaaagtcaaccatggttcaaatcacatatttacatattgatcaattctttatgatagacagacataaatgagatacagtaaataatttccagttgttaaaaaaaaaaaaaaaacaagtacaggcgacaaacttggtcatggtacacaaatatacttcatgtgtacagacagcttcattcaggtctaatttttttttaatttttgttttaggttaggtatatttgcaggtttgttatataggtaacttgtctgtcacgggggtttggtatacagattatttcatcacccggctaataagcatagtacccgataggtagtttttccgtcctcacccccgtcccgtcctccaccctccattattcaggtataattttaatttgaaagacctagatatactattatttaagtgataatggcctctaagatttattcagattactatcaaataataaattaaacaaatccactataatttaaaactctgtccattgcttgaaaccttggaggagcctatgctacaatcagttgctaactaaaagcaattgtacgtgtatttgatatttccccacagtttctacctctagatttaattcagtaaaggaagatgatatttgaagatgaagtagcacttgtgtcctgagcatctctcaggcactactgcatggaatggcaaaggggatgcaagaagcacatcagatgacaacggtcttagacgcttacaagtctgctaaggtgactgacaagggaatcaaagaaggcagtcatgtcatggacctatcagcagcatagctgggcaaccctggagctgaatctggccctcagacttgtttaaattgcccagtgtttttaaagacactgaattaattgcgaaaatttataactcaggaaatttcacataaaaatcccacttgtcagcttccctggaaaacccagaagagggggcagcactgggggaacagtgatctgaaatggctcattggcagagcagccaccacctttctgcaggcccctggttctgcatgggtccctctcctccctgtgctgcacccagcccacacctctcacttatgctacttgctggtgtttgtgacccctacagtatagtcagggtgccatataatcaggacaggaaatattaggatttcagaaggaatagagcttaccttggagagcagagtatagtggaaagaatagggctttagagccgggccaatctacattcaaatgctagcctgccctcctgctagcttttgccttagagaaatattttccctccagctccctttgcttatgataaaatggataatatcaccttccttgcctcccttacaaggttgtagtgaggattagcaataacggatatagagtgcctgatgtgcctggcacctgagcacatgccatcgtagatcttgtggaagaagtctggcaggatgctttggtttaagtacctggaaactgttataaaaagaagcatggaaaaaaaagaataacccaaccaccaccaaaaaacaaactccatgtagattaaagagttaaatctaaaaaatgtaaactcttaaaaaaaaaactaaaaggaaatacagttgtatatttaactttcctcaggatgggaaaagactttctaagcataaaaatcatgaagacgagccaaagaaaggtcagtagagttgactctaaaatttttgagctattccatgttaaataccataagtacagttaaaaggcaaatagcaaatgagaaaagcatttgcaaaaagtatgacaaacaaatgccttaatatctgtggttgtagatcaataagaaaacagtgttaacacccccatagaacaatggacaaaggacatgaacagagagtgttcacagcagaagaaacacaaacagcaaacagaatgaaaaaaaaaaagttgaacttgggctgggtgtggtggctcacacctgtaatcccagcactttgggaggccaaggcaggtggatcacttgagcccaggagttcaagaccagcctggccaacatggtgaaaccctatctctactaaaaataaaaaaaaattagccaggcatggtggcaggcacctgtaatcccagctactcgggaggctgaggcacaagaatcgcttgaacccaggaggtggaggttgcagtgagccgagatcacaccactgcactccagcctgggtgacagagtgagactctgtctcaaaaaaagaaaaaaaaaaaaaaaagaacttggcttgtaatccaagatctctaagtttgaatgagttgtcatttctcccctaattgtttttcgttactgtcagttgataatgttcagccagaagataggtactgtcatgttttcctggtgagattatagattgctgcagccttctcaagaaagcagtttggtaatataaatcaagtgccttaaagttcatacacttggctccagtaattccattttttaagaatatatcctagaaatatatgcagaaatgttttgcccaaaaatctgcttgcagcagctttttatttattttccctctttttaaaaaaaaatactggtgtatgaaaatcaatctccaaccatgtgctccttactgctccatccttagtactagcataatgcctgatatatacaggtggtcaaaaggtatttgtgagtttaaaggaaggatatgttcatacaaaggaatattctataaccatatttttgaaatgtatatttaaagatatagaaaaatgctcaataaaatattaaaaatggagtacacacgattgtatatctggaagactctgtgtgtatgttgtataaactctggatgataggattacaggcgattttctacattttctgtgtactcttcctcagtcattcagtacatatttattcatatgtgtgataggcactgagaatgtttcttaacaggaagaccacataaactttccctcatggagtttataagagcagaggttgaataaataattacaagtgcatcatttactttagtaaacttatgttactttttatattctagaaggaaaacctgtatgatgattttaaagcattgatgattgtttgtaatttctaagacattcttttaggacaagaaagggatgattttaagaaaactccaaatctcatacagtatgaattacctttccaatggaaagaaaaatgtttaggtttcccatctgttggatggttaataatgacataacagtaaatacatccagattttttcaccccaaatagcattttcttaaaggaaactgaataggatatgttggtgaggtggaggtaagagttgtgagaagctttagaaaagcataattaagccttcaaatgaactggctgcggttggaggaatgagaatgttgatcagcattaatataaaaatacatgtttttcgctttttccatgtactcgtagggtttcaagtatttggaaaaccaagaacatcaataacaaaacccaccctgtagcttgagtgtgaccctaaaagctgcttttaaccaggatgagtgatggaaaattttatccttagccctggttttggggggtgtgttttgttttgttttgaagaaaaccctgagtaaatcaaaagggctacagagatgtgtttgggtaacttaaccacgcttaatgactaggaaggcactcttctaaacagtctgacctgtgtttccactgttgcttatccatttatcaactggagcctttatgcacagccatgtgggttcctctggccttttatctgactcctaagtggaaacagtctccatgcatcttgcttcagttgaagggcatcttgcttcagttgaagggtggctctatggtctgttgccactctggcctcgagggaaggatgcatttgtgagctctgtgttgcattagtaggatcccttgccctctttcctgtctgtctccttctgcaaattaggaatgcatcttctaagtcaaagatcttagaaggaataaataacaagcagcaaagaatgatatcacttctcacagagggtacactgtgtaagggtgtctcctttgtggactgattcgagtggctccctcccaaacgaaggctcacccttgtctgctttttggtatggctaatggttatgttgaatgtaatgtgttcaaaaccaacctgagactttctctcatttgaaaagttcagatcttaggaacagtatgtgaaatgtgatcattgaacatcactttccatcagtgctgatacatttcggaattctctttcacttgtgaggtggattcctgcttcatgtttccaggtggaactatagtgtttacctattctcttccactgatctagcacctccttctccccaacagtgtttttaatgttctaggagatcttcatctcagaattgccttcatgttgtggttaagtgtctttcctttctactttattttattctccttagtgtctgtacttgatttgtagattaagcccatgttgcactctctgattatgtagagggtagcagaaattcttctgcttctagctgtgttgaaccttgatctgatagctgactatacagcctaaattaaggagccttggactgtctaatctcatggtcagtgcactccctccggatatcttttccccagtaggaccatgtgtctcctctgtctggattttttttttaaatcagagcagcgttttgcttttctgagatggagctgggctgcagtgagggcagggtcaccttcccactgccctctggttgtctgaggggtcaaaggtaaatgttttggtgcccacttattactggaagagaaaaggtggcagacacaattaaaatcaatcactgaaaccaaagttattttaaacattgcttctatcttctgtctataaaaattatgactatgcttgacaaagttactgccaaaagttggggcctggaacttagactgtttatgcaagttcatgattgttttgattttgattttcctagggaaaatctttgtaaacagttaagttctcagaagcacccatacagtaataaacataaacacagtttgcactgaaatcaatcctgcagtaacccaaatgtaaccctttctaccggaagtgaagcagatgaatgaatagacccatcagttctgcccagaatggaggtgaagaaatcaggaagctcagatctgtcccagtctcagcacttgacatgctctttgttgctgtgagcacagaagttgtttaatgctcctggttttcagctgtggaggagccacactaccagttaattgctttgcagcttatgctctgaagactcctgagaatattggacataaattgcttttgagctctctgtgtaaatacaaagcatttgtatcctaagtgtacaggagtcgtgatccatcctcaaagatgtaaacagccaatctcagtttgacagcactgttttggtcaagccagagctccctttgagaaaatcttgctgttgtctgttctggaaagaggcaggaatatgtctccaaaactccatagtagccatgagaagaattgagactataggtgccaattagtaaattagcatacattgtgaaaaggtgaaggaagtcatcgcatcaaatcttggttaaaaggacatttttcccacactgagtatgtcaaaatgtagagcacaacatcagtcagatgtaaagaattcttgtacaggtgacttttatttccttcttaggccagaatgggcttttctgcattttggattatgatgatgacactaatagctagcacttactgcatgccaatcttcaagggatttacacatattctatcaatggaggctcaccatagccctaggtggcagtcactgtcatcctccccattttacaaatgagtaagtcagggtacagagagatgaggtaacttgccaacagtcaagcagctgccaaatgacagagctatatatggattcccacagtctggctgagcagaggtttccatttttttttgacctctgtcaggttctgttgcatcttgattacacaggcaaaacatttattacaacaaatgctgttttctaggaagagaatggagactacacatatgtggaaagagtgaagatacccttggatcatgggaccttgttaatcatggaaggagcgacacaagctgactggcaggtgaggatctgcaagtaatatgaatctgctttcatgtggaggcagtttcctgactctgaggactatttctaagtagacatggtgaaaagcaagctgcttttacaacgagcaagagggaatgagctgacattctttccaaggagttttgctactactgacaatccaggtggacactagtgtgtccggtagaactttctgtgatgatgaaagtgttcagtatctgtgctgcctattgtagtagtcactagccacatatgactgacttcttaaaatgtggcttgcatgctataaagaactgagtttttaatttaattttaattaacttaaatttaaatagcttcagggtagctagtgactatcttattggaatacacagctctgcagctaggccatgccatttttaggccagatcatttctaaggtgcacatgttaatgtcaaaacacttaccataagaatggaatctcatgcctctctttggtctcatccatttatatgttttatgagatttgggaaatggcaggtgtctgagaggaacagcaacaattagaaaagatgaaaatatctcacttcagaggtgctggcatagcacagtggggctggggatggaaatttgtttcaaagaagggacctttctccacaagacttcaaagagcttactactcatttaagggggatgagatggaaatatttctgcattctcatgaataagttttaagtcgctttgaactaaaagtgtgtatgtgtgtatttatgtcagagttatgtgtatttccatttagcatcgagtgcccaaagaataccactctagagaaccgagagtgaacctgacctttcggacagtctatccagaccctcgaggggcaccctggtgacgtcagagctttgagagagaagcttcactgaaacggagcaaaccttccactgagaagccacttcaagaggctggtgctgctagatctcatgatgtggctgttgggaagatggtggggtttgtttgccagcttggagtcctattaaatgaaagccagcaactcatgttggtaataggtctactgtgggaacagttatccctaaccacagctcaaaatcgctatcatctttaggcaaattaaaatctatgtggcagtgctcatggat

SEQ ID NO: 54 - DNA, 89830 bp, Homo Sapiens
gtcccttaactcgttgagcgcggctggaaatccaagcgcttctaggtgctggttcaatgcctggttcatgatttatttcattctctccctccatcttgcaataggttacttttaatcatttagatctatgacactatgctaaacgttataggagacaaaaagactgtgaacaaacaagaagaaccaaacgaaaagagccaagtccaggattctcgttcagatcagcaagtcattgggatcgagctcctagggcagctactacatctgttatgtcctcaagataatcccagcacctagcactgtgcctggcacaaagtagatcttcaatgaaagaacgaaacgagccgttatatttacacagatgtatttcactcagtcctctggaagagatgcctagtgtgaaagagattccaagaataaataccataaacagcaccgagcccaaatcccacagcaaacatccttattaaaggcaaggaacgtggggcgagttccttttctcagaagattttacgagaacgcaactgttgcgaagaaggaacagacattcgaggttctgagtccaatgggaactcatttaactttttattttgcagcagatttcaaagtctgcacccagcccctcccaggacacaggtctccttgcagctgcctttaacctaagcgtatcctctctccactttaaaccaaacgccgctgcatggagccctgggagcctgagccatgagaatcctgtaaagagggtgagtcttgctattagttaactagagcgaagttaggggacgcctttctggttctcctctcgttttaagaagtctccaggaagtaagccaagagctaggagagaccaggtttccccagccccgtcctgggtaaacacccggcgggctttaggacccagcggtgggctctccggaaggggaaggggccgggcctcgaggcacaagccgctgccgccagggtttgaactgcgcgcatgcgcggcggccgccgaaggggcgggatccgaggcaagcgttggttctgtgcgcctcaggtacgtgttgggcggcagtgggcgcggactcggtgcggtctctcgcgggctgcggtcgggcccgggatcctgctcctggccgagtcgcggtgcgcgggctgctggggtccggcagggctggaggcggaccgcgaggaagcggcgcggccgggaagatggggcagggtcgcctcggccccggggcctcggtttcctccgatcacagcgcctcagggggcgcgcacgggcgctgcggagacctgtgtcctgccggggcgcggcgctaggggcccctgctcgggtttttattcccagacctaagcttacaggtgcgtggtcccagaaagtgagtaggaaagcgcccaccacgtgccaggcgcttaagctttctgtgctcggtttcccagtataggaggacggtcacggtacgtagtatagagttgtcctgagggtgaagcgagtttacacttggtgaggcgcttcgaatcgtgcctggccggccccaaatgagcacgcagtaaggttagcagctgctgccgtcacttcctcacgttctgaatctgctccgtccccaacgccttcagcaagagccctctcacttcctttgtcttcaacccattctccgcagagttggagcacacagctgtattaaaaaggcaaatcgaaggccgggcgcggtgactcacgcctgtcatcctagcactttgggaggccgaggcggctgaatcacttgaggttaggagtttgagatcagcccgggcaacatggtgaaaccccgtctctacaaaaatagaaaaattagccgagcgtgatggtggatgcctgtaatcctagctcctcgggaggctaaggtaggagaattgcttgaacctgggaggcagagaggttggagtgagccgagattgcgccattgcgctccagcctgagcggcagagcgagactctgtctcaaaaaaataaatgtaaatcggactccccttcttaaagccctcagtggggtcccattgatcattgcataaaatccaatttctttaacaagtcttctcccctcacccgcttcggaccactgcctgccttgcctaagtcctttcttatgacctctttcccacctctgccggctgggttccctctacttgggaatgctcttcaccccatcatttagacagcaggttccttttggccctctgggtctcatttatatgttactttttaagtatattccaaaggtcacccctatttttctgtctcatacttataaaatgtaatgaatgtctaactcatcttggctattaaaatttttatgtgtgggtctgtctcttctgccctgaaattagctctgctagggtagaaactatattgttaacgcctcattcccagtttttggtacataatagctgcccagtaagttattgaatgaatgaactccagggggtaagcatgatatccatttcacagactaaaaaactgaggctcagcagttaactaacctgcccaagtgcacatttactccctagtcatggccgggtttgagacaagggaccatgtttgcctattactggccacacaggaactcaattgaggagcatggcctccaggcccagctgatggtctttaagctcaatgagaaggagcagctggaggtgaaagagaaatgccccagctgggtctcatatagtggggagtgaggaaacactagtagctctaaatggagtacccttttatatccacaacatgttttaaagtccttaataaaagtgctaacagtgtcctgagctagcatttggtgggaagatttcttagatttttcatgttagtgcagtgtttgccaaatttcactcacactcacctgccttctccccagtttgctttattctcttaacacatgacacaggatttatttcagggccgctttgccagctggagacctccagccctgggctggctgcaggaggtgccctgcccactcagcctggcagaatgcatttgtctttcatccccgcccagatcccgtggccactatgactgcatgctcagcccgcgaggagtcggtttgtgagtgagtgagcaagcctggaggcccggctggctgttccaagtgctggcccagtcacaggctccatgtagggcttgtggatggcctgggtgtatggcaagtgactctggtagcagattctggtgtccagacgagggggatgcagtagtgcccaaacacttggagacaccaggcaaatagagatgtattaacagctcttttagtcccaccatctgcagcccaatgaatgggggtgtgtggcagccagcagctccctctcccattgcttcactagcggaacggagtgctacagggttatagctctatttgcactcgctgtttagctggtccgaatttcttgtcctgcgtccaagaataatgaggttaggctgacaaccgaaggggaaaagggcggaggtgagttttactcagtgatgagacagttctcagcagagacgggaccccaagtggatggcccctgccctgaccccaaggtgggcagttcgctggtgtgactgagtctggggcttttatgggctcagaatgagggagtgtgtgctccatggtttgtgagtatgcaaaaaaggctaaaacaaaggcaccactcaaaggtgggcatgacaatgtaaaaaaccaattagggaagggtagatatatgtaaagtaggtgaagggtggggattgatcagaggaaagtgtgccaagtgggaagaggggttatcaatccggtccgtggatttacccaacacttgtagcttggctttcaggctttaaactgtctttggtttgcaggtggggtttcactggggccctgcccctatctgcctagggatttgtctgcctcctgccgctatcacatagactatcatatacttaatatttttgtttgaatccaatcattcttttacataaaataaactttattttgctatttcaaatataacgtagccataagataccttctgttgatggtaaacaaaattgttggtgcctgcagaagagcccaaaccctgctatttgttcaaaatcaagattaaaagcatttctacaacactacaactttcttcttgatttaaacagggagtttggattggaatggaaagggaagtactttcataatgtcaggtcccaatcacttccacttcaggaaacactgtgccgttctgattgagtgccaggattcagaatcaacacagctatattgtattctgattctttcagtaccacttacaaaaagtgtgacttcagatttatgctgtaccaagcactgcccaggcagggaagacagatgataaacaattgaaggaaagctctcaggttctacatttcttaaaactgtatgacttgattacaaagcactctgaaatgctgggcaccagagcctctatgagggaagtaaattctgttactggtgaccagttatccaaagtaaaagtttgatattggtgtttactagcagttcttttccaactgggcgggagccttgatgtcataaagaggttggtaagctgctacatttaacaacaagacacaattttattagtctgttgcactaaattgtaacccaataaattgtattaggttgtaataagcaactcaggcatatttttgagtttcagcaggtccaaaactttatagagcagaaccccaaaaaaaggctttgttctctagaaaatgtcttttttaaagctttgttttattttttatcctcttgtcctactttgttggagggaattccacttccatatggttttagaaaatggagataatgataaaacttaaaaacctttgaaattctctaaataattcacagagttgctaaggattttaccttagcaactcttagtacataataatgtacttagcacagaattctcagtgtttggaaattccattttatttatataatgcaggcaaccatatttgttatggtagcctcttaagattctgcaactgcttctgagagtggaagctgaatcctttctcaccaaaaactaagacctgctacttactttagaatgggcaaggtatctatagagaacagcctgaggactgtaatggaagattctattactcaccgccttggtttagaactgttgtagaattcaaaggaacctagagctgacattcagagagtggtttttcctaaggtggttcttttgttcctagataactttaaagtcacgaaactgtagccactgaaatagtttcttcaaagtgtattgtaacagcttaaatacccctatccagcaacttctagactctagaacactagaggaacctaaggttttgtgggtttttttttcaaaccggaaggattaaaaacatttaaaaaaccacctctgagctgcttaagtaggtgttgagtagtaaatcaatctgaatctctttcatggaggaaactgggcactcagacccctttaaccatgacaatacagttctacaaacccagttatctagtttcttaacccttagcagattagaaacaatttagggaaaatatacctatgctatgagttttaacaaccccttgaagtgggctggacagagtgtagaaataaatagaaacttttagaaagcagatatgagggctcaaaagagccagacagtctagggtcactattacaggagcaagtggccccagccctctctacagtcaataaggctttggctgtgagatagtgtgttcatgctgggtagggtaataatgacccagagccatgaagaatgggccagattattgtcttgatgcattcttgcataaaagttccttgaaatgtgtaatttacagaaggcttgcttaacttgactggtagttaattgaaaaaggtgaagagagaaattgtgaaaagggatagatacctttaaagtatttccaaccctcccctgccccgccctgctgtgttcactgaaaaaatcatgagatctatacatttagaaaggagagcttagttcttataaagggctacagcctgcagtgtggcctgacaggctgggaagcacagcctcaggcagagacctttaatggcatcccagggaggagagggtagaacagagatttatactgaatgggttggccaagtatagtattcaacaggtgtgggaggagctatgaatattcaccaaggggggacacgtgtgcatgtgtaatgagcaaacgtgtgttttgtgcatctcgtgttcactttgggatggagacttaacatttgaatgaattacaattaggccctctgtcaaaaggtgaaggagagacatgaaggcactcagtgctcagcctctgaggactggtcagaaccagtctgtggtttcttttcaggagaaagttactccattgtccaatgacagctgcagtcatggcctgtggaaccagaggggtcagttagtcaagcatctggcagtaggtgagctgcaattgtttagatattccttatctctaggccagtgcttatttagctgctgaagaaaaaagaaccttgtggaaggtagaacatagtttaaaggtagcagtgtgtgatttaacccttgcttggcatggccttaggtcttgtttatgatttagtgtcatattgtcacagaatctattctgccagtcttacgatctctggtcagttgtgtttaaaccgcagaagggaggggatataacaggcatgtctgagctcccatctcatcatggcccggaactcagtttttaaggtttctctggggtccccttagccaagatttttatttttagttctcatctagagacatatgcatatgtattgatttgcaaatcttttgatgtagaataatgttgaattctcttttttggggaatgtaggttttgtgaagggagtgtcaccatcttggtttactccactcaatgcatcttttccagcctcattaaaacagcagaaactcgaagatactgttgatctgagcacagactactgagttttgtaattttcccctgggtcttgtgctaaaatgttaaaagtatcacattgaggaactgttctttagctgtctggaaagtctacttagatagtcctttaccactgaattgacaagatttggtaggtaacagcaaaagtgactgtttcgtgtactttcctgttctcagaacaagaaagtagaatttgactgtggggcttaaaaaataaaagtgtgttgcttcagtacaagttatttctgtgtaggtgttagtagatttatgatgtagccaataggataattatatcttgatataattatatccaactaattataattagttgggtcctcatggaagtagtgtaaataatgtacatacctaagtggtcatttggctttcctcttgaagactttgttaagctttatggtaaatgggttgtcttttgggaagtaagacatacataatcactgaagtcctgtgggtgcctgtacttgggtgaaggctaggtttgtaaattccaatttgaccttaagcatttgaacatagattaaatggaccttaatcccaaacgcttattggaagtttcggggtcaagaatgaatgtttgttttattttggcatttgtcttgatgcattcttcaaccccctttcctaggacatctaagaacaaagtttagattgaaagccaaggccaggcatggtggcttatacttgtaatcccagcactttggaaggccaaggtgggtggatctcttgagtccaggagttcaaggccagcctgggcaacaataatgaaaccctgtctctaccaaaaaaaaagaaaaaaaaaattagccagacgtgatggcgtgcacctgtagttccagctattcgagaggatgaggcaggaggattgcttgagcccaggaggcagatgttgcagtcagctgagattgaaccactgcaccactccagctgggtgacagagcgagaccctgtttcaaaaaaaaaaaggaagaaaaaagaaaggtgaccaggacttttgcttgtgatttggcagaatctgatagtggattctggtaatgtgcttataaacacccaaaaagcagctgatgttaggtggttcagcctctggaaggtgtcagctcatctgacagggaagttgagagcaataaagttattttgccaatgccctgatgaatgggaaatgctgatgtttccacttttcatttccaggagtataatgtctcaggaaggcgattatgggaggtggaccatatctagtagtgatgaaagtgaggaagaaaagccaaaaccagacaagccatctacctcttctcttctctgtgccaggcaaggagcagcaaatgagcccaggtacacctgttccgaggcccagaaagctgcacacaagaggaaaatatcacctgtgaaattcagcaatacagattcagttttacctcccaaaaggcagaaaagcggttcccaggaggacctcggctggtgtctgtccagcagtgatgatgagctgcaaccagaaatgccgcagaagcaggctgagaaagtggtgatcaaaaaggagaaagacatctctgctcccaatgacggcactgcccaaagaactgaaaatcatggcgctcccgcctgccacaggctcaaagaggaggaagacgagtatgagacatcaggggagggccaggacatttgggacatgctggataaagggaaccccttccagttttacctcactagagtctctggagttaagccaaagtataactctggagccctccacatcaagggtaagaggatgctgggtgtcaaggagctgttgaattgcccttgagagtctctcctccgtgaaacaaggagggcagcctagaatagtttctgagaactcttctttgtgttcttaactactttcaggaaaaaaattcttgacaggcaagtgcattagtataacagcagactgtttacttaactcaggcagagcgtgtgttctcaaaaccctgtagctcaaccccttatatcacttagcacgatgtttagcattatttaactttttaagatgaagcttgatgagtaacagtttatcaacaaggtagcaaatacttgacaacagtagtagttctccatgggccctggaccagcagcctcagcatcacctgcaacttgttaaaatgcaaattctcgggccccattcccgattcattaaattggactctgagggtgagatcctgcagtctgtgttttcacgagcccttgaggggattctactgcccagtcaagtttgagaaccactgcttaaaagcctggttttagttcctggtgaagaagaagaagaaaaaacaaaatagtgcctgagtgcaaatagatgtttcagttatggatcaaaagatggccttagtttgctctccttattcctcagggagcacctgcaggaggaagagcaggagctctagaatctgctttctggcctcaccactcatttgctgtatggattgttaacacaggacctaacattctctgaattttagtttgctcatctttaaactggaaatgcagaaaaatgggagcaaatatatgaagtaaccagtgtaatatattcacatggcagatacaataaacattattacccttatttcagatttttttcctgtcccatatttaagaatagtaatgttcactgtcagcagtgttgttctttttttatatatccagtatataattgtatattgtgtgtgatgtatacatgttggagtatttcatactgtagagtgttctacaggttgttttctttttgagaatctcttatcttggtactttgtcaagttttttgtttgtttgagacagactgacaaatatttagagaattttgccaagttttgctctatataataaaataaccggcaattagcaccaaggtattgtggtaacatgataggagctcttacatatattttctcctttaatcctcaggacagtcttatgagtagatgttacaatcgtattccttggataaatgatgcatctgcactttagaaaagtgcccaaggtcgtagagctggtaatgacattctggcatcagaatccatgctgtttgctatagcactctaccatgtgccataattgtagatggcttagaagatctcatggaggaagggggacttcaaaaggcctttgaaagatgggtaaaatttagaagggaagaaatacatgctggtgggggcaaatggaagaatatttgcagtttatctctgcaactctcccaataaggtagaaccttccttaacaatttttttgttgttgttctctgaaaatcgttctaccccagcatctagctcaatgtccagaagataggaagcactcaggaaatatttgccaaatgaatgagccagtcttaattctcagaggcagtttagtgggtatgagcgaaggtgctggagccagacagcctaggttcaaaccccgactgtacccctttctagctgtgtgtctgtgggcagcctcctaagaaggctcctccgatataaaatagaaataacagaccccacctagaaaatggatatgaggagtaagtaatggatgggaagtgccaagagtgctgcctggcatctaacaggtctccacagatgtggctgttgtaatggaaggtcacgatgatggtgtacttgctctcgtggtatggtttgagaagtgagctttcaacttacctaacataaagcttgaatgggtacaaagtgagacttccctagagatgaccaggaacaccaggaatgtgagttgataattgtgagtgcctctgtcctttcattcacaggccacaggtgctttccagtctttctggaaagtctttctaaactgtccacatttataaaatctttctagaaagtttttctagtcttgagttgggagatttcctggagagggacttgaatgggtacttggaggaggtagaagttcagagatctgaaaagaatatgtatcattattgtccatattgagtttctaaacttgatcaatcattcagtactgaagttgtagattttggttttgcattgttttataaaagaatgtatgataaatattaaataccatagggaaattttttttgaattttatgaaacattaaagtctgactttgtagtaactgtttagcttactgtgttctgagtcagatcttgattgtcagtgactgttgaatgagttagtagtgattattatgactagaggatttttgtgagtgtgaatttgatatatgttttgtcttctcagatattttatctcctttatttgggacgcttgtttcttcagctcaggtgagtatacctttaagctgttttttctttgggtgaaagtagacaggtaattaaacaactccataagaaaatatgagaggcatagtttggggatctcagtcctgttcaaagactgagatggcacatacctggaggctggctcaagtgccacagtaatgagatccatggccatcaacatagaatggggatgtcactatcaggagagcatttgactcaagtcagcctccgctggccaagaagtcactttggacattccagcttgaaagactagaatgggacacttcttttggggatactgattaactcatgggactgagttaactctggtgcatagagtggtgaggtatggatagagtggtgaaggccaagtcaagtttgatttaatttagaaaaatgtgaattttcatgttcagtggctccttcctgactgagctagtccctttgtcttgataaatcatgtaatggtccagacccacaagtaagtggtccaaagggccctgtccctgaagaaaggcaggcttcctttatgtttggtttggcattgaaagtcctggtttccatttggaaggtggggagcatttgcaaatgccctgttagctcgactgagttactaagtccaggattacccaggtatggggaggagcctccacgggtaagaccagtacagaacttgcatttaagatgtaattgttagaagcctagtgaatgtctggtcccaggtggctgtgtacaaagctagctaataagttagcctgaaaggaaatgttcttttctgaaagtcctgggatctttgtctccagtatctgtctttttataatcacctaggggaaaagggataaatttataaatccttttatttaaattaatctcagggccattagacataatgtaataacaccctgcggacaagtacagatgctgccaaaacatgcagagataatttcctgggaacctgttatctcatgtacttggctccatttaggttcttttaaccatgcatttaagataaattataggtttgttagtattgcagcataaccctccaggtttataaataatacatgtagtgtatcactattttagagtttccttaaatgtaataactaaacaattctccttatgaactgtttggcagaattacctatggcttagttactcttcttttctcccatctagtttaactactgctttgacgtggactggctcgtaaaacagtatccaccagagttcaggtgagttcctcagggtgacagacaacactataaactgtaaaggggctttgacacctaagatttgtatttctcaggtgaaagccactcatcttttgagtttttcttttgaaactgttgaaatcacacagacattaagttatatccggaaaacagcattctttgatctatttaatcctacacattctttttacggattttagcattttcctctgtgctctttcaggaagtagataaggacaggctttaactcaaataacagaatttcatgtccagtcttaatatgaaggaaaataccatctccacataccttctagatctgtgaatgtgccaacatgccgccaacgtgccatgctttccgtagcacatcaattctgttctgttttgaggatccctttgtgtttctgagatgaggaaaggaggcttatctgtggccttcccttatctaggctctggaggtgatggatttttaggccttctgcctgcacttcatcagcctcatgttaggcaatacagaccaaatagggcatcacacaggtgccacccttccctatttctaacacatttacggggcagattcccataacagcaagtaggatggaggaaaacacacaagaaataatgattgtcagggtcctcaaaattcttggtacatttagggcatcagattgtggaaacctttgacattaacagtagataaaatgctgttaaaatttttcaagcagctttggcacttggggcttttttttttttttttgacctgtaacacacagaattagttttagctgcatgtaaaagaatattcaaaataacaatggcttaaataagacaaattgtttccagcgtgacacattcagatggtaaacatttatggtctagatgggggcaccagggttctcagagacttatccacctaccctttctgttccaccatccttgtatgtgacttcagttttcagagtcacctcgtggcccagtatggcagctagagctccagcttactcatctattccaggtagcaggaaggggaaaggaggaaaaggacaaaaaggcccacattctagctatgcccatctaagcagccttcctggaagtcccacacaacacctgcatctatttcattgagcagagctcagctgcatgctaaccagctgtaaaagaggctagaaatgtcttttagcttagcacaccttttcctgaattagccttttgttagggaaggaggagagaatggctgtctggaggcaacaagcagtttctgccttggctcctcctcgcagtagtatccttgggtgtcacattggcattttctgttcttcctcccttttcttaaagaccttgaaatcaaactgtcaccccattagagtgttggcaaagtgcagactgcagttcctttgtatctgttatgagttaaattatctcacccccaaaaaagatctgttggaatcctaagcctcagtacctcagaatgtgatcttatttggagatagagcccttacaaaggtaatcaagataaaatgaaggcattaggatggacattaatccagtatgactagtgtccttataaaaagagaaatttgggtgcagagacagagataagaccatgtaaagacacagaacgccatttacaagccaagctcctagaagctgggagagaggcttggaacagatgtgcctcacagcctcaggaaccaatcctgccagcaccttgatcttggacttctcgcctccagacctgtgagacaatatattgctgttgtctaagcctcccagtttgtggtgctttgttttggaggccctggcacactaatacagtatccactggactctcagtaactaaagggacgaaagtgtcctccttctccctgcatccccttattgccaaatgcatcttgggaaggctattacgagccttagaaggatgaggagtgacctaaatggtaagtttaagtaacatccagaatttgtatgtagaaaaattcagatcataaggatttatacctcagtatgctattgttcaggtgccatctttttgtaataagtcgtagaaccaataaatttgaaagaattaatgaggacttcagtttctatcagtcatatttaatctttttaataacatgacttgatctaacattttttatttctaggtgctagatgcacgtgtgtttcttacattattctgtttttcttacctaatttctaaaaatcacaggtgcgtgtttcatagtttcattttacctgtcatgttagaataaagctattgggcaagaggtagtgaggtattagtactggaaatagatgtttctctctagttgattgttgttcctttgtgaatggtagagaatcattctgcagtgtgattgataaatgtggaagtgggtcggttgtttatctttcttgattgcttatatccaatttttgttgtgttgggagagcttgtagaaatatacttatttcttttttttttttttttttgaggcggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatctgcccgcctcggcctcccaaagtgctgggattacaggcgtgagccaccgcgcctggccgaaatatacttatttctaaggattatcttgctttgagttaatcagaacaagaatccctcaaaagcctttttaatgtattcttgaagagtgtttttatattatatttggaattcaaaaatatagcattttcaacgtagcttgggctctgtttcattgaaatctaaccacccattagtgaagctgcgtcatgctgtgggcctggcctgggcctgttctctgttgtatcctgggtctagctcagtacatagcacacaggaggagtttggtgaatatagatgtggtgtgaaatgaatccaccgtgtggtccaaaagaaaaagcaaaaagcactatattatataataattattatatatctttaatttatttggacttaaatattttaacacagaactacttatgtgccgttttgggccaaagaagataattattcaaggactttcttgagtcattacccctctgtattacaacagagctgcagaatcaggccatgtagccccattataaaggtatctggtaaatgaacattagcttttcactgctctgtgttagccctgtcttcattcaactacaaaggccggaaacatatcgagtgataaggaagctagcattccttaatgaggcgagtccagcttcatgaatgatgtattttaattaatttatttatttatttatttatttttgagacagagtcttgctctggcacccaggctggagtgcagtggctcaatctcggctcactgcaaccttcacctcccaggttcaagcgattctcatgcctcagccccagagtagctgggattacaggcacgcacaaccatgccttgtctaatttttgtattagtagagacggggtttcaccatgttggccagtctggtctcgaactcctgacctcaggtagtccacctgcctcggcctcccaaggtgccgggattacaggtgtgagccactgagcctggccatgaatgatgtatattaaatactaatgctctctttttaggaagaagccaatcctgcttgtgcatggtgataagcgagaggctaaggctcacctccatgcccaggccaagccttacgagaacatctctctctgccaggtaagccacttactgccgttggagagcacgcgtagtctgagttagaaggaaacttagacatttagtccaccctctcacttagtgcagaaatcctctctccagcatcagtcatcaatagatatttgtctagcctcagcttaaacacttcctgagatagagcatcccattcatagtactcctcagggttggaaaggtttttctttttgtgggcctgaagtcttcttactaatttctactcattggtcttaattttccccttctggagccacacagaataagtaagtctttcatcttacacatgtcagtgattcatatatctaaagtgatctgtcctgtctcccttcgttttctctctttaattcaaacattctctttcttcagttttactcaatgtagtatggattctgagtctttccgcaacctgctagtgctcccctggttgcatgtagcttgtcagtatgcctgttgaaacctgggtttcaacactgaataggtcctctggatgtagttcagtggctgtgggtttctttttgtgagtatcctgtgagtgcaacttaaaacttgtagttttttgtgacaccttatgtaacttatattagctgccattgacacttcaacggtagtccttcaactgtagttctttttttttcacatgagttgcatctaaggtctaaacaggagagacccatagattaaaaaactgttaggaaactatgtgagtcgtatgctgtgtatgatctaagtccaatgtggagacattaagtggtcttgtaacaggcatatccacttggtttgctaggaccaaagcaaagcagaaaagaaagctatgttagtttgttcttgcaccgctatgaagacatacctgagactgggtaatttataaagaagaggggcttaattggctcacggttctgcaggctgtacatgaagcatggctgaggaggcctcaggaaactttcaattgtgacagaaggtgaagaggaagcaggcacatcttacttggccggagcaagagggaagagagggggaagagctacacacttttatcaaacaaccagatatcatgagaactctctatcacgagaacagcaaggaggaagtccacccccatgatccaatcacctcctaccaggcccctcctccaacattggggattataatttgagatgagatttgggtggggacatagacccaaaccatatcaaaggccaagaaacggttattgcccagtttctttatatattcccataattttgtcctaatactttgcagttagcatacaatgtggccagtgagtcttggactttcattaggatccatttctttagactcatcatctaaaaagatcttctattacacgtggcgcattttgagcaagaaacatgcaaagtagaaaggaaaacaaggaatacagaagaatttctcacatttatgataactacttcctatagaaatggtgattatgaagtagctggtgtaatagtcaccttttcctatttcttttggctgtattcgtttgttatgagaaaacacgaaagatgctttttatagcccttttctttccttatcgttagcttagtgaaattggcaaaagatttctgctctgcaagtacagagacagagtgaattacatcctttctggattttttttctcattttccttctagtgtcttttttccccatccacaaagatgtaagaattccaactcatattgtatcactctttttccaactatatatgatatctttgtatttttttaagattaatacagtacaagagctcaatcttgttagtttaaacatacctcacaacattttccttatgatttaacccactgcactttatagagttgtcattttaaaaatgccttctatccaacatgggctcatctcatgcccatagatgtgcctttgcttcgcagttgccaaaattccattgttttgcttctatttccagcaacataagaggttatactgcagtaggatagctcccatcaaaccttatagtgggcagaaagtaaactgacacagaaatcctgaaaaccagtgactaaatgaatggaaataaagtctttttcaaatattacctacctgtgctcgtttaggagagtggttcctgtgcttgatagtgtgttccaggctggccaccagagggcatagtgagccacttcttccaaacctcttggaaagagctgtgaagaagctcccaactctaggctgacgtacaggattgtgtcctcctgatctcttgaagcacctttataccttgtctgtaagataaagtctttttctagcaacgtgagtcattgaaactgagacacattagtcagagaatcggtggctgctgaccctctcccattttgcaaatgtgggacctaagggcagacattgagaccttgtggtggtcagagtcacattgcctgggctcagtcccggctctacgtgtgtgtattagtctgcttgggtgctataacaaaattacctgggtgacttttcttggacttgggtcgctgaaacaacagacacttatttctcacagttctggaagctgggaattcaggatcaaggtgccagtcagttcagttccaggtgagggctctcttgccagcttatagatggccacgttctcacggtgtcctcatgagggagagggaggaagacagacacataggctgtctggtagctcttgtataaggacagcagtcctgttggatcaggatcccacccttatgacctcatttaaccttaattacctccataaagtccctctctgcaaatagtcacattggaagttggggcttcaacatatgaatttggtgggggacagaagtgtttagtctacaacacttattctgggcttgtcactggcttgtcacctaatttctttatctttgaaattgattgctaatgctgttcatcctagagtttactaaaggacttggtgcactagcccaaaaacagcacccagtaaacaatatctattgaagctattatccttgttttttgtgcttagacttacccagaagcatgtaacttttagcaaacgaaacaaaagccaggtctcttgaccattgttctttctcagctaaatatcagtttatagagtggcagtcttccttctcatttggtaattttgaaaacatgaaatagagttccctgcactttcttctgtggccagaatgcacagatgcatgctggtctgtgagcatctccattccaaacaggagctgtgttgtaactcacctgtgtattccagtcgcccattactgcccccagcaaagtttcacccatgtcatgtggtaaggaggctggggtaggtagtggggagaggttgcagtagtgattgccacgattatagagtgcctattgcatgcaggcccccgttgctcagcattttacatatgtgatctcgttcctgacaactctggatctcagaatggtaccgttttaaagaggagaaagctgaggcatagagttagatgtattttccagagtcatacaaagttgtgaaggcaggatttgagcccatgtactgcgttcctaattgtgaaacttttacggttatttaaactctttcataatctgcatcttgtgacatattctgcttaaccaagatctggcattagtgggtattagataacatgttttctatatacataccctccattagtttgtaaaggtgtcattttataacatgaaaatggatttcatatgtttttattttcagcacttgctatgctaatataagaacatttctattttaatttaacatcctaagtctttatgttgccaccactttcagtgtttctttttttgtttttggagacggagtctcgctctgtcacccaggctggagtgcagtggcgctatctcagctcactgcaagctctgcctcctgggttcacgccattctcctgcctcagcctcctaagtagctgggactacaggcgctggccaccacgcctggcaaattttttcatatttttagtagaaacggggttccactgcgttagccaggatggtctccatctcctgacttcgtgatgtgcccgcctcagcctcccaaagtgctgggattacaggcgtgagccaccgcacctggccttcagtgtttcttttaaatatgctctgaaaactgtgtaccattaatttctgtataagccaaatatctaaaactttgcatagagactcacttgttttactagttttttgtcaactaaagaatttaggcttctcagtcctaattactgtaattaaaaatgtagtatatattctgtagtgtataatcattctgggtaacaaaatttgtgttttttttttttttttttttaatgagcgtccccagatgctattataaaagctgtcttgttattcaagggcttgcctggtagagatcagtaaaaatagttttaaaaaaaaaagttgacctgattgctttctaatgtaatttccagtagatatggatattagtgagttgtttttaaataaatgacttctttttcatcctaggcaaagttggatattgcgtttggaacacaccacacgtaagcactttttgtgaaataggggaacccctcaagcattgtcatttgtccattacacggttattcttaggagagactgagcatggtaggcccacctaggatctagcacagcgatgcttaactgagcctgggggagctattcttttatttaatgctcttataaaaattatttggtctttccttttaattttatagatcaggaaactgaggcccaggtttaggtatgtgatttttccttgggccagtagtggagacaggaatagaacctatttattctaactttaattaatatatacacacaatttttcaagatgtggtctcactctgttgcccagactggagtgcagtggcatgatcacagctcactgcagcctccaactcctgggcttaagcaatcctcccacctcagcctcccgagcagctgggactacaggcacacgccaccatgcctggctaatttttttgtagagacaggggtctcactttgtgacccaggctgatctcgaactcctggactcaaacagacctcctgccttagcctctcaaagtgctgggattacaggcatgagcccctgtgctggcattaactttagctttaaatttgttcttgtttgctcattgctaaaatttaccttattatttcctttggtccattcaccactaccccctcgctcctacacacatactttgcaggttaaactcaacagagctcttttttttttttttttttttttttttttagacagagtctcgctctgttgcccagcctggagtgcagtggcacaatcttggctcactgcaacctccatctcctgggttcaaacgattctcctgcctcagcctcccaagtagctggggttacaggccactgccaccacacctggctaacttttatatttttattagagacggggtttcaccatgtttgccaggctggtctcaaactcctgacctcaggtgatccaccctcctctgcctccccaagtgttgggattacaggtgtgagctaccatgcctggccaagagctcttaattcagagtttaaaatgcctaggaggctgggcgctgtggctcatgcctgtaatcccagcactttgggaggccaaggtgggtggattatttgagatcaggagttcgagaccaatctggccaacatggtgaaaccccatctctactaaaaatataaaaattagccgggcagtagtgggacatgcctataatcccagctacatgggaggctgaggcaggagaatcgcttgagcctgcaaggcggaggttgtggcgagccaagatcatgccactgcactccagtttgggtgacagagtgagaccctgtctcgaaaacaaaagaaaatgcctaggaaagtaattacagttgaacttttcccaattaagtatctgtagtttacattttgttgaaatgacattatcttgtagaagattgagctcgtgtcttgaaattacttttagttgcttatttaaaaaaaaattttttttttgttgagacagtctcgctctgttgcccaggctggagtacaatggcgcaatctcagctcgttacaacctccgcctcccaggttcaagcaattctcttgcctcagcctcctgagttgctgggactacaggcgtgtgccaccacgtccagctaatttttgtatttttagtagagatggggtttcaccatgctggccaggctggtctcgaactcctgacctcaggtgatccacccgcctcggcctcccaaagtgccgggattacaggcgtgagccaccgcacctagcgtatttttaaaatgttttaagaattaaatacttcttatgttcttgacacagctcaagaggatatagagtttttattcttacagctttttctttggtgagagaagcaagacaaacatgtgaattagaaaaggagaatcaccttccagatcatagtgatggagggtaaactgccttccccacctcacagggtagagctagaaacagtgaacgaggcagtctttgagactgcatacactttggcacacaagccctgctctgtccagttttggttggatgccatgcaatcccgtggtctgtctcacagtgttttagaatgggaaagctctttggtttcctctagagctgggagcagagttaattcttatggctccaagaatcgatagaggggaaagagaaagccaaagcagctgaatgtcaaatatccagatccaggtggtggccagtagcaaaccacaggatgggcgaggcatgcctctttccactaagatctgtagtcaggcccccaccatgcatcatttagtcctctttcccaccaaggccatgtctccccccacctcacctacccctgtaccagtagcatgaagtgttcaccgttgctgccaccagccctgtgaaaccatgtgtggtgaaaggagtgccctggcatctggcatttgtgatcccaacaagctcttccgctggcccactttgtgaccttggataatccctgttaaatgtccagctgtagattccacaattgtagaatgagaataactcctcttctgtattgctgtgaagacttggtgtggtaacatacgacagagcttctaggatggcacctggtagagaggtgcttgccatatgttagttctcttccccctttgcaggaatagctgcgcatttgggttgggtcccttttgctgcctcacagcttagcagacagtatggcaggtcagcattcttcaagggagatctcattcctcacccttttctatccatttttaactgtgaccttattaacactaccattttgtctatgaaaagatgaatatggctactctcaagttcataattctatttgatagcattcattgacattagtgtgtgatttgcctgataatcgatgtcttgactaatggaaatatttgtaaacgttctatcatgaatccataactgacttattcttaattacaatcagctgctgatttggcaactgtgtatgtaaatttgcccagatttcagggagcacatttcacaaatggaaagaagatggcacagcagctgtcatttctccagctttgcattaatttactgtttgccagcttgggttaatttctcgttttggcaagagctaaatatctcattctcttgtctcttctcgtaccctttttcttatctttttatgataatttcatcctgcccagataatgttcatgttgtttatttggagagagccagtggttcacttttttttgccatgtgtgaattgagtttcatcagtaagtattaagtagcattttggcctcaatagaaatgataaaataagtcaagacagagttacagccatgagaagtgacactttagttggagagagagaacttagattcctgaaatattgaaataatcctattgaaaacaacagggagataaaaatcatccattattagatgagaaaataaagctgtgtaccaaaggagtaataggaatgtacaggtgagagtgtttcacatttaacaatttttttttttttttgagacagagtttcactctgtcacccaggctggagtgcagtggtgcagtctcggctcactgcaacctccgcctcccagcttcaactgattcacctgcctcagcctgcttagtagctgtgattacaggtgcccacgaccacacctagctaatttttatatttttagtggagatgggtttcaccatgttggcaagcctggtctcaaactcctaacctcaggtgatctgccagcctcagcctcccaaagtgctgggattacaggcatgagccaccgtgcctggcagcaaaatgtatttttgcatttcactcacaatagtcctgaagtggggttgatccttagagatacaagtggaaaactgaggctcggggacattgaatggcttacctagggtcaaagggcttctaaatgacaaagtctggagctcaggtcttcagacttcaaatggaaagcttttatctatatcctattccctctctctcactgcaattaaaataagagaaatgtgttcgactagaggcctggggaggtcacatggaaaaagagtggaccccactaagtctgatttgggttaatgaagaataggcaagacttaccccaagcccagataacacacttttgacaagtgtggcatctatggatacaaaaaaccactaatggtaatgaagcatcttttaaacttcttaaaatttcaactcataataagaaatacactttacatttcagtgtattgtgcactaacatacctttgtgccaaaacaaaatttcatgaaccagtaattaaatatatacagtataccaatttatgctattttagttgtttaaaaaatgccagccatgatgcagcaagaggttgttgaccatactttgaatctcaaacaccagaccagaaggttccaacggtccctagtagtaacaggtaatgctgaatagataataaggggccaggctggagggatgtgaagtgccaggactggcactagggttgaaagttcttttaccaccaaatactcaacctttctgaaaggttttcatcctatcacttaggcagactttcatcatggtaatgtatagaagggaagattataaatgttaagtttgggtaatatgagagtttaaaaaaattcctttagctatgtattacatttgcattggaaaggtattacatattttgaaagtactattaatgctttttgatcctttgctgtttttaaaggaaaatgatgctgctgctctatgaagaaggcctccgggttgtcatacacacctccaacctcatccatgctgactggcaccagaaaactcaagggttcgtaggggcctgctcacttcctggcagtgtgtgtgttgataaaggtcaaaagccagaacattcactttattcttttttctattttttttttaagttgtaaaaataacacacatggcctagaaaaagagttgtatgcagaaaaagttactgtattcttttactacctgccccattctaccttcttggggtaaccagtgttaacaggagcatcatcatccacagctacctctgctgtacatgtaaacatacattactatttacacacagtagtctcttcctagtttttagagaagtggcatcatatacactctacagctaagtagagggcacagcacatgcagagatctgaggcagaaaaggggttacagaatgaaagatctgaacctattgttttcctagtaggatttaccagatagcttttgtgatttctccttactcatgtacccacctgtatttttgcttaccacttcccaaacaggaatcaaaggaaaagttggggtagggcctggtcatgttaatagtgtgctaaatatttccccactcccccagttggtgtattttctttgaaacaaatttaagctggtgtctttttagagcctttagtgtgttaataaagttgtgaatctccaagagaagaactgaatacgaaagcttttatgaactttttaaactactaaccctctgtacttggtgcacatatgctagatccaggttttgatccccttttcaagaggggtttgctttttaaaagggagctttagggatttgctcaacaagttcagctattgttcttgattatgactaactttaattttcttttgtttaagccattttgtacatctctgcctgtgctagagaagagctggttaacaaacagccttctgtgttgggagaaactcggacgtttgtctagcaccatttccaggttcacgttttctctgtcatcctcctctgcctcaccctgccccatatcattgcctagcttgggctagaactcctaatttggagtgtattactttcagctaagctctgctgagcccaggttacatctttgttttgtttgtttttttgagacggtctcactctgtcacccaggttacaatgctgtgatgcgatcacggctcactttaacctcaacctcctgggctcaggtgatcctcccacctcagccttctgggtaactgggactgcaggcacgtaccaccacacttggctaactgtctttattttttgtagagacaaggttttgcctagttgccaagtgatccgcctgcctcagcctcccaaagtgctgagattacaggcatgaaccaccgtgcctggccccaagttacatcttagtttgagctgaaatagctttccagtttccttcaacaggtcttgcttcaacctgagtgcactgcgcaggacaaatgtaatctccctcccttaaagcagtccttcagagtttgaaagggagtcttgtttctgagccttacatctcttgttccctccccactcccttgccccaccatagcatgtggctttgagacccctagctgtaattcctggtcgcttttctataaacatgttataatttttcagtatcccactgaaaatatgcttttcaaaatgaagtgtggctctgactggtccagggttgaggggatagctgcttggtctctaagtctcagctgtagcactttcttgatctactgaatttatggttaactatgcctttggtaccccaagagcttctaagccagttctcctgagctgccagattgggtttggggattcatgtggccctatcaaaaggcaatgagattaatgtagcttgttctcatgaaacaatgttactaaagggatttctcaggttagctctcagcctcacgtggttccaagaatcccaccctgggcctccagctccttctgaagttggaagcttagcttacaggcagtagtactgtcttgggattctctggggtggttgccaggagggaagaggcagggataagggcttgggtgtttcttttatttaaaaaaagtattttttaatttaaaattttggaaaacttattgactaggtaggaacggttcaaaactcagaaagtaccaagactatgaaatcttcctctggcagccatcctggtgtgggatcctattatttcatgcttggcctatattctactctctaatgttttgcatttcatgttatttgtggtaattttaaaacttttgaaagcagtttttgtatacaatctcacttcataattggtctactgtggttctgctaatccccttcagctgcctcatgatccacctgttgatttctcactttttaaaattagaacaagagttgcatccaaagctcacagtaaagaataaaataaaattatttggctcattataataattttctcattttgtgatgtgttaaaaatgcctcatatctcagcatcttagtttagaaagtcatttgtcttgtttctcatccagaactcacctgtgagtgaatctctgatccaggaggagcctcactcagcctgggaactttgaggtgctattgcaaggggaggtcctccacgtctgtccagcccaacctggtcattttacacacggaggcaaaggcccagagagatcacagagcttacccaaaatggtatagtcagctagtcgatctgggtccagaacatgggctccagccctcatcacaccatgctacctcctgtgctaagtgtctccccagggtgggaagcaggggtatgaaatgccccttgctagaaacttgcagagttgagaagatgtacggccgagagtccttgcagttctggatgccttctgccctggtggcctgcatcttgccagtctccttcaggggctgccaggtgaaagagaaattgggcagtttctctttcagcttaatagatagaacccagggtggggaaaaggagagtagccacagaaggggaaaaaagtaacacctgatacttttgactgctcctgtaagtcattgctttgcaacagcccagtgaggcagccttgttaaccccacttttttgcatttgaagaaactgaagcacaagaggtttgaagccattttagtaatctactgtggagcagtttatagaaggattgggattagatatgattgttttctatttatggatataatgtagaagttttggcaaagagcattgttttcctctagggaaaaagaattaatgaaatgaaagatgtctgtaatgcttcttcagtgaattaagtgttgaaagtttgaggttattgtaatgtcactgaatgtgatatatacttaatccaggcaccagaaagtataagacataaaaatatgctgctataggacctacgttatgaaaatgggtttgttaattgaaaatagatttttcacatgcacttttggtatagataacacaattcttatttcacatttggctgaagagctgcattgatgcagacaagggcaaattcttgcttgggattaccactagtagcatggatttgctttaaccgttaagagtagaattcttaactcttgtcatcaagtcttagaaagcaatatataggtgcagaggtaagaggagcaataaggaaggtttggcaagtgagagggagcatggagggatgtgggttggaagaggtgggcagagcccaggtcttactgaatcttaaattcatggcaagacattcaggaataattctgaatgtgatgagaaaccattggagtggtgttctcagatttatgtttcatgtttcctaagattacttaccatgtggagataccgagaattcacctctttcttaggatgaaggcataatcgatacagagatcattatgatcagttgtgtgcctgactgttaaaggttatttttttaattccagaatatggttgagccccttatacccacgaattgctgatggaacccacaaatctggagagtcgccaacacattttaaagctgatctcatcagttacttgatggcttataatgccccttctctcaaggagtggatagatgtcattcacaagcacgatctctctgaaacaaagtatgtgtcagcttatcaatttggggtgcttatgataggcttataccttgggagcctcatgaggtctggcatgcaggggcctggaaagaggtggggtgaaatctagccaagcttcaggatgtgatgaggggatgagcagattctatcacatctgtatcttgtggttctcaggcattaaagtgacagccagtgaatcctcatgtttaccttagcctcccactgggttactctcacaattattgagttctttgtctggtactttacatcttgtaggcattccatcattagttgatttgcttgaaaatgaatttgagagtcaattcaagaaaatggattggctcttagatcatttcttgattatattagttttcatgtgtattttgtcattttttttggtgcccaaagcacatcactatattttataacttgtgtttttatgtctttttagtgtttatcttattggttcaaccccaggacgctttcaaggaagtcaaaaagataattggggacattttagacttaagaaggtaacagaacttttactattttaacatttttaaaaaatttaatgtatattctctcttttaaaataattatatattttgatgcagcttcacaatatttctgcacaattctgggcaaatagatacttgataaattgataattataattcttagtaattactgctttttaatgtgttttgcctcttttatagctgtaggctgttaatggcataaatatatagaccttttctagtttttatattgtaataaagatagaggcttcctattcatacacatactgtagctttgattatagcttttgattgttcagcatatcaagttttaagatataaattcaacaaacagaaaatgttgagtaaagactacaactgagctataatatattttgattattaaaccagtgcccttaagaaaacaaattcaaaaataatacttgctgctgatatgaaaatgcacgaagaaaggtcataaaataagttgaagattaaagtttttttcatctctttttaggtggtttactgaccttaataaattccctggccaggtgtggtggctcacgcctgtaatcccagcattttgggaggctgagaggggcggatcacaaggttaggagttcaagaccagcctggccaacgtggtgaaaccctgtctctactaaaaatacaaaaattagccgggcatgatggcaggcacctgtaatcccagctactcgggaggctgaggcaggagaatcgcttgaacccgggaggcggagattgcagtgagctgagaccacaccattgcactccaacctgggcaacagagcgagactccgtctcaaaaaaataaataaattccctaaagtggctttcttaaaagccttaacctcttattccataaactatttaaagtctaagaattttcccttggttaatgaaactttttattttaatttccttttatgaaatgagaccacagcttaaagcaggcaagatcttgaagacatctttatgtcttggcctagagaggaagttcagcacattggcctgtgcccagtcttggaggcagatatccatagctgggttcaaaccctgctttgttatctacaagccgtgtgacctcgacttgttccttaacatacatcggttgtcatctataaagtggacataataatagtacttccctcccgtgattgtgaggattaaatgaaatgatgaatgtaaaatagtacagggcacacagtaagtcttcagtgcacatacacagttgtttgtggacaaatgtctaatggtttagataggctagataatagcacgtattatgtgtgatcaccatctgatactgaaagttcaactgtatgttaagagttttcaaaccactttttacacacagttgctcatgttgcaccacagctttcttccaggaaggccggccggtgattaggtgcctgtttccactgaagtgtaaatctaagccagaggcttgtccaggatagggtggcccttcaggggctgagcactgcagtagaaactgggtgttgtaagttgtcggttcagctctgtttcctacaccatgctgtacccaaggtggacatggaaactttgggctttttgggaagtgtatgtgtaagtattaatgcctaacctgtgttaaggaaaataatacatattaaattaaacaaaacgtcagtcagatgagctacagtttatttttctgctctctccagccctctaggtaggcattcagtacatatttaagtggatacagtttccaaatgttttcttaattgtttctgcagctttgcataattatcaaagcaggaaatgcagatcagtcttctgcagtgttttagctggtatgtgtatgtaaatattctcttttatgtttagaccatcacagctgcctggagctcaagtgttaaactatgactgttaagcctctttcaaatgataggagtcaaaatatgtaatccttctaggtattgtttaagtgttggtagcaaaaaactcactttgtttcctctgctctcacactacaacagtcaacacagaaaactgtgaccaaatatgtgtggggttttcctcatacactaagcaggggacaccagctgggtgtcctctaattcacttcagttcttatgctgtcttcctggagatgtataaagaaagtgactttaaagaaagtgatgatataaagaaagtgatggtataaaaaaagttattttttattccaaagctggcttagaggaataagtacaggcttcctgtcttaaggatactgctttgctcttggagcagaaagtggacacttttaaaaggggcctagcatgaatggcacgcagaggaggaagcaagcaggtggatacttccttactttctgccttctctaccaggcagtccatttggtctcttcctgggcagaactaggttgtaaagatggctgaaactctccaggtgggagagtttcttagtgggcatactttgggttgtaaatttactgctgtccctcgaggcagtcccctggtgggagaaagttctgctctggagcttctaagcacatagatgaacttgccctgtagggagtgtctagtaaaggaaaggtaaaaggttatattgtatttctaaaggtctaagtaggaagtggggaaggagttggggaatagtagggaaaaaataattgaaaaaatacattttttttaaagaaatatgggggtagcctcagatcccatagattgagggctccatcccacaagactgcccctctccctcagacaccagttgcaagtctgggcctccagaacttctgactgaccagcttcaagttgaggttcccatgaccctctctttgggcttcatttgctagagcagctcgctgaactcagggaaacacttaacatttactgctttattataaaggatacagatgaagagatgcatagagcaaggtataggggaaggggcacagagctttcatgccctctctggatgcaccaccactgtccagcagcccgcaggtgttcagctgtcggaaagctccctaaaccctgtccttttgggtttttaatggaggcttcattacataggcatggttgattacatcactggccattgctgatcagctcaacctttagcccctcctatccctggaggatggggggttgtgccaaaagtcccaatcttctaatcatgccttggtctttatcgtgaccagcccccatcctgaagttgcctagggtctgccagccatcagtctcattaacatacagaaagacttcacattggagatcccaaggattttagtagttgcatgccaggaaacagggatgaagaccaaatacatatttcatagcatcaaagctgcattaaacacttgtgatttcaagtaaaaaaaatctaatttcatatgacaagttggtggtttatctgaaatttcttctgaaatgggcctttttaaacctgtttttgcttttagtacaaatcaaataattttggaaaggagaacttctgtccatctactccattaaaaatatgtttttagtatttaaaaaaaatttcccaaagaagaagtatgtatgtgtgggtatgaaattgatcactagtattttcagcttttcttgttaattaggctttccaagagcagaaaactgttttcaaatattgcagcatttctgttaagattatttgagtcactttaacattcacttttattctttcccagcttctgaaagaccatgcctcatccatgcctaacgcagagtcctggcctgtcgtaggtcagttttcaagcgttggctccttgggagccgatgaatcaaagtggttatgttctgagtttaaagagagcatgctgacactggggaaggaaagcaagactccaggaaaaagctctgttcctctttacttggtgagttctcgtcctcattgaggtagtttacttttattctctacacaggagaagaattgaaaattggtcctctttgtaatggagagatgttttattctgtgattctttttttttttttggcgtggcgggggcggggtgcggaaagagcagtacattagcatcgtcatttgtaatcaagttgcctttgccttaatatccagtgctaagagcttgccgattcgttcaggagctccattgcagacacagactggcctgtgatttttctatcctttctttcaggttgttgaaccaaggtagaaaatatttgatgtagcacagccagcagaattatgggcattttaattatttagagaactgtgaattaataattaattttccattcaatgttaacttgaatttcaaaggaaaaaatactccaattgaagtataattttacatcaaatatggttcctgttgtttaattactagttcatttttttcataagatgagaacttttaaaaatttaaagcatattttctaatttaaaagtatttttaacagattttcatttccttaaaagctgattatcattccttttcttcaacatggtacattccgagttttattgttttcctcttatttttagatctatccttctgtggaaaatgtgcggaccagtttagaaggatatcctggtaattcttggggagactgtcttgattgtgttttatgtatatttcatgaatgtcctggtaaagttttactactattgcgtagaaatttggagatggttttcacttaactatataaggatcatgaaaataggcaatatgaagctctgcattccgcagatgatacccttcagtttgggtgtgttattaatccttacagaaaccctctgcacaatagttttcatttttaccagtaaggtaaccagcaggttggttgtccagacaagatagccaaataaaatcagcttccccttactcttcaatgcgttttcagagcttatccaacataccttcctctcatctctgcatatcctcccttcctgtgtttgaggtaccatgtggtccttttaaatgcctgctatagataacatttaaggtccggaatttttaaaattttgcctttggtataactttgttgatatgtctattctgtcaagggtgtcatctgcaaatgcctaagattttttgtaggcatctgtcaacgctgtccctttcccttatactcataccaggcactaaacctttatttagaattcagcagccccgctagttagtgtaatcaggagatgttaactgaaaacccacatagtggttgtctctggaaaaagcaaagtctaattggcatttgttgatggctgaaagcagaatgcactgaattaaactaatttagtccatttattgcttatcaggctcaataagaaaaatctgccaggaaaatttcgctagcgtttggagtgtattagccctttttttttttttttttttttttaatggcaaaaccaaaattacttcaccgagacccagggatacagtggtggtttttctttggtactctttttgtgcctctaataggctagattcattcaaagtgtacttttaatgggggaacaacatggtatttttaacaaagttgttttataactggctttgaaactgaatgtttttagttatttgaagttgaagacaggacatgccctatttgatatgtcagagatgtttggatatagatctctttgggtgtagatcagtgtggagaagttccagcatgtgtgtggaaagtcactgataatccactgtggagttttcttcattttaaaaatgagcaagcattgacttctaattgtatttccacttggaactttctttattctctttgcaagaataaggcttttagaattccttttttcaaactgaactgtttactgaacgttttgttttttagccattcttttctgtttgtcagaatctgctcagccagtacaaagtctgtttggaaatagtgtgtaaaggtgaagtagaaggggcactgacatcttgtcctagattttcctccccaagtcccacggtcttgggcaaaacagaggctgtccagctgtgtcttatttgcataaggagggtaggatgggccaggattctaacacttcagatctgtgcaggtatagatgttaaattatcatcaccaagtaattcaattataattttttgttttcaaagtgtacttttaatggggaacaacgtggtatttttaacaaagctgttttataactggctttgaaactgagtggttttagttatttgcagttgaagcttttgcaggaaaaagctctattctgctttacttggtgcgttctcgtcctcaatgaggtaatttacttttattctcgacacagaagaattgtaaatagtccttacattcctgatgggagaaatctttttaatgtgttcataattcttgctctgaatgttgaatgggtttctaaaaagtgattagcgagttgtcattagttttcagtatgtttgtgttacatgagccttatttaaaggcatcccatgactatacttcgtaaagtatatgatcatcacttacttttgcttataagtctggatgtttataagatttgcataaagttaatactgaaggaaggaaacctcgttaagagaacatatctagtgcaactatagacattttctttcaaataactattctataagatgaagtaatagaagtagtttttttcctgttaccttcttgctgtttattgtagattttcctcttaatgagggatcctcaaattatatttcataatttttattgttttatttttcttttaaaagctgggggctctcttccctatagcatccagacagctgaaaaacagaattggctgcattcctattttcagtaagtaattggtttagactgctgctattgcttctttaggaattagagtgttatttatgtcactggtttgtttttttttttaaaaggaactttatgtaatatagctatattctttcatctacatatgttagtgatagaaataatttaaaacaaggttttgaattttttttggaataggtttttaataccaaagaggaaaatttattgctgtgaggtttctatttaaatattggcatgccaagaaagacaaatagaagatcatgttgggtagtttagaatttacataagcagcattttagttcatttttccaaaatataaagtatcattattctgtctgtaccgtcacacatgcagctgcaagcttgttgagggcagattctttgctgccgtttcctgaggatacaggacagtatctggcgtgttgtcagagttcagtaaatgctgagtggacaagtgaagggaatgtccttcaccctcctccagccacagcagttgcacagcctgcatatgcaaggccagtctgtttcatgcttgtctcaacaggtgtttgctgtgctggttagccagaaatgaaagcagaattactttgaattatagctttcaactgtaagtcagtgtgtaatcctagagcttttctttagtgctttcttgagaggtttttccttacagaggacatttctttaaattgaactcatttaaatattatattattaaattcacttgaatgaagacagtgatggtacctacctaaacctgattctgttttcacagaccatctgttaatctggagggaccatcctcttatattcataagtaaagattgttgcttcatgatataggttcccatagaaccatagtctgcaatattggaaacttagaaaccaaactcagatttgtgaatgtcagcatttgactaaagtatttctgccctcgcttttcaacattcatttttttcatatactgtttgtattttgccttttttgtattttgtttcattcaacaagcttttgctgagcctctactcataacacaccgtggaagcatgattcttccctttaaggagctcacagttcaggcaggagacatatacacacatgctgttaaaagcacaacagaaataatatgtatgcatgtatgtatgttcatggcaaaaatggaaaggctatatgctgaaaggttgcagtgcttcttgtgaaaagtgggaagtttataattctaaaatgggcatgcgttacttgaatggagtttcataaaatctcacaggtcacagagtcgtgtagccactgttgatttttagataataggctctttgttttcatgcagtttcctaatattaggattatgatcaattttatttcataattagtaacttttgtcttttctgtcactagcaaatggtcagctgagacttctggccgcagcaatgccatgccacatattaagacatatatgaggccttctccagacttcagtaaaattgcttggttccttgtcacaaggtaaatagtccttacattcctgatgggagaaatctttttaatgtgttcataattcttgctctgaatgttgaatgggtttctaaaaagtgattagtgagttgtcattagttttcagtatgtttgtgttacatgagccttatttaaaggcatcccatgactaatccctttgtaaagtatatgatcatcacctacttttgcttataagtctagatgtttatcagatttgcataaagttaacatttacttctgttatttaatacctcaataggggttatgcaaattgacatttggggtaagtacagaagaataatgaaatgttaaaattaatatttttttcttaattagtttctccttaggtaattgaaatctgaagcaatcaaatctcttatgtgtccttttctaaaacatctttaaggtgtaattcacgtaccataaaatctgcccattaagtctctactgtttaatggtttaggatagtcacagaattatgtaaccattaccataatctaaatttagaatattttcatcaccctataagaaaccacctacctgttggcatttttgtgtctatttttataggaagataaattgctatgccctttgaaaactagaactttagttcctgactcccaggctgaacccaacgattaggcatctctttatgattcagtaacataattaatgtcaatagcaactaattaaagtatcacagagtagaattatttctttaagagaggaacagcactcatgaacaaacttttaaacaaaagagccacttacatcttcttggcgagagagaaagatttattttaaggaattggctcatgcaattgtaggggctggcaagtccaaaatccatagggcaaaccagcagcttggagatttagtaagacttgatgttgcaatcttgagtctctttctactttattggaaaagtttaatttaatgtctgtttgggtgttgttttccctcaaagtgtaataaaaaggtgatgtacttcacagaaattacgtattattgattctgtttcaagggcattaagggaagtggagattaaagtaaccctgtgagtaatctttttctaaaggcaaagtttttgtagttcagttcaatggcagtgtgtgcttgactgtgggaacacaaagagccaggaagcacgagccctgccatgcatgtgatgttgtatcctagttgtttacctgtgtgaggaccatagtggaagcactgttagaaatgtattgccttgctggggcagaggcaggatcaaatgagagatcagctaaactaagtaaagaggtgctattgtaagtaggcctagaagtaagcctgagagaaaacccagacggattagaaggaactagtgaggacaaaggccatggaggtgggaaaatacacaggattttcagggaaaatctgagtgattccatgaggctatgtaaaaggaaacacaggttcagatacctttggcatgtattttctaaagttaagtcaaaaaacatccactgtcagtttactcatttaatatttgtcagttttgtactgtgaatatctgctttaatgtcgaatggctgttactaaattaagcaaattatagttatttgaagtttattgtaagaatttgaaatttgtcattatggctttgtagcttctagttttattctgtaataactggactgaaagctgtatctacttgcctaaatgtttaaagatgaatagcaacaacattcattcagtaatttcaatatgccagactgttctgggtgagcaatcatgtgtatttacttatttaattctcacaacagctgcatgaggaccaggaggcacagagtgattaataagctgcctactatcatgcagtaataagtgatggaacccagataggagcacacctctcctctactgtctgatgccccctcttaatcaacatagagttttagtgtgcctgttttctacaaagactagttaattccaaagaaattgtgtcaggctttactttgattgctgtataaaagaggaaaaggacattgagcattccaatatgattaaaggatttctaagaaacataacttaaataacaacttagatacatagaacccactctctcagcccttccataataaaggaaagtatagtttccaaatataaatggcatctaccagtaaggagctcccttgattaggtttggacattttgttttgtctgtcactttttctgaacctgtcagaaagaatgttcccaaaccgaactcatgtagatggagatttcttttcccagaattcttctttgcccttgtggcacctgtctcttattaccaagcttaaagcctgaatgtctctttcactattccctcaaatgtttggcaaacatttgctgaggtcctcctgtggatgccaggcactcaggataaaacagaagatttagatagtgtcttttagatgctcacagtctctgatggaggagccagacacagaaataattacaataggaagagaccaattatgtgcttgaggtgggcacatggatgctttggaaatagctgtcaaagcctatttatctttgaaatgtttcaaaagtttcctcttccagtccttgcaattaccaggtcagaaacttatcctctggacttctgaaagggtttcctatctgttgtgtcatcacgtggatgttcttcataagccactcatcctggttgcccatgccccttcacctttctgaaacatagagtttcctcattgttccatgttcagaattccccacgtcctgtaggctaaagtacagattcctcagtttggaagtcatgccccagccacaccattttcaccattcttacccattaatccccaagaggagccttgagaagaagccaggctagcctcctttgcccctgaagtcatccagccaacagcccatgtagtttcttctcctgatcctttcatcccttttctctctttcttcagttgctgttcatcttttaagagttgtgttcaggtcccatctccgcctggagcctctttcagcctctgctggtccctccctgtccagatccttagatccgtgtgccaccagtggagctcacagctcctacctcactattttgtctctcaagcatgagctttaacattgtcagacagtactagatgagatggtcatgtctactattgaacaagtcttgccttggacaagtttcttaacctctctgagcctcagacttctcaactgcacagcaactatgaaggtttaaggtgccaactatggtgacctgtgggagtaagaagaaaggggcaggggagagaattgacctgcattaagtagccaccatgtggcagacacttctggtgctttacctacatagtagtgtctttcagtccccacaagagctgtgaggtggcgttatcccctccctccactcaatgaggaataaggcggcagagttgaggcagttctacccattactcagcaaatatgtattgcccgctgtggcaagaatagagtaattaagatgaggttctcacagaatttacattggcatgaaagagatttaccaaagaattcattgtatacatattagttaattgcacttgtaatgctttttgactattctacataggtgggtttttagccaaaacatcacttctggagcctggtggcttccataatgccctagattcctgcattgtcagcgttctttccctattcactgtggttgcttgtgtaattatctggcttcccctctagactctgtgaggccaagtccatgcctgtcttgttcagcataccctggtgactggccaggtgcctgacatgtggaggctgatgaagcctaggattgaagtggtaaccatgaaagcactgcctagactgcataatggaacatgggagggccctcaaaggtgattcctgagtttggggtatgtagatggggattgtcactgatatcagtatagaagtcagggaatggaactggcctaccacagtgggatgatggtgaatttgattgaagattgatttatcatggtggagacttcaggtggaattgtttgttggagatgaacttaaaagtttggtgtacatatagtatgttttggagttttggttagtactgattgttaacaccgtaatcctttgcgacttccagaggagaatatagcggatcaacgcctgggcattgaggaacatacaagaaatacatatcaggtgggcttttcatgcctaccaggtgttccattgccaaacaaatgaattggattcaagccatccctcctgggttgaagagcaactggtcacacattctccattacataatttttcttctacctaagaaaaatgttttatatatatattctattttgggtatcagatttaaccatttatccagcacataactactgagcacctactatgcaccacacacttttctaggtgctaagaatgcaataaacaataaaacatcttgacttttatgttctggtgctgggaattacacaaaaagcaaagaagtgtgtttatgtatgcaaatggtggtaagtgctatagagaaaaaatagaatgataatttaggtgcacaatcctttattctaaattcttggtaccagatgtagttcagtatttggattttagaaagataatatggtacctatactgtctgttaatatccctagtggtatctggaccaacacttcataatacaacattttggaagcaaagatcacaggtagccccatgtcatcttagttcaacttttgttgcccaatgagttaagatcaagttttgctatcaaatgaaatgagttaaaagctttatttcaaatttggtttaggttattgtttttaaattttcagagctaacatgtagttcttaaccagcagttccaggcacagttccaagcacattatatatatatatatatatatatatatatatatatatatatatatatatatgtatgtatgtatgtatgtatatgtatatgtatatatatgtatatattaattcatgtaattcttatagccgttctacagtgtatccattaatccccttttcagatggaagaactgaagcacagaggttaaacaatgtgcccaagaatccagagtccccaccctcaaacactgtcctgtagggtgtgagtgctcgggttggggagggaggctgctccttaaggaagaaggtcagggaaggccttctgacgtggtgacattcatgcagagacctgaaagaagtaggggaagagccatgtggatgggttgctgagggacgcggggtggggagtgggaatatgcttactgtgtttgattaacagcaaagtgagtgttactggagtcaataggatgggagggtaggtgagttcagagcagtagtgggtggccagactttgcctttttacctgctttcagatattaccgtttctttgatgtctccggggttgcctgaggccttattagtcgttggtctatggaaagcagttcaatgaatgttataatttgaattgattggaataattgagtgcttttctaaatgcttgttccatgagattttctagaataagatgtggttttaaatagtcgacttcagcttatactcaaatagtgtgtctctcaacagggcactattgttattttggtcaagataattttttgttatacaagattgtcccatgcattataagttatttaataacctggccatcacatattaactgccaagtcctagtgaaagctgaaaaaaatgccttatacatttctaaatattccctagattttatgctctggtggacaatatcatcatccttgagaataaattcgttatgaacaactgatatatcctttcatttaatatatttacttgctttagaatagtgaggcaggattgtagagagcactgtggattctagtccaaatgaagtgctcatgcccagcaaatctaatgctctgtcagcaaagtagcagacatactagttttaagaattggattttagccaaaggtaaatacatcaaaagctacgtaaatttaacttttgatatttttctactttattattactgatccgtattaatgtttgggtttggaatgaataacccactcctctttattaagtacaataaaattaaaacaaattccccagaaaaaaattataggagtaataagcacagagaattataggcaatatgaattttgacttttaacatgatagactttaaaaaataatctagagctgcatatccaaaaaagtattatgatcaccctttgaaagtaggtgctttggccaaaaacattgccattgctcaagttttctttccactcttccaagttctttcaaaataagttgacatgacacattaacaaataagtattgtttcttaatagacattctttgtttccagccttgcattagttttctgttgctatgtaatatatgatcacaaactataagggggcttaaaacaatacaaatttactatctcatggttcccgtgggtcaggagtctgggcgtggattagctgagccctctgctcagtgtctcaccaggctaaaatcaaggcgtcaacccagctgtgctctcatctgaagcttgggagtcctctttcaagctcacggttgcttgtggctgtaagcctgacgttcctgctttcttgttggctgtcagcccggcgttctcggctcctaggtgctgcccgtggtggtctgctgcattcctcatgggatgcttcttggagaccagcaggaggatctatctcaggaaggacccaactcaggcccacccaggattgtttcccttttgagtaacttaattaattgataaccaaattatgcaagtgaaactctatcatattcacaattctggcttatcctcaaggaaaggggatatacaggcatgtgcaccaggggccatctttcgattctgctttccacagacttcactgatggagttccgctcttattgcccaggctgaagtgcaatgtcacgatctcggctcactgcaacctctgcctcctgggttcaagcaattctcctgcctcagcctcctgagtagctgggattacaggcatgcgccaccagaccacggctaattttgtatttttagtagagatggagtttctccatgttggtcaggctggtcttgaactcccgacctcagatgatccgcccacctcggccccccaaagtgctgggattataggcatgaactactgcacctggcccactgatatttctttcctggttcgatttacccatcttattctccaattttggctggaattaattttttactgtttccaaaattggggtttgttttttgtagttaagcaaaagtacccttgtacacactcaaaagactgaacctctggctccaaagctctttgagaagttctgtactttcttggagccaaaagaggcagctgtactggagtaagggaccaaccccgcagcatgactgctttggagaaccatatttacttgggtatgtagagttgttaaaaataatagtcctataaaagattcatagaatcacaaaagatctgatttcctaatcttaaaaaatctcatccccttaggaaatgtatttcgtatggttcctattgggtctacgtaatatcttattgcctgttatgtctctacccatcataagtagaggatgttgacttcctgatcatttggactttgtttcatccagttgacatttcacaaatgtgaaaactggctacagaaggtcaggaattggaatcttataaaaatgctagccttaatatagtttttaatcttcccttttattattttaaatataaatcatagttttcatttcctctctttcattatgtgttgtgattgaggttctgactgaaaacatttttcatagatcctgggtcacgttttagtatatggttgccatagttaccacgtcaccaagaatcataaaatctgcaccaaaaccttttttaatgaagtttctgttgaactatctgcattagaagtttccttttactgtagagaaaaaatgagtttataattatcatgcttcatttcctaccagaatactcattgtgatctttggtaattattctttaatgtttgtgccttctggcagattggctaatatagtgcctagttcagtacctggcctgtagtggctcagaactgaatgaatggtatcccccttaatctaaatgcagtttattttcagactgcttctcaggttttatttttttctgtactgtctacaataactatacttttctttcaacttctaattcaaatgctccccttaaagtgaaactttttctagctcagcaggcataattattttttcctttgtgttttcatggcgccttttgcttggtccttttttcatcttcccagtttattttatttattttttaattttttgaatatcttctcactgcttctgtaggcatcgacctggttgcttctttatgggtctctttgcttccctgtgtcatgagcttcaggtgagcaaggtgcctgatcttactcatctttttctgcttagcatctaacactgcatggcacatggttactgaccaaaaattatttgaatcagtacccttttaaaaacttatttttttccaataggtaacatacacaataaaataaatggtatataaagaaggtatgtcttcccattcctgttccccagccaccctgctcctcatccagaaaccactactactagttgcttgggtttaatagctgtaacccatcaacattttcaaacccagggtccacagatggtgacattacccaatcatccagcatattatggaggaaataacctgagatagagtccaaagatccaagtcctaatttgagattgccacttactagccttgccacttaaattttggaaaacgcatttatacccttggcttttatctcatttatggaatcccaaggatgatgatagaaaacatgcggttgtttcctattaaacagtatgctgtgtttaatattagttcactgcttgatttttcatgtctctcatattcattaggcctcttaggatttaagaaagcaccttataaagcctttatctgttttgcctgtgtaacacatccatataaaatatatgaccttaagacgtattcaagctaggtgcagtggctcacacatgtaatcccagcactttgggaggccaaggcgatcggatcacttgcgctcaggaattcaagatcagcctgagcaacatggtaaaaccccatctctacaaaaaaaaaaaaaaaggcgggggatgcttggtggtgtgcgcctgcagtcccagctactcaggaggctgaggtgggaagataacttgagcctgggagattgaggctgcagtgagtcatgatggcaccactgtactccagcctaggcaacagagtgagaccctgtctcaaaaaaagaagatcttttcatagatatatagccttttctaaactaaatatgtggttatttttattttatttatttattttttttgagatggagtctcgccattcacccaggctggagtgcagtggcatgatttcggctcactgcaacctccgcctcccgggttcaagcgattcttctgcctcagcctcccgagtagctgggactacaggcgcatgccaccatgcccagctaatttttgtatttttagtagagatgaggtttcacggtattggccaggctggtctcgaactcctgaccttgtgatccgcccgccttggcctcccaaagtgctgggattacaggcgtgagccactgcgcccagccatatgtggttaatttttaaattggtcacaattactctatttaatcaggacaagtaccgtcagccagatttatacattcagagaaactcaaaattaacagttcacttgaacttattaggatgttatattagctggcgatttcctcttttgattggttacttttatggagagatatttatggttttaataagatttccctcccatctgttttgatcctaccgtaaaatcatcccatgtttgatgggcagccggttgttagggaaattattgggacatgatgacaaatgtggtatttaaattttaccacaggactaagcaggaggaagatgaggtttaagagaagccttggctaagaggatagtgcctaggtgtaattggcaaacccaatgagaacagttacgaaagttgtgtattgtgggtggtcagaagcaaggtgggtacctaacacatgctggatcactgttagagttgcctagcaactgacaggcaatgcggatagtcagggatgagcagaaatgttggtgctgccacttcgggagaaaacgagacaagtgcttgactgcaaaatcactggctttttgaggaaacataaaagacattctctctcctctgcttttcaatattactatgcagtactccttctctaatgtctgttgctttgattctgaaacaaatcatctctttttgttctcctttgtctgagtattttggtgaaaataaaattggattacacaagaaaatacttacagatgtcattgggtagacttgcttgcctggccctgtggctctaagatattgggattagctggtatgcttcatgtgctttgttacaaatgatggttatcagtactaacgcctacaagtgacttcctttatacgatagagatgactcaaggtcatattactaccctcacctgcctacatctggtacaagcagagtgaagacagagcatacccctttctgtactcatatgagaaagtcttgtgagcatcatcactgatggaaaaaagcttgagacccctgacttagtgcctctagaccctttgtacactggcattgctagtcactaagtgcacatctggcttgagatgaggaggtgctacctggaatttcccaccagggactggcctccaaagaaagcctctcacaagtaatatagcaaatacttgtatggtgcttactatatgctggccaagcgcttttttatactagctcatttaatcacccaaattgggagctaggtactgctactatccccattttagagatatgaaaactaaagcatagagagcttaaatagcatgcccccaagtgacccagctgggaagcaggaagagctaggatttagacccagatagtctgatgtgactgtttcttgtttatgtgccaggtgctattctaagttttagttatagatgatggacaagacaggtgtggtccctgctctcatgaacttgccttctaattgatgtagacctatcgtctctctgctttgggattggcacagaaacattattgcaggagagtcagcaggatggtgacaggctgagagaaggaagggaggaagtaggttgcctataaggttgtgagcacagctctctaggagagttaaacatgctgttaggctttctggagctgatcaacagccccaaggaggctgcccctccagctatctcaggtcttagtggaaaccttccttgtgctatgcagcaccaatgcttcaggctccaaaaagacaagaatcattcccaggacactgtgtactatgggactcaggaaaacaaaggtaaggcaccagccttcacacactttataaaggaatcatcttcagagagcttttcaaggtctcccaggaccttgaccaaatgctgaccatatattggactattcagtcttactggccatgtgaacagtccatctgctctgcagccacactcttaagacatttgtttctgctttctaggcccatttccccatctgtaaaaccaggggttgggctaaatcagtggattttatgctgtgttccttggagccctgtgggctctggaaacccctttcagaagccaccacaacagtgggcagagagagatgagtgcaagtaattcacccagagatactcgcccttgtttgcttaaaatgtttcctttgaacaaagggttctcgaggtttaaaaaaaaaatttttttaaatcattataatagatcatctcccaaggcccattctaacaaccatatcatagttctgttaaaagcattaaccatttccaaacctcacctttgtgaggtgcattaaaatttactaagcacttgcacctagattatttcattcattcctcattatagcccagtgtaatgagcagatggtgttaagtccttattataagtgaagaaattggtgacctaagtactaaccacaaggtaacagagctagccaaaagcaaactcatatcttacaagtctgttgctcttttcaagtccttgtatttattgcctttccactataggagatagactaaaacattggaacatttcattagaaaataaaacagtaagcagtttttggttgtcacatgggttactattaaatatatactcaaattatttggtatagtattctaaataccaattttgacctgaaatttgaaaagcactttttttatccttggcagtaatttttgtcattttggattattgatgtgatgacttctaaagtccttgtaattccatctgtgggatcaagaatagatggatccttttaaagactaggtcaacaggtaggctggactatgccatcgggcaccaaggcctccatttagagtccaacatggctatgaaagactgcttgtcgggggagggtcatgataggcctgtgactgaggaacaaagtgaggttgcaagtagatttgtccaaatctatttggtggtttgtcagactttacacttgcaaaaccccacacccaagtgtctaatcttctttagtgttttgctcttatctgcttgaaaacatgcatcataatcattttcatttttcttttcttgctggcttttctttgttaatacactgtatctgtaagacctgatagccaccctggaaacacagctgatgtgttgcatcctcttagtagttaatctcccaagattcttcaacatctgcagaattttgagataggatttcacgctgtcactcaggctggagtgcaatggcatgctcactgctcactgcatccttgacctcccaggctcaggtgatcctcccttctcagcctccccaagtagctgggactacaggtgtatgccaccatgcctagctaattttttttgagacagagtcttgctctgtcacccaggctggagtccaatggcatgatctcagctcactgcaacctccacctcctgggttcaagcgattctcctgcctcagcctcccaagtagctgggattacaggtgcccgcgaccaagcctggctaatttttttgtgtttttagtagagatggggtttcaccatgttggccaggctggtctcgaactcctgacctcaggtgatccgcccacctcagcctcccaaagtgctgggattacaggcgtgaggcaccatgcccagcccatgcctggctaatttttgtatttttcatagagatggagttttgaaatgttgctcaggttgctgttgaactcctgagctcaaaactctctatctgccttggcctcccaaagtgctgggattacaggtgtgagccaccatgaccagctcctcttcctctttattattcaccaatattttcattccacccttttttggctttcaaaattagtcattgtcattattactttacagtcacttcttgtttacagttacccataagtttactcatttctttgttctttttcttcccggtagccctgtcctttcaaacaaattcagttttattcctgaactgtatcttttatagttatttcactgatgccttcttactggcaataagctcttatttgtttttctaaaactccctttatttttgccctcatttttgagtgataatttaactgaatttaaaattctttggccggacgcggtggctcacactgcccatacctgtaatcccagcactttaggaagccaaggccggtggatcagttgagaccaggagttcaagaccagcctgggcaacatggtgaaaccctgtctctactaaaaatataaaaattagctgggcatggtagctcacacctgtaatcccagctactcaggtggctgaggcatgaaaatcgcttgaacccaggaagcagaggtggcagtgagctgagatcgctccactgcactccaacctgggtaatagagcaagaccctgtctcggggcgggaaactgggacaaagtaactgccaactaagatttttttttttccttttaaggcagagttttgctctgccacccaggcttggttcactgtaacctccacttctcgggctcaagtcatccttccacctcagcctcccaagtagctgggacaggtatgcaccaccacacctggctaattttttatttttttttagagatggggtctcactatgttgctgttctcacactcctgagttcaagcaatccttccacctcagcctcccaaaatactgggattacaggcgtgaaccaccatgcctggtcttcctctaagttccttaaatatttttttccattggcttttgagctcagttgttggtattgagaagttgccatctaattgttgctccttgtggaaaagctgtctcatctctggctgtttttaagattttctttatatttggtattcttcagtttagctacgatggataaataggtatggatttatttttatttagtctcagcagggtttgttgtatttcttcactctaaagaactgatttttcaacagttcggtaaaattattggctattatcattaagcatattgactcaccctctctcacttccttcttgcaactcttatgagatgcttgtcggaccctctcattctatcttcagtttcttactttgcacctctttgcctctgagttgcattctacctaatttctttagatctttcttctgtttcattagttttgttttcagctgtgactcatggtatttaattcatcagtagagtttttaattctagtgactgtattttacttttggaccttcttggataccatatgtttcatggtttagagttcagcccagagtcacgctgcctgagttcgaattcttactctaccacctagtacctgttgaaatcttgggcaaatgacttccattttctcatctgttaagtaagtatagtaatagaataggtatctaatagttaagaatgaaaataaatagaatatataaaggtattaaaacaacatttggcagttaatagatgctgcatattagctgccattattagcaaatttgttttatgcttgtttcattatttcttttgtatgttgtttactttgaaatcttttgtttatttttgttttgttttttgagatggtgtcttgctgtgtcacccaggctggagtgcagtggcacgtgatcatagctcctgggctcaagcaattctcccatctcagtctcacaagtagctgggactgcaggtgcacaccaccctgcctggctaatttttgcattttattttgatatgggatcttgctttgttgccctggctggtctcaagcctctggcctcaagtgatccttctgtcttggcttcccaaagcactaggattacaggcatgagctaccatgtccagctcaaatcattttaagtatacttatttttaactcgacatctaattggtcaatcatctgaagttcctggaggtctaattatattttctgttgtcttgctcatgatggatttggattattttcccttttattttaaaatttgtgtcttcactgaagctttaactataaaaattatctgtgacttgagtggacaaacctctgtacctccagatagattttgttgctgctggtctcttcaagaacctggaaccaatgtctatgttaatatcttgacataaggtaggggcagatacctagcattccaatatttgagagatcaggtggaagaaaaggagtgaccagagaggttgaaagcagaaaggaagccacaaagtgtagcagaaaacaaggaagaataattacagtaatgtttcaattatgccaggggataagaggcactgatggtagaagtctcatgctacagagagattaagatgagagtaaagaagtttccattggatatggcagtgtggagtgactttaagtggtttcaggatagtggtttggggaaaagtcttattgaaagcacataatagattgaagggtaagtgtggttctctgcagtattgtactggaagttatagccagtgcaataaggcaaaaaaataaaagacataaagattattaaggaagaagtaaaactatatttgcagaagatatgactgtgcatttgtaaaaccccaaggagtttaaacatgatttcaagattcactataaaagcagggtaagactgtgatatcagcataacaatagataaattgatgaacagaacagaacagagtccagaaatagacacatatatcatcaaccatttttgacaaaggcaccaatgtaattcagtggatgaaggatgttcttttcaataaatattgctaaagcaattggatattgatgcaggaaaaaaaaaccttagcctatcttaggacatagacaaaattaacttcagatgtatcatatgcctaagtgagaacgctaaagctataaagcctagaacaagaataccctacaaccttgaagtaggcaagatttagtacataagacataaaatgcacttgcaagaaaagatttacacatgtttggacttcagaatattttaaaactttattttgtcaaaagacaccattttgggatggatgaaaaggtttttctgagtaagacctcacacccagaagctataaagtcaaaaactgcaccttggataacttccttcctcgccccaaaatggaagaaaacaagcaaaaattaccttctgaactataaaggttttcataaacaaagttataactgggcaaacatttgcaacataattgtaatatatgaaaagcactgtgtggtgggcagaataatggccacccaaagatgtctttgtgtaaaatcctcaggggctgtgactgttaaattatctggcaaaggggaattaaggcagcaggtgggattaggtttgctaatcaactgaccttaaaatggggtggttattgggggagggcccagtataatcacaaagatacttaaaagtggaagagggacaagtcgagagagagagcactgcatgaaaaaggactcagctaacctcactggccttgaagatgaaggaacagagacattccaaggggaatgcagacagcctctagaactagaaaaggcaaggaaatgaattcttcctgagggcctctggaagaaacacaatcctcctaaaactttaattttactttactttgtgtaagataatgaatctttgttttaagtcattaaatttgtggcattttgttagagcagcagcaggaaactaatgggcactgcatatcaagagaaaaaaacagtatcatagtttaaaaattgatacttcacggaggtaaacatcagcgttcagtagtgatatgggctggctgtatccccacccaaatctcatcttgaattgtagcacccataatccccacatgttgtggaagggacctggtgggaggtaattcagtcatgggggtgggttttcctgtgctgttctcatgatagtgaatatgtctcatgagatctgatggtttttataaagagcagtttctctgcacacacactcctgcctgccaccatgtaaggcatgcctttgctcctccttcgcctgctgccatgattgtgaagcatccccagccatgtggaactgtgagtccattaaacctcctttcctttataaattacccagtcttgggtatgtctttattagcagtgagagaacagactgttatagtaaattgctaccggtagagtggggtgctgttataaggatacccaaaaatgtggaagtgactttggaactgggtaacaggcagaggttggaacagtttggagggctcagaagaagacaggaaaatgtgggaaagtgggaacttcctagagacttggagggctcagaagacaggaagatgtgggaaagtttggaacttcctaaaaacttgttgaatggctttgaccaaaatgctgacagtgatatggacaatgaagtctaggctaacatgttcccagatggagatgagaaacttgttgggaactggggcataggggactcttcctatgttttatcaaggagactggtggcattttgcccctgccatagagatctgtggaactttaaacttgagaaagataatatagggtatctggcagaagaaatttctaagcagcaaagtgtttgaggtgattttgggtgctcttaaaggcatacagttttattcattcatagagatactctttggagttggaacttatgtttaaaagggaagcagagcataaaagttggaaaatctgcaacctgacaatgcaatagaaaagaaaaacccatgttctgaggactacagaaatttgcataagtaatgaggagccaaatgttaattgccaagacaatggggaaaatgtctgcagggcatgtcagaagtcttcacggcagaccctcccatcacatgcctggaagcctaggaggaaatggctttgtgggccaggcccaggcccttgccgctttgtgcagtcttgggacttggtgccctgcatcccaggcatggctaaaaggtgccaacatacagctcaggccattgcttcagagggtgcaagccccaagccttggtggcttacacattgtgttgggcctgtaggtacacataagttaagaattgaggtttgggaacctctacttacatttcaaaggatgtatggaaaagcctggatgtccaggcaaaagtttgctgcagggatggagcctcatgtcattaagtgtttatggcttttccaggcacatggtgcaagctgtcagtgaatctacaattctgcaatcttgaaggattctggcccttctcacagctccagtaggcagtgccctagtggggactctgtgtggggcctccgaccccataattcccttccacactgccatagcaaaggttctccatgagggcctcgtccctggagcaaacttttgcctggacatccaggcgtttctatacatcctctgaaatgtaggtagagtttcccaaacctcaattcttaacttctgtgtacccgcaaggccattgcttcagaggtgtgctgcaggggtggagccctcatggagaacctctgctagggcagtgcagaagagaaatatggggtaggaacccccacacagagtccctactggggcactgcctagtggagctgtgagaagagggccaccatcctccagaccccaaaatggtagatccactgacagcttgcatggtgggcctggaaaagctgcagacactcaatgccggcccctgaaagcagccaagaaggggggctatgccctgcaaagctacaggggcagagcctgtccaaggtcatggaagcctacctcttggatcagcgtgacctggatgtgagacatggagtcaaaggagatcatttcggagctttaagatttgactgccctgacagattttggacttgcatggggcctgtagcccctttgttttggccaatttctcccatttagaatggctgtgtttacccaatgcctgtacccacattgtatttaggaagtaactgacttgctgttgattttacagggtcataggcagaagggacgtactgtgtctcagatgagtcttcagactgtagacttttgaattaatgccgaaatgagttaagactttgggaggctgttgggaaggcatgattggttttgaaatgtgagaacatgagatttgggaggggtaaggggtagaatgatatggtttggctctgtgtcctcacccaaatgtcatcttgaactgtagcttccataattcccatgtgtcatgggagggacctggtgggaggtaattgaatcatgggagtgggttttcccaagcagttctcttgatagtgaataggtctcacgagatctgatggttttataaagggcagttccctgcacacgctctcttgcctgccgccatgtaagatgtgcctttgctcctcctttgccttctgctatgatcgtgaggcctcccccgccatgtgcaactgtgagcccattaaacatcctttcctttgtaaattatccagcctcgggtatgtctttattagcagcatgagaacagactgatacaagtagatacagttaaaaatacttgatatggtttggctgtgtccccacccaaatctcattttgaattgtagctcccataattcccacatgttgtgagggagacacagtgggagataattaaatcttaggggcagtttcccccatactgttctcatggtactgaataagtctcaggagatctgatggttttataagaggaaacctcttttacttggctctcattttctctgtttgcctgctaccacctttgtaagaagtgacttgttcccccttgccttctgccatgattgtgaagcctccctagccatgtggaactgtgagtccattaaacctctttcctttataaattacccagtcttgggtatgtctttattagctgcgtgagaacagactaatacaatacttaatatcattagtaatcagagaagtcaaatataaattagatatattttgcctattagacttgtaaaacttttaatagatactatccacccagtgttctcaagagtctaagaaaagaatacttctatacaatgttgctaataatctaaataggatagatgcttgagacagaaattggacagaatttatcaaaattaaagattatgttcctgtgtatacctgtatacaacttgaatcttttacagtgagaatatctttacatatcacttgtgaaatgtcttttcaatccataaaacagagcctaagagtaatacaagaaaacctacagagaatgcaaaatggaaggaaacctacgatgtctgtgtttgtggcacacacactgccgtggagttttaggaaagggcaacagcagcattggctggagtcatggtttcccctccacgtcagtacagctgcttggtctccatcttctccagcacacagttaacattctgttttattgcagctgtctgtgaacatgtctgtcccctcatccctggtcctctagaagtgcagtggccaaagcctcagtctgtacattgtctcattgtctctgtactctttgtgctgctgctgctgcctagactgttaagtaattaatgatgaaaaagaaatattttatcagtggacgtatgttcccataacagcagtcacccttggggacttgtacatcttcttaaaaaaaacttaaaagtgaatctaatcagccactctaattggtgttcaagcagggattggtgatggcaactgttcccattaccaaagttcaggttttgaaagatgcttggagcagggcttggcccagaggtcatcttcatagctccccacttcctttcttaggcagttgtttcccccatgtgttaccatgaacatccaacaagtactccactccccagtggtaaacctccagtgaaactcagagattttaccttaggatgagactacatcactggaggggaacactctagttcatgtgagcatgggtgtctctcatcattgtagactctagcctggaaagggatttttggtctcataggctgacagccctcattctggatataggaacctaaagcccagggaggagaggagtggcttaaggagtcacagctaatggggaagctgagacataaactgctcctgattcagggtccagggctcttttctcagcatgtgcctgcctgccttctccatgtgcctaacatgccattcctgtgctctcctgagatttcctgtacgaattttttgtcatacgttttcaagtttactcttaaaaatttaatctttgggacagaatgttcatattggggactcaggtcaaacctgtaataagcagtcacacctcacaagctgtggcagggtattctgccaccatttgcactccttgtaggcaaggggacaataaactgccaaatgagcaacatatcattagtcagcttagctgtggtggcttggtgcctcattcagctcagactgctatacagagcagcttataaatatatttcatagttctagagaatggaagttcaatgtcagtgtaccagcatggccaggtaccggtgagggccttcttctgggctgcagcctgctgacttctcactgtgtcctcacaaggtagaaagagggcaaggcagctttctggggtctcctttataagggcaccagtctcattcatgaggaccccctcctcatgacataattaacccaaagcccctgctcctgacaccatcacattgggggttaggatttcaacatatgaattctggaggacacaaacacattgggggttaggatttcaacatatgaattctgggggacacaaacattcagttcctaacactcggtaatggtcaacttgtctaccctcaaccacaatttccagaattccctttcttgtatgtttccaattaggtgggccccaagggagattcttatatttggagagcaaatgtgagacagcagcctttttttttcttttttttttttgagatggagttgtttcgctcttattgcccaggctggagtgcaatggctccatcttgccccacagcaacctcctcctcctgggttcaagcgattctcctgcctcagcctcctgagtagttgggattacaggtatgtgccaccacgcccggctaattttgtatttttagtggagacagggtttctccatgttggtaagactggtctcgaactctcgacctcagatgatccgctgccttggcctcccaaagtgctgggattacaggtgtgagccactgtgcccagccgagacagcagccatttttataactcatgcgttgtcactgtgtccagcagaagctggacctcacaccctcccaagtcctccttcagcttttctaactcctggccctcaccaggtatgtattttttctgtgatgaaggccctgtcttctgcaagacatccacacctccagtgccagaggcacaaaaaccacatgggtttccatcctcacagtcttcagtccctgcctgtggctccagctagttattctccactttatgcctgtcctcctctggcttctgcctgctctgtagacttctagctccagcatcaggacaaagataacacccttataaagactttaaccagctcctacaattacatgataataaattcctttaagaaatacacacacacacacatatgtatacaatttcctagttatgtttctgtgattgaaccctgactgatacacccccagaagctactgtcactcaacatgactttagtaagggtttgggtagtgtttctggtagatggtagaccatgggacctccagagttctaccctaatgatctaaagtaaattaaataccccacccctctttagtgatgaagcatcactcggtatccagcagcaacaacacaaaccacagcacttgggagagaaagcagcccagtccagtagaaaaaagaacaatggaagagtgagggcagggggaacaaaatggtgaaaacgagttttcaacagaagccaggacaggcagtggacaatggattccatgtggagaacagaagctagaactctttggagttgtgggagcaagagacccctgtggtgtcgctgtgcctcatgaaagacatagtgcttttgctgtacatgacgggcgtgtgtgtgcacgcacacacacacactccccccaccctccctgcctcccaaccccacaagagtttggaaataccccatcttcctggctgccccaggtgcccgtgattcaaagtattaacccagaatgtaaaaagttattaaagatgatatctcagggaatgttgatttatcacctagacaacctgcaagtgactttcaggctctcagtgttcacagtagagtttctaaggttccaaatgcttagaaatctgttacaagccaaataaaaggagggattggaggaagccatctgaaaggctgtccttgtgatctctgttgaacattactttggaataagccctcaaatcttggaatgctaagaaaacacaactcatggggaaagaatgagaacagccttccagaagatacctcccgtctttgttgtcatgatactgatagtcaagagttggccagaaagcgatcatctaaaaactgagaaaaacacctcagacccactggttggttttgccgttagactttcctcttcgcccaggagatgacctgttttactaacaggtgaaagacctaaaagcaagatgtcatcttggacttttaaaaaaagtttttttcctagaatcataataccagtttatcataaacatcagcttcctcttcactttatgtctcaacgacgttatagacagtgatgttcatgattgtggtccttgtgcaaaggtttcctgtcctcaatatggttcatttaggaagccaggaaagcttgtaaataatgctctatttgcttaagtcagcctaatcgcttcaagagttttccttagctctgatttccacattcttctttctctgttcccatagaacccttaacaaacttttttttttttttttatcttacttggtcgttgtttttgtttgactctccaattccagcagacaatagttccagcacatagctcagaaaacatacttggtgcaccagtgagtgaatctcgaaatagtcacagtcatccacaaagtcaggctctaaagagttttctgaatagctgaggtttatatgttttaaaaatgaaatagaacttgggtgagcctaactgaaaaaatgtttatggtgggtttatgttagtctctgccacattcgcttataaaaagagtctctgaagacgcctcagagcttagtggtctccattcctgagcaccttaatatgcaccttggcacctcttgcaagttcagtgtccagtctcctttgtcctgctgcagcttgattttttttctttttcttgagacgaggttttaattgtcatccagactggagtgtggtggtgtagtttttgcttgctgcaacctccacctcccaggctcaagcgatcctcccaccgcagccttccaagtagctaggactgtaggttcgcgtcaccatgcctggctaatgttttttagaaatgtggttttgccatctttcccaggctggtcctgggttcaagtggtccgcccgcctcggcctcccaaaatgctgggattacaggagtgagccaccatgcctggcttgtaccatgatttttttagccacaactctttgaacatataaaacatcattctgaatgtaccatttatctctagatacaaataacagtctttgccctcagagctgttttcttcacattgaaagtagaaattagcactacctggcaaaaaaactgaaaaaggaaatatgaagcttaagatactactacataagataatattaactttcttcttaaatgctagttttatgtacaacaaaaccagaaatcctggctactccaggatcgtgaaaagaaaaggggctttagaacgaaaaaaataaaatctaaggaaagataattattttaatagctgccctcaggaaaatgcagatgagggtgaaactatcccaaattagcaattagataaatctcgaggattagagaacagcagattttaaattctcttttcaaaaatgcagcaactctgctagaaaatgaatgaatgtgattgcagctatatatttttttgaccggtgctcttgcagctgtggaagtttgacccacactgagatgcctccctgagtcagccctatctgtgtccttgtctctgcagcgcaaatctgtccaaggctgcctggggagcattggagaagaatggcacccagctgatgatccgctcctacgagctcggggtccttttcctcccttcagcatttgtaagtttacacttccaactgcacagtgggtcacatgggagatgaattgggctttgtgttctcttcctttagtcacaacagcttgcctaaggtaggcaggaaacagtcgggattcttacccagagcctgcactcttaaccgctggtctgtacctctgagcttactgaacactcaccagtctgggtgcagtgggatacctgctttcaaggcatgtacttgattaggaattgactgtgtgcttccagcgaaattaataacatttaaaataaatattgtgaactacaatgtgaagatttatctcgaggtggtagatgacaagtcaccaaaggaatggcccaatcaagcacaagttgttttaggtaggggtgactggaggatgaagttgggaagcaggagagcttggcagagtatttgaaagatgcttaggatgtaggctgtatagagagaggtgggaatggcatcaacgttggaaaggaattggtagtagcacaaactgggaagcagagattggttcacatcatcggctagagtttggctgggcggggccagtggggtggcacaaaggacatgtgcttctggcccagtaagccccctggaaaagcaccgtgtcgaactggtctttcgagatgtccagcacagccagcttgtctcctagctctggagccacttgagatttctgtgtccaaacaccagaaagagtggctgtgtccaaacaccagaaggagtggcttgcacataggggctggggtgtacaagccatctgtttctctaaatgctagaatcacgcttgacccagagagatattctcaccataagaggcacatggactgagatctcccatgtcacctccttatactcactgtgggtacacacacacagaatacagaatcgcccacacaatgagatggctaatgctttttccttccttcctcccttcctccctccctccctccctcccttccttccttcctgtcactgtgggcacacactcagaatcgcccacacgatgagatggctaatgctttgcccacatgatcagatggctaatgctttttccttccctccctccctccctccctccctcccttccgtccctccctccctccctcccttccttccctccctcccttccttccttccctccctccctcccttccttccttccctccctccctccctccctccctgcctgcctttgtccctccctccctccccgccttccttcctccctccctcccctgccctcctcactggctatagttgaatttatgacaaacacacatgacaaagctccattgtggacaacaccaactggaccagatgatttagctgaggggttggtgtgtgcttgtcctcagacttcaatctggactaatccagtcttttttttttttttagacagagtctcgctctgtcgcccaggctggagtgcagtggcatgatctcggctcactgcaacctccacctccagggttcaagtgattttcctgcatcagcctccctagtagatgggactacaggcgcctgccaccacgtccagctaatttttgtatttttagtagagacggggtttcaccatgttggccaagtctccaactcctggcctcaagcgatctgcctgcctcagcctcccaaagtgctgggattacaggtgtgtgccactgcttaatccagtcttaaggcacgctggagagcacccaccttcccagcccaccccagcgtcgttcactgtttctcacaccgtgctcaggtgaagagctcttttctccctttctctctcctcttctcaccagtctatccattctttctctttctgtctcagtttcactacaaaactatgtaactaacctcttttagttataagatttcagctttatcatacagcttgtgggaaacaatgaagtcacatcactaggaggtgtgattatagtgactgtggcttttataataactgtggctggagttctctcccaataataagtaatggaataaattccacatcactcctgtttggcttctgttgtcagcatttacaaaagtctggtcctttgtaactgttctgaccatgaaaatgctgatcatgaaaatgctaataggaagaaatgtattgcccttccaggtcctctaaacccttctgagctattcattttttaccccagatattctttctctgactatccattaatgaaggctaatagagaaaaagaaataatcatttggaatccctaaaccgaccttataggggggctcttctatattttggaataagaaagagccccattatagcacattccaggtaaaatagagattgcattatttataaagaccatcagacaagaatataaaacagattccaccccttctagactatgccaactgattcaagagctaggcaccaattagggtgacgatgtaattaacagtctaagattgtaacagattttccaagagtttgttagcacatctcaaaaaacagagcctggaacagtgctttccagcaggcttccgtcatgaccctggtgaggccccactcactatacctatcttgtcattagtcattgtccctttggttgggctgtgtccttcagtgaatcacaaatgacttgggcagagtgctctaatcaggcattgtggacggtacacagaatggctttacccttcccctcccagggagctcataggctagttgggcagggtggtcatagagtcagatggccacctgatacacctaagcaatgagacagagacatccttcctgggtgagagctgggtgctgagatctgagggaggtgcctacctgagtgagcagagccagaggactttgttgtgcattacagaaaccaatttgtgcccacagaagcccacagatggaaggagtttactgaaaagatgctggggggatgtcatgggatcagaggagttgctgagtagctgagacttgggagcaacgggcccaggccctcttaggggactcagcagcggcccttctccctgggttctgcagctagcatggctctgcagcccaggtgctggccagtccgcatcccagtgacacctcaggcctagatctgccttccatgactcaggactctcccagctccattcccggagaaagagcctgtttccagagaagggaggatggatgtgagcgaggaagtcaccctaaggggtagatactaccaaggggtttcacccataagtgagttgatgtgcgtcttgtcagtctgtaaaaagggttgttgggttattttgatataggagactttatcttaaagtgcttatatcacaacatctatgttgtctactgatatgtgaagcttctggaaaaaaagtagacctttgcttggccttcacaaaattaacattgatggttttgaccttgaggatgacccagagatttgtgccatgaggtagtttgtcgtttcgctgagtttatacgtgcacaggagtgagatgcttaacttgtgaaggagaggctgtccaacggaacagcccgacggttccctcctcaaagcataccccaggctcctacctggacgttccagtggcctgggactacccacctccatactcacttcagtcccacacataccctgtgcctgctgtcttccaggcccctgcgaagagaataaaggatgaagtggaggcttcgttctctggtaacgcatggataagctgaggaaacagacactggtgattacaatatatgacaacaactagggtgtggggcattcaaaatacaggggctctgagaagagggaccatgtggtctgcccggggggcttgggaaaggctttgttaaggaggtggcattcgatctcactcttgagaaaggagtatgagcttaactgctgtcagggaagaggaggcttccagacagagataatagtgcaggctgtgtttgggaaagagcaaacagttctgtgtgcttggaatggggatggggcgtgggtatgagaggcttggaattccaatctgaaggagactggagaacagaacacaccactggccttggttccacgtggatagtagaaaggcatcagttttttaagcagggctagtggtcttaggccagttttcagagaatttgaatcttacaaaatataattctgaaattaggattatgatttatactatttaaaaggtacttgaggatatagcacattgcatgtattatcaaaatcatcatcttagccatgtaaaccacactgtttaacaaacctgattattaatgagtcactgttactattcacctcactctcttggcacgtcttttctttttttttcctttgagacaggctcttgctctgccgcccaggctggagtacagagctgcagtctccaccaggctcaagcagtcctcccacttcagcctcctgagtagctgggactacaagtgtgtgccactacacccagctgacttgttaatttttctgtagagatgcggtcttgccatgttgcccagactggtcttgaactgctgggctcaagtgatccttctcagcctcccaaaagatcttgtcatttctcactccttaatgcttcttgataatctgttccctctgaacacccccgcaacatcacatgctgggcgaatcagctgttactgccatggcccccacttcacctccctgggccacatctatgctactcctcagtccactgtgggaatgggccttgtagaccacagatctggttttgttacctgctggagatcctgtaaggtagaatccagcctccttagcagggcttcttttccccttcgtgctccgactcctaacctctcgttcctggtacttactgtttatgctgtgcagaactcatggctctcactacgagccaggtccaccctgctagccagccataatctgtactgagaatgacacctttacgccccacctctgcctgctgcacctgtctccactccaggcacccctcctctgcatccacaactttctagaacctggggctcagcacatatcccaccttgcattgtgacctttgactcttgtctcctggaccagagtgagctgaatgggtcatgtgggaggcttttcctaagtgtctgttagttgaagttgtttcctttaagttgatccataccgaacaatgtgagaagtgtgtgaaacagtatggagactgtgattttggtccagtgggtattgtgtgcagtaggtgcttaaatatgttcacaaactgtgttgtaaagcaatttgcagtatggaatagctcatctgtagctgtcttgaaattaaaatacacatacgcttaggagtccactgcagtacttacaaatgccaatccctataaattaatttaataaatatcttaaagatttctgtatcataatcctaaaatgtttactgacaagaatgcagtttatcataaaatgaggccaggagttaatatctttttttaggtttccctgttcagtaccagcaagacatgccttttagtgtttttggcttcatgtttgccaaatagacttacttaatacagaattttttagacatccttcagactggacatcatccagaatttacttccttgagatcagccctccttcatatctcttgggtagaactctgtgtccgcaccacccacatgtctgaggtatcagcagccagagttgccacttttgtccttcaccagtaggccgtgtcacttgctgtgttctgaggggctcatttggagccattgttgcagatagtcaagcttagtgcccagaatggcacagtgtcacacactgcagaggcctcacctagaaaaggaatcctgcagttctctacttccccacagccatgattaggacctgtcactctggaaccaagttgccgtgtgatgtgacactactgtgaactaaaaatacagcaggtggagaaccagcatttcccattcatgataaagatgccatttgaaacctgggattgatctggaggctgataagtcgctggtaccatgtgttcctattttttttcttgtttttttaagtgaataaatctggaaatacatccttttgagagaaacctaacttgtaaagtatgttgtcaatagcttcccctttgactaagaacactttcaagagctttggagagtcatgtcaaggtacatttgactttgtatgcccagtacttagtgatgtttggtgtatagtagtagtagtcgcctaataaaagtttgttaatttaaatcaaagactttattcttttcaggtctaaaatcaatttatcaattatgtaatgttttctgggttgtccctttaagtgtatttaacttttaaattagactacggttcagaaagtctcaatataggaaagctgtgattatttcaaagatcagtagctgtattccaaacccaaaggcctctgtgaatatatcagggaggtacaagtacttctctctttggacctcattcctttggtgtttattgagcacatactctgtcagccactgagtaggcactagacttgagcctgcctagtgcactgtggctagaattcctcctgcctctgggaataatattgcacataagcatctgagaagcctggatcagggtccaatactgcttacttccggatgaaagtagcccaggtgtccctgtgctggtctcagcctcttctgagccccagggtcacttggtcctgtgctagtgggttccaaaaagtcaagtctctactttctcttttctctgttctgtttaaattttttcattgtaaacatggtgtgtaccaaaagtacatgcactcttatgatgtggctctggctggaagaactaatacagtttacaagagccaccaccttaaccctctctttgtcttcttcctcctgacaccaatgctgcctacctgccttgggcccagcccatctgttatgggtccccagggtttcccaggaggccacagccgggcaacaatttgacatggcgtatcttggtacctgctgatgttctcgcatccagcgaataaagccacggcccttgcattctactccttcctctcacctgtccacatcctataccatctgccctggcaagaatttattttcttttttttattattatactttaagttctagggttcatgtgcacaacgtgcaggtttgttacatatgtatacatgtgccatgttggtgtgctgcacccattaactcatcatttacattaggtatatctcctaatgccatccctccccctccccctgccccacgacaggccccggtgtgtggtgttccccaccctgtgtccatgtgttctcattgttcaatttccacctatgagtgagaacatgtggtgtttggttttctgtccttgcgatagtttgctgagaatgatggtttccagcttcatccatgtccctacaaaggacatgaactcatccttttttatggctgcatagtattccatggtgtgtatgtgccacattttcttcatccagtctatcattgatggacatttgggttggttccaagtctttgctattgtgaatagtgctgcaataaacatacgtgtgcatgtgtctttatagcagcatgatttacaatcctttgggtatatacccagtaatgggttggctgggtcaaatgatatttctagttctagatccttgaggaatcgccacactgtcttccacaatggttgaactagtttacagtcccaccaacagtgtaaaagtgttcctatttccccacatcctctctagcacctcttgtttcctgactttttaatgatcgccattctaactggtgtgagatggtatctcattgtggttttgatttccatttctctgatggccagtgatgatgagcattcctggcaagaatttctctgcctgttcctactggttgtcaccttctctctcccctggatgaactgacccttccctccctgttttccccatctcaggctactgctgggtttctacccacatgtcagggtctgtgttcctctgcccttaaaccctcagcagcaatctttggcccacgagatgatgtccggactcctttgtgtgacatcaaggtccactgtgagctggaacagcatgtcccccaggctccagccacccacaagtatttgttagcatattaatgcacgtaggctgtagcagcaatggcccctttttactagcagtgtgatcctgggatctactgctctttgtctcagagactctgaagtaacttggtaagagaatatggggaaacacattggacagatcccttagggacctcagatctctaggagccaaaatgagagaaagagaatgaactttgaagtgagacagagaggagctaggatcctgcttacaagctgtgttagatttggcctccttattctacttccgtaggcccctttttctcgttgtacaatggaaacaatgtaactcataggatctcatgtgagatcaagagttataacccataaagtgtttacaacagtgcctggtacttagcaagtctcagtaaaggttgcagttgacattagcagtagcagcaacagcatataagccacacagttcaacagaaggttgaaagcaggggctgatactccatgggttttcagtcaaatcagaatcttgatgtcacttctgtgatgacgttgcactcttttctttccttctgaactgcattcccccagccccacacaaacagccctttgcttatcaaaaacccatccttcaaaatcctgttaggtttacacttctccacaaagcttttcctaagcccctagctggaagcacttccagttgttgatcctatactgccttgcaggaaagatgccaccaccttcctataatttacttccttgccaattagttggtctttgactaagtgtgccccttctgggaagttcagctgctatcactgttttatccaggaaagcctgatgccttgtgtagggttttaccacttgaggttgctactcggatagctgcaaataaaaacataaattacatctctaactgaaactgaagcatgcctcctgttccctatgattgagctaagctgctaaacataaatcatcagagcgacaatcagctctttcactcccaaagctgaagaaaggaaaagccagcaatttctcatgtgtgatatatgtccaccctctcacctggtgttttataaacgtattgtcttaactgtcttctaagtatctgtgcctgggagggtgccttcctctgttttgtaaaatgccaagtgataccactgtgatatataaataatgataattagaagacagcctcaaattatttgacattcagattgaaggggaaagtagtacttttttttgtaataacctagaatttggatcagaaatggcattcaaaataaaagcatattggtttctgtcagacagggatagttcaaaccttctcatatctgaggtcgaatatcacaaaatggagtcatgggtcgagcacacagcctcagatctgggcccaggctgtaaagaaccataacctgtggccacgatatatttgaaaatatcaggactaataggagctaaagaagagagaagtcattttttacctgaaactccataaaagtataataatcattaacttggaatcacttcccagccactagcctctttgttttttaaaatgtccaaataccagggtttctagaatttggctcatcttgaccctgcctgccttaaattttcaaggaattcttcctttgtcatagttcctggtggtgaatgtgagaccatttgtttgcttggtggaaggaatgtaggaccaagaatcagaaagacggtttgatttccagccctgccattatttttttttttttttttttttgagacagagtctcgctttgtcacccaggctggagtgcagtggtgccatcctggctcactgcaacctccgccttctgggttcaagtgattctcctgcctcagcctcctaagtagctgggattacagatgcgcactaccacacctggctaattttttgtatttttagtagagatggggtttctccgtgttggccaggctggtctcgaactcctgacctcaggtcatccgcccgcctcggcctcacaaagtgctggcattacaggcatgagccaccgcacccggcctttttttttttttttttgagacagagtttcatcactgtcacctaggctggagtacagtggctcgatctcggctcagtgcaacctctgcctcctggattccagcgattctcctgtctcagcctcccaagtagctgggattacaggcatactccaccatgcctgactaatttttgtatttttagtagagacagggtttcactatgttgatcaggctggtctcgaactcctgacctcaggtgatccacccgccttggcctcccaaagtgctgggattacaggtgtgagccattgtgcccggccttgccacttttaatagctgtgtggccttgggcaactatttaacctccaaatatgtttccttctctgtaaaataggagtgattacatcacagagaattgtcctgaaaatacttataattatactcatttgtttcctggaataagtaccatgggccagtcattgttaaataacttaaatatcctcacagtagccctatgaattaggtgctcatatcatcttcatttcataaacgaggaaaccagggcccagaaaggctaagtaacttgcttagagccacacagcaagtaagcagtctgcaaaagcaagagataattagggacttcctcagatccagagtgtgtcaaaggtaacatgtgagcagggaaacctgggggcaggtgctgccgagctggcctgcctgccctccgtgtcttccctgtccccctcctctgtgtcttccctgtcaccctcctctgtgtcagtgccctcgccctcccgggatgtgcctgctctgtgctttgctgaccctgcctttgattatgctgttctcacgcttggtattcttccctatcatctctctgtttattaaaattacaccaatttttcaagccctagctaaaatatcctctacaaagcctttccttatccttcttggataaggaaaatgactagaagaagggcacttcttcctattctgtctagagtttgtgcctggcatctgccacctcctgcctttcactgtattactgatcaccatcttcatcagtgctgtaacccatacctttctgtaggtcttgacatgcacaaaacactttcacacaggttgtgccatttgctcttatgcagaaacttataaaggaagcaggaaaggaactttagttccatttctacagatcggtatttcttgaacacctactatgtaccaggacttgtgctgggtgctaaagttagaaatggtaatgtctccagaagcttgattatctcatttttactcttttttttttttgagatggagtttcactctgtcacctagcctggagtgcagtggcgtgattttggctcactgcaacctctgccttctgggttcaagctattctcctgcctcagcctcccaagtaactgagattacaggcacacaccaccactccagttaatttttttttttgtatttatttattagagatgtggtttcaccatgttgtctaggctggtcttgaactccggacctcaagtgatctgcctgcctcggcctcccaaagtgctgggattacaggtgtgaaccaccacactcagcctttcccacttttacaaacacagaacatttttttttaaattttattattattatactttaagttttagggtacatgtgcacaatgtgcaggttagttacatatgtatacatgtgccatgctggtgtgctgcacccattaacttgtcatttagcattaggtatatctcctaaagctatccctcccccctccccccaccccacaacagtccccagagtgtgatgttccccttcctgtgtccatgtgttctcattgttcagttcccacctatgagtgagaatatgcggacaaacacagaaattgaaacctaggcacagtggctcacacctgtaatcccagcactttgagagcctggggtgggtggatcactcgaggccaggagttcaagaccagcctgaacaacatggtgaatccctgtctctactaaaaatacaaaaatctgccaggcatggtggtgcatgcttgtaatcccagctgctcgggaggctgaggcatgagaactgcttgaacccgggtggcagaggctgcagtgagccgagatcacaccactgcactccagactgggtgacagagtgagactctgtctccaaaaaacaaagaaacctaataaaagtggccaactgtcccactcaacatctgttttagtccctgggacctgccaggctctttgccacctctgggcctttgcggatgctgttccctccacctgcaacataattctttccactcccacctgaccaaactctgctcatctttcagagtttaataaaggtgttgcttttttaagagaggcttccactgatcacccgctcctgccaagtctaaaataggcctgctattctcttatggcactcctttgcttttctttgcagcacttagcacaaatagtaatttttattttacttttatagatgtattttatgtccctccaccagactgtatactccatgaggacaaggatattgatgtttatgttaactcttgtacactcagtgcctggcaccatgcctgacccagaagagggactcgagaaataaagtgtcgaatgaacgaatgtgcagacatcagtcatttactcagcttaataaatgccagagaaaagtctagaacccagattatctgaagcccagtcaacacggacctccccatgttctttgacactgcccatgaccagcctccgcttgctaagttgcacctcagtctttgttctttttatgggttcctaagacatcagcactgttgggtatgtgcctattgaggatttgaagggtggatatgtgtgtggatgggtggacagaaggaatgagagacagacggacaagcagaatgccaggatgatccacgaaggggcaggagttggtcaatgtatggaagcacgagggggcacatcggtcatgtggtaagcacctgcactgcggcaggccttgtgttggaaggaagtggcagtgtgaacatcagcctagatatagaacctccacttccaccctgattaagatctaaaattaataccctattctagagttcttggaataaaccttccattttgataggtcttaaagaattttcatttttatacttctgtcacattatattggaacactttcattatacatgaaagcagcttttatttcttcttactccaggcagcctgttactatagcaatgttggaagtattttgaggtatttttatacagtgagttctacaaactccctgcaaactgtacataatgttgggttgaaatgggctatcatatccaaaattgtctctcttgtttctttgtatcctttgaaaacttttgcaaactttgctataacttaattcctgaaaattaaagctcttatgtttagaaaggaaaataatttggggcgggggggttgtaaatatatttgcctatgaacattgaaaatacctccaaaataatttgaattttatttaggtaccataaagatattattgcttcttgaggccttctggtttttttttttaaacccagaaaatggggtgcaatcatagatttcctctgtgtgtctgcagggtctagacagtttcaaagtgaaacagaagttcttcgctggcagccaggagccaatggccacctttcctgtgccatatgatttgcctccagaactgtatggaagtaaaggtgagacacagataaaggaaaaccacgggtggatatgcataagaaaaacaaacagagcccaggagaagcctttggtctcagtgggatcctggctcatggaaccctctggaagctcaagtttgcagagggccctttgccagcctgtctggggccttgtagccactggttagtcttggaatccctttgcactcctataattactatacagatccttcctgacttacactggggctacatgctgataaacccctcatgaattgaaaatatcataagtcaaaaatgcatttaatgcgtcaaatctactgagcaccatagcttagtctagcctaccctaaacatgatcagacctcttaaattagtctacacttgggcaaaataaatcaaagactgttttataataaattgttgactatctcatagaatttattggagactactaaagtactgtttctactgaatgcgtatcactttcacaccatcataaaggtcaaaaggtcattaagtctaactattagaaattaaaaccaagaaatgtaacaataataaatctattgtaacgtacatttatgccaggcacggtggcccacacctgtaatcccagcacccttggaggccgaggcaggaatattgcttgaggccaggagcccaaggccaccttgcccaacatagcgagaaccagtatgtaaaaaaaaatttgttttaaatagccgggtgtggtggatcatgcctgtagttccaactatttggatggctgaggtagaagaatcgcttgagcccaggagtttgaggctgcagtgagctatgattgagccactgcactccagcctgagtgacagagcaagaccccaactctaaggaaaaaaaaaagttcttatgacaatttccaaaaagaagaaaatagcaaggaaagtggtgttttatgtttttgcaagcctctttatgtgcatcttaaaaggtgacacctgaattctcattgctgtgttctcattgaggctgttgtgatatcacatcgcatagcctctgtatacctgtgtaaaaatgaaaatgaaaacaacaaatgatggcttaatactacaatgaaaataatgttgacttcacaggccctcccaaccaccatgctcacaaaccctcaaaagggaggtccccaggggctacactttgaaaactgcatgcattgagtcttaagggcagtgaccaagtatctttcacagtagaaacacaataggaatagctgcagaaggttcagttgtgctcagaggaaggctggctggcatcagtgtacccacctatgtctggcctgcgtgtgtcccagcctcacaggctgctctgctgcttttatcagccctgagaatatctgtctttaaggtgggtccacacttagcaaactcagacaggatgagatatataatcaagacacacttaatttaaaatggcaaattacatcaccaaatcagcatattctccactggaaaggagaggcccacatagccaaattataatctgcaggtttctgagccagtgttaaatctgaacagagaaaagatttttttttcaattggcaaattttaatgacatcactcattgataccccaaaatctccagttcttaccaagcttggccttgcccagtggttcctctgttccctcaacaatgtttcatggaatctaacaacttccctacccactaaccttctcagctttcatggtgaaccaagcctcctctgtcgcactaaccttcccagctttcatggtgaaccaagcctcctctgtcccgctaaccattctcagctttcatggtgaaccaagcctcctctgtcccgctaaccttctcagctttcatggtgaaccaagcctcctctgtcccgctaaccattctcagctttcatggtgaaccaagcctcctctgtcccactaaccttctcagctttcatagtaaaccaagccttctctgtctgatgggccctttcttagatggtgttaacacatctgacaaagttaatcctatctcatgctgtccagtgtgccatcctgcctcttgctggtaactttgtatttctctaatcaatagtttgatgctaagtttcaggaggcattctttttctcctttctaaagtgtggaaatcccctatgcctttctgttgagtcctctaaatttcttgtgtattcatgcatatttcgttttcggtagcaaggctatctagatttttatcagaatttaaagcagtctgtcaggatcttacctgccaccaaaaaaaaaaaaaccccaggaaaaccctgctttaaaatcaggccatgtttctgtgccaactccacaacttactaaatagacttgggcatttagttactttctctaggttttagtgtgtctgtctacacagtgaggaactgtgagtatctaccttatagggttattgaaaagattaactgagattatctataaagtacttatcttccctcttttggctttgtgctacttttgtcttttctccccttatctgttcttcaggttccttttcttcctttttttttttttttaacccaagttctcctcctccctgttggaagtggggactgactgactaggctttatctgctggggtctggccttgggccctgcacttcccacccccagccctgcaccctggctggattccacccccttcatttctttagtcctaatcttcaaaggactaagaaggcaaaaatggaagcactagaagagcctgaaaaatgttccaagggccctttccttccagtaaagtaagcattcccaggaacttagaagtttacagctaggtatagtgtcttagaccatggaatgagaaatcttttatttggccagcaagcagaatgctttccaatgtttaaatgagttttgtttgtttcttcagcatttcttttgaaagatacatataatctcagggtatgcttaagctaaaataataataataaattttttaaaaaataaagatacatacaagagagactggagcattttatttaatattggtactgttttgtcctctacactgcctcagttgcatgtaggataatgctagtaattcagtattaccagttcatatatagccaacattcctgggaagccatatggactatagaaaggcatttaccaagattgaaaaagtaagtggttaagaacatttgaaaagcacttcattttaaaaagtgattttcaagccattgtaacacctctaagatcttgtcagtgttattttaaagacagaagactacaaaaagcttagcaaaggaatatactgctgtgaatgaagtaaagctcaatgcaagaggctgccagatatcttgaaaccaagaaaatgatcaaagtaaagcaaaaactaagactcagctaccagtataccctgcttggtgcagtagttactgtttattcattctctccacagatctatattgagagcctattgtgtgcagacaccatctaggtgcttggaatatgttggcaaacaagacaggcacaaatccttactctcatcaaacttacattcctcttctcctgaaaaatcaaacttaaccaaacccattttactaatagtaattttaaaagaagcccctcccccgccccttaaaaaaaaaaaaagatagggtctcgctctgtcacctaggctggactgcagtggcatggtctcagctcactacagcctcaaactcctgggctcaagtgatactcccacctcagcctcctgagtagctggcactacagtgcgtgccatcatgcccagctaatttttaagaaatgttttgtagagatggggtctcgctatgttgcccaggctggtcttgaactcctgggctcaagtagtcatcctgccttggcctcccagagtgttaagattacaaatgagagccaccacacctggcccaaagaaggcttttataaagcaaaatcaccaacttttaaaatctaacacagattatttccatatgtcccacttgctgtgtgaccttgattttgaagaggaagcaaaatagactggtgtgtaatcttaacctttcttccaagggcatctgttttgcactcccttcttagcttatattcactttgttatcttatatgctatctagagagtaaagggtgaagaagtaatgagctaagggtgaaataaagcctatcttatttggacttaataaattgtatgactcctttaagaagtaactgaacatgcaaagcttcagaggtactagttatagtctattaaggaggttgtttcatttttattattttaaaaaaatacacatatgagtacttatatagtatttttttcctttcaaagttttggcataattccaaatttacagaaaagtttacaagaagagtacaaagaattcctgcacactctttacccaagttcctgaatgtcaatattttatcacatttacatcctctctcatatcaatttttctcatctatttgagagtagcaaacgtgatgtccttttatccctaaatactttgattgtatatttcctaaaaagaaaggcattctcttacgtaactacagtacagtgatcaatatcagcagttaacattgatccaaaactgtattcaaatttcatcagtttcctcaataatgtcctttatagcaaaagagaaagttcatgcattgagttatgtctctttagtctccattaatttggaacagttccacaattttttgtttcatggcatcaacacattgcatagcatggaccagttattttataaactctgaggaacattctactttgggttttccactcaccgtttctttataattagacccgggttatgtacttttaccaagaataccaaagaagtaatgtgttcttcctggtgcatcatatcaggaggcacatcctatcgatctgtctgattactgatgatgttaactttgattgattggttaagttggtgtttaccaggttgtgaataattgttgacaagtataatttcaaaattttttttaaaatttaagtggctgaaactaaactaataaactgcaaatgtagttaatagaagaggtccttaaaagctgattggcacatgaggtatgcataatgtagatttagcatatacataatatacataatcctccaaaaggttttaaaaccatttgttcctaaatggtctaaccattctcccactgccttattaattttaaatagctccctactttcagatagtagcagaataaacttcactaaacctgttagaattattgctagagtccagaatcatcaagtatttttctaagggaaactaagttgattggattatcctttccaaataaaatgcacaaaaggtatattgctttaaattgttggtatggctggatgtggtggctcacacctgtaatcccagcactttgggaggcagaggcgggcagatcacttgaggtcaggaattcaagaccagcttggccaacatggtgaaaccctgtctctactaaaaatacagaatgtagctgggtgtggtggcacatgcctgtaatcccaagtacttgggtggctgagacaggagaatcacttgaacctgggaggtggaggttgcagtgagctgagatcgtgtcactgcacttcagcccgggtgacagagcgagactccatctcaaaaaaaaaaattgttgatatgttttatttttaaggacctgtttttgaaagatcttcagaaatgaagttttttttttttaatgaagtaccccaaaacattttttagaatgattttggccatctcctttagtaaaatctatttttgtttcatagcacaaacagaaggctaaaagtaaactatgagttcagcttttaaaattactttgtaatcaggaagcttaaggaaatctagaattgaaattgattcttttgaaataaataagtactgaattttcagcaagttgaatttatcctcacaccagtaagatggttctattctgctgtatatagtcacagattaatatgtgcagttcacagagaaaggtgttaatgggtttcagataacattgataccgtaattacaaataattgcatttctactaacttggtaaatcagtgcaaaacactttggagctctctttggcatttctagctggcatgtctcgtacattccttgatttcagagtaggctaatgtaaaatggcattggatcttttaggataattggttcatctctttggcattccaccctgcccccacaccctactttacttattcctggtataagaattaaaagtgactgctcaggcgaagacagtgacagtggcttctggaggtcgtacatcaggtttcgcatagagatgacagtggaaaatgtatgtgtgggtgttcgggcatgggggtgagagcagagtcataagtccttaacccgtggccatttcttagggggttggagaaaagaccttattacctggctaaacaggattttgtacgtcacttggatttatctgattattaaaaaaaaaaaaaagaaactgttaagacctacatagtacatagggtgacaatccttatcctctgtgagttgagggaggtgagtaatctcaaaagcagctagcattcattaagtacttttgtgtactaggaactcatatgagcacttgacatgaattaattcattgtatcctcacaaccgcatgatgcaagtacgatagtacaatccccaatttccagatgaggaatctagggcactcagagtaacttggtcaaggccccactggcagtctggttccaatgcccacaccccctttcccgttacatggtactacctccccgtggagagctaagttctagagttaaagaggcagaagaggcacacagtatgaccacagggagagatgggacagagactctgtatataaagagatcaaaaccacatgggctgtcattttcatccttccagccatggccttaatgtaggcctcctctttctcacccagccttgcttacttgttcatcttcccagttctggtctcctcccactggaagccatcctctacagtgctaccatgcacatctggtcatgaccctcccctcttttaaattcttccactatagtccagaaaaaagacagcttcccatccccgtagccttgaatcccaaactctgactacatcaagatcatctttagaatttgataaaaatgcatattgccaggccacaacccagacctactgaaacaaggtctctgtgcatgtgtcctgggaaaatgttctctaacaggctgcccagcgtttctcatgtcagccaggttaggggactgctacacagatgtggaaaaggtcagaactccacctctgtggcatgcctgcttgtctgtcttccccactggactagaagccctgcgaggtttcatgcatggcttattcccctctgtccatagcacctagcaaatctctggcacctagccagcatgcaacaaatgttttaaatacgtgcatgaattattacaaggcaagttgttctctcatgggacaatttaggaggattgcataaagcaggttttcctctcaaccagtgagtattaatgctgatttccaggagtgatgagttaaaagaatcacaaccaccttcttttctcctcctatggttatttttctagctttgcctccaggtagtgatgggcttttcagccagctatagacattctactcatttaaacagcagagtttagtttttgtattggaaaggctaaaaactcaaaaagcagagctacagggaatttgccaacagagtggttaccaggtccttgcttggtcatttatgacctaattttgagggagaggagtaaatgcaacagtgatatttaagttactggctgagtggtaaatgcttgtatcaaaaatcctgcattgctgaatagtatgtctaatagcactcatagcaagaattgggtgtcattggccttgggaatgaagcagagctgatgttacccaacagaacagtatacaggaaacgatgggtaaataacagaagtccaagcacagatggagtttccagtggaagagagcaagggcttgctgaggccaatgagtgcaatggggagtcagatctgtcagccctgccagaccctcagcctcttaggaaacaagcatgcaacacagacccaggtgtatggctctctaacaagcttgtttagttaacaaagaagtgtttggtttcatgctttcagaccatcccaaagccagagacagacaaacagcgttctgatgatttgctgccatctttggtattttttcctacctatcctgctgggtgctgctgttcgtatgatggctctgaacaaaccgtgaggctgcgagaagacagcagcagataccattgtttgtcagaccttcctgtgacctaccatctgcctctgttcaagagaaagggaaaggttgccccagaggcgagttcgcagttgggagacactgctttaacttggtggtccatgccagacccgccaagaagcagtttacaatgtgcattctagccccttgaagtttctctaacacttaccaagacaataatatggggagttatttttaatccttgtgatgtatttacggtctacccatattatagttcttttgaaatggtttgactctagcagtggcaatgtgtggtaaaagtgatctgttgaaatgttttcaatttctgaaacatcagttaagatgaagaaaagttcacatttattgagcacctacaacaggagctttcacagatgttctcatttgtgctccatagtaatccctgccagttgctaaagtaattaattcccattccatagaggaggaacttgatgccataacccacatgccttccctagggtattaagagggacggaggaggtggaatttgacatggtcctcagtgtcctttccattgtaccatacccaggcatgttgttttcttcagcattggtctacagttatttatacagaggccttcatgtttcatcaattattaacccttaacaatagaacaaaaacattttataaatgtgactgtgggcctcttggttacgtgtgaccagctgagagctgcacctgtggctgtaccaactattactgttgctttcttcagcttcctaaaagaagaaaggaattgctgccctttgttaggccttttctgtctgccagatacaatgtctatgtggatttttctcagtcctcgtgacagctccacaacataggtacagataaggaacctggggttctggttaaagtgatttgccaatgtgacacagctagtaagtggcagcaccaggatttgcccctgtgtctctgcctgcctccctgtattagtctgtcctcacactgctaataaagacatactggagactgggtaatttataaaggaaagaggtttaattgactcatagttccacatggctgtggagtcctcacaatcatggtggaaggcgaaggggaagcaagacacatcttacatggtggcaggcacgagagcacttgtgtaggggaattcccctttataaaaccatcagatcttgtgtgagacttattcactatcatgagaacagcatgggaaagacccgcccccatgattcaattacctcccaccaagtccctcccacgatatgtgggaattatgagagctgcaattcaaaatgagatttggatggggacacagccaaaccttttcattccccatgttcactcacctagtgtcctaataggagccttcgctaaaagctgttgtctgaagggggagaatcttctgggcttggttcagaaaatactctaccacagtttagagagtcaagcacataagtgtttttatgccatcaggtgagtgcattttctaccatcctattcaaataaatattacgtaatgtgtttttcccccagatcggccatggatatggaacattccttatgtcaaagcaccggatacgcatgggaacatgtgggtgccctcctgagaatcttgaggcactgtgaaatttaagtgtaagacattgagccacaaacatggaatctcttctttgtactggatgtccacttcccttaaagtcttatttgcacccttacaaaatctttccaaaggtcactcttatgaatggatgttggttatacttttaatggacattaacattcctaataaagtattagtttcttaattcacttttatatgttttggaaagaaaattagtgaacttctctatgttaaaaatacgtactgcttgagtatcccctgtctgaaatgcttgggaccagaagtgtttcagcttttggatttttttgaattttggaatatttgcatagcataatgagatatcttgggaatgggacccaaatctaaacacaaaattcatttatgtttcatatacaccttatatacaataacctaaaggtgattttatatgatattttgagtaattttatgcatgaaacaaagttttgacaggcttttgaccgtgattcatcacatgagttcaggcatggaaattttcatttggagcatcatgtcagcactcaaaaagttctggatcttggagcagttcagattttcagattagggatgctcaaatctatatagatataaaattatcctcacagtaacatagaatctcttggtgctgtcagctgttgggaattgaagattgactttgtgcttccaccctccatccagaaaggcacccttcattccaccagaactttacccaggaagaacacgatcatttcctttttcaccgatgccctctctcagctttctgagtacgtctcttggggtcgctggaggtgatcctaggatctgtctctgagaccaatgtgctgtttcagccccctgcagctaagaattgtattgactgtcctcacagcggcttttcatagctttcagcttcagctttacgaggcttctcctctctccctggcaccctgctggctgcctcactgcttacagacaggtcccaccaaacccaaacacctgcctagggtaaatgggtctctcttctatccccagaaactttcagaggaagcagctcatagaaacatacaaaagcacacaagtattttgggaaaaaatcctaaaaggtgacttaatttgatgccttaaattcacaagtgaggaagctaaggcctagaaggttaaggatgtccccagggtcacacagtgagcggggctcagagcttgagtgtctttgtgctttgtgtacattgtgttctccctagggtgctttagaccctgtttgttttcttctgcatgaggctgatttccagtttgtcatcaacctctttatcttataatttaggatagagttgaacgttagtcttgaaagattttctaaagtagtctttcaaactgttcctcagaggcctaggattttccaaaagtaccttaggaaccttgtaggctgcagtgggggtgtggcgatagagcaggaggcagggagacagggctgcagggcctcccaccttccaacagacaggctctgctgtatctgttgtacatactgggattctgtaaaggacattatctggggtgttgtatgtatttttgtgtgttctgctttttttaaataaacttgaaaagctactgaa

SEQ ID NO: 55 - DNA, 16911 bp, Homo Sapiens
taaacaaataaaattctttatttaaatttctcttgtggggaaaatatttttctttaaagcacacttaaaagtaatttgcatttacttcctgtaaagcatttccatttcacaattagcaaaactaaaaggctatgtctcttcatgcatttatttttgttagaaaaatgtcccatggtgctatcaaaccgattttaaccatcatcaagcttaactttgcctctgttgacaacatgactacaaacatgaatcaaaaaggagttaaggaattttaagccataaggtttcaattatagcttaccaattatgtaattagctgacaaaaatcaagtctgatgtagaatagctgtcatctacttaactgcagataatcatggcattttcatttaagatgatctgaacttatgaaataaaggatccagtcccaagaactcaataatctcttatgttttcttttgaagacttatttcaaatattaactatttcggtgcctgaatggaaaaatataaacattagctcagagacaatgtggtacctgtttggaatccagctggcagctataagcaccgttgaaaactctgacaggctttgtgccctttttattaaatggcctcacatcctgaatgcaggaatgtgttcgtttaaataaacattaatctttaatgttgaattctgaaaacacaaccataaatcatagttggtttttctgtgacaatgatctagtacattatttcctccacagcaaacctacctttccagaaggtggaaattgtatttgcaacaatcagggcaaaacccacacttgaaaagcattttacaatattatatctaagttgcacagaagaccccagtgatcactaggaaatctaccacagtccagtttttctaatccaagaaggtccaaacttcggggaataatgtgtccctcttctgctgctgctctgaaaaatattcgatcaaaacgaagtttacaagcagcagttattccaagattagagttcatttgtgtatcccatgtatactggcaatgtttaggtttgcccaaaaactcccagacatccacaatgttgttgggtaaaccaccacatctggtaacctgaaaagaagaagaatactctctaagatacacatagccttttgcccactaacttaaaaaaaaaaaaaaaaaggtgtttttgctattaccgtgcaagaaattattaatgcagaaatgcaaaacaatgagatacattataaaaagtactatgctgcatagtggtatgtaatataaaaatatcaagacagccagaggggtttggaatttgccccttctcttctgccataaataggttcctaactttgggtttcagataaaacttagaaggctgaatatacatggcctgttactgctgttatctgttttcaaaaactgaactcaagtgaaaagaaggcagaactgccactctactttagtctacaacttcagaagtatagcattcatatgatccaaaaatttcaactgccttcagttttatttgaagtttattaataatattaattctgtttgctcattcacactccaggatttaaaaaaattgtttgcggtaaaatatacacaatacaagatttatcattttaacaattttttttttttttgaggtgggagtctcactctgttgcccaggatggagtggtgcaatctcggttcactgcaacttccacctcccaggttcaagcaattctagtgcctcagccttctgcatagctgggatcacaggcatgtgccacaatgcccggctaatttctgtatttttagtagagatggggtttcaccgtgccggccaggctggtctcgaactcctggcctcaagtgatctgcccacctcggcctcccaaagtgctgggattacaggcatgagccactgtgcccagccattttaacaatttttaagtgtacagtgatgtagcattaagtatattcacatagttgtgcaaccatgactaccatccatctccagaaccttttaatcttccccaactgaaactctgtacccattaaacaccaattcaccattcccttatacccccagtccctggcaaacaccattctactttctgtctctatgaatttgaccagtttaggaaattcataagaggaatcatatagtatcttttcctttttggattggcttcattcactcagcataatgtctttaagattcgcccatattgtagcatgtgtcaaagtttcttcattttaagggtgaataatattccactgtatacatatagcacattttgtttattcatctgtcagtgatatttgggctgcttccaccttttagctactgtgaataacacagctgtgaacatccatgggtagacaaaatacattcaaatccctgctttcacttcttttgggtatttacacctagaagtgtaattgatgcatcacattagtaattccatgtttaattttttaaggtcctgaaaaatcccactgtgtctcaactgagctataggcagggagaaagagactttgtttcagacctggagatctggacatggtggtggcaggaaaagtgggtaaaaaaggctaataaaagccaaaaaagaaaaaagaaaaggaaacctcagaaaaaaagagagtcaggaacaattatcacggtccaatctttccattgttctcatattgcacctaggaatactgcaaagaaacaaccttttctaaactcttctacaatcattttctctacctttctttctaatcctatatatatatatatacacacacacatatagtttagtgttgtctatttctcatgcacatttttattttcctccaaaaagagccccttcttcccctaggcatacagcataggctaaacaaatattcgctgaattgcaaggtcacttaagacattttgagtgactaaaggtcctagttttaacagctttggtcaaaggaacctaaattagtctccatagcaataatctgtcctcaaacatcaaactgactttgtcactcacctctcgatcccttagatttgtatctcctgcaaatataactgtagctgactctggagcctcttgcattttctttaaaaccatttttaactgattcattcgttccgcagcatgccctctggtgctctccaaatgggatgtcataaggcaaagctcatttcctgacacgttcacctgcagcaggacaaacagtcattaaaactgtccactgactattaatactgaactttaataataaaatcagcagattgttctgtcaaatggtatatatttactaaactgaaactgtaaaatcagcactatgcctatccctccggatcaaaagaagtattaaagcagtaaccctgtccccaaagacgacggtttagcaagcacgacctacccccagatgtcacctccactgtgaacctttccccagtgtccccaggccatcagcggctccctcctcaatacaccaaaggcatgctgaacagactgtttcaaagccccctaggctaaattaaaaggacaattatttccctcctacaaagccataagtcatttgcaaagcagagatgattcttatttattgctgtattattaagggcctggcatacaggtattccaaaaaagtcagttaactgaatgaatgagaatcatttaccatttgcaattaagacaccaacaatgtacaatctatcattatactaagtgtctgcagaatcaagtctaattctttcatattggtcattcatgctcttctataatcaggagcctacctacttctcaacctgtcacatttgcctctccatggcccctacactcaactgaatagaatgctcattcatactcatacatgtacacctcttgcaacttgcaaaagtttgctcatggtggtttctctacttggactctttttaatatgtatgtcttacatatttttcagggttcatttcaaataccatctcctctataaaactctcactaaacaatctggctaaaagtcatctctcctttctctaaacttccacacatcatttatacctctcctgtggcacttatgcctttcttatgttttagttactatatacacactctcccttactaatctatatactatatcagagcaagatctatttttcatttttgtaagtctcatagagtaaaatatagcagcatgtatagagtagaaagtaaaaacattactttaggaagcaaatgtggaatgtcagcaaactcaaatattcttaagaaaacaatagactgagaattctatctgcatttaaaatttatgtaaaaaattaattttagagagtgttaaagactatctaaaagaatctacatgtgtgaagcaaatttttctctaaaggcaatggttttaaaaagaataataacacaaaactatgaaaaaatcttttttttataaaacactcaatttttaaaaattactcacatgcacacataaaaggtttctcatcattttggtacttggaaaaggaataatctcttggctttttaatttcactcttgatttcttcaacattatagctgtgaaatatccttcttcatgacctacaaatgtttgtggaaaagaatttaggctgagaaggtgagagttattttcagtttaccacaagtttgcctattgaagaattttatagcaaacaggtaacagatatttacatggatctaaatctttaaactattatttcaaaatagttcatcatggccaaacaagtctacctcctccctcccaaattttagctagaagcttagaagaaataaaataaaataaaaaaagaccaggcacagtggctcatgcctgtaatcccagcactttgggaggtcgaggtgggcggatcacctgaggtcaggagtttgagaccaacctgaccaaaatggagaaaccctgcctctacaaaacacaaaattagtcgggcgtggtggcacatgcctgtaatcccagctactcgggaggctgaattaggcaaatcacttgaacctgggaggcagaggttgcggtgagctgagatcgtgccatcgcactctagcttaggcaacaatagtgaaattccgtctcaaaataaatgaataaataaaaatgaaaaaaaatgtaaacaagtgccaaaaaataatgctgccaatatcagatgagaaaatttgagaaatttctgaaagacacagagtagatgagatgaactgtggccagctgatagccacttactacttctcatactagaagtttcagaaaaattatagtaaatgaataaaaatctagaaagatataaacctgcaagaacagaaaataggagtagaggccatgaatgaaagcttccaacagtttttcagaaaacagaaaacagatggagaagtggtaaccggtttatcagaagagaaggaaaccacttgagtgactgtagcagagaaccatagacaggaagcaagcagatttgttccaccaaaatctggaaacacttagtgcttgaacataaaggtaccacaaaaggtaaggtgctgagctaagaagaggagggccagttcaaggtctggatatggggttaaacaacccccaggtttcctcaactccttagagctaagtgactgtccctctattaacaggagactacagttttacatagaactaaattttagaggctccagagtcaccagccacagggaggggcatgcatgttagcccacggctgataggtgaataggttgaacactgattaagtaaagtgtgcctactcagctcccttcccctcacctgcttccagaaggtaggcaaaacaagcacaccaccccagtcccaacacccagaaggcagaaagctaaataactcttttttggagaaacaaaatggtctcagattaaaggcctgtatataccaacacactgacaattgtgggtctccctcaaatgaataagcagtttgctctacaatcaatccctcacccctgtccagtaaggtaaactacttagccttgctcaggcatactaaactgtaatcaacattttagtgtttggtgtttaaatgtgaaccaaaagccaaggatccctacatatttaaggaacaggtctaacatgacatgatggatactgacataacataatcaaaataaacaaaaagaaggaaataaaaacaatgcagggaaagagattaaaacctaaaacaaacaaaaaactaacaaaaaagatactgtatccataaaccaagaaaagtgtgccataaaaaagatattcagtgaataggaggcctaggaaattaaaataatgctatctaaaagtcaagatagttgccaagaaagtagaacagtcaatagagataggagaataagagaaagttaagaaaattcaaggatcaacccaggagatccaccgtttaacagagggaattcagaaaaatgggagagtaaaaaaacttaagggaggaaagaagagacagggagaaaaggaaagagaaataacaaagataatgaaaggagaggcgaggggaatggtgggagggagggagagggaaaaggattttccaactaaggttttccacatattaaaattccacagaataaaagttcccaccaagcattcagtacaatagattttaaaaagacccaaagaacacgagggttaaaaagaagaccctcaaagcttccagagagtagggaaaaagaaaagaataaaaattagaatggcatcagccttatcacccatcatcaataatggaaactagaagacattgaagaatgccttcagaattctgaaggaaaacatctatttacccagatacctatcttcagccaaactatcaagaactacaaagctacgacacagacattttcaaatatgctgggattcaaaaacttcactatccatgcactatttcctagaaattaattagagaaggtgctccaataaaataaggaagtaaaccaagaaggaagcatgggaatcagaaatcctaaaagaatccccaagagaatacaaaatagttccataaagagagacacacacagactgagagagaaccctctccttagaaattctcgattaaggagtcgattgaaactaaaaatcacatactatataaaaatgaaagtcaaagaaagcactatacagttgacacttgaacaacacaagtgaacttcaaggtccacttatacagatattttttcagtaaatacggttggtcctctgtatctgcatccacaaccaaatgcaggttgaaaatacagtcttcccaggacatgaaacctgcagaaatggagtgcgcacatatagatgggttctgcagagcacactgaggaaactgagtatgtgcgaattttggtatccattgaggaaccctagaaccaatcctctgagaataccaaggaaagactgtatatgaaaatcacgagatgtggccaaagtagtattttaaatatatttagcaaaaacaaattagatggaaaatttaaaaactaaattactcagggcaaaaaaagtacaaaaagaacaacaaaataaataaggaattataaaataaagactttttgaaaaagcataataaccacaatgtgattatttcagttaaaacttttaacaactgaatttcaccaaaaaggtgttgtttctcaaattttagtaatttatattttcctgaaaaatcatccatttccttttcacactattaatattaagttgtataaaatattctcctataattcttgtagtattctgtgtcttgcttatttttctcaaacttatttatttgtgctttttcctctctatgtcccaatagaccaactttgatttatctctttcactgatctgtttttcaaagaaaagacaagttgaataacaaaaattgttacctgtaataatctcataattacttgatctcttctttaggtagctataatatgggggaataacttcctgtagaaatatcacatctgggctgtacctaatgaaaaacatcaatttatgacaaataccaagtataccatttcattttcagctacctaaatgaaggaaatcccacaacataccaaaaacaaaaaaccctctagggcacctaatattgagtgtttatgctgatctttgataactataaaatgagaaagatgtgtgctatttattaatgtagtactgtaacaaatatatcaaaaagaactagaaaaactgacaatagaaaccgccatattgagagacttcaatggtcctacacactaagagatgctttcaatgtttctttcaatcctcttgaagcagttattaaccacaatgaagaaaactgtccagagaacttaagtgatttggccaaggtcacagagccagcatggggcacaaatagatctttttggtagttttaatttcacgtagttacgataaacaaagttgaagaagaaaacagtactaaaaggcttctaacgaaaattagtgttccctctttgctgcagcctgcaatcctgctctcagaggcaatcatcttaattcttcagatgtttcttctcagagctggacattgaacttaggtttaattctaaagcccacaaccttgaactgttactttgtatatacataagacacattactattaaatagaagtgataatacttacaaagctaagtaggaacacacccctcgagccctctctgacagattgtttagatctaatccatcaatattccaggtaatgagagagaacatgctgccattttcttgctgagtatcttcagatgggctgattttagaagtggtggaatcagttgtttcttcattggttaggtcaacactggcaagatcagaataaaacatggctttgcaaataatctataaattgattaagaattattttgtatttgtagccctcattttacagacaaattttaaaagagccctaaaagtgacactgtccttacagggttaacaagaattgcatgccaggttctagacagaaatataattgagcattaatcacgctgcactttggcccacttctttgtacggaaagtcatcccatagccctatatactgatgacttgcatccccattgctcctatgggtaggatctctgacatcagaatcataaggcttttgtttaagcattgcttaagatgtttttcagacgctgaattccagcagaaagctgacaccaaccagtttgaagacaccccgacaggaaccgaatcagcatgagaatgcagtttcttcatctctagatcccatgacttcatcattgcactctgaccaatcaacaatcctcacaccttggtccactccaaacctctttaagtctcaagctccaaacttctcaaggagaatctgaagtttcctccagtcccctggtttggcggccttacaattaaaattttttttctgctgcaacctttggtgtctcagggtattgacttgcaagctgtacctcaacaacctagggcacatgtccacaaggtagtcaggacttcctgagggtgtgtcatgggtgcgtccttaaccttggcaaaataaaccttctaaattgatttagacctgactcagatacttttgggttcgtagatagattcttactgtactgtccaaatgtttgctcacttaggcagttataaacaacttaatatccttcaatgacatgtgtcactagaataattgtataaactatgatcccaaattagactcagaaacgtaggatttctaaatctttttggaattttttaaaatcatatgttaaataagatctcattgtggcagataaataggaactgcaaattctttgctactcccctttgaatgatgaaacctaatgcccctcccctttgaatccagaccttagtagcttgcttactacagggaaagaatattctgggacttttgaggtttggccttaagataatctgccacttccattcaaggcttttggaacactccctccaggaaccctggaactgccatgtaaaaagtccaaccaccctgagactgccatgctggaaaggacatatgtatgtgttccagtccatagtcttgactccaccatctgctcccccaaccaataccccagacatatgagtggagggacaaactttattaaaaggttaactcctaagcatttataaactattcatgaattttaaaaataggtgtctgaatttataattttaatgccaacattttaacttttctcctatacaccattcacccaggttcctcaaatattaacattttacttaacatttacttgctttattctttttattctgaaccatttgtttaaatatttttgtattatttcctaaacacgaagacatgcttacatatacagttatgcaccacatttggagaagcgtgtcattaggtgatttcatcattatgcaaacatcatagagagaatttacacaaacctagatggtacaacagcctcctacacacctaggctatatggtctagcctactgctcctaggctacaaacctgtacagcatgctactatactggatactgtaggcaactgtaacacaatggcacttacttgtgttctaaaaatacctaatatagaaaaggtatagcaaaaatacagtaatataatcttatgggatcatcttcatttatgcagtttgttgtcaatagagatgtggttatgtggtgcataacagtatactctagtatgatcaacaagtcagaagattatcattgatataagtttttctttttcttattgcctcctatggctagatttaatatctaaagacctagaccaatcttgccaattgtgctactagtgtcctaatctaggatcacatgttatatttagatggcatgtctcttttaattttcttcaatccagaaaagtttttcagtctttgtctctcatgactctgacatttttgaagagtacaggccatttatcttacagaatgtccttcagattgggcttatgttttcctattatttgattcagattatgcattttttggcaggaatgtcacagaagtgatagtatgtcctccgcaatgcaccatatcaagcatctgatatggagctttcccattcctggtgatgttagctttgatcacttggttaaagtgttgttaaccagatttctctagtacgaagttataattttccccatcatagtaagtattttgtgggaaagtactttgtgattatgtaaatatgctgttgttcactgaactttcctactagttttagtatctgttgatatctacctgaaataattatcaatacggcagttcccaaatgaagatttttttctaattcctcatgtcttccacatttaatagatggagttctactgtaaggaaaaatgttcccttctctcttggacaatggtatttatatcagtatgggttctttttttatggattgtaatctattcctaccaagcatcctgttgcttgggttataccagatttcacggggaaagggtaggcagcttttaagctaggtcttgtgcccttctggcatgtccccaacattttctgggcacctccttactttctaacaccacagataccattggctcatcttgtactttttttgcccctgctctggaatcagtcatttctttttaacttcttttttaatttttacattaagcccctttcattctatgaaatcagtcatttctgaaaagcccttgttcctttcagtgaagaattgtatttaaaggccatgatctgggtgctagatgaacttaatgtcaattttgtagcataaaatattttgaattgtctcccttttacataaaaataaccttcaagagcataaaaaaaaagtgcaaaactttcttttgtgaatttcatcctacccaaaagttctcttattcaacaatgagctattagactttttttcaacgtcttactgtgggggaaagagagatcagactgttactgtgtctatgtagaaagaggaagacataagaaactccattttgatctgtactaagaaaaattcttctgccttgaggtgctgttaatctgtaactctagcctcaaccctgtgctcgcagaaacatgtgctgtattgactcaaggtttaatggatttagggctgtgcaggatgtgctttgttaaaattgtgtttgcaagcagtatgcttggtaaaagtcatcgccattctccagtctcgagtacccagggacacaatgcactgcggaaggccacatggacctctgcccaagaaagcctgggtattgtccaaggattccccccactgagacagcctgagataatggcctcatgagaagagaaagatctgaccgtcccccagcccgacacccaaaaagggtctgtgttgaggaggattagtgaaagaaggcctctttgcagttgagaaaagaggaaggcatctgtctcctgctcgtccctgggaatggaatgtctcggtataaaacccgatcgtacattctatttacttggatgggagaaaaccgccttatagctggaggtgagacatgctggcggcaatactactctttattgcactgagatgtttgtgtaaagtcaaacataaacctggcctacgtgcatatccagacatagcacctttccttaaacttatttatgacacagagtcctttgctcacgttttcctgctgactccaccattaccctctagtcctgtcgcatccccctcaccgagatggggatagtgatcaataaatactgagggaactcagagaccagtgcccatgcagatcctccgtatgctaagcgccggtcccctgggcccacttttcttcctctatactttgtctctccgtcttatttattttctcagtctctcgtcccacctgaagagaaatacccacaggtgtggaggggctggcccccttcatcttaccaccagagagaaaaagccaagtgattccatgcctgatcaaagatgttatttcctttttatgaaaagcattaaaaccagaaaggagaaattattagctctttatttctgtcaaatcttctgtttcatagctgaatttaaaaatatatatactatcatagacaaaggtgtttgctcatcacatcaggccccttacctatccggcacacacacctttttttccaagtttaaagatatccaactataactcaatctacctcataaaactgtaaacacaacccctactttcctcaacaggtggactgtcatgggtgatgtatggggagagcatgatggtgtcattaatcatagcttatacttactgagctctatatgccaggcacaattccaagtgttttacatctattagctcacttaatccttacaacaaccccatgaggaaggggttgcacagataaagaaactgaggcagagagaggttacacagttactaaatagcacaggtagactcagaaccatattactatccccactgcacaaagaaattgaggcagagagaagttacacagttactaaatagcacaggtggacttataacctttgcattttggctccagagtccatgctcttattcactatgccatcctttcctcctctgtttcattgtaatccaattccatattgatatagtttggatgtttgtcccctccaaatctcatgttgagatataatccgtaatgttggtagtggggtccagtgggaggtgtttgggtcatggaggcagatccctcattaatgtcttggtgctatcttcacgatactgagttcttcttgcaagatctggttgtttaaaagtatgtggcaccaccccacccccttgctcctgcgctctccatgtgatacctgggctcccctttcccttctgccatgattgaaatcttcctgaggcccagcagaggctggggccatgcttccagtagagcctgcagaactgttagccaattaaatctcttttctttataaattacccagtctcaggtatttatagcaacacaagaacctaatacaaatatctctgcaatttatgcaacacccacaatatttaatatttaatgcagcaagaaaaaccaggcaactgtattaaaaatttccttttggaaaaatgaaaagggaaataaactctaaaacgttgctgtacagaaatactaagggaacagaaagggactggcaaactttaggggcatgatttgttgacttcattcctaagcagaggaggaagtgcttttgtcagtatatctggtgtcttaggttttatgtgttaggccagtgctcctcaattttaaatcacctggagatcttgtcaaaatacagattctgattcagtaggtctgggtgagacctaagattctgcatgtctaacaaattcccgagtagcagtggcacgctgctggtccagagtccacactctaaataacaaggctctgggacacgggctttcaatgctggctctgcattagaattacctgcacagctaataaaaaaaaaaaaaaaagccaataaggaataatgggccccactcaagactaatgaaattagaatctctggttttttttttaaattccccagataattccaatatgcagctaagattcagcatagctgttttaagaggatttcccttgtctctcatcagagacactgaagatagattctaatgtaggggactaaatcactttagtgttcaatttcaatttttgttgatatcccaggaattcactccagaattgagattcctgcgccattcatttaagacagccaatgcccttgctcagcagggttgagtttttctggtcataaaatcttccaatcaatttttttttccctttcatttttgctaaagccaacatcaaaaatctaatcaggtcacaggccttagaaacacgctgaagtttgccccttccccatttttctctcttgagcaaactaaactttaaaacctcactctcattcatacttgacctgagttctgagagacaagagaccacagcctaatcaacacctttgcttgtttttgccaatttaccattccggggtaagagaatcctaatagccatgacaccattgatcagcttgatccgcatcttttctgagggcctattacaggaaatccacttattttgttactatttattggttacaatatagtctgttgcaaccaacagacattaactcaggttggtttgaccaaaacaggagaatttataaggaaacaaacatgtcacagagcctggtacagaaatacagccatgtttaaggaagggcagttaagggctttctctcaatcctacacttcaacttccctctgcttcattgtctctctgcagacctctgttctcagcttctctgtacacaaaaaaagatatgtatgaatcctcacaggtgctaagttaacatgttacagttccagctccataggaagactcagacttgactctcttggtcctaattctgaaaccaaggagaggatctgactggccagtttgagctaggcaaacacctcctagtccaacttgctctggttagtaaaacgggagccagagacaaatcactgtgggtgagtaaacaattccccaacaagaggcaagacagagaaaggaacctaaagaaaatatcttatcacatctgtaagccagtgtagctgaaaagaccaaagggaaaataaagtctccactatgaacagtcaattttacaggttgtacatatagctgggagaattttatacattcagtaaatatttattgggagcttattatgtgtcaaatgttgtgtcagactttgggaaattaacaatgtacaaaacagatactccttactagatgtgcagtctagtaggagacataaaataatgaacagcaattataatacggactaaggtattgtaacaggggtcatgcaggatgctataagagtacctaaaaggggactcttacccagacttaggacatcaggaaaagcttcctagagataaatcatgtctcagcttggggctttaagacaaatattagcaaggaagggaaaagaaaaaaattccaggcacaggtaataaagatctttacgaagtttcaaagacaggagaaaatgacccgttggaaaaaagtaaaagtttgataggcctggaacctggaaaggcaggttctaagttatggagccaaatagtagagggccttgtaaggcagctacactttttaagtgcaggaactggagaggggcactgaaataacaggagtaggtgtgcattaaaaaaaaataacaacaacaacaaacctgttattctggccggtcagcctagggcctagaataaataaacaatacaggaagcaaggagacttccaagttgccatttttcgatagaaggtttagccttcgttcatttgtttcaaacctctcgcttacttatttcctttcatttgagttaaacattacatttccatcttttcctccctggaccccaaatcacgttcgaagcgacagtctggtgcagtgttagatccgctgctggggcgcaactccgcgcagcagcagcaacgcaagccctgctcctctggctacgcagcttggagatctgcctcagcatcgtccgcccagctccacggcaggtcccaggacgcgcagggctacctggtatcaaactgcctccgtgcggactggctcccgctcccctcatcacttactaggtcttgggctcagagatggtttcaggtcggcgttccaaggcgctctcctccaccggaggctcgaagtaggagttcagagccctctgaaaaacaaaggcacaagggatgaggtttgtgcgctccaccgacctaggtaatggagccggaagcgaggacagcgaaagcgtacttccatctcccagtcgttctcggccaggaagcactgagccactgcggcatcgcagcttgcgaccgaggcaaactccacacacagaagtcgccgctttttcacctcaggctcgccctcttcctccgccgcctccctcccgccctccaggcaactccccaactccatcttcctgccgcctctgcaccgcccc

SEQ ID NO: 56 - DNA, 231435 bp, Homo Sapiens
aagctgattgggtgtggtcgccgtggccggacgccgctcgggggacgtgggaggggaggcgggaaacagcttagtgggtgtggggtcgcgcattttcttcaaccaggaggtgaggaggtttcgacatggcggtgcagccgaaggagacgctgcagttggagagcgcggccgaggtcggcttcgtgcgcttctttcagggcatgccggagaagccgaccaccacagtgcgccttttcgaccggggcgacttctatacggcgcacggcgaggacgcgctgctggccgcccgggaggtgttcaagacccagggggtgatcaagtacatggggccggcaggtgagggccgggacggcgcgtgctggggagggacccggggccttgtggcgcggctcctttcccgcctcagagagtgggcggtgagcagcctctccagtgcggaggcacgggggcggaacgttggtgcttgtgcggattccgccgtccccaggttctgcttggctccggagggacgcccccctcagccctgaaacccgtgcctctccagccgccccggatctgaacttgtgatcacggagtgtttacgtcgtgccaggcattttaatgcattgttctagttcattttccagcagtcgcattcctcgccttggccctacatgtagcgctcattacaaacacggccagaatctcttattaacaaacagcagccaggagtgagatttaaaatagactgggggtttaggagacccttttatgacacgtaattctgctcccacgacgctcccatttataccgccggtccagctaagggtctggtaatggagcgccgttgaagagcagtatgatgaagtggtcaggaccaacggactctggagctgggctgcttgggatcaagtcgctgcccctctgcttattaacgtgtgaccttgggccagtcatggacgctatctgcttcagctcagcattcagtgctctccgtcacccgaccccatctatccaggattatctctccctggaaagctacaaacgtctcaccctatgtgggccaaatgttctggataggcctagttaacctcttctctccctgttttctttgcgctttcttgcagctatgtagttatgctaatgaaaagagcatcctagggggagcagagttgtggattctagtcctgactagaggactagtgcaaatgcgatactcctgatgaaaaatgtttcattcgttagatataaatgtgttaggcagggttatggacactagatgaaaaaagaaatacctctactttcatagagatcactattggacagcaaggcagaaataattacaattcaagttggaggcttatggaggtgagcttgtaagaggttacaagaggcgccaaggcaggatcgccaaagacggaagactttggaagagtctcatacaacggaagaggcgttatatgagacaccaaagtccacgttgagtcttggtggactagaagtttgctagggagagggcttgaaacgaggtagattggcgttgctggtgtagaaaaggaaggagactggcccaggtgggtggggttagatgaccaaaggcttttagtgtggtgttgagctgttgaaattttatgctgtagccaatgaaaagtctgaaatgttttttttttttttttttctgagacggagtcttactgtgtcgcccaggttggagttcagtggtgtaatcctggctcactgcaacctccacctcctgggttcaagcgattctcctgcctcagccaccggagtagctgggattacaggcacgtgccaccacgcctagctaatttttgtatttttagtagagatggggtttcaccatgttggccaggctggtctcaaactcctgacctcaagtgatccacccaccttggcctcccgatgtgctgggattacaggtattagccactgcacctgacctacatagattttacataagactttaaaacagggcgggcgcagtgactcacgcttgtaatcccagcactttgggaggctgaggtgggcggatcacaaggtcaggagatcaagaccatcctggctaacatggtgaaaccctgtctacactaaaaatacaaaaatcccagcactttgggaggctgaggtgggcggatcacgaggtcaggagatccagaccatcctggttaacactgtgaaaccctgtctctactaaaaatacaaaaaattagctgggtgcggtggcaggtgtctgtagtcccagctacttgggaggctgaggcaggagaatggtgtgaacccggaaggcagagcttgcagtgagccgagattgtgccactgcactccagcctgggcaacagagcgagactccatctcaaaaaaaaaaaaaaaaaaaaaaaagactttaaaaaaaattataagaaaggacagaccaagtgcagtggttcgttccagcacttagggatgccaaggtgggaggattgcttgatgctaggagttgaagactagcctgtgtaacatagcgagacccatctctacaaaaaaattaaaaagttacctttagaacttacgatttttatgtgtagactccatataagcagagggtctatgcttattcactatttattaccttccatagtccctgcacatataataggtgcttcataaacaatttaatgaatgaataaattactgagaaaacactggaagtttttgggttagcattgtgttaggtgcttgatatggtctggctgtgttcccacccttatctcatcttgaattcccatgttttgtgggaggtacctggtgggacataattgaatcatgtgggcaggtttttcctgtgctgttctcctggtagtgaataagcctcacaagatctgatggttttaaaaatgggagtttccctgcacaggctctctctctttgcctgccgccatccatgtaagatgtaacttgctcctccttgccttcctcaatgattgtgaggcctcctcagccatgtggaactggctgcagagtcattaaacttcgttcttttgtaaattgcccagtctcaggtatgtctttttttatttttttttgagacagagtctggctctgtggctaggctggagtgcagtggtgcgatctcgactcactgcagcctccgcctcccgggttcaagcgattctcctgcctcagcctcccaagtagctgggactataggtgcacgccaccatgcccagctaatttttgtatttttaatagagacggagtttcactgtgttggccaggatggtcttgatctcttgacctcgtgatcttcccgcctccgccttccaaagagctgggattacctacccagctgggtatgtctttattagcagcgtgaaaacagactaaaacagtaaactgataccaatagagtgggatgcagctgaaaagatacccgaaaatatggaagcaactttggagctgggtaacaggcagaggtcagagcagtttagagggctcagaagaagaccagaaaatgtgggaaagtttggaacttcctagagacttgttcaatggctttgaccaaaatcctgataatgatatggacaatgaaatccaggctcatgtggtctcagatggagatgaggaacttgttgggaactggagcaaaggtgacacttgttatgttttagtaaagagactggtggcattttgccctgccctagagatttgtggagctttgaacttgagagaaatgattttgggtatctggtgggagaaatttctaagcagcaaagcattcaagaggtgacttgggtgctgttaaaggcattcagttttaaaagggaaacagcatgaaagtttggaaaatttgcagcctgacaatgtgatagaaaagaaaatcccgttttctgaggagaaattcaagctagctacagaaatttgcataagtaatgaggatcccaatgttaatccccaagacaatgggaaaaatgtttccagggcatgtcagaggccttcatggcagcccctctcatcacaagcctagaggcctaggagaaaaaagtgatttcatgggccagcccggggtccccatgctgtgtgcagcctagtgacttggtgccctgcatcccagctgccccagctgtggctgaaaggggccaacctagagctcaggccatggcttcagagggtgcaagcctgaaaccttgacagcttccaggtggtgttgagcctgcaggtgcacagaaatcaataattgaggtttgagaatctctgcctaggtttcaaagatgtatggaaacgcctgcatgtccaggcagaagtttgctgcaggggtggggtgctcattgagttcctctgctagggcaatgtagaagggaaatgtagggtcagagcccccccacagagtccctactggggcaccacctagtggagctgtgaaaagagggctaccattctccagacctcagaatggtagatccacagacagcttgcaccatgtgcctggaaaagctgtagacacttaacgccatctcatgaaagcaaccaggcagtgtgctgtaccctgcaaagccacaggggcagagctgtccaaggctgtggttgcccagctcttgcatccgcatgacctggacatgagacatagagtcaaaggagatcattttggagctttaagatttgactgccatgctggattttggacttgcatggggcctgtagcccctttgttttggccaatttctcccatttggaatggctgtatttacccaattcctataccccattgtatctgggaagtaactaacttgcttttgatttgacaggctcatatgcggaaaggacttaccttgtcttgaatgagactttggactggaattttgaattaatgctgaaatgagttaaggctttgggggactgttgggaatgcatgattggttttgaaatgtgaggacatgagatttgggaggggtcatggcagaatgatatggtttggctatgtccccacctaaatcccatcttgaattcccatgtattgtgggagggacctggtgggagatagttgaatcatggggatggatctttcccatgctgttgtgatagtgaataagcctcatgagatctgatggttttaaaaacggaagtctacctgcacaagctctttctttgcctgctgccatccatgtaagacatgacttgttcctccttgccttctgccatgattgtgagacctccccagccatgtggaactataagtccagtaagcctctttttcttcccagtctcgggtatgtctttatcagcagcatgaagtccagctaatacagtgcttgaacatgtaatatctcaaatctgtaatgtactttttttttttttaaggagcaaagaatctgcagagtgttgtgcttagtaaaatgaattttgaatcttttgtaaaagatcttcttctggttcgtcagtatagagttgaagtttataagaatagagctggaaataaggcatccaaggagaatgattggtatttggcatataaggtaattatcttcctttttaatttacttatttttttaagagtagaaaaataaaaatgtgaagaatttaattgtgttttagtattttaagtagattgtgatagtagaatggtttgagacactttaatagcaattagcatgtggtttttaaaaagttgcagtttggctggtcgcagtggctcatgcttgtaatcccagtattttgggaggctgaggcaggtaggttgcctgagcccaggagttcaagaccagcctgcccaacgtggtaaagccccatctctactgaagataaaaaaatttaaaaaaattagctggggctattggcacacacctgtggtcccagctaatcaagaggatgaggttagaggatcacttgagcccaggaggttgaggttacagtttaactttcagaggccaaggcaggaggattgcttgagtccaggagtttgagaccaccctggggaatgtagggagatcccatctctatagagggatagattagatagataatttctgaggggaggggagggggagggccagggaaggggagggaaaggggaggggagggcagggccagcagtaaggtcataatagagacatgtatctgtaagatccttataataggtgaggatggccacaaattagcgccacagatttgtatttttagtagagacaaggttttaccatgttggccaggctggtcttgaactcctgacctcaagtgatccgcctgccttggcctcccaaagtgctgagattacagatgtgagccaccatgcccaaccacaagcatttatttatttatttatttatttatttatttatttatttagagacagtcttgctctgtcgccaggctggagtgcagtggcgccatctgggctcactgcaaactctgactccctggttcaagcttttctcccgcctcagcctcccgagtagctgggattacaggtgcatgctgcaacacccggctaatttttgtatttttagtagagatggggtttcaccatgttggccaggacggtctcgatctcctgacctcgtgatccgcctgccttggcctcccaaagtgttgggattacaggcgtgagccacagcactcagccagttatttttttataagaaaacattttactggccaggcctggtggctcacacctgtaatcccagcactttgggaggccgaggcaggcggatcacgaggtcaggagttcgagaccagcctggccaacatggtgaaaccccatctctactaaaaatacaaaaattagccaggcgtggtggtgtgcgcctgtattcccagctactggggaggctgaagcaggagaatcgattgaacccttgaggcagaggttgcagtgagttgagatcgcaccattgcactctagcctgggtgacagagcaagacttcatctcaaaaaaaagagaaaacattttattaataaggttcatagagtttggatttttcctttttgcttataaaattttaaagtatgttcaagagtttgttaaatttttaaaattttatttttacttaggcttctcctggcaatctctctcagtttgaagacattctctttggtaacaatgatatgtcagcttccattggtgttgtgggtgttaaaatgtccgcagttgatggccagagacaggttggagttgggtatgtggattccatacagaggaaactaggactgtgtgaattccctgataatgatcagttctccaatcttgaggctctcctcatccagattggaccaaaggaatgtgttttacccggaggagagactgctggagacatggggaaactgagacaggtaagcaaattgagtctagtgatagaggagattccaggcctaggaaaggctctttaattgacatgatactgtttcatttaaggaaaaataataaaaaaactcttttttttgtatctaattaaaataatgttctgatgtttacagaaactttgtatatttaattggacattagaacaagctgtttgttgtgtaagatttattttacctcagatcttttctcccccctttcctttctgtcttgtgttccaaaagagtaattattacggtaaatattactgtaattatggatttatcaaataagatgcagttctttagcattttttgataaatcgagtggaactttagcctgttattttactatttgttttattttaactaaattctgattgtgtcattttttttttttttttttgggaccgagtctcgctctgtcgcccaggctggagtgcagtggtgcgatctcggctcactgcaacctctgcctcccaggttcaagcaattcttctgcctcagcctcctgagtagctgggattacaggtgtgtaccaccacacccagctaatttttgtatttttagtagaggtgaggtttcaccatcttggccaggctggtcttgaactcctcacctcgtgatccacccacctgggcctcccaaagtgctgggattacagccatgagccaccatgctcggctttgattgtgtcatttgtataggcatgtggtttattatttagttatttttttttttttctttgaggtggagtatcactcttggtgcccaggctggagtgtaatggcgtgatctcagctcactgcaacctctacctcctgggttcaagcaattctcctgccccagcaggagtagcttgggattacaggcatgccccaccacacctggccaattttgtgtttttagtagagacagggttccaccatgttggtcaggctggtcttgaactcctgacctcaggtgatctgcccacctcagcctcccagagtgctgggattataggcatgagccacggtgcccagcatatttagatttttttttttttgagactgagtctgactctgtcacccaggctagagtgcagtggcacgatccacgatcttggctcactgcagcctccaccttatgggttcaagcgattcttctgcctcagcctcccaagtagctgggactgcaggcacatgccaacacgcccggcttatttttgtatttttatagagacggggtttcatcatattggtcaggctggtctctaactcctgaccttgtgatccacccgccttggcctcccatagttctgggattacaggcatgagccacagcgccaggcctagatgtttcttaaggtatgtatctcccaaagattctttttgtggtcctcaagtaccataagcaccgctggagataacacatgtgatgggcatttttagcatagattgtatctaagcaactttccacaagtaatagttctgttaagggttgttattgtggccgggcgcggtggctcacacctgtaatcctggcactttgggaagctgaggcggccggatcacctgaggtcagggattcgagaccagcctgtccaatgtgctgaaaccctgtctctactaaaaatgcaaagaaaaaaaaaatctagccaagcatggtggcttgctcctgtaatcctagctacttgggaggctgaggcaggagaattgcttgaacctgggaggcagaggtagcagtgagccaagatcgtgtcaccgcattccatcctgggcgacagtgagactctgtctcaaaacaaaaaaagagttgttaccgttgggactattttttgaaagctttatgtgaacgtaattttatattttgatgaaaatttagtttattgatgtaaaaagtgtatcagtacatcatatcagtgtcttgcacattgtataaacatttaatgtaggtgaatctgttatcactatagttatcaatgttataattttcatttttgcttttcttattccttttctcatagtagtttaaactatttctttcaaaatagataattcaaagaggaggaattctgatcacagaaagaaaaaaagctgacttttccacaaaagacatttatcaggacctcaaccggttgttgaaaggcaaaaagggagagcagatgaatagtgctgtattgccagaaatggagaatcaggtacatggattataaatgtgaattacaatatatataatgtaaatatgtaatatataataaataatatgtaaactatagtgactttttagaaggatatttctgtcatatttatctcaaaacctaaactgtgtatcaatgatattaagcttttttttttttttgagacagagtttcacttttgttgcccaggctggagtacaatggcgcgatcttggctcaccacatcctctgcctcccaggttcaagtgatcctcctgccttggcctcctgagtagctgggattacaggcatgtgccaccacgcctggctcatcttttttgtatttttagtagagatggggtttctctatgttggtcaggctggtctcaaactcctgaacctcaggtgatccgcccgcctcgggcttccaaagcgctgagattgcaggcatgagccactgtgtctggcctatttttatagtttatgtacttggaattatataatatattctgcctagcttctttcattcaatatttgtaagatttatccatattattgagtgtagttgtggatttttgcatttatatttcatagcacgagcatgtcagaatttatccattttacttcccttctgcccgccactgctactctccccattttacctttttttttgtttttttgagatggagtctcagaatttcgctctgtcgcccaggctggagtgctgtggcacggtctcagctcactgcaacttctgcctctgggttcagctgcacgccaccatgcctggctaatttttgtattttcagtagaggggattttgctatgttggccaggctggtcttgaactcctgacctcaggtgatccacccaccttggcctgccagagtgctgtgattacaggcgtgaaccaccgtgcccgacccccattctaattttgatggacatttgggtaattttcatttttggctgttataaatactgctgcaattacagttaattttcacagtttttttttttttttttttttttttttttttttgaggtgagtttcgctcttgttgctcaggctggagtgcagtggtgcgatctcagcccactgcaaccttcaccttctggattcaagcaattctcctttctcatctcctaagtagctggggtttacaggcatgtgccaccatgcccagctaatttttgtattttaatttcacagttctggaggctgggaagttcagaattaaggcactggctgatctgttgtctggtgagggcccacttgttcatagataaccattttctcactctaacctcacaaggttgaaagggcctaatttttgtgtttttagtagagacggggtttcactatgttggctaggctggtctcaaactcctagcctcgagtcatccacccgcctcgtcctcccggagtgcttggattacagcatgagccactgcgcccggcccccattttagttttgatggacatttgggtaattttcttttttggctattctaaataatgctgcaattactgttaattttcaccttgtaaaaaccattttcaaatctcaagagattaacctttagttttcttggtttggattgggaaggaacaccaaggaaaatgagggacttcagaatttattttcattttgcatttgttttttaaaatctttagaactggatccagtggtatagaaatcttcgatttttaaattcttaattttaggttgcagtttcatcactgtctgcggtaatcaagtttttagaactcttatcagatgattccaactttggacagtttgaactgactacttttgacttcagccagtatatgaaattggatattgcagcagtcagagcccttaacctttttcaggtaaaaaaaaaaaaaaaaaaaaaaaaaaagggttaaaaatgttgaatggttaaaaaatgttttcattgacatatactgaagaagcttataaaggagctaaaatattttgaaatattattatacttggattagataactagctttaaatggctgtatttttctctcccctcctccactccactttttaacttttttttttttaagtcagagtctcacttgttccctaggccagagtgcagtggcacaatctcagcccactctaacctccacctcccaagtagttgggattacagttgcctgccaccatgcctggttaatttttatatttttagtagggttgcggggacagggtttcaccatgttggccaggttggtctcaaacttctgaccttaggtgatcctcccacctcggcttcccaaagtgctgggattacaggcttgagccatcgtgcccagcctactttttacttttttagagactgggcttggtggagtgaagtggcaagatcatagctcactgcagtattgaactcctgggctcaagcgatcttcctgcttcaacctcatgagtagctgggtctacaggcacaagccaccatgcttgcctaattttaaaatttttgcagagttggagtttcacagtgttgcccaggatgttcgctcactcctgacttcaagtgattcttctgccttagcctctagagtggtagctgggattacaggcatgaaccaccatgctctgctattttttttcaaggtttttttttttttttttttttttgagagactggtatgactatgtatgctccctaggctggagtgcagtggctattcacaggaagtgccatcagagtgtactacagcttcaaactcctgggctcaagcacttctatcatagtctccaaagtagctgggactacgagtgtgtctcattgtgccttgctctcgaattgctttttttttttttttctggtttcaagctatctatgtggtattagtcctcactttatgaataattttgtatactactaatagcaattttttttttttttttttttttgagacggagtctcattcttgtcgcccaggctggagtgcagtggtgtgatcttagctcactgcaacctctgcctctccggtttgggcaattagctgggattagaggcgcctgccaccatgcccagctaatttttgtatttttagtagacatggggtttcatcttgttggctaggctggactctaactccaggtgatctgcctgcctcggcctcccaaattgatgggattacaggtgtaaaccactgggcctggcctagcaatttaaaatgacattctaagaagttttatgtctaaatctgcagtaagtggctgggtgacgtggctcatgcctgtaatcccaacgctttgggagtccagggtgggaggatgacttgaggccaggagttgagaccagcctgggcaacatagtgagactctgtctctacaaaagaaaaaattagcggggcttagtggcgtgcgcctgtagtctcagctactcgaaaggctgaagtgggaggattctttgagccccaagggttctggcttgccgtgagccaggatggcaccactgcactccagtctgggcaatagagtcagaccctgtctcaacaaataaaataaaactgtagtaattataaagtggttttggctgggggagaaatgtacagttgaacatacggattaagaggttgaaagttggtcttaggaagaggaactttttgtggaaatttcttaatatttgaagaatattatgttattgttcctctgtttttcatggcgtagtaaggttttcactaatgagcttgccattctttctattttattttttgtttactagggttctgttgaagataccactggctctcagtctctggctgccttgctgaataagtgtaaaacccctcaaggacaaagacttgttaaccagtggattaagcagcctctcatggataagaacagaatagaggagaggtatgttattagtttatactttcgttagttttatgtaacctgcagttacccacatgattataccacttattgtaatatgcagttttggaagtatatgttaccatttaactgtacagagtacatagtaatagagtggtaattatttagattgattaaagaactcatttttttaaataagttttttttttttcactataaaagtttattttatttgagatggtatggtatcgaacatgttcatattgtgtgtaatcgtgggtaaattactcaacctttatgtcatagtttcttcacctttaaaatgacattaataaaagagctacttaataggattataagcatgagatgatttaatatacataaaatacttacagtctgatatataggaagcacttaactctttatcctagaaaagatttaaggtgaccttaacatatatgtcagaaaatctttaaaattgtggaaataaaaggttgtataattctgctatcctaaaattactagtatttcaatatattttattttagtcttttcttttagatacaagttttaaaacttttaagtgaagtgtaatatacgtaagtactgcttgatgaatttaaggtgatttctaaagccaggtttgttggggaagaggagtgggatttagtgatttagaaccagaaattggggctgggtgcgatgtctcatgcctataattccagaacttcgggaggccatagtgggagaattgtttgtgccccggagttcaagaccagcctgggcaactcagtgagacgccatctctacaaaagaaaaaaaaaaaaaattagctcagtgtggtgacatgtacctgtagcccgagctactcgggaggctgaggtgggaatatcaccctggcccagaagtttgaggctgcagtgggctatgattgtgccactgaactccagcctgggcaatggagtgaaaccctgtctcaaaaaacaaacaaaaaaagaaactgaggctgggcacggtggctcacacatataatccagcacttggggaggttgaggcaggataattgcttgagcccaggagtttgagaccagtctgggcaacaaaatgacaccccatttctaccaaaaaaaaaattgtttaaaattagctgggcatggtggcatgtgcctgtggtcccagctacatgggaggctaaggctggaggattgtttagcccaggaggttgaggctgcagtgagccatattcatgtccctgcactccagcctgggtgacatagtgagacgctgtctcaaacaaaaatcaacaggccagatgcagtggctcacccctgtaatcccaacactttgggaggccgaggtgggtggattacttgaggtcaagagttcgagaccagcccggccaacatggcgaaaccccatctctactaaaaatacaaaattagatgggcatggtggtgtgtgcctgtaataccagctactcttgaggctgaggcatgagaatcgcttgagttgggaggcaaaggttgcagtgagccaagattgtgccactgcactctaccctgggtgagaaacgagattttgtatcaaacaaacaaacaaacaaaaaaagacgcccaaaatcaacaacaacaaaaacgatattggaatgattggatccccaaagataaatgtttgaggtgatggatatctcagttaccctgagttaagtattatacattgtatacgtgtattaaaatattacaaacccccaaatgtgtacaattatgaggtatcaataaaagagattggaaggactgggtaatttgcaagtaattaaggcaatttacaatttttaatttttatttgtgaataagtagttatacgtgtcaaaattcaaaaaggacaggtggatatacagtgataagtcatccccccttctctgtcagctccataaagagcccctgtcttgcatggctccagggtcacatttcctattgtattttgccaccacctgccctgggagcaacagtgttagtttcttgaacatccttccaagcagagtctgggcctacacaagcaaaacaagtatgtctattctctctcctctttaatttttttaaaggaagtgattgataatttaacactcaagctataggtcattggttatatttttaatttccaatttatgggaatagaggaagtgtcagtgatccccttctggtttaagaactggaggatgcatgtgtttagaccctttagaaacctgaaatgtcacctaatataattatcagagtaacactttttagtaagcaagctatctatcaaaagtaggtttttgaagaagagggtaaggaaaggttactttcatgggacatagcaataatttctaaaatctaatggttttacaagacttgttcattagaagtaacatctgtgaggatggctttatgagtcaaaatattatctgcttaataccccacctgtagggtaagaagaaatgtttttttcttggtgacaatttttagcagcaagcggggagggcctgtggcttccaaggccaaacgttgaaataccacagactaggaagaaaaagatccactccttatacaggatttgtttgtttcttcttttttcttcatttttgtagagatgaggtctcactatgttgcccaggctggtctctcttttttttttgagcccgagtttcactcttgacgcccaggctggagtgcagtggtgtgattttggctcaccgcaacctctgcctcccgggttcaagcgattctcctgcctcagccttcctgagtagctgggattacaggcatgcgccaccacgtccggctaattttgtatttttagtagagatgggtttctccatgtgggtcaggctgctctcgaactcccggcctcggatgatccacttgcctcggcctcccacagtgctgggattacaggcgtgagccactgagcccagccatgctggtctcaagcaatccacacccacctcagcttccaaaagtgctggcattacaggtgtgagcccccgtgcccagcctgtttcttataattattcctctttctcaactctgtctgctgtggtacctcatgcttcctagtttaagccttcttgggagttctcaggagaaatctgttatctcccttactaagcatttgggattgatgttccttccaggttactataaaaccaagttttttttggttcttttttttttttcttttaaaagaaatgagattttgtcatggttagcctggtttcaaactcccaagctcaagtaatccaccttcctttgcctcccaaagtgctaggattacaggcatgaaccactacacccgatctgtactgttcctctttccattcactaaaacctacttgcaactatgagcatatgttattgccatctagaaatgagtttctagggacttgttcctttttgtactttatttaaacagtcgaattagaaattattattatcattatttattttttgagatggagtcttgctctgttgcccaggttggagtgcagtggcgtgatctcggctcactgcaacctccacctcctgggtttaagcgattctcctgtctcagcctcccgagtagctgggactacaggcatgtaccaccacacctggctaatttttatattcttaatagaaacagggtttcactattttggccaggctggtctcgaactcctgacctcagatgatccactcaccttggcctcccaaagtactggaattataggcgtaagccaccgtgcccggccaaaattatttataataagcaaggcatggtggcttgtgcctgaagtcccagctacttgggaagctgaggcaggaggatcacaggttcaggtccaccctgggaaaatagtgagaaccttccctatccccagtcttcaaaaaagaaaaaaatttgctggagaaggtcacacaatgctgataggtcccattgtgctttcatgctttctagttttcaatgataactggttgttacttttattgtctgactcattatagtgaccaactcccgattttttactttgccttaagccttcagctatctcctacctctaagcggatgatttcttccttaacacttaaaacctcaaaatttatctgtacttccactcttttactctctggctctttctcagaagaagaaataacacttttatttcttttcaaagccaacctttccatactttacttggagacatatttctttttttttgttttgtttttgtgagtggagtctcactctgtcgcctggtctggagtgcaatggcgcaatctccactcagtgcaacctctgcctcccaggttcaagcgattctcctgcctcagcctgctgagtacctgggcttacaggttagcacaccacacccggccaagttttgggtttttagtagagacagggttttgccgtgttggccaggctggtctctaactcctgacctcccgatccgcccgcctcaggtgcaagccaccgcgcccagccctagtgtagcaatcttaatcagaaatatgtctctggctgggcgaggtggctcatgcctataatcccagcactttgggaggccaaggcaggcagatcacctgaggtcaggagttcaagaccagcctgaccaacatggagaaaccctgtctctattaaaaatacaaaattagctgggtgtggtggcatatgcctgtaatcccagctactcaggaggctgaggcaggagaatcgcttgaacctgggaggcggaggttgcggtgagccaagatctcaccattgcactccagcctaggcaacgagcaaaactccatctcaaaaaaaaaaaaaaaaaaaaaaagattgctatgttaatcttatttatttatttatttattttgagacagagtctcacactattgccagggctggagtgcaatggcataatcttagctcactgcaacctccgcctcccgggttcaggtgattctcctgcctcagcctcctgagtagctgggattacaggcgcccgccaccacgcctggcttattttttgtgttttttagtagagacggggtttcactacgttggccaggctggtcttgaactcctgaccttgtgatttgcccacctcagcctcccaaagtgctgggattacaggcgtgagccaccgtgcctggcttatgttaatcttattttatataaaaagaaataatattaaactagaaggcaataaaaatgccaaattcaatacacaaattattttgtcagcatttccacaagaataaactattttatatgctaacatatgttcaatgttccttacagaattctgacattaaaaatgaaaaattaccaaagcttcagatgaatctataaatggacaaaagaaaaagcttaaaaggataaagagcaacactccaagtgcatgtataaacataaggactcttgggacttaacctttttaaaaatctttaggcctagcacagtatttgctatttaatgtatcaaatgggtggttttgacttcattaatccatatataggacagatgaaaaaaagaattatagacttgtaattacagttctttaggaaccatatttgctctcagccttttaaatacgctgtcaggcaattccagtcagcacttttgaaaaaaacctacctacctacctacctacctatctatctatctatctatctagagactgagttataagactagctagtttttgtattttttgcagagacaggatttcatcatgttttctaggctgttcttgaactcccaggctcaagccatccacccgcctcagcctcccaaagcgctgggattacaggcgtgagtcaccatgcccaaccaattccagtcagctcttaaaatgaaagcctagaaatggtagggttaaagaggggacagaatgttgattttaaaatacctagaatttggccaggtgcagtggctgtaacccagcactttgggaggccaaggtggccggattgccttggcctgcctcagcctcccaaagtgctgggattacaggtgtgagctcaggagttcgagaccagcctgggcaacacggtgaaaccccttctctagtaaaatacaaaaaattagctgcatgtggcggcgtgcacctgtggtcccagttacttgggaggctgaggcaggagaattgcttgaacctgggaggcagaggttgcagtgagctgagattgcgccactgcactccagcctgggcaacagagtgagactctgtctccaaaaaaaaaaaaccccaagaatttgattaattctgttggaattttaagagttaactgatccccaaaatgactcagctgtatgcaatttaatgcaatattaattcgcatgttgactctcagaattgcatacagctgagtcattttattgagtaggattgataagtatactatgttatgccaacagtaactgtgatgcttctaaaattgtgatttttaaattggcattgtcacagaaacagcagagtagttgtttttttctttaagcttcttttagccagaaacataaactgaaactgtaattattactgcaatcgtatgttgaatagacttgtgaaactagcaatttattaggcttttaatgatatctggaccaaaggctgagggagctgtgctgtgtgtatgttgctttgtgctttgttttttagaagcttgtcgtttctttgccattttacttctttctttttttttgagacggagtcttgctctgtcccccaggctggagtgcagtggcgcagtttccgctcactgcaagctccgcctcctgggttcactccattctcctgcttcagcctcccaagtagctgggactacaggcgcccaccaccacgcccggctaattttctgtattttttagtagagatggggtttcaccatgttacccaggatggtcttgatcttctgaccttgtgatccgcccgcctcggcctcccaaagtgctgggattacaggcttgagccaccacgcctggcccattacccattacttgtttcttaatgttacattctctttccctctttttttttttttgttttttgagatggagtttcgctcttgttgcccaggctggagtgcaacggtgccattttggcccactgcaacctctgcctcccaggttcaaatgattctccagcctcagcctcccaagtagctaggattacaggcacctgccaccacgcccagctaatttttgtatttttagtagagatggggctttgccatgttggccaggctggtcttgaactgctgacctcaggtgatctgtctgcctcagcctcccaaagtgctgggattacaggtgtgagccactgcacccagtccttaatgctactttataggtgaaaattgtgaaataacttaaatttcattttaattaaagttaatttttgggaaattaacgaaaggttgacattttattcttttgaatattgcagttgttatttgggtttaaattggggggcttaggaaggaaagaagcctgatggttgtttctgaattttctgaaaattatgtttgatatgctgtatatgaaatccagcttggagagaatatgtccattgttaaggaaaaattaatgaagatttgatctagataaggcattccaatcatttggaagtggtttgagtatctttttttctttttttaatttgagacagagtcttgctctgtggagtgtagtggtgcaatcttggctcactgcatcctccacctcccgggttcaatcaagcaattctcctgcttcagcctcccgagtagctgggattacaggtatgggctaccatccccagctaatttttttttttggatggaatcttgctcccgtcgggcaggctggagtgcagtggtgtgatctcagctcactgcaacctccacctcccagtttcaagcgattaagtgattctccttcctcagcctcccgagtagctgggattacaggcgtgtgccaccacgtcgccaccacgtctggctaatttttgtatttttagtagagacagggtttcgccatgttggccaggctggtcatgaactcctgacctcaggtgatccacctgcttggcctcccaaagtgctaggattacaggtgtgagccactgtgcctggcttaagttttgtatttttagtagagacggtgttccatcatgttggtcaggctggtgtcaaactcctgaccatgcgatccgcctgcctcggcctcccaaagtgctgagattacaggcgagagccaccgtgcccggcctgtttgagtatcttttaaaaccagtaaggacaaactagaggtgtcagctctcttcatgggctttggagaaacaagacaaaaaggaaagagatgtttcgccgggcgcggtggctcactcctgtaatcccagcactttgggaggctgaggacagcggatcacccgaggtcaggagtcaagaccagagccattgcactccagcctgggcaacaagagcacaactttatctcaaaaaaaaaaaaaccaaaaaagaaacaggaaagagatgttttgattttttaagtctagagtgttctgttcttactctacagcacttagcagtagtccatctatcctccttgtttgttctttacaacaaaaccccattggttctctcttaccaagtttgctttattcttggtttatcctttgtaagatgtgaaagggatatgaagagcaaataggaagtgttactcttgctgcttgagagaaagctgttttacaatttgttggcaaacaatttgtaaaagtacaacaaaagtgtgcatttttggcttcttatttatgttttatcattgctatatctcataatttgtgatttttaaaataactttttatttgaaaagcactacagggtcacgtcatgtttttaaaaaataaattaagaaggtaaacacccgtacttctactttacctctagtcctagtctatggtggtaatcagtgttaacagtttagtttgtgttcttacccttccaggggttttttttctctatgtatacagatatatgcatttttaaaaacatagttaacacttaaaaacaatatgggatcgtattaggaatacaatctgtattccttcccaacagtatatacagtttttttccatttcactatgtatctatttataaattttttatttctaataatttctcttgaataggtgagacatcatatagtataaaattcagtagaaaatcagtttttcagaggtacaaaattggctgactttgcacagactcctttcatttcacaggtagggatgcacagccacctcttccaccgacgagaggaaaggatatgtgtgcctgtgggctcttcaactctgttgattagttatgatttattttctggtcagtttgagaggaaacagtgataaaatactgggaacagggaagaagcataagattattattgtttttttttttttttttgagacagagtcttgctcagttgcccaggctggagtgcagtggtgcgatctttgctcactgcaagctccgcctcccgggtccatgccattctcctgcctcagcctcccgagtagctgggactacaggcgcccgccaccacgccctgctaattttttttttgtatttttagtagagacagggtttcaccatgttagccaggatggtctcgatttcctgacctcgtgatccacccgcctcggcctcccaaagtgctgggattataggcgtgaaccaccgcgcccagctttaattttttttttttttttttttttgagacagagtcttgctctgtcgcccaggctgaagtgcagtggcgcgatctcggcttgctgcaagctccgcctcccaggttcacgccattctcctgcctcagcctcctgagtagctgggattacaggcacccgtcaccatgcccagctaattacgggacctcgctctgtcgcccgggctggagtgcagtggcacagtctcgctcactgcaatctggcaagtgattctcttgcctcagcctccagagtagctgggactacaggtgtgcgccgctacgcccagctaatttttgtatttttagtagagatagggtttcgccatgttggttggccaggatggtctcgatctcttgacctcgtgatccgcccttctcggcctcccaaagtgctgggattaccggtgtgagccatcgcacctggccttcctactttattaagatacctaagggatttctgtgattgttaggattcaaatttctgtgagcataagaatcaagctgtgtgcataataattgcatgggatttcacagctgggccccattcccagggattttgtattatctacctccaagtgattttgatgctggtgatccttggaccagacttggtgaagctcaatgcttagctaggaaagccccaaaaatttgctttattggattgtgtaatttgactacatccattgtttcttttttcaaatgtagagttatatgccacaaaaatattttccgtagcagtaggcatcctaattaatctcgatgtttgtttatagccccattgatggggctataaacttggcagcaaattgttttcccactaatttggcattttccataaatgtttgtttatagccccattgatggggctataaacttggcagcaaattgttttcccactaatttggcattttccataaaaaacacgtatctgttgttagctgcctagacgttagctggacatggtttaggttacttttctcttaaaaagtaaattttaattcaagttcctttaagccagcagtctcaacctggggcagtttttccctccaggggacattcagcagtgtctagagacatttttggttgtcatgctgaggaagagagtgtatagtgggtagaatccagggatgctgttaagcatggaacagccccttacaacaaaaaattatgtagcctaaaatggcagtgttgccaagattgagaaattatgctttaaatgtgtttttatatatggccattttgtgtttactctggagataacatgcttttcctcatataacatgcttgataaacattttggtaacacaggaattgtaaatgctggtgatgtcagtaaatagttaagaaatttagggctgtgcgcggtggctcacgcctgtaatcccagcactttgggaggccgaggcgggtggatcccgaggtcaggagatcgagaccatcctggctaacatggtgaaaccccgtctctactaaaaatacaaaaaaatgagccgggtgtggtggcaggcacctgtagtcccagctactcaatttagaaagcagatttgtttcctttctatacctgtgtaatttgaggtttagtttactgtcacatcgtttataaacataaggaagatcgttgctcatctgatagcattccgaaccttgagtcatctgtaatgcctatggcctccagaaaagcttctctaatactgtacttagagatgtgtaaaatatgtaggaacattttcccaccttcgattgttagtttacctttcagcttcagtaatttacctttcagctattactttagtaacatcttcaacattgtttttcaaactgcaaggtgtgacccagtagtgggtcgttaaattagtaggtgacagagcatttttgaagaattaaatacaatagaacatagcagagtgggctcacgcctgtaatcccagcactttgggaggcgaggctggcaggtcacaaggtcggcaggtcacaaggtcagaagatcgagaccttcctggctctaacatggtgaaaccccgtctctactaatagtacaaaaaattagcggggtgtggtggcatgcgtctctagtcccagctactcaggaggctgaggcacgagaatcacttgaatccgggagctggaggttgcagtgagccgagattgcaccactgcactccagcctcagcaacagagcaagactatttcaaaaaaaaaaaaaaaaaaaaagaaagaaagaaaaaaagaaaatagagtgtatcacataattagagtagcaagtattgatttgtgaaacctattttaatcatagatctatgtatgtatgtgctggattgtgatgtaaagacatttcttgctgtggttacactgaaaaaaatgaaaagtcactgatttccaataacttacagaagcagtatgaactacatattctgtcgttcttgaaacaagctgagattttattgactttgggaagcagtagaattattttagttttttaattaacagtttttggctttgtactgtcaagaggtaattttagaaagcattctaaaaatgtaagtactggatttggcaacattcttgaactgtaattctgtttcgttaaacatcactatttacatgtgcaacagcgtgtctgtaacaatgtcccagtaatgaaattctttcttctatttaaggcatgtctgtttgataaaagtcaaacaaaattgggtatatgtcagtgtcttatgatactgcttaattaaacattaatttgactcttagctaatcaggaaatgtttgcctcacagtcttacagagctttccaccttctaaaaaagctaacgtttcagaatagattcaggattcaaccttctttctgtctttttttttttttgtttgagacagagtcttgctctgttgcccaggctggagtacagtggcgctatctcggctcactgcaacctccgcctcctgggttcaagcaattctcctgcctcagcctcccgagtagccggggttacaggcgtgcgccaccatgcccagctaatttttttgtatttttagtagagacagggtttcaccatgctgggtggccaggcgggtctcaaacttctgaccttgagatctgcccaccgtggcttcccaaaatgctgggattataggcgtgagccaccgcacctagcctagattcaggctgcttctttttttttttttttttgagacagagtcttgctcttgttgcccaggctggagtgccatggcatgatctcagtgcaccacaatctctgcttcccaggtttaagcgattctcctgcctcagcctcccaagtagatgggatcacaggcatgagccaccatgcctggctaattttgtattttttgtacagacggggtttctccatgttggtcaggccagtctcgaactccctacctcaggtgatctgcctgcctcggcctctcaaagtgctgggattacaggtgtgagccactgcgcccagcagattcaagctttttaaatggaattttgagctgatttagttgagacttacgtgcttagttgataaattttaattttatactaaaatattttacattaattcaagttaatttatttcagattgaatttagtggaagcttttgtagaagatgcagaattgaggcagactttacaagaagatttacttcgtcgattcccagatcttaaccgacttgccaagaagtttcaaagacaagcagcaaacttacaagattgttaccgactctatcagggtataaatcaactacctaatgttatacaggctctggaaaaacatgaaggtaacaagtgattttgtttttttgttttccttcaactcatacaatatatacttggcaatgtgctgtcctcataaagttggtggtggtgactcactcttaggacacattcagatttcttttttttttttttttgagaaggagtcttgctccgttgccaaggctagagtgcagtggcacaatctcagctcactgcaacctctgcctcctgggttcaagcgattctcctgcctcagcttcctgagtggctgggattacaggcatgtgccaccatgcccggctaatttttgtacttttagttttaccatgttggccaggttcgtctggaactcccaatctcaggtgacccacctgcctcggcctcccaaagtgctgggagtacaggcgtgagccacagagcctggccatgttcagacttctaataacaggtttgtattgactcttagcctcatggcagaagccaagagacatgagacagcttagaaatttttgctttttggaaatgaatgttagagttactggtttgtgattaaggcctattgcactgacagaggcagtgaaaaagggtttgattgccaaggaagattcacagggcctagaatggcagtggttatgcatctacagtttattacaggagaaggatacaatccagtagcaggattatggtaaggatatgcatcacagtcaaaggctgtcatagcaagtcatccagagagttcgggtgcaagttccagttttcctttgttgtgtaaagtctgtggtggggtgcattttctctctcagagcaggatgtgtgcacaggacaccttggaacctaggagcccaaaatagagtcttcactggactttttaatatttttcttgtcaagcggacatgttcctgttctctaactagcctcttcagtggaggtcagaggaagagcctcattgagaccaagtgcaactcatcaatcacatgaaacaatgctgataaataaaccacctaaatatcccctgacccacaaatacaaaacaacaccattcaatcagtatttttcatgccttgatcaggggtcattgccatgcaggaactttaacaaaacagtacaggctaataatagaattgttggaattaactcacacagcacacctatgagagagagttaagatagagggtcttggtggtctctaacagttgaattcaaagtgaagttaccagagtaaagtgagcaaagacacatattagtacaatattggtagataaaatcacgttgctctaataagcatagttttaaactttaaccatgtttctccagtaattttagtaattatattgttgttatgtctaatacataaagcattttttacttttttaaaaaatttttaggcaatgtggggtccaaagtaattaaaaaaaaatttttttaacataaagcatcttaaaattttacttaatcatgatcacttagaaccattaaaacatacgttttgatattatggggaagcttcgttgttcctttgtagacagacttaaagaaatacaactttatgatgacaagatataagataattatagatttaaattttatagaaaccttttcccttatctagtgcaagaggtagctaagtgcttattttctcaaagtactgtgttataaaaagtattcctagtgtagtcaaagcttctctttagactgataaaacttagagcacctgcatttacttccaacaaagcagaattaaagaaaatgagacttggccgggtacgtttgtaatcccagcactttgggaggccgaggcaggtggatcatgaggttaggagatcaagaccattctggctaacatggtgaaaccctgtctctaccaaaaatacaaaaaattagctgacatggtggtgcgcacctgtagtcccagcttctcaggtggctgaggcaggagaatcgcttgaacccaggaggtggaggttgcagtgagctgagatcacaccactgcgctccagcttgggcaacaaaaaaaaaaaaaaaaaaaagaaaaagaaaatgagtctttactggctgggcacagtggctcacacctgtaatcccagcactttgggagaccgagacgggcagatcacctgaggtcgggcattcgagaccagcctgaccaatatggagaaaccccatttgtactaaaaatacaaaattagcggggcgtggtggcgcatgcctgtaatcccagctattcgggaggctgaggcaggagaattgcctgaacccgggaggcggaggttgcggtgagcagagatcgtgccgttgcactccattctgggcaacaagagcgaaactctccatctcaaaaaaaagaaaatgagtctatactttgctgttttcatactctcttagtgtggtgtaggcagccatgtatcccccttgtgcctctatttctccattctgtgaatgagtgtcttccactgctgtgcttttctgattccgtaacctttgtttgtttgtttgtttgtttgtttgtttgttttttattgatcattcttgggtgtttctcgcagagggggatttggcagggtcacaggacaatagtggagggaaggtcagcagataaacaagtgaacaaaggtctctggttttcctaggcagaggaccctgcggccttccgcagtgtttgtgtccctgggtacttgagattagggagtggtgatgactcttaatgagcgtgctgccttcaagcatctgtttaacaaagcacatcttgcaccacccttaatccgttcaaccctgagtggacacagcacatgtttcagagagcacagggttgggggtaaggtcacagatcaacaggatcccaaggcagaataatttttcgtagtacagaacaaaatgaaaagtctcccacgtctacctctttctacacagacacggcaaccatccgatttctcaatcttttccccacctttcccccctttctattccacaaaaccgccattgtcatcatggcccgttctcaatgagctgttgagtacacctcccagacggggtggtggccgggcagaggggctcctcactacccagtaggggcggccgggcagaggcgcccctcacctcccggacggggcggctggccgggcggggggctgaccccccccccccgcctccctcccggacggggcggctggccaggcggggggctgacctccccgcctccctcccggatggggtggctggccgggttgggggctgaccccccgcacctccctcccggatggggcggctggctgggcagaggggctcctctcttcccagtaggggcagccgggcagaggcgcccctcacctcccggatggggcggctggccgggcggggggctgacccccccacctgcctccaggacggggcggctggccgggcagagcggctcctcacttcccagtaggggcggccaggcagaggcgcccctcacctcccggacggggcggctggccgggcagaggggctcctctcttcccagtaggggcggccgggcagaggcgcccctcacctcccggatggggcggctggccgggcggggggctgacccccccacatccttcccggacggggcggctggccgggcagagggtctcctcacttcccagtaggggcggccgggcagaggcgcccctcacctcccggacggggcagctggccgggcggggtgctgacccccccacctctctcctggctgggcggctggctgggcggggggatgacccccccatctccctcctggatggggcggctggccgggcggggggctaacccccccacctcccttccggacggggtggctgccgggcgcagacgctcctcacttcccagacggagtggctgccgggcggaggggctcctcacttctcagacggtgtggctgccgggcggaggggctcctcacttctcagacggggcggttgccaggcagagggtctcctcacttctcagacggggcggccgggcagagacgctcctcacatcccagacggggcggcagggcagaggcgctccccacatctcagacgatgggcggcctggtagagacgctcctcacttcctagatgggatggcggccgggcagagacgctcctcactttccagactgggcagccaggcagagaggctcctcacatcccggacgatgggcggccaggcagagatgctcctcacttcccagacggggtggcggccgggcagaggctgcaatctcggcactttgcggggccaaggcaggcagctgggaggtggaggttgtagcgaactgagatcacgccactgcaccccagcctgggcaccattgagcactgagtgaacgcgactccgtctgacatcccggcacctcgggaggccgaggctggcggatcactcgcggttaggagctggagaccagcccggccaacacagcgaaaccccgtctccaccaaaaaaataccaaaaccagtcaggcgtggcggcgcgcacctgcaatcgcaggcactcggcaggctgaggcaggagaatcaggcagggaggttgtagtgagccgagatggcagcagtacagtccagctttggctcggcatcagggggagaccatggaaagagagggagagggagaccgtggggagagggagaggagggagagggagagggaaccttttgttttattccagtaggaccagctagaaacagaaggtgattgaccagtattagggatggaatcagggtacaattatggagacaggctatctaaacaattcactctcaccatttaaatcagctgtttgatcattttttttccatatatctttaccatcgcatagtaaataatatcctttttattttcaagagggagtattggccttaagttaggaactctcttaatttttttcccccatcatcccacccgcacttcttactccttacttcctacttgcttttattctttactggctctttaccactgcgtatttttaggtgcatacatctattttttaaaaaagcacccttgttcctgggtcctcttccagtaccatctattaatatatctctctccctctttccactcccagctgggtttctgaaagcgtgcacttcccatcttccattcattcatctggtttccagccctgaccacagtactgaaatggcatttgctaggtgacctttatttttttttaaatccagtgaatgcggtatagtccccccgcttttttctttctttttttttttttgttttttgttttttgtttttttgagacagagttttgcccttgttgcccaggctggagtacaatggcgtgatatcggctcacggcaacctatgcctccccaggttcaagcgattctcctgcttcagcctcccaagtagctggattacaggcacctgccaccacagctggctaattttgtatttttagtagagatgggttttctcgatgttggtcaggctggtttcgaactcccgacctgaggtgatccacacacctctgcctcccaaagtgctgggattacaggtgtgagccactgcgcccagccttggtatagtctttaacgaaagttcactgatcttgaaaattttgatcttgaaactcttttttttttttttttttttttttttgagatggagtcttgctctgtcacccaggctggagtgcagtggcacaatctcagctcactgcaacctccacctcccaggttcaagcgattctcctgcctcagtctcccgagtagctaggattacaggtgcccaccaccatgcctggctaattttttgtatttttttagtagagatggggtttcactacattggccaggatggtcttgaactcctgacctcatgatccacccacctcggacctcccaaagtgctaggattacaggcgtgagccaccatgcccagccttgaaactctcctaaggttatgttaaacatttttgtattcttggttttctttttgttccatgggttatttctctttatccttctttttagctttcttaagtgttcctttaccttatcaaattctatttttggctcccatttcacttaataagaggaaaagctgggatttttttttttcttttgtggagacagagtctcactttgttgcccaggctggagtgcagtggtgcgatctcagctcactccaacctccgccttctgggttcaagcgattcttgtgcctcagcctcctgtgtagctgggattgcaggcatgtgccaccacgcctggctaatttttgtatttttagtagagatgggggtttcaccatgttggccaggctggtctcgaactcttgtcttccaagtgatctgcctgcctgggcctcccaaagtgctgggataaatttgagccattgtgctcgtctaagctgggattctttgaatgagttcttagaggcttcctgaaactttgtgcaacattttgtgtatgtgtatattttctggggaaaggatttgtaactttctattttttgagagggagtctctgtggctcagggtggagtgcagtggtgtgatctcggctcactgtaacttctgcctcctggttcaagtgattctcctgcctcaggctcccaagtacctggaattacaggcatgtgctaccacacctggctaattttgtatttttagtagagacagggtttcattatgttggccaggctgggaatttgtaactttcatcagatatcccaagggatatatgtctttcctggtagagagggaagaaacaaaaaacgtgtgtaaataccctcctctcccccagaaggtaagaagtactgctctgcacattccttgggtgatctttctcactccctgggataattaaggaagttagggattggggttgagggtaacttggcatccttccccaacctccctgtataggcacagtctaatatacttgatgacagtttgcaacaagtcaacaatttcctacttttctggtgttaggtttaagttatatagacctatggtgatcataacattatctaaatcagatgcttcacattataggtcttgcagctgatgtccagtttaggtgtttgaagtggcttagcctggaaaatgttacaggggaaaatctgctttccatgtgttatgctcagagctgtgttcttttcttttacacaatatgtttgacatttgttgaattttaggtgtaccctggtcattaggaactccctaaaggatctctgtgaggttttaaaaaaacaaaacaaaacaaaaaaacagtggcattttgcagaactcagtatagctctttaccatactgactgcaaggagaaagtaaaaagtgagactaattttgcaattagtctcccaagtttctttacaagaaaatagaccaaaggtactatgtttaaaagcaaaatcatggcttaaaagtttttctttttcttaatatattaatatattgctataaattgagtattgctctcttgctatcttgtgtttttttggtttttgattaactctaagcttaatgttattcctgacaaataaataaataaataaataaataaataaataaagtgaattcagagagacagtagagggcagcagccgtttagaaagtagattcacattgagtgattacggctcttttaaatctttctccactaagagatagctaatttccgaaaaggtatacttggcctcccatattccttatgtctcttaaaactaaaaaagctgggacaaaacttaaaataacagtattctacggttagggcaaatttctgatactgcttaaaacaatttaccgaggtatctttatttttttttgagacagggtttcactctgtcacccaggctggagtgctggagccttgacctcctgggctcagctcaagtgttcctctcacctcagtctgccaagtagctgggactacaggcatgcaccatcattcccaactaattttttaaaattttttgtagagatgggggtttcatcatgttgccaggctggtctcgaactcttgggctcaagcaatctgcccacctcgtcctcccgaagtacagggttataggcatgagccaccactcccagcctcagatttttttattgatgaattttattataacagctacaatactgagatgcataacccttccctttcctgatacccagttatcatctgtttctgtttaatacactccttaagtacctcacatttgctattcccctgccccccatggtctatgcatcttcttcattgaagtggtagtagtctttgttagctcatctggtcatgtcatcaattcagagcacattacctctttagttcagaacacattaattgcttcccataatcttcaggacacggccccatttcttcacgtggcttggccattgcttccctgttcagcttcccccacactccctcacctacaccttctgtctcagtatagtactgctagtctccagacatgccatgcctttttatgcttctatgcgtgttttcctgtctttaatgtccttgtccatgtgatgaacccctactcatttttccaagattgaactcaaatgtcaccttttctgtgagcttctctgctcttctcatgcagagtagaagtgtttatctccattgcccttgaccctaaataacagtacattagtataataatcacattttttacctgtttgtgtgctttccttctaaatggagaataagaatataaaagtgatttatttggcatttctgcaaagggagatgataaaaagaatctgcgttacttagcctttttaaaaaacccttagcctatgaaggctactatttaaggtttggttggattttgtatgttggaaatatgttctttaaatctcatcttcatcagtttataaaagcaatataagttctttgtagatcattatcatgccatccagatgtagtcattattgttttgatataggttgtttcagtctttaaaccaaattatacactgttccgctgtaactcttgttttgaaaacagatttgttccaatgtgggtggtatattagggaacaatttgagcataatgtaaattttgagtttgcttatgcacaaatccctaggcaacactaggtgaatgcagaaaaatgcatgcagctgaactcagcagtgtagatatatacaaaagatacacatacacacgctcttcaaatacctaccttattttcctgtatgtgttatgaaccatacccattcacatctggtattacaactttgccacccatttcagacagtattcctttgaccattctgcagtaactcagaagctgcagccctttagaagtctactccactgtggctcacgtctgtaatcccagcactttgggaggccgaggtgggtggatcatgaggtcaggagatcaagaccatcctggctaacacggtgaaaccccgtctctactaaaaaaaaatagaaaaacctagccgggcgtggtggtgggcatttgtggtcccagctactcgggaggccgaggcaggagaatggcgtgaaccggggaggcagagcttgcagtgagccaagattgcgccactgcactccagcctgggcgacagagcgagagtccgtctcaaaaaaaaaaaaaaagaaaaaaagaaggccactccacaagcaaaccgcagatgttttgcaaggtgacttatttattgtaatagttgtgtatttcttaaccatttcacatgtataaaactgtgctactacttttatgaggttcctgtctttattttttttaacatgtcgctggtgaaggttctgagagttgtggcttgaactccagttttctcataagcacggttttttgttgtttttttttgaaatggtctcgctgtgttccccaggctggagtgcagtggtgtggtctcggctttctgcagccttggcctcccagcttaagctatcctcccacctcaagctatcctcccacctcagcctcccaaatagctgggactgcaggcgtgagcctttgcccacctaatttttatacttttgtagagacagtttttccatgttgccaggctgctttggaactccttagctcaagcaatcagcccgccttcacctcccaaagtgctgggattacaggtgtgtcctaccacacccagacggctctggtatttactgcatagtgttctgatttttaggaatacatacgttgcattatatagcagaactggctgtattcaaaagtctaatagaaaatattgatagggtgataatgtatatagtactaattgtcagttgccataatttaactaatattgttttactttttactttttttttttttgagatggggccttgctatattacctaggctggtcttgaactcctgagctcaaggaatcctcttgcctcaacctcctgaggatgtttgacattttttgacttttttttttttttttttgagacggagtcttgctctgtctcccaggctggagtgcagtggcatgatctcggctcactgcagcctccacctcccgggttcaagggttcaagcacttctgcctcagcctcctgagtagctaggattacaggtgtgcaccaccaccacggctgatttttgtatttttaatagagatggggtttcaccatgttggtcaggctggtcttgaactcctgacctcgtgatcctcctgtgtcagcctcccaaagtgctgtgggtacaggcgtgagcctccatgccggccggctttttggcaatttaaatagttacagttacctattataattgatatttagctaacatctatttttattttaatattccaggaaattattatgcagaaactttaaaggtctgtgtacttctctggtgttttgattttttttttttctttttctgtgagtaattttctaaaactggtttctaggccaggctatttatgtcttgctttttattttttttggcgatggagtctcgctttgttgcccaggctggagtgcagtggcgctatctcatcttgctgcaacctctgcctcctgggttcaagcagttatcctgcctcagcctcccgagtagctgggactacaggcacatgccaccacgcctggctagttttttgtatttttagtagaggtggagtttcaccgtgttgcccaggctggtctggaacttctgagctcaggcagtctgcctgccttggcctcccaaagtgctaggattacaggtgtaagccactgctcccagccttattattttatttttatggattcggggtatatgtgcaggtttgtcccatggatatattgtgtaatggtgagttttggacttctgttgtgcccatgaacattgtacccaataggtggtaatttttcaattctcatccctctctctgcctctgcccttttggagttcccagtatctgttaattctctctgtatgtccatgtgtacccattgtttagctcctctattttttattttattttattttatttttgagacaagagtcttgctgtatcacccaggctggagtgcagtggtgcaatctcagttcactgcaaccttggtctctgggttcagatgattctcgtgccttagcctcccgagtagctggaattacaggtccgtgccacgatgcccggctaatttttgtattttcagtagaggtggagtttcgccatgttggccaggctggcctcaaactcttggcctgaagcaatccgcctgccttggcctcccaaagtgctgggattacggtgtgagccactgctcctgaccccatattttttcttttaattataaaggtaataatgtaaaaagaagtcaactcccagtttaactctagcagagtaaccagtgttaatttttttttttttttttttgagacggagtcttgctctatttcccaggctggagtgcagtgatgccatcttggctcactgcaacttctgcctcctgggttcaagccattctcgtgcctcagcttcctgagtagctgagattataggcgcccagtgccacgcctggctaatttgtgtatttttagtagagatggggtttcaccatgttggctaggctggtgttgaactcctgacctcgtgatccacccgcctcgatgctgggattacaggcgtgagccactgagcctggccaatccattcctttttatggctgagtagtattccattgtgtgtgtgtgtatatatacatatatatacacacatatacatatatatacacgtatatatgtatgtatgcgtatatatgtatgtgtgtgtgtatatatacacatatacatatatatacacctatatatgtggtatgtgtatatatatgtggtatgtatatatatgtggtatatatatgtggtatgtgtatatatatatgtggtatgtgtatatatatatgtatatatgtgtgtatatatgtggtatgtatatatatatgtatatatgtggtatgtatatatgtatatatgtgtgtctgcatatatgtatatgtgtgtatatatacacgtatatgtgtatatatatacgtatatatgtgtatatatacatatatacgtatatatatacacacacacatatatatacacatatgcaggcacacatatatatacatatatatatatacataccacagtttctttatccacttgttgattcatgggcatttgggttggttccacgtttttgcaattgtgaattgtgctgctataaacatccgtgtgcaagtatcttttttgtataatgatatcttttcccctgggtagatacccagtagtgggattgctggatcaactggtagttctacttttaaggaatctccacactgttttccttagtggttatactggtttacattcccaccagaagtgtagaagtgttccctgttcactgcatccacaccaacatctatttttgattttttgattatggccattcttgcaggagtaaggtggtatcgcattgtggttttgatttacatttccctgatcattagtgatgttgagcatttttttatgtttgtttgccatttgtatatcttcttgagaattgtctattcatgtccttagcccattttttgataggattgtttgttttttttcttgctagtttgtttgagcttgttgtagattctggttattagtcctttgtcagatttatagattgtgaagatttttttcccactctgtgggttgtctgtttttgtctgtttccttctgctgactgttccttttgccatgcaaaagctctttttttttgagacagaatctcgctctgtcggccaggctggtaacaaagacacaggtactggtaataactgccatggcttattgcctacattaatgatgaaagcaaatgctaaatttcagctagaggctagagaaaataagcctggaattttcttttatgtttatatactgctatgaataccaggagtccttgggttaagactgtagggctttctaaagcctgtgatcactagtggagaatgtagctttacaaagtctagttggaaattggcaactgggggttagtacaagttacaaggaagggatggaatttaagatgctagtgaaagcttggaggataagggagcaggtgaactcataaggaagtttatgaactgagaagggctgcagcaaagtgggctcatgtgcttgaggagccagaggacatgttgagggtgacataggttctgaagttcgtacagatacttatgcagtatggattcttggaaaaccttctttagtcatgtgatagaaaaataacagcttatggaaaaaacagggttgaggcagacctgaaaatacatgaaattttaaaaaccgcttctaacagaagcataacagactgtaataaaaactgtggccttcctggcatttgcacccaaacaacagcattagccaactctttgaagccttagatctgtggctcttgttttctcctttgaggtgtaggtccttgagggcatttgcttctaatagaggctagtttcatcagaattaaaaatctgaaccatggtatgaaattcaattcttttttttttttcttttttgaaaacactggcaaatgttttgtatccttgagctttcccacatatcttaacatagtgagtggaaagtacagtggctgttaagccaactactctgaggtcttcactgctaaggcttactcttaattgtgtgagagcttaaccttgatccctttaaaacattaatgggctagaaaaaaaaccattcataaaccagtgccacctctgaattttgctaccacaattcccttatttaccaatagtgcatgagctaatttggaataaagaactaggcattgtagcacaacagacattatgtgggcaaagtgttgtttatattctgtctaaatagtgcttcacatgtatgtactattttctaaatatgtatagatgcttttgtgattaataataaaacatgaattcttaaaacaattttgctgacttcatagtagcttttcaccgttttttcagtagctgctaaaatttctggagaagtttgggaactattgttttggagtgaaatgcagtgtgttagatatcacttgcagaattcttctaagggtatttattggcgattagaaaaaaaatccttgtgttataccagtagtaatacaaagtaattgttcagcttctgttaagtgtaaaggactatacaagtattgtgtatagttatctcatttattattttctgggtagctattgttattattacttcgtacaaaaagggaaaaggaggctcaaagtatcatgctccagataacagagccagtaggtagcagagctgggattgctacccaggtctctagtcctgctttttcacactatatactcattgcttcacttactccttcatacatgattccccagcatgtactcttttttttttttttttttttttgtttgagatagaatctcgctctctgttgcccaggctggcaggcagtagtgtgatcttgggctaactgcaacctccatctcctgcattcaagcagttctcctgcttcaacctcctgagtagctgagattataagcctatgctaccacgcctggctaatttttgtatttttagcagagatgaggtttcgccttgttggccaggctggtctcaaactcctgaactcaagtgatctgcccacctcagcctccgaaagtgctgggattataggcatgagccatcatgtccggcctccccatcatgtacccttaaataccatcaagcacagttccattgtgtaaaaacttggcttgatttaacctgttaattggaacactgtcattaatggaaattaggaatatgaggtaagctagaggttttattttaatgactttgggttattaaatctataagaaatgaaattcatttagtcataattaatgtcatgtttctgcatctatattacttgttgggtttacagacgaggtagtgtattattagtgggaagctttgagtgctacatcatctccctttctataaaataaattgagtacgaaacaatttgaattaaaacacctgagtaaatagtaactttggagacctgctgtactatttgtaccttttggatcaaatgatgcttgtttatctcagtcaaaattttatgatttgtattctgtaaaatgagatctttttatttgtttgttttactactttcttttaggaaaacaccagaaattattgttggcagtttttgtgactcctcttactgatcttcgttctgacttctccaagtttcaggaaatgatagaaacaactttagatatggatcaggtatgcaatatactttttaatttaagcagtagttatttttaaaaagcaaaggccactttaagaaagtttgtagatttttctttttagtatctaattgtagcacctttgtggacagtggatgtaatattaagtgacagatgggaaaaggatttttaaaaaaatagcaactgtttcagtggatgaaataaagattattagcagagaaaatgaatattgggcataactgtcctggtgaaagacaatctcataaatgaacaatttcataatttcgtaaatgcaactgcattttattttcaaagagaaggaaaattatagtcactggaaacggaaagagaagttagaggtaaacataggacacacaagaaaactttcattttgtttattttcttgtttttcttttgagacagggtttccctctgttacccaggcttaagtgcagtgacactatcatagttcactaacccctcaaattcctgggttcaagtaatcctcctgccttagccttagtaggtgtaaatacaggtgtgtaccaccatgcctggcgaattttaaaaaaacttttttatagagatgagctctcgccgtgttgcccaagctggtcctaaaacgctggcctcaagctatcctccggcctcagtcttagcctcccaaaatgctggggtttcagtagaagccaccatgccgggccacttctgtttcttttccatgtagagttctttgcaggaggaggttagaataggtgtgcatctcctaaatagttgtcgaatataactaaaaagttaaccaggactctaaatactatttacttctaaaatttgttaattgggaacatttagggtttaactgatctatatcttatgtctttaacaattttgaatgataattatatgtaaagtaagaacagtttgtgaaatagttgaaaatatccttacatgaaagtgaattttaaagcacagtttatgtaatgttaatgttttgttttgtatctgttaaaaatttgtttatatgaacaagtttacaggtttactgtggtgagcccgttgaatatagtgggttttttttgtttgttttgtttttgtttttgagatgaagtctcactcttgtcccgaggctgatgtgcaatggcgcgatcttggctcactgcaacctctgcctcctgggttcaagcgattctcctgccttagcctcccgagtagctgggattataggcacctgtcaccaaacccggctaagttttgtatttttggtagagatgggatctcagcatgttggccaggctggactcaggtgatccgtctgcctcggcctcccaagtgctgggattacaggtgtgagccaccatgccgagcctgaatatagtgtttttaagttgcaggactttaaaaataatattttgaaatttttctaagttaaattccctgttaaaatggtcatgcaggaatatacgcttgcattattcatattagggtaactgtttggtttgctagttgttagattctttgcattcctttttttttttttttttttttttttttttgagacggagtttcactctttttgacaaggctggagtgcaatggcgctatctcggctcacctcaacctccgcctcctgggttcaagcgattctcctgcctcagcctcccaagtagctggaattacaggaatacgccaccaagcccggctaattttgtatttttagtagagatggggtttctccatgttggtcaggctggtctcaaactcccagtctcaggtgatcagcccacctcggcctcccaaagtgctgggattacaggagtaatcccccacccttttaaaaaaatgagacagagttttattctgtcacccagggtggagtgcagtggtgcgatcatggttcaccgcagccttgaatctgggctcaagtgatcctcccacttcagcctcccaagtagttggaaccatagatgtgcatcaccacacctggctgatttttaaattatttgtagagatgaggtcttgcttgttgtctaggctggtcttaaacttctgggcttcagcagtcctcctgcctcagcctcccagagtgctgagatgatagacatgggccactgcccctggccgcatttttcttttcttttcctttctttttttttttttttttttgaaacggagttttgccattgtcgcccaggctggagtgcagtggcacgatctctgctcactgcaacctctgcctcccgagttcaagccattcttctgcctcagccttccagttatctgggattacagtcatgtgccaccacgcccagctaatttttgtatttttagtagaaacagggtttctctatgttggtcaggcttgtcccaaactcctgacctcagatgatccacctgcgtctgcctcccaaagtgctgggattataggcgtgagccaccatgcccggccctaactgcatttttcttagtatttgtggtttgagttaatacttgccctatgtgatgttgatttattattactggatcattaagtgaggtttaaagaagctaaatgccatttgctctatgccctctggattttaaaagtgcatgggtgtgcacgtgtgtaggtataaatgtttccatattctagtatattctgtgtcagtgatagagcagtcttagagctgtcttttccatttacttgtaggttaagaagccaaaaaaagttgtgtcatcatcccgtttaggaaaacttacattttggctattgtttcctctagtgctgctattagtggaatgattttaggtgttcaactttcagatcaatgggagacagaaatattgttctgagacatctggaagccgaatgtgttttattcctgcctgtctgaggatgtggtcttgcctttgatagggcaaagttatttgtaaacattgctttaaataaaaacatgtaaaggtgtttttgatggttaacaaaaactatgagtataatagagcctagtccctattacggactggtattgatctggtgtgggaagagtattgagcttttcagtgtcacctacctgtattcccttgaagggacccagagcccaggcaaagctctgctgaggtcgggcgtggtggttcacgcctgtaatcctagcattttaggagaccaaggcgggtggatcacctgaggtcaggagttcaagaccagcctagccaacatggtgaaaccctgtctctactaaaaatacaaaaattagctgggtgtggtggtgcatgcctgtaatcccagctatctgggaggctgaggcaagagaattgcttgaacccaggagacggaggttgcaatgagccgagatcatgccactgcactctaggtgggtccctgagtgagactccatctcaaaaaaaaaaacaaacaaaaaaaaaaaaaaaaaaaaacctctgctgaaatgctacagttaattttgccatttgtggtcagcattcttcttctaaattgctataatcttgccttcatattatgtgtctcaaatttaagcaggtatcagaatgtccacgggaacaaattgccatggctctaagcccagaatcagattcttcagatctggagtagggctggggaatttgcatttctaacacacaagtttgttgatgctgtttgtctggggtccacgcttgcctaacttctgatgtgatttatttctgccagtttctttttttgttgttgttttatttttttgagatggagtctcgctctgtcactcaggctagggtgcagtggcatgatcttggctcactgcaacccctgcctcctgggttcaagcgattctcctgcctcagcctcctgagtagctggggttataggcacactgcaccacacccagctaatttttgtatttttcgtagagacagggtttcaccatgttggccaggctggtcttgaactcctgacctcaggtgatccattggcctcggcctcccaaagtgctcggattacaggtgtgagccacccaccatgcctggcccttcctaccaatttctatcctccctgaaatgctgcacacttaggcagtcactggacaatatctgccccaaaattggtttgtataattgagaatatttaagaggttgttaaaatttgaaccactttctattcttctattaagtgtacacatctattaaagatccccttgtagctctttttatctgggccatcacatttctgcccagcagatgcagaggccctgtcctctcttccacctccccactacctctccttccctacttttggactgtaaaagctgtctttctgcagttaattgttttattctttgtaggttctactcgttgataatgttatctactgctataataattacagacggcaacaggatgatcaaatcttggatattttaaatttacattatgccttttttattttatttttttaaagtctctgcttgacagcaaataagcctaacgttccctaacaaatgatgatgtcccattaatgatttgatgacttcctgtttgtagtttttatttagagtgcttgtgggtagtttttcataacgacatttaaaaatcaggatataaataattttttaagttttttttttaggcggggcacagtggctcacacctgtaattccagcattttgggaggctgaggtgggcagatcttgtgaggtcaggagttcaacaccagcctggccaacagggcgacaccccatttctactaaaaatacaaaaattaggccgggtgcggtggctcacacctgtaatcccagcactttgggaggccgaggcaggcagatcacaaggtcaggagatcgagaccatcctggctaacacggtgaaaccccatctctactaaaaatgcaaaaaattagccgggcatggtggcaggcgcctatagtcccagctactcggaaggctgaggcaggagaatggcttgaacccaggaggtggagcttgcagtgagccgagatggcgctgctgcactccaacctgggcgagagtgcgagactctgtctcaaaaaaataaacaaataaaaaataaaaaaattaaccaggcatggtggcgcatacctgtagtcccagctacttgggaggctgggacagtagaatcgcttgaactcgggaggtggaggttgcagtgagctgagatcacccactgaactccagcctgggcaacagagcaagactctgtctccaaaaaaaaaaaatgtatttttctttgaagcttttctacttttaaatgtaatgtatagtattataacaagtgaacaaaatgatacaaagaagtatggcgggaaaggtgtggtagagatgggaaaacatatttcctccagcctcttaggttcattggaggagcttgggaattcaactgacacacgacagatttacaggagaaaagttttatttcaagtacacatgagagcttcatagaaaagaagtgaagacctaaagaaacagactggagagttcatatgccattttaataaaggataatgtattagtctgttctcatgctgctaataaatacatacccaagactgggtaatttataaagaaaaagaggtttaatcgactcacaattgcacatggctggggaggccttacaatcatggcagaaggtaaaggaggagcaaaggcacatattacatggtgtcaggcaagagagtgtgtgcaggggaactgccctttataaaaccatcagatctcgagagacttattcaccatcacaagaacggcatgggaaaaacctgcccccgtgattcaattacctcccaccgggtccctcccatgacacatggggattatgggagctacaactcaagatgagatttgggtggggacacagccaagacatatcagataataaattgtggagaggcagtaagattgaagaaaagaggtttgagcttcgaggggtggtaaattgtgggaaggtaattatttggggcaaactaatggcacataaggattgttttagtaaggcttgttatgcatacccaaaacaagtgccatctccagtaatttaagagtctatggtgatcaagagtagttctcttcctgctagaagaggggtgggagagaacaccttcacaaagggaaatttatattctgccttcatgcagaaagggggcgagcagagagttcctacgtatactgtttcttcattatcttcctctcaaaagaatacttaggctaaagtggcatgatttggggtgacattctgatcctcttcagtgacaatccttgatatttttccttctttctctccaggtaaacagtgttaacatcctggtatgcttcccccaattccattatactaactctgtattgtgggttaaagattttttactttgatcagcagtatttgaaacatacctgttatactagatgtactctgactgtaaaatagtggtcagtgttacttctttaatgatgctgtgggattaaaggattttattataaatgctgggaagagcctggatttgaggaaggtaagcagtgcagttaggtggatgtagactagaagaggtcatttgttctcatttcattgttgcccctatgacatgcccgtttctttcttttttttctttttttttttgagacggcgtcttgctctgtcgcccaggctggagtgcagtggcgcaatctcacctcactgcaagctctgccccccgggttcatgccattcttctgcgtcagcctcccgagtagctggaactacaggcgcctgccaccatgcccagctaattttttgtattttcagtagacacggggtttcaccatgttggccagggtggtctcaatctcctcacctcatgatctgcccgcctcggcctcccaaagtgctgggattacaggcgtaagccactgcacccagcctacgtgcccatttcttaaagtagaaaatttagtagttgatgatgtcagggaagaaaagctttttctctgccttacgttaagtagttgggggcaaattaaattaataaaagacagattagtgagagaaaaggctgtaagaatttggactttatataccatcataatagaggaagtaaagggagatgaagggcacttaagggaaaacagatgacttgtaggaaagataaatgaacccttaagagaatagatgagaaatatgaaggttttgtgacaatgtctgtttaggtggttacttctcttcttgttatgagagtcagtcttctggttgctggaaactgctaggagatttataacaattgggctctttcgagaggctcttcttttaagcagataagggagttcacaaaaaagcctgttctcaaatgatttcagcacacacacacacacacttacgacacagttaagtactgtgccagtaagatgtgagttgtgcatttcttttttttctctgagtagactgtttgaggttatttatatcaggacttgttatgcaggtaactgaaaactcaacataatctaggttatgtagttaaaagtatggagagaaggtaggctttatttagagttgcttgatcctgtagatctcttctaccttttgtaattttaatttcaaccaaggatggttccctttttggccctaggaccagttagcagttggggcaccattccaagcaagagtcctgcagtttgtagtgatgggaccatttaaacagtgattgtgaccagggacatagaatgggatgattggcccgaggtaaccatggttgggtatggagtcagcttccctgtaggaagagatagacaaagtctgagcactcctgggaagggggaggaagggaataactgttgtgtaaatcatcagcagtgtctactaagataccatctgtaaccataggcttctatgttttataatataaggctgtcttttaaataaatcagattccctgttaaagatctgttctagattccctagggggttgacctcatatagtatcttctttttctttggttacaaacttttaaacttgtctgaggttataaggtgaattcaactgtccactgtcaatgtagatatttttaatggatttagggatttaaattacatgattcagaaccactttgaggaagtctagggaatatcagttgtttctgtataatttctgaaagcttcactgttttctaggtgtgcacttaattcatgtgatgaagggaacagtatttacatgagtggtttggttaatttttcccctcctaagcttagctttgtgtatcgtgcgtgcttccagtgtttttgtggctgctttacataagtcttttagaagtattttctatttttgaagtaaatgtggatcaaaaccaccccaagacaggattgaaaaaaagacagtttttcgcaagaaagtaaataattttatttagcttgggactttaaatgatatgtcttaaatgtaaacatttctatactgcattttggccatcttttgatactagttttcagatgcatattgttatttcatttattattggaaaagtagtaactttaaacaaatttttattgaaaatgctgacagaggccgagtgtagtagctcacacctgtaatgtcagcactttgggaggccgaggcgggcggatcacgagctcaggagatcaagaccatcctggctaacacggtgaaaccccgtctgtactaaaaatacaaaaaaattagccgggcatggtggcaggtccctgtagtcccagctactcaggaggctgaggcaggagcatggcatgaatctgggaggcggagcttgcagtgagccaagatcgcgctactgcactccagcctgggcaacagagcaagactccatctcaaaaaaaaaaaaaaaaagaaagaaaatgctgaccaaaaaaaatgaaatagttttaaagaagccacagttgtgtgatcctgatacaactatatcattattgtatgagtatatatgagttataaaaatagtatatgtaaatgcttcataatttttattattagaaatgaaaaagtataacaaggggggtattcatattctctccacttagaattaaccctcaacatgttgacatctttgtttatagtaatccttttttgttttttttgttttttattatactttaagttctagggtacatgtgtacaatgtgcaggtttgttacatatgtatacatgtgacatgttggtgtgttgcacccattaactcgtcatttacattaggtatatctcctgatgctatccctcccccctccctccacccctcaacaggtgtgtgatgttccccttcctgtgtccaagtgtcctcattgttcaattcccacctatgactgagaacatgcggtgtttggttttttgtccttgcgatagtttgctgagaatgatagtttccagcttcatccatttccctacaaaggacatgaactcatcattttttatggctgcatagtattccatggtgtatatgtgccacattttcttaatctagtctgtcattgttggacatttgggttgattccaagtctttgatgttgtgaatagtgccgcaataaacacacgtgtgcgtgagcctttatagcagcatgatttataatcctttgggtatatacccagtaatgggatggctgggtccaatggtatttctacttctagatccctgaggaatcgccacagtcttccacaatggttgaactagtttacagtcccaccaacagtgtaaaagtgttcctatttctccacatcgtctccagcacctgtcgtttcctgactttttaatgatcgccattctaactggtgtgagatggtatctcattgtggttttgatttgcatttctctgatggccagtgatgatgagctatagaaatcctttttagaaacaacagagccttgttgtaaaacaggtaaatgtacgtgaggacttcaaaaagtttgtggaaaaatggaattaaaagataaaatttaaaaacacattttaaatttatttcccaacataagctcctcaagttcaagacacttttataaatgatgatctcagctgtttagttcatccgtaaagaactgagggtactagaaattttaccatgtcaatgcagtctctttacattactaactaaagaaaaataggtgctctttaaagatcttttaagattaggaacaaaaagaagtcagaagaagccaaatcaaggtggatgcttaacgactttccatagaaacttacaaaattggccttgtttgatgagaagagcgtgcaggaacgttgtcatggtggaaaaggactttgatgatgctttccctggcatttttctgcaaaaacttgggataactttctcaaaacactctaataataagcagagcttatgttctttatccccccagaacatcagcaagcaaaatgcctgaacatcccaaaaaactgttgccatgacctttgcccttgactggtccacttttgcttcgactggaccacttccatttttggtagccattgctttgattgtgctttgtcttcaggatggcattggtaaagccatgttttggctcctgttacagttctttgaagaaatgcttcaggatcttgatcccttgtttaaatttctatggaaagctctgctcctgtctgcagttaatctgggtgcaacagttttgtcacccatcaagtgaaaagtttgttcagctttaatttttcagtcagaattgtgtaaactggaccaattgttgagatgcctgtagtgttggctattgtttctgctgttagtcattagttctcttcaattagggaatgaacaaaattaatttttcctgaaaaattgatgtggatggtctgccgctgtgggcttcatcttcgacatggtctcatcccttgttagaacaagttatccgtttgtaaactgctgatttcctaggagcattgaccccataaaattttcataaagcatcagttatttcattattcttctatgcagacttcactataaatttgctgtttggtcttacttcaattttagcagaactcatactgctctgacatctaaactgatgtcttagccttcatagtgtctctgactagatcctattcagacgtgttatagcaaattagtaaagtttattttggtgccaaaaacttttgaatccacgcatagttttttcacaacacattttccatgaactttttgaagacccttcatatattataagaagaaagttaaaaatatcccctgcatctactactcagaaataaccactgttaacattaagtctgttctcaactctaggcattattgagggttttgaggacaggtcttgaaaatttctatggctaccttttactgggtggagactagcatgtatagttgaccgcataggttaatccctccactcaaaaagccacaattttaaagtgtagtattcactagcatttagtatattcacagtgttgtgaaatgaccaccaccatctagtttgaaaatatttcatcacaaccaaaagaaaacctcatatctattagcggtctctcctgtttccccagacaccggcaaccactaatgtactttttgtctctgtggacttgtcagttctggacattttatataaatggaatcatgtgaccttttatgattgacctctttcacttagtataatgttttagaggctcatccacattgtagcatgtgtcagtacttcatttccttgtgtattggtccattcttgtactgctataaagaaatagctgagactgagtaatttataaagaaaagaggtttaattggctcatggttctgcaggccgtacaggaagcatgatgatggcacctgctcagcttctggggaggcctcaggaaatttaaaatcatggcagaaggggaagtgcggcgtcttacatggtggagcaggagcaagagagagaagggggaggtgctccacacttttaaacaactagatctcaggacaagtcagtcactataatgagaacagcacccaggggaaaccgccctcacgatccagtcacctctcaccaggctccacctccagcactggggattccagttccaattcaacatgatacttgggtgggggcacatatccagaccatatctcctcgtatagctgaatagtattcccttatatggacataccacatttattattaatttattgattgattgacaggatcctgctctgttgtccaggctggagtgcagtggtttgagcatagctcactgcaggccttgaattcctgggctccagtgatcctcccacctcagcctcctgcgtacctgagattataggtgtgtgccaccacacctggctaattttttttattttttagcagagacagggtttttgctatgtttcccaggctggctttgaactcctgggctcaagcaatcctcctgccttggcttcccaaagttgtaggattacaagtgtgagtttagagaggtataatttcttactcaacttcaagtattttatttctcttatcatttgttgtttggtttgttaattatttggaagtatatttttaaatttccaagcttagtgtgtgtcagtttcataaaagttccccatgtatttaaaaattggatgtgtactctaattttgggattgctttttcattgtctatatatgcttgctaatttttgatctgctgggttactgagaaggatgtgggtttctccatctagttctatttttggttaatatgttaggcacagagctgttgtttttttgtggtgaattgaatcttcatcattctttagggactctgtccttaataatgctttttttgccttacattttgtttcattgtaagagagctatgtcagagtactttttaaaacactttttaatatggtatatatttttttcttttttaatgaggttttttaaccgtaagtttaagcaaaataaagcttaataactggattttatttagttttaaatttaatttgatttttttttttttgagactaagtctcactctgtcgcccaggctggggtgcagtggtgcgatctcagctcactgcagcctccgcctcccgggtttaagtgattctcctgccttagcctccctaggagctgggattacaggcgtgcgccaccacgcctggctaatttttgtatttttagtagaggcgggctttcaccatgttggccagtctggtctcgaactcctgacctcaggtgatccacctgcctcagcctcccaaagtgctgggattacaggcatgagccaacactcctggctaatttaattcgatttttttagtagcagttttagtctattatgtttgttgtagttactagtatctttggatttatttctacctaattatttggtgattcctcttcttcctggttccacttacacattaaaaaaaaaaacaaaaaaaacttagaatagagatggtgtctcactatgttgttcaggctgctctcaaactccagggctcaagttatcctcctgccttggcctcccaaagtgctgggattacaggtatgagccaccatacctggtcccccttgcccattctgttttacttttgtattgcttgggtttctaaaattccattttgtcctctccctttgctcttccccaatcctatctcatcacacacactggtttggaagatagccacttttttttttccaatgtgtttacttatcttatcagagtcaaaagcctatcagtatcttctcagatatcccaaaaaatactaggaccttaagacacctaaaatcaggttacatttcttcataattgtctagtattctagttctatcagttttacctctcagatctccattctgtaagtcaatgttaagtttagatttgtccatatgcatacgagtttctttggtattcaatacttcctgtatatttttaagaagttcctttgttggaggtctgttaggttttatttgtttgaaaatgtctgtatttcacccttgttcttgaaggatggtttttctaggtatacagttcttttttttttttctttgatacagttttgctcttgttgcccaggctggagtgcaatggtgcgatcttgactcactgcagcctccacctcccaggttcaagtgattctcctgcttcagcctctcgagtagctgggattacaggtgcccaccatcacacctggctaatttttggtatttttagtagacggggtttcaccatgctggccaggctggtcttgaactcctgacctcaggtgatctacctaccttggcctcccaaagtgctagggttacaggcgtgagccaccgtgcctgacaaaggcctaactttccttcctcattcttttcatcttgtttcttggtttcatcatcccattttttagtttcttttcagtctccttttgtgtagcctgaagcaataactgtgtttctgatgcctaggtaagtatactgtaggtaggctgatactgttcagctagtacatagtagaagtcagatgtcacatttttagaatactccagttctagataagaataccttgttgggtgatatattttattatcctggattgtttggcggatgtaatggattgctgaagacgcccagtttcctgtgtggcccttgagtatttattttagtaagttagaggctagttgttcacttttcccttgtttaactggggactcctcagcagccctttcaaaacagtataacctcatctgagaaaggaaaatgtaaggatattcattaagttttcttctctccagatttgggattatttttaggaattctcaagagttttgttgacttaccaactaggtttcttgaagatggtgagtgaggataggaacttggcctggtttggctcacctctcagattcattggaagaggcaagttcattagcacagtttcagtccaccattacagcatttttttcctgaattattataagtcttagtcaatatttccagataatcatcattatctgtttaaattactgcacagtattctattttactgatgtaccattgtgcaaatactatgatgttttattatttttaagttttgctataacagataagtctgcagagattttattcagctctgtattgttttgcttctgttgcattgtttcctcagattgaatttctaggagtagaattgctatgtcaaagagaataacaagtatctctgagccttgccgcatactgcttttttcatttttaaaggttataccaagttagagtctcactagaactgaatgagtgtactaattttactgtagctagtttctttttttttaaaaaaaaaaaaagctgtagaataatctcaaggttgcttaaatatttctgtcttttattcttacagcatttcctgtggattagttcactacttattttcttatctgtgagttgtaagtgcttacacatgcccacttgatgaccttgatgttttcttacacatggaagcaagtgctttttgtaaaagaatatattaacctttatctttttacattttgtgaagctttttttttaatgtttcatcttttaaaaattaggtttattcagaattttaaattttaatattatattgaatttcttttggttggtttaaattgagaaagttattttatgtatattctctttttttgctagctttctgtaatttgattttaattccttattccttgcatagtttgcttctggtatgttaaagtgtgctctctctaagtgggtagtaattaggaacaatttatctcaacctcatttattgaatgttttaaatcaagagaacggactctgttatattaagcttctatatataattgtctgtttcactgtaatgcctagtaaggatacacttcattctttttttagatgttctttcacaatttcatgtaaattttagttgttttgtttcaaaaaacaattcctattgaacaatctctaggaatagatagcttaataataatattagatctagttttctcttttcatagtttacctcttctttcttttctttcttttttttttttttttgagacggagtctcgctgtgtcgcccaggctggagtgcagtggtgcgatctctgctcacagcaagctccgcctcccaggttcgcgccattctcctgcctcagcctcccaactagctgggactacaggtgccccccaccactcctggctaatttttttttttttttttttttttttttttttgtatttttagtagagacagggtttcattgtgttagccaggatggtctcaatctcctgacctcgtgatccgcccacctcggcctcccaaagtggattacaggcgtgagccaccgcgcccagcctctgtctctcttttctttttctttttcttttcttttcttttcttttcttttcttttcttttcttttcttttcttttctttcctttcctttcctttcctttcctttcctttcctttccttttcttttctttcttttcttttcttctctcttctcttctcttctcttctcttctctgtctttttttgacgagtctcagtatgtcacctaggctggagtacagttgcacaatgttggctcattgcaacctctgcctcccttgttcaagtgattgtcctgcctcagcctgccaaatagctgggactacaggtgcgcactgctacgcccggctaattttgtatttttagtagagatggggtttcaccatgttggccaagccggtctcaaactcctgacctcaagagatccacctgcctcggcctcccaaagtgctgggattacaagtatgagccacgatgccagtccaattcttgtgtagttttttaatcagctgaatttaacattcaaattcttcttttaaatcttccaataggcagttatctttataaagatcctatataatcaagactttgtttctgaatattttatgtatgtttttgctactgtaaatgagatctatttctcattgtggtttcttgctgttattactggtaagaatttagtgaaacaaagtacttaagagtatgtctttaaattgtgagattttgatgaacttttaagaaataaaattctttagtttcttagagctttttgagatttctaaggtagatccttggtttgggcaacatataactattacaagttttgcacattgaacgttatttggtaatttttagagaggacattttaaatgtttaggaaaaatataaataaaatgtagaatactattgggggcatatacatcatcagcactgtaactgtttcatatgaatcatttttgtacatatagaactctaaagtcctaatgaacagaattttacatttctataaatagaaagtccttaatagttgtgactgaataacttatggatagcaaattatttaactgaaaacagtaaaatttaagtgggaggaaatatttgctttataatttctgtctttacccattatttataggattttgtcactttgttctgtttgcaggtggaaaaccatgaattccttgtaaaaccttcatttgatcctaatctcagtgaattaagagaaataatgaatgacttggaaaagaagatgcagtcaacattaataagtgcagccagagatcttggtaagaatgggtcattggaggttggaataattcttttgtctatacactgtatagacaaaatattgatgccagaattattttataagttccctgtccccaagatgatgacttcacatctctgtcaaacagaaatcgcccaacaggcccttgtatgatgtcatttaaacaagccctattttaaatgtcacctccactggtaacaggatactcctaggaggatcaccaagcccaattcttctaggagtagtgcattgattaggctttggggtttccaagcagttcattaatgtcacttttggaaaaagtctgtctttcataccagcttattaattccctatgggttcacacggttttttttcctggattttcatcaaacatgtgtaaggtactcagtacaaagaagtttagaaatccagaacaaagcagtgtatttaagtagtagtaaacttccagataatctgatgcccatatctacatatataaaaaatttgcaaatagttctgtagagagtccaaacatggagtagatccctaattaagagcctttgcattaaagtccaccttcctcatttcatagctaaggatattgaggctcagagagtttatgtgtctggagttaaagttattttgtgtttccttaatttttgacttactagaaagttaaagtacctacagatttctgtgtttcactatatgttaacttgcttggctggaagtttttctgctgataattggttttatgaaggaagaatcctgttaagaatgcatcattggactgggtgtggtggctcacgcctgtagtgatcctagcagtttgagagaccgaggtgggcagattgcttgagtccaggagtttgacactaacctgggcaacatgatgaaaccctgtctctacaacaaatacaaaaattggccatacatggtggcacgcacctgtggtcccagctactcaggaggctgaggtgagaggatcacttgagccagggaggttgaggctataatgagccataattgcactactgcactccagcctgggtgacagggtgagatcctgtctcaaaataagaaaagagaatgcatcattggccaggcacagtgactcatgcctataatcccaatactttaggaggatcacttcagcccaggagttcaagactagcctgtgccacatagaccacatttctaccaaaaatcaaaaggaaaaaacttgctgggtgtggtgatgcacacctgtggtcccagctactcgggaggctgaggtgagaggattgctttagcttaggtggttgaggctgcagtgagccatgatagcaccactgcattccatccagcctgagggacggagtgagagcgacaccttgtctttaaaaaaaaaaacagaggaatgcatcatagtatatattaaattattgcctatttttttatctattttattgagtgctaataagaaaattaatggcaaaaacttgttttttacagtataaattaagtttaatttcattttaaaattaagtaaatttgttttattaaaaagtatgttgaaagcaacataaatagcactcaaattgagacagaaactgtaactgtagtataagaagcattaggctgggaattgggaaacacgagttctagttgcagcttggaaactttttctgaagctctttacaaattacttaatttctctggttttcaccacattgttctatagcattaacatgttggattcattgctttaattcttagacctacgtgtcatcagaaatgccattacactttgaggatttgagccttattttaaataaagttgtgatcctcatggcagcctaggtttacatgtgttaaataaacagtattctgtaaataccattgtctttcatgtttagtgatgttgctgttgttaacactgcagtgaaatgcatatataagcaaactacattacatactcatgaacatggtcctttgttttgaaactttgatcactgattgttcgcagtctttcattgtggaactactctttcactttgaatgttttgagaggttcctttgttcagatcagtccgatttcgtttctgggtgggtctctactttcccttttctcactggtcaagcgaggtctgtctaattgtttgctactactaacatttgatggccacgcttcagcaagtacatttgtagattctctctctctgtctctcttaatttgtggtctagagatcatattggttaatgaaattatgaagagggaatgtatttataaaaactcaaattcttgatgcagaaggtctagctgattgtgaacccaaaatatccgagacaggtcacaaccaatttagaaactttattttgccaaggttaaggatgcatccatgacatagtctcacaaggttctaatgacacatgcgcaaggtggttagggtacagcttggttttatacattttagggagacatgagacatcagtcaacatgtgtaagatgtacattgattctatccagaaaggcaggacaacttgaagcaaggggctttcaggtaataagtagataagagacaaaaggttgcatacttttgagtccttgatcagcctttcactgaataaacaagcttagtcttgttagtgaatctgcgtttttacataaacagtaggtcagaggaagcaatcagaaatgcatttgtgtcaggtgagccgagggatgactttctgtccctcacctgtgaagataagctatcagtttccattgctagggtgaaattcaacagaattgtttgagagtgaacatctggaggcccacaaggactttccttgtggaggggaagtatgtagtgagggaagtatgtagtttttaaatctttgtcgctatcttatttagaaataagatggaaggcaggtttgtctgacatagttcccagcttgacttttccctcggcttagtgattttgcggttccgagatttattttcctttcacatatcagtcagatcatttggtttgtgaagtttcctatgcttaacagaaaatatgtgcactagttttcctagagtttcattgtcagagtctcaagtttttgtttggaaattgtatttggtcacattaattatactctatgttagttccaaagaaatacctttggttaagaaaagaattctcatgcataactcctcgagggtggggttacaccttaatccatcctcaggtgctcatggtaattggggcaaatatgttgcccagtgctggtgctctgcagccttggatgggtttacccagaaagcagctttcaagtcagaaactaacattcataagggagttaaggattttataaatagatatccataattcatgtagttttcaagtaagtagtatttgaatcttttctggttagataataattgtgagtatgttgtcatataataacagtatgtttttcactatttaaataattttagaattacattgaaaaatggtagtaggtatttatggaatactttttcttttcttcttgattatcaaggcttggaccctggcaaacagattaaactggattccagtgcacagtttggatattactttcgtgtaacctgtaaggaagaaaaagtccttcgtaacaataaaaactttagtactgtagatatccagaagaatggtgttaaatttaccaacaggtttgcaagtcgttattatatttttaaccctttattaattccctaaatgctctaacatgatgtgaatgttctatgataagttttactaatgtagtcatcaggtaagagtcaagctttcttccatagagcagtcagctgtcgcaacaccatttgttaaatagtccgtctgttctccattgactgaagtggtactttgggtctattttaaagactctacttttacctcgtctcaccattcttttgtctacacaaaatatattttatcgcttattctgtgttaccatatctattagagctagttccccctcatatctctgctttagttattttcacatgtttcttttatcttttttttttttggagatggagtctcgctctgttgcccaggctggagtgcagtggcatgatctcggctcactgcaagctccgccttccgggttcacgccattctcctgcctcagcctcccgagtagctgggactacaggcgcccgccactgcgcccagctaattttttgtatttttagtagagacggggtttcaccgtggtctcgatctcctgacctcgtgatccgcctgcctctgcctcccaaagtactgggattacaggtgtgagccaccgcgcccagccttatcttttttttttttccccctgagacagagtcttgctgtgtcgcccaggctggagtgcagtgacgcgcagtcttgactcactgcagcctccacctcccggattcaagcgattctcatgcttcagcttcctgagtagctaggattataggcatgcaccaccacgcctagttcatttttgtatttttagtagagatgggttttcaccatgttggacaggctggtctcggactcctggcctcaagtgatccacctgcctcagcttcccaaagtgctgagattacaggtgtgagccaccgtgcctgacccacatgtttattttttctaagaaaactttactatcatttatcaagttaagaaaattattctgatatttcaattgggtgtttaaattagttgagggaaatatgaggccattcactagatgataggttttttttgttttaatcatgtttcatgttgaaacaaaaaagttttttcctgccagttttctggctaatctcaggaagtccctgaaacaaattattgataagtaaaaaaaattatttaaaaaattttaaattatatttaaaatcttctgtgacttatggtggggggaggctaaagcctttctccttctgtactgttctggaaactatggcctgttctactccctcccctcctgaattttcccagaactttacaggtagcttttatatatatgatcccctgtcgtctgtttaacaagtactttgagtgtctattatatgcagacattctaggtgttcagacaccctagtaattagtttgttcctcataattctcagtaaagaagacatgtatatttctcattttataggtgaagaagctaagactttacttttcctcagttagacagctagtgctggtgggtgcctaaacttagatcttccattgccaaatctaggtgtgttgtttttccagcacactagaatcctcctggttcaagaaatgtatatattttagcttggataagatacaacttttggagtgttctaatcatcttcaagtttttcgtggattagttataacatatgaaaaaagatagggctgaatgggccacatgatgccaaaagtgaaaaagtcactcactagattatgacctgcagaatctggtccttgcctgcctctgcttttatattttgcagcttgtcccttcacacagtggtctcacttttataatgtctttccctcatgcatttctttaattctttttatttgcctgttccatagtagtctgtttgtgctgctacttgcccctgtactgttcttgagctatacatatacatgtctgctgtgccattgagtgattccatcaaggccacaattatcatcttgatgaactgattttctcccactgctgataattacttctctctcctttctttctcctttacatcacctctttttgttcttaatttcattccctccttgatgccagtgagtatttttttcttattttattctcatcttccttgagtattgtttatttcaacctctttttttttttttttttttggagaagggtttggctttgtcgctcaggctggagtgcagtggcacaattttggcccactgcaacctccacctcctgggctcaagccatcccacctcagccacccaagtagctgggactacaggtgttgcccactgctttgtatttttaatagacacaggatttccccatgttgctcaggctggtctcgaactcctgggctcaagcagtccacctgccttgccctcccaaagttctgggattacaggattacagatgctgtgcccggcccaacctctaattttaattttctcttcaaattgttcaataagatttagtttcaagacattttcctggccgggcatggtggcttacgcctataatttcaacactttgggaggccgaggcaggtggatcacttgaggtcaagagttcaagaccagcctggccagcgtggtgaaaccccatctctactaaaaaatacaaaaattagccgggtgtggtggtacatgcctgtaatcgtagctattgtggaggccgaggcatgagaatcgcttgagcccgggaagcagaggttgcagtgagttgagatgacaccactgaaatccagcccgggcaacagagtcagactacgtctcaaaaaaaacaaaacaagctgggcgccgtggctcacgcctgtaatcccagcactttgggaggccgaggccggtggatcacgaggtcaggagatcgagaccatcctggctaacacggtggtgaaaccctacctctagtaaaaatataaaacattagccgggcgtagtggttggtgcctgtagtcccagctactcaggaggctgaggcaggagaatggtgtgaagccgggaggcagaggttgcagtgagcctagatcgcgccactgcactttagcctgggtgacagaacaagactccgtctcaaaaaaaaaaccatttttcttattttgaaaacttttggtattgaaagatatttatactacagtaatgagaaatactgtgtgtgtgtatatatgtttgtgtttttttttttgtttttttctttctctctctctcttttttttttttttgacagagttttgctcctgttgtccaggctggagtgcagtggtgctatctcgactcaccacaacctctgcctcccgggttcaagtgattctcctccctcagcctcccgaatagctgggattacaggaatgtgccaccacacctaactttgtatttttagtagagacgggttttccccatgttggtcaggctggtcttgaactcctgacctcaggtgatccacctgcctcggcctcccaaagtgctgggattacaggcaccctgcctgtgtttgtgttttaaaaggggtaatagcttcagtcttttttttctttctctgagacggagttttagttttgttgcccaggctggaatgcaatggtgtgttcttggctcaccacaacctccatttcctgggttcaagcgattctcctgcctcagcctcctgagaagctgggattacaagcacgcgccaccatgctgggctaatttttgtatttttagtagagacggggtttctccatgttggtcaggctggtctcgaactcctgacctcaggcaatccaccgacctcaggtgatccacccgcctcagcctcccaaagttctggggttacaggcgtgagccaccacgcccggctgtcttcaatcttaaataaggattccatttaaatattttgtaaaaggacacagatcacagttttactcaggggaatataattgttatagcaggaattgtgccattgcgctattccaaacagtgtaaaagaacattaataaattgaattctaactacatttgtccctaaggagttgttcgttttccacttgtatttccattttaattatcattatttggatgtttcataggatactttggatatgtttcacgtagtacacattgcttctagtacacattttaatatttttaataaaactgttatttcgatttgcagcaaattgacttctttaaatgaagagtataccaaaaataaaacagaatatgaagaagcccaggatgccattgttaaagaaattgtcaatatttcttcaggtaaacttaatagaactaataatgttctgaatgtcacctggcttttggtaacagaagaaaaatcatgatatttgaagtgtgttttgttattttcgcaagccattacattctgactatttaatatgttaggtttcctatataaaataaggcatggtatgttacagtaggacacataactggaagttactcttgcacatagaaacaaaaaatggcagaaaagcacaaaacttactatagttgtaacagggaaaggaaacactagggcctacaacgtactaatgtcttgggtcatctatgggctcatgaggctctaggttatggaagtaaataccactgaaaagcaaatattaattacacatgaggcaagcctttttgagttctgtatgtcattttgtagattttgagttcattctagtggcaccatttgagatcattttcatgtaattaaaggaacacagcaacctggcactgtgttattgcccttagaatggaatgaatatatgtttagcacaaggtaggaagtgatgcgttaagttggaaggctttgccgatcatggtgtgtatgttgactaacctttattgtgcctttaaaaaatatactcaagaactaccttaaccaagtaattaaagtcaagattaccagttgtgggacaaatgacatgtacttcctggtgtgatatagaaggaaggacacagtatcacctatatagtattcttgaccagaatatttaacctgattttaaacaagaagtaaaaattcaaataaatttagattgtggtgcattcaaggcctgaactttaataaatgtccatgtcacggcagcaaaaaagaaatcaacaggtcttaaagagacagggcaaccaaacgcagtaggcagtagttgattagatcccaatttagaggttggagttggggaatagctatagaggacactattggggcgaattgagaaagtttaatatgagacaatatggtgttagtgtcagatttcttgtgtgaaatggtagtgttatgattaggagaatgtccttgttctcaggatatgcatgctaaattatttaaggacaaatatttttttaaaaggttatgtgcatgagtaattctataaattgtgttgctattatgaattgtcatggtaaatcaaaaggaaacataaaactcaaaaggttttattttaatacactttatgtattgaaatgaatggaattgatttgtaaagattacatttttgcttgttggtgtcagataactgtgacgtaataatcttttgctgaattatgtttcttaggctagatttcattttaaagaaccctgtaaataccatttatttgaactgtggatcttccttaaaaaataatatttattaagcacctagcagggtaaagtttttagattttaacatttaaattgaaggttttatattagaagtcaacctgaatttaaatgaaacttcttcttggtctgatattacatattatgagctatttttatttaaaaatgtaatggcggccagacatggtgattcacacctgtaatcccagcactttgggaggctgagctgggaggattgcttaagcccagaagtttgagaccagcctagccaacatagggggaccccaactctacaaaaaaatccaaaaaatattagccggctgtggtggtacatgcctgtagtcccagctactcaggaggctgaggcaggagaatcacttgaacccaggaggtcgagggtgtggtgagccataattatgctactgtacttcagcctgggcgacagagcaagactcccatctcaaaaagtgtaatggatcactttaataattttctatcatacaattaagtcataaaaggtcatgctattaagagccagttatgtgacatgccaagtatagactcttaattaagatgctttggtttgctttttatttatttatttatttttcagatggggtcttaccatgttgcccaggctttagtgcagtgatgcgatcatgactcactgcagcctcaacctcctaggttcaagggattctccccacttagcctcccaagtagcttgggactactacatgtagtagtgccaccacacctggttaatttttttttaattatcttttgtggagatgaagtctcactctgttgcccaggccagactcaagcagtcttcctgccttggcctccgaaagtgttgggattacaggcgtgagccaccctgcccagcctagttttcttttttttactataaacttattcttgtcagtatgctagcaattttacaagttttaaagtagttatagcaagtacttcactcatgtttaattcttaaaggcttctattgctatataatagggtagtctgaattcttcaaaagtgtactgaggccaggtgcagtagctcacacctataatcccagcattttgggaggccgaggcgggtggatcacctgaggtcaggagttcgaaactggcctaaccaacatgttgaaaccctgtctttactaaaagtacaaaaattagctgggtatggtggcaggtgcctgtaatcccagctactcaggaggctgaggcaggagaatcgcttgaacccaggaggcggaggttgcagtgagccaagatcacaccattgcactccagcctgggcgacagagcaagactctgtctccaaaaaaaaaaaaaaaaaaaaaaaaaaaaagtatactgaaacagaggaagataattaggtctgcttggccattgttaagttgatttttattttcaaaacatttgatcactgttgtggggaacaagggaataaaaaataagttaaatttccagcccctagattaaactaataatttttggttttcctagaattaaatgcttttatcttgaatgttctgtgaagcttttgacatgattgatagctgtatgatagtctgaatgacatgtgggtcatgcaccagcccctccaacctgttaacatttagaatctattcagaaaaatttaagcattgttaatttcctttgttttttgtctagcatgtgtcagatttttttaaatgtatttattaatagcttttaatgttaatactctagaacagtagaatcttgaaaatgttttaagtgacaattagagatttaaatttatgctgacatcctctgcatgtgatactgatgaggaaagaaagccaaactgtcttacggtcagttcgtacaatataccaggccttgatggtcacatttcaacttgctacctttttgcttacatttttcttatggtgattttgaggtgtcattctggtttctcagatacttaaaatataggaaaaggtgtgtcttaaaattgagagaatgtcttggataagcagctgtgtagttttatattttgctgataagggaaggtactctatttttgttttttgtgtgtttttgtttgtttgtttttgagacagaattgcccaggctggagtgctgtggcgcaatctcagcttactgcaacttccaccttctgggttcatgcaattctggtgcctcagcctcccaagtatctgggtttacagacatgcaccaccatacctggctaatttttgtatttttggtagagatggggtttcgccgtgttaccaggctggtcttgaattcctggccccatgtgatcccccggcctcatgcgatctgcccgcctcagcctccctaagtgctgggattataggcgtgagccacccaacccagccagtactctgtttttgatagctattcacaatgggaaaggatgtagcaacacattttaaccctatgttgagttttaggtgggttcctttgaaattttgttaaggctaacttttgttaatttttttaaaaaagtgtaaattaggaaatgggttttgaattcccaaatggggggattaaatgtatttttacggcttatatctgtttattattcagtattcctgtgtacattttctgtttttatttttatacaggctatgtagaaccaatgcagacactcaatgatgtgttagctcagctagatgctgttgtcagctttgctcacgtgtcaaatggagcacctgttccatatgtacgaccagccattttggagaaaggacaaggaagaattatattaaaagcatccaggcatgcttgtgttgaagttcaagatgaaattgcatttattcctaatgacgtatactttgaaaaagataaacagatgttccacatcattactggtaaaaaacctggtttttgggctttgtgggggtaacgttttgtttttttttttttttttttaatcttggagtagaaatatatttaaaattgatggagaaaattcccagttcttaacattagaaagggaatatattattcttaccagttagtaatctattcacatttggtttagagggaagatttagaaggtgagataaaagcttgtgagagaatagtgtattcatgtgaaacttcttccatgggttcagagcatttagaaacaaacatcccttcacactcaaagcttacctttgagccagtcctccaatagtgaggtctttgaaggtcaggccaaattggctgtgggaggacctcaggttaggataggaattattttaagacatggcactatattcatgtgaaactcgcaaaaactagccttgcatataggctcatgtatcatgtctcagctgagatgtttgagagatcttaactagattctagaaaacaaaaaaggaagtagttttggggcaaatatatttgggaaacagtttattgtatttcctttccccaaatggattttcaagttcttcatataatctaaccccaacaaataaattgcctgtttttcaaaagaaagatcatgtcttcaggtttttgtgtggggtttaaatgattcgaaagatttgaccatactgatacattcactagtaaccttagttactaatgagtaatggttttgagttaatcagttaggcctgaactacttttctggaagttagtaaattatctcacaggcagccctgtgagccatgggaaaatgtgtatatggtctttctaggccacagtcaaattacaggtatatttgtcatggcttctcttgatgaaaggcccagtatcggtttgtctgaagatatataatagcattgcttttgggggtaatatgggcagtaactctgtccacatctttgggcaggctgtggttctgcctttatatgctatgtcagtgtaaacctacgcgattaatcatcagtgtacagtttaggactaacaatccatttattagtagcagaaagaagtttaaaatcttgctttctgatataatttgttttgtaggccccaatatgggaggtaaatcaacatatattcgacaaactggggtgatagtactcatggcccaaattgggtgttttgtgccatgtgagtcagcagaagtgtccattgtggactgcatcttagcccgagtaggggctggtgacagtcaattgaaaggagtctccacgttcatggctgaaatgttggaaactgcttctatcctcaggtaagtgcatctcctagtcccttgaagatagaaatgtatgtctctgtcctgtgagaaggaaaagtatatttgcagattctcatgtaaaaacatctgagaatgtttgtcttagtttaatagttgttttcctgtggactttatatactttgtattgtcttaaaagagtgattgatggtagctacggaaaactttgatttttaaaattgtctctttaagtagacaatttataagctactggtacgagttcaccttataaatctccactaccatgtttttgcttggactgttcacacttcctggaatggtccttcttgccgtttatccaacttctttctaatttttaagtccctaatgatgggaattctatttctgtagtgatttttctggtcatacgaccgtaaggtcatgggtgtttttctctgaattcctcttgagatgcctgtaacttgaaccacgtttttattctagacattactgaaatgttttgtctttatttcactttttaggagcttccttgaaggtagggactataccttctatttcttggtatctttttctttctttttttaaaagttttttagagagacagggtctcactcttttgcccagactggtctcgaactcctgggctcaggtgatcttcctgccttggcttcccagagtgctgggattacaggcatgaaccaccgtgatcctccttatttcttagtatcttctaaagaacattaaatatagtaggtgcctagtaaattatgtattgatttaacttctttgaggttctgttgtttgtgaagaattataaaagcaatacaaatgtttgtatagtaattaagcaacaggttaatattcatgacttaaaagattaaagaaataagcaaaacatgttagctggcaactcacagaaaaagaattaaattgccaatgagcacacgagcacatgaaaaattagcaaaagtttcacccctttacatatatttggttaaaattgagaaaagaatagtaatagatggtattggtaggactgtggcaggcacacaatttacatgaccaccaaaagtgtatgcaggtatccatgtcaccacaccctggtctcatcttcattcagttttatttattttttttaatctcggcctatttgattggcacgaaatgaatgatagctgccttatttggaattcctttgattactactagtgtgcttgataatgtaaaacaatattcaaaatctgtttttcctttcatccgttgtttgttcatgttcatgacctttttttttttttcctattctcctccctccctccctccctccctcccttccttccttccctccttccctccttccctccctccctcccacacaaaggtgtgtgctaccatacctggctagtttttaatttttttttttttttttttttttagaggcaaggtctcactatgttgctcaggctggtctgggctcaagtgatcctcccacctccgccttccaaagtgctgggattacagacgtgagccatcatgcctggcccttgcccatttttctattgaagttttagtgctttttattgactttgtttatatattaagataatccattatgtttgtggcatatccttcccaatgtattgtcttaattttgtttttgtatgtgtatgttaccacattttatgtgatgggaaatttcatgtaattatgtgcttcaggtctgcaaccaaagattcattaataatcatagatgaattgggaagaggaacttctacctacgatggatttgggttagcatgggctatatcagaatacattgcaacaaagattggtgctttttgcatgtttgcaacccattttcatgaacttactgccttggccaatcagataccaactgttaataatctacatgtcacagcactcaccactgaagagaccttaactatgctttatcaggtgaagaaaggtatgtactattggagtactctaaattcagaacttggtaatgggaaacttactacccttgaaatcatcagtaattgccttattctaagttagtataaattattgatgttgttatagaacccatttaccccttaattcacagtctgggggtaggaacatgtacatcatatttctgtatctcatagtaggaccactcattctaaagcattcacagaaagaattatctgtactctttttgggacagaatctcgttctgttgcccaggctggagtgcgatctcggctcactgcaacctccgcctcccgggttcaagcgattctcctgcctcagcttcccgagtagctgggattacaggcgcctgccaccacacctggctaatttttatatttttagtagagacggggtttcaccatgctggccaggctggtctcgaattcctgacctcaggcaatccacccgtctcggcctcccaaagtgctgggattacaggtgtgagccaccacgcccggccagaattatctgtactcttgaacatcaccatggaggcattttctgctacctcccatggcagtatgttttcttgttgaattaggataacaaacaatatgctttcaagttccaaagttctagctgttattgtttaacaaaatcttcattataattagcttattttgtgtttaagagtgtgttatagaaacaggttcatttaaagctgggggttccagaaatcttgaaatagtagttatcacatgcagagtgacttatctgttgttgtttcatcctttcaggaaagtttgtcattcgtgggcttgggatctagtcagatccctgtattgatgagattcacatgttataaggctttcaaaggttttaaaaatcatactataaggattgatttcactagtcaccagaataactttttcagatagcgctctgattttccacgaacacgtttttctgcatcagttggttgcacatgagtgagataatcttggttctttatcctttgttatttgtacttcattgggaatccttttgagttagtatatttgagtcattattattattgctgtagaattcaggaacttttagtagatctggcagcataaaattttgcttttaaatcattgtttgtgttttgtatgctatagaaatgggttcagaatattttttaaaaggccagatgaagtgtgaagatagaaaaacttcatccttcactgtgaatgtttaacaaacatttgcttctactttatttttgtttgcttcctttagttgtgcaaagtattcagttctagaatgcatgagatatatgacaaagccaaaaaattctttatagttgataaataattgtggcaaaaacagctgtatagtaactttgcaagcatcatttgattaaatgcttaaaaagtcttgactcagttttaactatttcctgcaaataatcaatatttaattaaagctactccaaattagtgacactttacgtgtctgtctttctccctccccttctcccttctcccttcccccttctcccattctcccattctcccttctctcttcttcctttcctcttcccttcccttcccctttcccttcccccttccctcttctcttcccctcccccttcccatcccccatcccttcccttcccccatccctttcctttccccttcccttccctcctcttcctccttcccttcccccttcctccttcccttcccccttcctccttccctttcctcttccctttccccttcccttcccccttcccttccctcttcccttccccttcccctttcccctccccctctcctcccctcccttaccttcccatgaaatgagaaagcctcagagatagtggcttgattaatttttctttagattaagatatttgtctaagcctttaaggtttatctattgagcttttttgtctcctatttttatttttcctactatgtttgtcgaggataaaatacagcactgtgtgccaagtcataatcacttttcatttgagacttaattaaaatgcctttattttaatgatatatttggctaatgtatttgaagtaatccgaaattaagttttctaatgacaaggtgagaaggataaattccatttacataaattgctgtctcttctcatgctgtcccctcacgcttccccaaatttcttataggtgtctgtgatcaaagttttgggattcatgttgcagagcttgctaatttccctaagcatgtaatagagtgtgctaaacagaaagccctggaacttgaggagtttcagtatattggagaatcgcaaggatatgatatcatggaaccagcagcaaagaagtgctatctggaaagagaggtttgtcagtttgttttcatagtttaacttagcttctctattattacataaacaggacactaagatgaaggttttttgttgttgtttgttttcctctgtgtttctagtgcttattttttaatcagtttttttgatggcaaagaatctatctctgtgttattttgatttctgcagtatatacatctgcatgatcaatattcgatttcaagtaccaaagtaggagtaaaggaatattaacctaggtttaaaattagtcatttcactaaaattagttattatggacgatagatgtctaggtatatctttgttcataaacgaatatatcaagttcagttattaaattacacattaggtaagaaaaggacaaagaaataaaaaagcatgattcataattcctgccctctatttgtctagaatttagttgggaagataagaataacgaacgtgacacagagaataaagtggcatatgacaaatatttattcaagaaagctatatgtggacgggatgtttcagttctcatgggagaagtggattttatggtgcctttgagtaatgggtcatatttgggcgttcacacagaaagacccaagcatatgcctaattttttattattattattttttatttatttatttattttttagacggagtctcgctctgtcgcccaggctggagagcaggggcgcgcgatctcggctcactgcaaactctgcctcctgggttcacaccattctcctgcctcaggctcccgagcagctgggactacaggcgcctgccaccacgcccggctaaattttttgtattttttagtagagatggggtttcaccgtgttagccaggatggtctcgatctcctgacctcatgatctgcctgccttggcctcccaaagtgccgggattacaggagtgggccactgtgcccggcccttttttttttttttttttttaaattagaggattactagttctcttcaattataaaaataaaagaatcttatttcactgcctggtcctggaaacatgtactgcaatatacattgtgacaactttttacctgtcatgtttttagcttttacctgtgaatgtcttatcattgttcttatctgaaggatagatagttgctacaataataatagatggtgtgtatggtttttgagcctaaaaagtgtagttttatctgttgtacctatacaagcaggagaaatataacttgttaataattttaggtatggcaggctgccatcctaaatatgaagtggtctttgtatttgcactttaatgtgttgaaatcatagctttcagtgatccaggattaggcagactcttttatgcaatctcttgtttccagttagaatagaagtcgtgtacttttgataacattaattataatatattttgagccctgtgaggttggtaacattattcccattttatgaatgaggaatgtgtgttaaggagtttgcccaagagtcacatagcaagtcatagtcatgctctctgaagcagcaataacttggcaataaaataaaaatgaagcatcttctgtatgtgttaacttttcagtgactgtttatgccttccagtattctttgtaaaccttgaattctttttttcacagatgattaaagtttatcaattgtaaaggtggaggaatttgggaactagacagtgcacacataaataataaatatgttcttcaaatattgggtgggctaatgtgggaggagtttgagaccagcctgggcaacatagtgagaccctcgtctctaaaaatatgaaaaataaaaaaaaaattttttaaatgtgtgatatgtttagatggaaatgaaacaatttgtcactgtctaacatgacttttagaaaagatattttaattactaatgggacattcacatgtgtttcagcaaggtgaaaaaattattcaggagttcctgtccaaggtgaaacaaatgccctttactgaaatgtcagaagaaaacatcacaataaagttaaaacagctaaaagctgaagtaatagcaaagaataatagctttgtaaatgaaatcatttcacgaataaaagttactacgtgaaaaatcccagtaatggaatgaaggtaatattgataagctattgtctgtaatagttttatattgttttatattaaccctttttccatagtgttaactgtcagtgcccatgggctatcaacttaataagatatttagtaatattttactttgaggacattttcaaagatttttattttgaaaaatgagagctgtaactgaggactgtttgcaattgacataggcaataataagtgatgtgctgaattttataaataaaatcatgtagtttgtggaatttgagatgcattgtagttcttcgcagtgtgacttcaaatattttggaagaaacaaatagctcagagacctcgtaaaatatcttaaactggagggctccatggagatcattgcgagtgactcccccagaatgtccatctgttgacaggagccaggctggctgcatacgaattagctaaggagcttattatatatccagagtcctaccgtgagcctccatcccgtctgccattctcccatccctggtctatgataagacttagaaatctggattttaacaaaacgtttcagattgagaaccttgatttagtctacttctcctattttacaataaagagatgaagcggttaagaattagctaatcctacgcaaagtgagggaaaaaggacagtctttttaataaatgcggcgggctggtggggtatccatataggaagaaatgacattggacccctactccatgtcatatataaaaacctccactttgggaggcgaagcaggcaatcacttgaactcaggagatcaagaccagcctggacaacatgacgaaaccccatctctacaaaaataaatgcaaaaattagccgggcatagtggtgcttgcctgtagtcccagctactcaggaggctgaggtgggaggatcacgtgatctgggagaggttgaggttacagtgagctgcactccatcctgggtaatacagtgataactgtgtctcaaacaaaacaaaacaaatcaccttcagtgatttttagaccaaatgtacaaggtaatactctcaaggttttaatgttttatagttctgcagaagataacataggaaaatatttttatgtccttggctttgggaagaatttaagtcacagaaaaacaccatccataaagtttgacttatttagctatttgaaattaacaacttctattaaaaggcaccacaagtgaaaagacatgaatcgtaatggaagaacatactggtacgttataaaatatcaaagagttgggcatggtgtcccatgcttgtagtcccagctactcaggaggctgaggcaggaggatcacttgagcccagcagttcaagtctcagcagttcaagtccagcctgggcaatatagcaagactgcatttcttttcttcttcttttttaatacctggaataaagaactcctataaaatcactaagaaaaggggtcacttaagaatctcattaacaaaaagaatttgaatatttttccaaggaagatatgcaaatggactgtaagcacatgaaaagatgcagatcagggaaatgcaagtcaaaaccacaatgagctacaacttcacactgattacgatagttaaaatcaaaaagtcagatggtaagtactggcaaggaagtggagaaattgaaactgtcatgcgctcttggtgcgaatgtaaaatggtgcagctgctttggaaaacagtctggcagttcctcagacaattccactccaacgtatatccaagtggaatcacaacatatgtccccacaaacttgtacataaatgtttatagcaggattattcataatagccaaaaggtggaaacaacccgaatgtccatcagcagatgaatgcataaatgaaacgtggtctatccatacaatggagtatattattgagccattaaaggaatgaagtactggtacatggtgcagcttagatgaaccttggaaacattgtgctaaatgaaagaagctggttacaagagtcaacacgtatgatttcattcatgtgaaagttcagaatagagacagcagtagagacaaagtagcagttcagggttggtgccagggaatagggggtaggtggggtgaaagctaaaggatacggtgtttctttgtgagatggaaattctaaaataggtgatgtttatacatgtctgtgaatatactaaaaaccattgaattgtacacattaaatggatgaattgtataggaattatattttaataaagctatttaaaaaaatccagacacttcacccaagaggaaatctaagtggtccataaacatgaaaaggtctttaatcaccagtcagaaaaatgaaaatgaaaaccatgccaggccacctcccaccaccatagtgacaagcatttcaagtgtggcagttccagctgttgttgaggatgtggaataacactggtaggggtgttaagattatctggtgaaattgaaaagacgcatacgacccagcaattctgctcttaagtgcatactctggagatgcttttgcccattgtgctgcgagatgtatacaagaatgttcctaatacctccacactggaaacaactcatcagtgaaaatgaactacagctacacaaaatgacatagatggaatcttaaaacgtttagtaaaagaaatgatacaaaaggatacagtttttttttcatttatgtgaagtttaagaataggtggtattgtttagggatgcagtctttgggatggcaactgtaaagaaaaagtgattgtgttaatcagagtgattgtctttagggaaatggagtgctgatggggagggggcacattagggcttctggagggccacagttctggtttttaacctgagtggtggttttgcacgtgcttgctttatagttagctgcaatttttttttttaatgcagttaaagtttggtatgagaacaaatgtatgaccgatgagtcctttcagtttaccaagttctttttcgtcatcgttaatttagagtgggttacatcagtttttcttttctggctgccaaaggcttaggaaaaaggcaaactgacagaggaagattttaaatgtagaaatatttattggtttacaaatccttttaatcacttatacatgaaaagctttcatataattcaaaaagcaaattttaaattccaatgaaatagttcatcccgtggttgtgaaagagtgtttttagattgctgcacagaagcatgtttaacgtggaaatcagctcatggttttagttgttagggctacaagaaattgggggagacttcattccaagaaaacatgtagtctgtcaggctgttttcattcctctaaaagagacagttttctaagatgtttttgaaaatgagaaaatacgtaatagatctgcttaagaagtttcaaacttaatctgtgcttattacatgaatatgctaatgtaaaaccaggccttcagttagtgtttccttccttttagaatggtgtatgtaaagcaaaatataaactaatttctgacctgtcaaaggttttttcttaaaatttaaatttataatgtggtttggtttttctttcccactcaaacatgaatttgggtaataccagaataaagctggatatataaattttatccaaaatttagaactctgttgttaagaaatctgttgaccacataaccatgtttctgagaaaatacatgattttttgcatctttaaaaaaaattagcactaagaagctaagatgaagttgtttttgtaatttgatttttttttccttaaaatactgttttggagttaaaagttgtagcaaaactggtataagaaagatgttttaagatatatttaagtcttgtctcatactctattgactaagctagcccggtgactagggtagatgtatttaaagaataacttttcccccttaaaatctcaatattccacatcctgttagacttcttgagtattaaatacatcttctatccttggtctttctgcatttagcttttttgggaagtatgtttttacccaagcatatggtatgagctgctgattcagtattgagtggctctttaagcttgttagttacattctgctgattaaaatggtgtacagaatagtcaggaaaaaccagtccctggtctgaaataaacaatgttaattagcttatggggaagaacaaatgagtaaggagaattttcatatacaaaggaaatctctgattgtctttctggactcagtgtgtttgggttaaggagatagggtgcggctggagaaaatgatgaaaatgttcagaatgttacatgtatttttacactgaaactggaagtggaagcccagtgtgatagttttctgcccgatgttggcctgtcttcacacccacaccacttatcttgattgatagagctactacttcctcttatactgcttcagaagttaacctctgtggtgcagtgctaggatatcacagaggaaataatcccttgtagacagtgtcttgttgctgggagttatcagtgcctcctgttctctctaaggagggcaatgggaagccctttccttgcatttgctacagccgtttccttgacctccctggaagaacagtatttcatggtgtcagacaacattcagaacatgctcaaattaaatgtatgtcagtatgcatttgctttggtgtgtggtttgtccaaaccaaagtgcccatacatgtctctggtccagccatgtgggaaattcagcagtggggtgaaccatatggaaatggcaggtgttgggcagccttgactggactgccctggtcttacttctggatttggtgagtagaagatcacactgttgcttgctgccctgggttcacctcaaagagggaaagaagaattagcaacttaaatggttaaatttagaaacaagaaaaagttctgtcagtgggcagtttcttacgtctaacaaaaaaaacaacagcagtgaattcttttgtgttcagaattaaccagtaaacacaaccttagcaattaacctatcactatcacgattgtttatttcctggaattttgttgacagaattagtccaataaatgttatgaataataattttatgaatagagataggttaatgccaaattaagtataattgaatctgagacattaatgcaactgttttaaattcaaccactgacctgcaatttttatatgccttgtccatccagcaagatacattttgtccatttttttcatgtttaaaatttaatatttattgtcaattccagtgtgtttcattgctaaacatcaggctcagccaaagcaatcacgaaaatgactccacgttgaatctttaacatcacaatgtggattaacaatttggcaacatttggctgggcgcggtagctcacctataatcccagcactttgggaggccgaggcaggtggatcacgaggtcaggagatcgagaccatcctggctaacacggtgaaaacccgtctctactaaaaatacaaaaagccatgcatggtggcgggtgcctgtagtcccagctacttgggtggctgaggcaggagaatggcatgaacctgggaggtggagcttgcagtgagctgagatcgcgccactccagcctgggcaacaacaacaacaacaaaattggcaacattaaatactttgtcagtatctgaaaagtgcaaagtactgtgcttggctccccaaaggctcctcttaatcctgaaaggcaggtgcttttattatcttttatcttattatctacattttccagatgaggaaacgtaggtacagaggtttagtaacttgcccaggtcacatagccagtaagtggcagagctgggatttgaaccccagtaccctatctccagcgaatctgagatgtacatgtgataaatttaatctttctcaataaattattaagtgtcaaagcaagtggtatgggcaatgcaccaggattaagaaaaacagtgtgtggtaaagatgtaaaatatttctaattctgttgtgggctgtggcactcccgtggaaggcttgccacagacacagccagaggcatccacgtgggcccctgctgcacacctggtttgctgctaccaaggctgctctcccgaggcttgttcacacaaaggaaagtgagcagctaggaagctgcatatttgaaagttgactagtcaccaaatgctggcatccaaccaagtgattgcattgtaccctgtttggatgaaagattgtgtttaaatgaaaagagagatgatgagccagaagtgtggcaaatgagttaaaataaattgtcagcagtgtttgaagcaggttgctgagggctggtgtcctgaaatccggtcacttggaggatgtatatgttccatcaggggccggaaatgttttatccaagctttagggaataaccctggagattctcttcgttactctactgttaagtacgtgcttacggagtaaacttcgcatgactaaggtttacaggcctgaatgtgcaactgagttcaagtaagcagcaatgtggtgtattaggaagactgcttgacttgggttctaatccttgcttcaccacctagctgtgtgactttaaacatcactgtttttcctcctgccttccttctgtaacttaagggggttggattattagagttctcaaatgccataccttcaaggccaggtgcaggatgcagagaatagtgggttaaagtgaacacctcaatgtaaaatcattcaaaaatttaaaaacatcacggaccaaacaaatatgtctttaaatctgaatttggttaaaggtcacaagtttatgccctttggagtactctctgacattttcatgatgatatgaaaggatttttccatacatactcaaaaggcgctcacgcctctgttgcagtcagtctggccacttccaaatagccaccccatgttggtctccacttcttccctccctctttaagtgctatgttaataatctagcttataattctctaatcagcagtagagcactttgctactttattttttattgttaggggtgatcttagcagcccaagtatgctaagtcttagaaatattcatcagtgatgtttttccctgaagctcgtttggtgactgctaaactagaaccagaattggagaaaaacgaccctgtgaattccaagccaacaaagccggggaagaggcattgagcaacctgtggttgcctgagaaacaaaaggcaaggtggttggatgaaagcaacacttccaagccttttccagcttaacgaacataagtctaggttttggggagagcctatcttagtgagagtgaacaaataaagtaggctgtatctttcagaattgggtatgactcaaataactttttttttttttttttttttttttttttttgagacagtctcactctgttgcctaggctggagtgcagtggcatgatctcagctcactgcaacctccacctcctgggttcaagtgattctccggcctcagcctcccgactaactgggattataggcgcccaccagcacgcccagctaatttttgtagttttagtagagacagagctttaccatgttggccaggctggtctggaactcctgacctcaggtgatccacccccctgggcctcccaaagtgctgggattacaggcgtgagtcactgtgcctggcctcaaataactttcaagattgaataatagtagcttgaagcaagtctagagacgagccagctggaggacagggccagcaggaaggaggtatgcaaggaaaaacctgcaatgaatggacctactgtgtttgagggtactgagaggagtttggggttgaattaatacctacaaagcatccacaaagcaattgggaagaaagggtagggggactattaggcctagtcatatcaaacttttttttttttaaaaaagagtaaatgtcatgatagtatactgcccacctcaattgtaaaattttattttatttcgtttttagatggagtcttgcactgtcgcccgggctggagtgcaatggtgcgatctcggctcactgcaacctccgcctcctgggttcaagcaattctgctgcctcagcctcccaagtagctggcattgcaggcacccgccaccacgcctagctagtttttttgtgttttttgttttttttttttttttttttttttgagacggagtctcgctctgtcgcccaggctggagtgcagtggcgggatctcggctcactgcaagctccgcctcccgggttcacgccattctcctgcctcagcctcccaagtagctggcactacaggcgcccgccactacgcccggctaattttttgtatttttagtagagacggggtttcaccgttttagccgggatggtctcgatctcctgacctcgtgatctgcccgcctcggcctcccaaagtgctgggattacaggcgtgagctactacacccagccaattgtaaattttattcatttaaacaccaacaagtgatttaagaacaataataaaataactgtagctggtatgatggctcatgcctgtaattccagctactcaggaggctgaggtgagaattgatgaggccaggagttcaagaccagcctaggcaacatagtgagacccccccccacccccgtctctaaaaaaataattaaaaaaaaaataactgggcatggtggtagtcccagctacttgggaggctgaggtggggaggtttgcttgagcccaagagttaaggctacagtgagctgtgatcactgcactccagcctgggtgacagagcaagaccctgtttctaaaaaataaaaattatattgggatgatggaaaggtataaatctgctctttctgtaagatgatgtctaaaattggaaaataaatagtggtataagcatgttatttaaaaatttagaggtaagtgatagaggattgtgaaagtggctacctctgggacagtgaacagggcagcattgagaagggagctgccatttttcatcataagcctcatgatgatcctatttgattttttttaaagatttgtgttcataaaaatgaatattgaaagtgaatgcaggaaaaaaactgtctaaaagtatatttaaacagtgacattcactttgcacattgacaccttaagataaatccaatgcaatgtcatactcttaccccaaataagttgcattgtaatgtaaggtcattctcttggggagaatctaaactgacagaaaaatctgtcttaaggagtacctatgatcacaaagtacttcaagcaccctttaaattgtgattaaagataatttgttgtttagaaatatatatacctaggtctggggaggaatagaagggaaatggagagtgactgttaaggtttctttgagggatgatgaaaacgttctaaaattaagttgtgataattgcaaaactataaatatattagaaaccactgaattgcacatttaagtgggcaaactattacggcatatcaattatatcccagtaaagctgtttaaaaaatagtagcataaataagatgtaataatagccaacatttgttgggagccaatagcctgagtgaccagctcagcattcttgataaccacccccttctccctatctcctttactcaataaatatgaagggctctagaagctcagggcccttgttccctagaagcaaggagcccccgaccccttcttccaaacacactcttttgtctttgtctttattcccatgttcatcctcctttgttcagtccagcatggtctgtggcaaacattcaacaatctctaaggtagataatattatcccattttataaatgaaacgggcctagaggagctaaatgactttcttaagaccatcagacatgaatagattagaaattatttttctttcatgtaaaagaagtctggaggtaggctgtctagggctagtaaggtggctccacgattatgcagcagagaccctggaacctttgagttggtttctccactgtacatggcttctctcaaggtcacctcatggcccaagatgactgccagggcttcaaccaatgcatccacattttaggcagcaagaacgatgagagtgcaaagatgcttatcccacctttaaagaaacaaaagtacacagcttccacttgcatcttccatgggagaactgagtcacacatctatgctgttggagcctaggaaatggagtcttcactcccaaaactcattttgaaaagcattcgcgttttgtgaatggcaaggagtttccggtttggtgcttggtaaatgctttgagatgatgatgtctcttctgcccaccatcttcacagcctcacctagtctttcatatttatttccgctcaaagcttcatttggcctctggtcttccttctctttctctcacagcttttttggactctatcctgtaatcgcttttccactgaatccaactaaacactcagtaccttgtctgtctcgttcatcgtgctaggcacagtgctaggctctcaggaaacatgcatggagtgtaggttccttgggggatgtgaattatcaacacccttgagcatggctggaacgaatcgcccctcccgaggacagacaggtagagccagagtgcagggcagtctcccagctcgctggaggcagagctggcctggagcctggcctcctgaccctcaggtgcctcctctcaccctgagcttcccaaacaccgatttccaggcaaagcctcatcacacaacgatattaagtaaagtaaaataggaacggataataaatttttatgtatgcagaaattgtttctctcctcccctcctcttggggttgattaacttagctggaagtaatgaacctgaactgattttttgagcaccagatctaagtggtaattactgagttggtaccttgtttatagactttcagaagaccgtaatacttactaagagaatccttttctcctctactcccaccagtttctcccttggcatgagaaccgacaaaccagaacataaatgagctggaggagagagccctttcttttttttctaggagttgtgtcatatttctaaagggcagcactgtaagtactctgctcccttcagggaagaaattgtgcttccaggacccctcactgagagcaacgccagggaaagaatggccggctcaggacttccatcgcggtcattggccaaactccttccttctgagaatcttactgacagaggccccagggtcatctcatggggctttctgaggccagtactgctttcttctgactttcctcagtagacatctatggctcttttaatgacattctctctccaacctgcttggactccatccacatctttctttgggttcctccttctatgaaggagactcctgtttgtcctcaactggcctctcctggggttcaaaggcagcccttccttcgagtctctcgtgggttcgtgagcactctacctgcttgtttttgggtacttggtaagcccggcatcacaatctcccctggagctagtcccatggtgacacctgcccagattctgtggtcaccagaggtttcaggtgatggttcagagagggcaccgtttcccgggaggcttggggacttggcaattcatgggctttatattctcttgtatatcccacctgggccctggaagcccagtagctaagtgaggagaggcacaacctcctggcctgaagctgagttgcttctattccacctacaggttttcctctccctgttccctctcctggagcttccagatctctgccaccctgtccccctattcaccccagtgatacaggcagcccgagggctgagttctgtgacagcaccctcaccacttcaaatatgctgacatcggttcttcaggcctgggccactcactgagcaatttgatcttccatttatgcctctgcccagctgcgtcctgatcggtggctctggcctgctctcttcttgtcctggcttcagcccttgcgcctgcctctggccagccgagcttcaacagccagagcaccagctcctgcacaggtcgaggctcaagccgtggcagggccccttccccaagcagtcttcatctcatgtagctgtgacagtccttggatgatccgagctgggaggggcttcaaacaactgtatcaagttcaaacccttgatttaaatgtgaggaaaccaccgacccaaggccacacaggtagtgtgaggtggccattgccaggaaaggagggatgggcagttgtgtgccccatcctgagtgtctctggcagctggactggatgaccaccactaagccttccacaaactcaaatctgctttgacagtgaggagatacctgatgtcttgtttgttccccagtccctccctgtctttgctggttgctgctgctaccaatcacatggcccgttgtcctgcccacagaagtggaccaatgacccaagccatgtcatcagctttagattctgggaacgagaagctctccttcctccatgattattgagcttgtatgctgctatagccgtctgtgggcataccccacctctacctcttctcatctttgtgtaccctacccagccatcccggggagcctatcagcagtgggaaagaatgagatcaacatagacgaactattccatgttgatggggaaaggggcatggtggagcaaaagtgagctgagcacattattggagtccttgggctacgtcagggagtctctaggtcaccaagccaaccagttcctttttggcttaagctgctctcttattctcctacaccaactgggtatccaacaatgcaacccaatcctgacaataactatccggacggcataggttaagggcttggtcccacaagactgtccccacttcagacatcagctgcaaagaaggtgcccaggctacccacatttctgcccaactgactataaatttgggggttcccaccagccctcttcatgtttgataatttgctagaacaactcaccaaactcaggaaagcactttacttactattattggtttattataaaggctaaaactcaggaacagccaaatggaagagttgcatagggcaaggtatggggatgggagtaggggtggctcagaactaccatgtcttcttgggatgcattaccctcccagcaccttgacatgctcagcaacctgtaagctccctgaaactttgcttgggaattttttttttttttttttagattccattaagtaggcatgattgatgaaatcactggccattagtgattgaactcacactccagactaggtgtggtggctcccatgtgtaatcccagaactttgggaggctaaggcaggaggattgcttgaggtcaggagtttgagaccaggctagccaacatagcaagacccgatcttgacaaaaaagaaaaaaaattaaccagtcatggtgatgcaaacctgtggtctcagctacctgggaggcggaggtgggaggagccaaggaggttgttctctcttgagattggagggtggggctgaaaattccaaccctctacacacagggttagttctggctaccaaaccctgtcttgaagctatctagggtcacctcattagcataaactcaagtatagttgaaaggggctcattataagtaagaaaatacacttccatcattcaggaaattctcagggttttaggagctctgtgctaggaaatggagacaaacaccaaacaaattttatataccagaaatgctataagtgcagtttctgttgcctgtgaccaaagggtccctggatggttcaggcactgatggagccagaatgaaaacccatgacaaccaactcctaatgggcctcatgttctgtgaactactcagattccaaatgcatcaaagacaccactattgaaggcaagtctgattgttttgtgggctcttgcagaccataaatgtagccttgcacgcgtgggtttgatcgaagtgaggttctatcagtaacatgtgactatgcctctttcataggttgttgcttcaaagagaaaaataaccacttctgtgctgttctatgtgtacggcatccagcatgggtgctcaagtagaatgaaataaattcacccaagggtccctactctgcctctgcacctcagacctttaacctcatttgtagaaggagggtgacaatcgaatcgatgtaatttacctatctactaataatcagaactcttttgctttcaggtgagagaaatgcaacccataccaccttctaccctaagaaccatctgaggttaggggtgctgatcccaggcccagctgggttctaaaactggaggggggcatgcggcctcatcctccctcgcttcctctctcatcctgagtgtcatctttgtctttcggttccttcatgtggcaggggacgtggccactgaaagcaatagggtcagatccttacagtatcttctttttcttttcttttttttttttgagatggagtctcacactgtcacctgggctggagtgcagtggcacgatctcggctcactgcaacctccgcctcctgagttcacgtgattctcctgcctcagcctcccgagtagctgggattacaggcacacaccaccatgcccggctaattttttttttttttggggggacagagtcttgctctgtagcctcggctagagtgcagtggtgcgatcttggctcactgcaacttctgcctcccgggttcaaataattctcctgcctcagcctcctgagtagctgggattacaggcgcctgccaccatgcctggctaatttttgtacttttagtagagacggggtttcgccatgttggccaggatggtctcaaactcctgacctcaggtgatctgcccgccttggcctttcaaagtgctgggattacaggcatgagccactgcgcctggcccttacagtattttctcagagggaaagaaggcctctgtcttcaggggccaccttagatcccagaaggattctgacacctggaccagaggcagagaccgccagggcaactctacccgaaccaagaggaagtggggacagatactctcctttgaccaaaactttaatgaggctcgtctgagaccttcctgaccaggcccagcctatgtccttgcagaattcagtttgagcaagaatcctgccgagtcagggcagggaaacgcccccagccttggtatctgaccactgtctacatcttatcagcctgatctgccttcagcaagagtcctattgggttggtctaacaggattcccctctccccgatgttttctctcagttattttccattcactgacctccaccctgcttcatggctgcaagtccccacttgcccatgctgtagtcagaatcgagtgcaatctctccccacaactgcaagaccacactgcagtgcagcttgttcctctgaccatggctccccttgtgtagtctgccttactatccataacaagtgtcatgaataattttttctttaacaatacccccctccaggctgggcacggtggctcacacctgtaatcccagaactttgggagactgaggcaggaagatcacttgagcccaggagctcaagaacagcccaggcaacatagtgaaaccctctacaaaaaatgcaaaaattaatggggtgtggtggtgtgtacctgtagtcccagctactcgggaggctgaggtaggaggatcacctgagcccagaaatttgaggctgcagtgagctgtgatcatgccactgaactccagcctgggtgacaagagtgagaccctgtcccaaaacaaacaaaaacaataaaataaaatatccccctccaaaaaagtgaagggttgacagtctgaggaaaacagcttgtgtctgcacatatatatttttttttaggtagagtctcactctgttgcccaggctggagggcaatggcatgatcttggctcactgcaacctttgcctcctggttcaagtgattctcctgcctcagcttcccaagtagctggaactacggggtacatgccaccacacctggctaatttttgtatttttagtagagatgggatttcaccatgttggctaggctggtcttgaactcctgatctcaagtgatccacccatctcagcctcccaaagtgctggggttacaggtatgagccaccacactcagccatctgcacatttctttataggagacttgtgaggattctaggagagaaggcatgaggaaagctgagtacagtgtccagctcccagcaaatcctcaaccaatgtcagttgctgccacaatgatgacggcagtggtgatgaggaggggaggtgggatggggagttgggagttaatgtgccctgtgctttgatgagggcggccagcgtgtagcccagtggaactgcactccagcctgcaagctgctacatgccagggtgtgtgtggtttgtctgctcagaggggtgccttgttctacttcatgctaaggcactgcaggagctctcaatggtcctgggaaaaagaggatctccttgtactaaggtatgaagagctaagttcctttgctcatcaaaggccagaagtggggaaatgattttaatgtcttgtaagagattgccgaattggagcacaatttgcaactgatggtgtagtgaaatgagaaaggttttggaaaatcatttccaaggccccagaagctgctgagcctggatggctttctaagtgggaactgaaactggcccagttgtcctatagaactgatgtttactgtttttttgtttttatttttgtttttttttttttgatagactgtagaaatggagcctcctgctctgaaaggttgaaacttacatttgtcttatctgagttccttcctcaggaaactgaccctcaggcctggcagatgttattaggaactgaaacttaccagatcaccacatcagggcaatgagacaccagacccctcacgcatcatgattgcctaagcaaccatctgttgtttgaccaactcgttttccttacctctccctaattcctgttttcccacatgtagttacaattcttccctgccacatgaactcctaaattcagctggtccagctgatcaatttgagactgatctcccatctccttggctgcagcacccaaataaagccttcttccctagcaatgttccttgtctcagagatcagctttctgtgcggtgagcagcaggacctagactgaagccctggtgtttcggcaacagaatcagccgcaggcatcagaggcagtgggcacctaacaatattctgttgttttgagcttggggatccaggcagatcctttgcctcctgaactcggctgagggaggctctgctgagtgaggacggcaaacatctctcagaagggaactaaaatctattgcacacttggtttgtggtctacactctgcatggatgatctaatttcatctgtacacaaccggtaatgctcacagacaagaacaaggaggctcagaaaaggaaagttattcactcaaggacactgagtcgatggaaggaaggaggactggcttccactgtgcctcctcacctcctgggagtggctcacagaacagtcacgatcactgtcactctggcactcagacaagctggttgtgtaggcaaggtgtgtgaagtcctcacagccaagtaagataatacacagagatgtatatatgtatgtatttatttatttattttgagacagtctcctctgtcatccaggctggagtgcagtggtgcagtcatggctcactgcagcctcgacctcccaggcccgagcaatcctcccgcgtcagccggccaagtagctcggactacaggcacacgccaccacatccagctaattttttatttttcatttttaacttttttttcagagatggagtcttgctctgtcaccaggctagagtgcagtggtgtgatctcagctcactgcaacctccacctcccgggttcaagcagttctcctgcctcagcctcccaagtagctgggactacaggcgtgcacctccttgcctggctaatttttgtatttttagtagagatggggtttcaccgtgttagccaggctggtctcaaactcctgacctcaggcaatccacctgcctcaacctcccaaagtgctggaattacaggcataagccactgcgcccggcctatttttctatttttatttcttttgagatggagtcttgctctgttgcccaggctggagtgcagtggcacgatctcgactcactgccacctctgcctcctgtgttcgtgtgattctcctgcctcagcctcctgaatagctgggcctacaggcatgtgccaccatgcctgtctaatttttgtatttttcgtagagacggggttttgccatgttggccaggctggtctcaaactcctggactcaagtgatcctcctaccttgacctcccaaagtgcagggagtacaggtgtgagccactgtgccctgcctacacagagatttagaaagctaaaaggactcacccaaactcacacacttgagaagtggcagagttgggtcttctgtctctaaatctaccacaccaaacaactcaactggcagcattttctcagcaacatctttgcaggaaccttgtggtcaattcctcctgcaggggtgagtggcagcctgcagagagttctgtgagtcaagtgtttcaacatatggatggattgttgttttttactgtggcaacaaaaggtgtgagatttttgtctttcatcagctacaaactacactgttggtcaggcacttttactgggagatgtttttcccccgattcttcctggggtgacttgaaatgtgggcaggatccaggaggtggagagagaggggtctttgaaggggtggaggtgggctgctgacactgaagagctctcagctgattgactcacctgcacatgactgtgtagggaatgtctggcccaaggaggcttcctgtaatgtatctatcatctcttcatttagctcattttttgggtttcagaatccctcgtggaaggtccatttaaaatcttggaagaaacctgggctctgcagattgtcctcagtggagcaactaagagctgaatacagtaaaatgaaaggcaagacaaagtcatttcctgggttaggataattagaatttgagtcaccttcctgtgtaaaaggaaacaaacattctgatggtcttcatcagggaaagagaaatgttttatcaaataaagtgtaatcctggcagttggcttcaactgaggcttgaagagaggcccggggtgtttaatctcctgacattttccctgtacctcttttatgacacttttcactttttgccaagttatttataccatagcctttatagttaatttttgcttctagattatatatttccacttctgtggacaacttgcagcagtttgtgcatagtatgtattcaaaaaatgaaaaaatataaatacatggatgaattactgaatggatggataggtgagtgaatggatggatgagtggatggatgggtggatgagtggatggatggataaatggatggatgggtggatggatgtatggatggatggatggatggatggatggatggatggatggatggataaatggatggatggatggatggatgagtggatggatggatggatgagtggatggatggatggatggatggatggatggatggatggataaatggatggatggatggatggatgagtggatgggtggatggatggacggatgagtggatggatggacggatggatggatgggccctggtcatgttcacataagaaaggttgaacttgtgggagaggaggcaaaaagaggaagtgatagtcactgaatgtgtgtgctagacagtatgtctggcactttataatcattttagttaatcctcacaacaatgcaataaggtagattgcttgtttccccatttcaagatgttgaaactgattctcagagaggttaaagaatttgcttaatgggaccctcatctagatcagtctgaatagaaagaactaccagactcttaaagtcagcctagcaccaagtagacactaaaacattgatttttgtgatgttgtttcccagaaacattgagtcagaaagcatgtggatgcagattaaagtggaacaggctcggccatgactgagcatctgcaggaggagctgaggaaagagctggcctcctcaaggcctgggtgactcaactgtcagcctccaaagcccattcccctccttcattggagaggagtttgaggacagttgtggttgaacccccagcaaaactattccaaaacgccgtgtgctggggcaggtggggcctaggccaaggccatttggccctgcctgctgtggcccttctcccctcccatgtcttccagccttgcctcccccacaggctgcagatgacacccttcgcagtgcttattctggagtgtaagagctgagagcaggagctacctgggggttgaggggtgggcaggctttagagaaggggagagaagaggcctcactgtgggagctgggggctcccaggagccacatttgccaggcttggcttcaagctgacatcactatcagagaagacaggtctggggaatgagagggcccaggagttcaggagcccaaactgtcattcagttttggaagccgaatccccagcacaattgtccaccttgctggcagcatcctggttcccaaagcctgtcagcccggggctgcgggcctctctctcacaaagccttgtctaggtgacttgggaggtgaggcccctgttggtcagccccgttcctgatggaacaagccaccctaaccgctctgtcctctcaggtcaggcttctgacaagccacaatgtgggtgagcctttgtgcactgcctgcccacctctcaccaggagccctctctccccatggcctcaaggtaccagtgaggcttttttctgtctcagcctggccataagcagccctctgcaagagttccgttaccagtcatttgcattgtagtataagtggaaaccacagaatcgccttcctccccagttatttatacttcaagtcatattgtagagagaaaatttctgtcagcaaaaatctcaggaatcctcctcatttctatttgtatggctttcaatcgttgacatgattttttcacatatgtcatcttctggggatggattcgtataaccctgcttcacttgcttccctgtgggaggctcacttgcttctcgacaggctctggaagaactaggcagtctggtacatggttgtgcaagaacccttgagggggccttggagtgtgtgcttgggccctggaactcatgcctaggatggagggctgagattgccccttcccatccaccagggagttgacaagggggagaagaaacttcttgtgagcttgcgatgacttgtggcacttgcatcagaccttggagttccctggggagaggcactcttgggtatgacactgtatagtgccacctgattgccatttgacccagtttggccctggatccttgagcaagagggctggaaagaaagacaggcccactttttgggacactattagggtctgtagcattggtggggagagaattcccccaacccccaaaagagctgaaaatgagacacgcgtggaggggtgaaagtggagtgtggtcaacagtgtggttacagagatgtgtgtcggggccactcccactcaccagggagactcatgaagcagaagggatggggcacaatgtggcttccataggcacaccaagccacctggagagcgcatcagccctttgggtacccccaagcggaaggaggttgggtctttgggtctgggaactttggtgcttgttctggtgggaagggcagggagtcaagaccagctgtgtcttccactgctcttcttgtccactttggttactggcctctgttggcatgaactggggaggcagaggctacctacagacgaggaactgtgtggagtgcgagtgtatgcagtaaagggttagcttagctgacttgaggtactcacacccatattccgaagaaaagactggccctcagcctgagcctccgaaataatctctaagcccttagaataccctgctttgtattcaaagagtatctttgaatgctgaacttagaaccactctagaaaatgtatgctaacaatgcgatttatgatgaacacttgtctttgttcccctggggccctgggccacattgtatcagtttgagccctagagggacagagaatgagaaactaagatcagtcatgcaggtgctccaggcctatgtgaccaaccaccaataaaaaccctgaacatcaaggctcaagtgagcaatacagctggtcccaacttacagtggttcaacttgtgagttttgcactctacaatgggtttattgggacataacccagtggaggaggatctgtacttcattcacatgtgttgtcacatcattactgggagaattaagcactgtccacgtgaatccactgggagaggataactggaagcttgcacctggcttctcctggattctgctctgtacgcctttttcccttgttaattttaatctgtattctttcactgtagtaatctacaactataagcagaatagcttttctgagttctgtgagtctttctagtgaatcattgaatccaaggtggtcttggggacctctaacaaaagatgtctggacctgaacttcctgttgtttcaaagatcctatagcaggctgtcttaccaactttcagcatcaagaagctggtggagagtgggttagtttaaaaatgaaactggggagagagatgaagccgggggaagatgccgtgaaatctcaccttataggcagcctctgattcacctgagggtttttccttgaatactttctgggtacaagtatttgagacaggtgatgtgctggtcactttattctcagctgcttgtggcctagccctaacatgggcactggaaacaatgggggtaggggttgatgatggagaaatggggagtaaagggatttaaaactttgaaaaactgagctgtttccatgatttgtctcttttgattctcacaaaacctttatgaaatatgtgctgacattttaagctctcacttatagtgagaaaagcaatcttcagcaaggtgatgacttgtccaagggaagacatggtcgcccttgttccttgggagattttgtgctcccaggggaaagcataagccctcaggagccatgatgagaacagctgtagaacagcaagtgaacaggtgtgtatcagtcaggataggcaaggctaagctgcagtaataaataatccccggatctcagtggcggaacattgaggaggtttatttcttctttatacaaatatgctgtggatcaggatgactctccaggcaactgtctgtgggactgtccaggtgggcttggatcacctggtgttgggccttgaagtcggtaatggagaggacatgttagaagagaaggaacttacaagcagtgggagtgcagcgcccttttgtggataggggtcaaggcaatgctttccaaggctatgacttggtgtggtcgaaaaagtcaagcagtcttcactttttgctgtggtcccagcaaatctgcttccaatccaggcttctcccatataaaaagcctcctttgtgtacagtgagtgaactagaacagggaggagatgccagtggagcttggcttgctccttctgtggccagctggcttgttttaccactgcctttggggtacagtggcagctgtggcaaatctctctggagtttctctagcgggagcgaagcacctaaagcacatgggtgcaggagcagccaggcctgcacccatagacatggtacagagaggagcagggaagcccgctgcctgcagacttcaggaggagagaggtaggggtggtgcaggggagagggccttaatgccttcagggaaaggagtcaaagaggaatacccaggagacaactagactttagaattcttggggccagaaacttgattccacctctagtgctttcttttagatttctttctctctttactttctttctttctttctctttctttctctctctctctctctctccctccctccctccctccctccctctctctctctctctctctctctctctctccctccctctctctccctctctctctctctctcctttctctctctctcttcttaagactgggtctcgcagttgggcacagtggctcatacctgtaatcccagcactttaggaggctgaggtgggtacatcacatgaggccaggagttcaagaccaggctgggcaacactgtgaaacccatctctactaaaaacacaaaaatttgccaggcatggtggcagatgcctgtaatcccagctactcaggaggctgaggcaggagaatcgcttgaacctggcaggtggaagttgcagtgagccgagattgcactactgcactctagcctgggtaacagaacaagactctatctcaaaaaaaaaataaataaataaaataaaagggataccgggtcttgctctgtgtcctaggctggagtaccatggtgtgatcatggctcactgcagcctccacctcccgggttcaagcaattctcctgtctcagcctcccaagtgagtacctgggaccacaggcatgtgccaccatgcctggctaatttttaaattttttgtagagatgaggtcttgatacgttgtccaggctggtcttgaactcctgggcccaagcagtcctcccactttggcctcctgaagtgctgggggtacaggcgtgagcctccacctggccagcctccagtgcttttgcatccttcctgttaacttgtgtaggaataaaacattgtcacaataagatttttttcctttttattgttttgattttttagccaatgagaaggaaaattccttattagggagggcgagggtgaggatatgtggggtggggagaagcgaacgttccaagtttcgaaaacagcgactctctcttggactctctagccagtagaaacctccctcccactctcttgccccaagatctggtgcttagaagagaatcaagggaagttggaacccagaagacggagacagattgagggactgctgtgaaatgttggggtgtttggtgaataatattagaagttgggctggcagagaccctgtcacataaacattaaatcaacactggagactgagcatttgttagaaatgtaagcgggaatggcagaaaacttgtttttaagggaaagcatgttacggcttatgttcagcctccatcctctgaaggcaaaagttagcaaagttgatgtatggcgttgctttttctgggaactttatctcgtttggtggggttcccatctctgtctcccaggagccaagactttcccctccctctgctccagcagaagccagtctcaggcaaggctccctgtacctcatttacactttggtgtgaatatgttattgtaacctctctcctggaggtgtctgcattccaagactgaacttttctgtgaaagttactgtcactgtgaaaggcagttcagcccccagggattgaaaaaggaaatcattttgggtaaggggacagttagtccagattttttcagttgcaagtaaacctaactcagccagtaggcaaagggggaaattgctggtttgaactggtgggaagaaagctgaggaaactcctacacttgggggaagaactgcaggtgcctggctgcagggaacgcagcgggggctcaggaccaggcagatgccctgcctctgcttcccttggcacagtggcctccttctcccttcaagtaggcagatgctgcctgtggcagaggacagcagctgattggcagcccagcagggaggatgtggtagacaggcactgagcatctcttctaccctccttctagagggctatcctgtactgttgaggctaaaagactgaaaaccacatttcccagcctctcttgcagctaccaatctggatgagagttagattctacacattagatgcactttagcaagattttcaaaagcagattggagaaggagcccatgcttctgctggttttttttgctggcaagtgaggggttctgtttttcctggagtgactttatcatggtggcatctgaaaaaggctatttcttgatcagagagacagcaaccctctcagtgacctagttctgtgggtgtgtctctcctgagagttaatcccagagctcaaactagagctcaaccctagagtctcttcaggcttcccaggggtgggggtgcatttaacagtccaagttaaagagaaaataaaggccattaaagaccaaacattgagcactgagtgaaaaagttttattgccaaacaggaaacctgattcaggccagggtcttggaaggttgttcaggatgagatgggggaggtgaaatggggtaggtctttgaaaaccaacagattgcaaattctctgtcccatagcaggaaaccacagtctctgatgtcagctggctgccaacacgtcagttgtatcagcattagctggctggaggtggcctgctgtgtgcagatggtacctggtgcaggattgtggtgtccaggtgtctctccttagcacataagaccctgtccgaggactgtggcatgacgtgctggagtcacgattctgtcacccagtcaggtcatcagtgtcagagagctaggtggccaggttggagttgattgccaatgataggtctttttctgcttaaatcagctggactggattctattgcattaacttgaccctgactcatgccgccaggcctaatttataaaccaagacaagaaagggctactccaccccctccaatttgtgtaaggccaggggacttcccccccactccccaacctgaggcatgcaccctcccttagatcaatggctgtttctctgagaatgcggaaccgtgattaatccagccttgatggggaggcagcaggaactgtaggcattctcacttcacacccatcccaatcccctcccccttgctgtcctcttgtacagaggactgaaagcacaacactctctccctccctcccttataggtggtgacgatcatgtgactctcttctggtcaatgagatgcagcagaaagtcctagggaggtctaggaaaagtcctgttgggagagagcattttttaccttctccctgctacttcttgctactagtaacatggatgtgagccttggaggggtagctaccatctggcacctggggtggcaagccaacatggaaaggatggcagagcgggaaggaggagccagccttaccgatggcatcactgtcactgcgctagccccagaccacctgctccagagttctggttatggtaatgaaataaaccttgatttttattccttaaaactacccttcaatgggttttctgttcattacagttgaatgctttcataactgatacaggagggaccctgtgattggcagttccactagactgcatggagatgggtggagttatctaaaagaacagagatagtgtccctagaagaaggggacaggaaagcatcctgggtacacaaaagtcaaggctccaggatctgccctgggggctatctcaacacccctacactctcaccgcacgtatttggtcagctatgaatatgaccaactctcgtcgtttatctctattcagtggaacacagcagcactgtgacctgcccacgagaagaaggatttttagaacttatcttagggcaattttaggtagaggagcagacaagatggtgtacaggagaaacaggtctattaaccctggtattaatattaactggctgcccagaataaatgaagaatagcttattctttgccaggttgaagatagaaaaggaatgaagggccggagaagtacagctgggtgaagcacagagcagcctagtgcttggcatgggactcagatctgaagcagcctctccgggacttctctgagcctgcccctggtggtatgactgtgatatccctgcttctatagttggcaaccaacatgtcctagctcctagaccatagagggccagattcatgtctcattgactgtgtaatctctgtgtggcccagtacagagcatgcacaccgtaggttctcacatatgtttgttgagtgaatgaatacaataccaaacgaatggacaggacagagctgtgggctagcaggaaggatatctggcttttgcttgaattagctagtgaattgctgtgtggcctccttactgagcctcatttccctctgtctgcagagtcaagcaaatcttccattttttgttcccctgctgccagagcatggcagagtaaatgtgtgagttgaagggagcaacctcatgaggttttgctttgtgtcttaattacagccatttgtggaattaggcttttaatataaatatttgtgtgcctgcgcctgcatatatgtatttggaccaatgctctcatgtgtgcaaatacatgtattctaaagaaatctgtccagaaccccagcatctgtggtgtctgtggtgggaggggcttccatattacagagagatgcccacagtgcatgacgttacccgcacaggtgtgacatcacagggtaaccaaatgcttttgccctgggggtgggagagggatgggtgcacggtgaacagcaggtgggggtctttccataggggatgaggaagacaaggccacttggaggcagaggagaccacagtggggcatgatggttggggaaggccttttacttctgccccttaaggatgccctggaattcaggctttcggatcccagagctctcattagagcagccctgcgttgtagacttttctgcagtgacagaaatgttctatatctgtgctatccaatatggtagccacaagttacatgtggctattgaacacttgaaatggggttagtgcaattgacgagctgaaaatgtagtttaaattcacttacatttaaatagctgtgtgtggcttgtggctgcctattggactgtgcagttctggagaatggtactttacttgtccttggggaagcagaaacaaatgaaaacgaggatctggagctcatgaagtttctcatggggtggggtatgtgtgttgaagctgcaccttcagcaggaacctggccagtccttagtggaggacatttctttccatcctgcatccagatggctggtcctgctcctcccagtccatggagaaaaaagaattgaacaaactgtctaagctgggtcaggtactctgcagatgtttgctgagtatcgttcttgatggaaatccccgtggaactcctacattttctcctctcttctccttcctttcagaacctcagagtgacagagccaaaagaccagtgcctcattttgctgacatggaaaaggaaacttcgtgggggaaagagatctgcttgcagtcggccagagagacagaaccagggcagtggtgagctctcatgacctggtgtctgttgccttctggttaagtttttcatttgtaattctacaaacatcccttctgtaaacatttccctcaaaatggagcaggaagctctcaaaaatggaccagaaaggggtcaggaatataactttctctgcccagattccaggacttacagtgagaaagcgccttctgggaacttcacaatggctaaagtgtgctaatgggatgatgtgcccttgtacacccactgcctctgaactctgctctgcattgctgagcaaactacatttcccagaactccttgttggattccttccaaacaggtttaccactgggagagcctgttggttggggagggcaggaagagggaggaaagaggaagggactcacttcctgtttccagctgaagtctaaatcaatccactatcaacaggtagctatcatactaccctcattgtcacccctcagaggtcccactgcagctgcataatgtcccctcagtggcctgaacatgagatgaacaacactcttcttgggagtaccagccttgcttggttcatggccacttttcctgattatcttgcagctatattaggtcatgtgacaaagttctggccagtggcaagggaacacaagtgataggtacagatagaagtgtctgatactacatagattatgcttgcactcactcttaagagagagacatgaacttttaccaacggaagccagtattattttgaacctctgttagagtggcttgaatctgtatcctaacttgtatccctaatgtgtgacccatgaaaattagccaggcagcaccagttccaaagaagctcacactcccctgcggctgcttctgccaaggtcactgatatttccctttgctaaatcttgtgggtgttttcttcagtccttgtcttaatcactcagtggcacttggcacttattccttcttgaaacccttgtttcccttggctttgtggcatcctgtgctcttggttttctcccatatctctgaccctctttccttagtcttttttcttcttcctcctgtcccttaaatgctggttgtgatcctctttttatctcattctacacactcacagcctgagtaattcacaccatcttgatgctgagaacttccaaaatgttggtctagcctgggtcattgttatgagctctagactcacaaggccaattgcttggtgggaacccctcccccatggttatctcatgggtccctgaagtccaacttctccttcattgaactcatcacctcttctgttcctcctcctgggttcccaggctcagtggtggcaccactgtctacctggctgcttagcctgagacctggctccgtcccaattcctctctctcagtcttatcatccccatccaggcaaatcattgattctgtggacctactctttcgggtgtccctcaaatctctccacgtctctgtgttctcactagcactaccttggtccaccctgccatctgctttcctcctccactcctgcattctgagtcattttcggcagcacacgcatccttaaaacccctccactggcttgccagtgtcctcaggattaggcgaaaagtctttgctttgttttacaaggcccttcgctatctggccccctcattacctcccttgctctgcatgctccagtcctgcagaactacacacagttcccccaacaaggccctgctctgttcttcccacacactgctcctctgcctgggccactcttcctgctccttgtcagcaggcttgctgctctcaggctcagcatggacagctgcttctgagagccttctctgcctacccaggctgggtggctgcctctctttggtgtgcccatggcagcccagaatgcctggtggacagggagccctcagcaggccgtactgcagcgccctgcccccgtcagcctccaggagcctggagtccagggacatcaagggcggtcctgtctttctcacccttgtctctccagcccctaacacaggggatgcctgaccccaaactagacgagttacttgacctctctgacccaagacaaaatgggaggaaagtgccaaatttccaagattggccaggggattaaataagataaatatgcaagtctcttatctgggggtctggcttggtaaatataaagttcttttttcttttcttcctttttcttttttttttttctttctttttgagacagggtcttactctgtcaccaaggctggagtgcagtggcatgatcatggctcaatgaaacatcgacttcctgggctcaggcgatcctcccacctcagccccctgagtctcttggactccaggcgtgcaccaccatgactggctaattttttgtatttttagtaaagacagggtttcgacatgttgcctaggctggtctcgaactcctaggctaaagtgatccacttgtctcagcctcccaaagtgctgggattatagacatgagccaccatgcccagctaaaagttcctttttaaaatctgcttgttagatacactcatagaaaggtaactggccacagaagggagaggaatggcagtccatccagggatcactggagtgtcatatgaaatgttataggaatcacaggccttagaacttgaaaggaacccaaggatcatctaggctactttatgcaggtaaaacagccacctgtgcccatcacatagctggggcacagctggagaccccaacagagaggagagctgatgggtgacgagaaatcaggcctctccgccacggcagcctagctaatgggtcttggctggaagctaacaggaaggcctctttccagaaacactgtaagccagtgtttctcagattgctgggtgtaattcataggcagatcatgaaatcagtttaatagctttgaccagcattaacctatttatgcctagcgttcccttattggaacactaagtctgtgagagttatttacatcctactgcttaaggtcatcgccaaaatctgattttttacacaaaaaatttgcaacctccagcataaatgggttaaaacaagacaaaacaaaacaataccagaatggaaaatagtgcatgatctgtacagtatagttgtagaaaacttcttgttttatcatttgatgtcatgaaagtccctgctgtagataaaagatggagcttgtgcttctgagtggtcatgctcaacagggtggggagcccaggggagtggggagtgatcgtatagacagaggtgggtggggccagtgtgagcctgatggtcaattacttctcatttctagggaaaattgaaggaaaagaaggagggggatgtggaggggagagaaggcctcagtagagtttgcactattattagggcaagtaagctgcttctgaaaagaaggggtttgcaaagccaacccaggcaaaagcaatctgctggaagaacttcatccccagctgacactgtgggaaggaccccatgcagaagcaatagggcagcctggtcccatatcctcatgaaatgcctcttataattgtgacatcttgcaattgtggaggactttacacttttcggagttcctagcccctcacttatttctcgtaagaccgctgggaggtggggggatggtatcatcatcccactttagagatgaggaaacaggatcagagtgagctaaatgactgccagatccaaaactagaattcagacctcctagtttctaagtggacgctctttctacaccaccataatgtgagtgttctgtgtttacagggtgtattcaagtccatgactgcccattagaatccccccaaaaaattccaggactggcctgagttgctccttagaccaatgaaatcagactcctgggagtacggcccgggcctcgggatcctttaaagctccatttggagagcctcgggcacagccaggttggatccatctcccagtcccccagccttggctcagcctggccaagctgcccaggaggtcccttggtgccctgggctctgtttcactgttgttttgtagagcaacttcccagtgatgctgccactgggccccatcctaacagtgaagtcccccgggccctcctgagaggaggtgtgaactggaagatggggaggcaggcggctctgacagacagaaagcaaacagctcagaggggtggcaggctgcattttattcatcgttaatttaaacacccttcaagtcctctcttggaatgctgctcagaaaaatagatgtattgtttgagaaaccctgcaggcttgtcccgcatgctctagccccctcctgagagaacagatagcataaaaaatgatttgtaaagcaagggggagcttccttagggaagaaggggaaggggaagagggtttggggccaggtccgagtgcagaaatcctcaatgcatgagactagcgtggaaggtgtagcaattgtgctctggggtgcctgaaagtgccagagctgcttcaggggcaagagtccaggccccaagtccatgctgatgagcccaccctgggggtcaggaatggcctcagcaggccctccctccctccctctccaccctacaaagtgaggagccttgagtcaccaccagcacattatacaacaatacaagaaccctgcaacagataaagccccagcgcctcttctggactcagatgccctaggctggctgtctggctgtgctttccagacagtgtgtatgtggaattgtgctttttgttttttaagaatgtaaaaagttacagtaagatcgaaccacagggcccgtcgctcctatggtctctgcctgactgggctgccgtctgcctcagttccccagaagcttctcctttggccatgagggctcagtcatccctcaccccagagtccacaggaagagggggtctgctgggaggcctgtctgaaggacggaggatcctgggtcaatttagcagctattttccagggtttggcttgggtttggatgctggcttctgtgtgaaacctgaatacatgcaaattgtacataaaactcccccaaggcagagagggattttccaggccctggtacatctctagagagttaaaaatgggaaatctttcttcttaaagtggcccagactgagacttttccttggggaaaagggttagtagctctttgtaaggctggtgtgtatgtgtgtgtgtatatatatatacatatatgcatgatgctgtgcaaatgcccagggctgtctggcattttccacaaaatgagagcctgagattgcctaagccttctgatgccttctccaggcctggaggcactgcttcattcagaggacacaaaggcctgaccacctggctttagcaagctaggacacccagggtggcttctttacctttctcctcagctctgagaaggctgctagccaagactctggattctctgtggccacagtcatatggtgagggcctcttggagttcattcaaactttaagggagccccacagcaccggcatgatgggtaagtccaggcctaaggttaggaagcaaatcctggagcatgaggaaattgtaggctacagtgagctaccagtggtgtgcaaactggagacccccaagacagtgagagaggccacagcatctgagggaatggagctctttcttggcctgaggttcagaagaacctgcaccaaagaaaggcatccctatcaatgtcactgttcctgaaatgatgggagaaccacatccctgcttcagggaagcagtccctgtcgtctggggcgctgagccctttggcctgagatgaaggatgatggtgtgatgtatcatggcagtgtgactgagactggattgggggatggggacaggggaacataggcaaaaatacacatgtgccactggatcctgagctgccattgtaccttggaggactggcgtttctctgggaagttgggaggtgggaagaggaagggtctcattttcctgccccttgaaaccatgcttaccattcctttagaagattgctcaagctgcctccaattgcctctttccaaaaccaaagcataggaaaacaagtaaaaacagctgaggctgcagcataagcaacttaggatagagtctaggaagcaccgccaacagagaagactgccaagaaacattttgagtttttcttctctggaggtgggtcctggttcctcccatggagaccacgattctgtgtagtcctgcacgctgggcgggggattgcctggaggtttctttagacctgtctagctcacacagtcttgatgcctgggttttaggctgctgtactgttgctggggctcacttcctgtgggtaggctgttattttgcccgcagatcaagtcctcactgtctagatgcctctatcatggggatctcttcttccctctctggatggctctgatccccaagttatttcctgttgcctaggtaacacctctaattggatgccttttaatcgttcccttttttaaagggataaatgtggattttatttccaggtcctgtcagagggccctgccctagagaacacgtgcgcccctgcgtgggcaatcccttcactgtgaccgcaaccatgggttggatggggggcactcactgggctggcctgacagtcacagtgaatcctgaaagcatggttttcacaggaacccaccttcaggatttagcaagactgacgtctctcctggccagcgctgcttcactggcttcaccccagattagggcctgtgtttaaaaaccaatcccaactcaaatcagaaattacccaaaatagctggagagtcactgagatctcaggtaagctttcccttcctgccatgaactagaaggggaaagaagagtttgacattcaagtttgactctaatgctgggtgcgtgagcgcatgcgtgcatgtttgtgtgtgtgtgtgttccacgcacatttgccagggagagagatttcacagcatggctccagctggaggcggtgaggcggtgcttttctaagacttcctatcagaagctgtgcatactggtgggtcacgccgtgcctgtataaactctggcacctgtccttgccctcatcatatatgagaaaaatgggcagagagagtgttcgtttacacccccagaccactatcctttcaatgaagcctgggtatctggccttcctccaggtcagggaccccctatgctgcagaaggcaagtctgggagaatctgtccctcagcccgagagcaaaactgtaatcctaacattacttccatccaccagtttcaccagctacctccctcctgccttcctctgcctccaataggctgtgcatggagaagacaaatcctcttgataaacaatatttagaaagggattctatctttcctgaccccaaacacatcatggcctctggagccaaataccctgacatttgcaagatggcttcttttgggttcctggtgctgcaggccctggttcccaaggacgcagctggcagaggtgcctccttcagaggaggaggaggagaagctggagggctgcgcccggcaaccccatgatctcttaaagggggaaaagttgaactgatcaacagtagttaagaaaaaaaaaatccacaccaacaaataaatatcttgtctgagaagactcagatattcctggttaatattgaaaagcactgctgtggatgagcttgtgaaagaaaggacggttgggggattcaagatctgccgatccgagcctggagatcagccagctaaaagcccagcagggctcctgcagcctcaccgctcccctcctcacaggtgccctggaccgcccaccattagaagtagctgccctgtgctctgtgctaaatggactaactctgagctgagaaaggccagctaagcccctcaccactgcaatttccaaatctgggggaaatgccacagtccgcaagttggtgctatgtttcatctcattgcataatactacaccattctctgtgtgtagtggctgttctatatatatacatcgggaggcaacatatggctgtcccaacccccacctgtcaaaactgtgactatatcacttctgacgaccagaaggaagctgctaggctgggccaggattctaaatgctgaggaggtaattcagagccacgaaaagttgcaccatatgctttggggttgccggctgcttctgtgcatggggacggggtttagtgccagtctgcaaaaccctcctcgctgcggtatgccctgggtgtgggcctggggggccacgttttctctccctgaaggagaatctgctgggggccacggttctccaagaggggactcacaaggaacacaggcgtccccaaaacctgcccttgataacatcaggcctggccaaatagtatttctttaaaaaaattttttttgtttcattttattggataaagattaagaaagcgccagcagtgactgagagaagcaaaccacgcccggcggccccgcggcctggagagggtccccggcgcgggcggacgggcggtctacctggaggcgctggtctcggccagccggttgttcatgatgcccagcgcgcccacgccgcccgagaagccgttctggcgcgtgttgacgcacacgctgcgcgggtagccgttggccgtctccgacagctgcttctgcagcagcgccagcgacaccttgttggaggccgtgaggtcgcgcatggagatgagctcgcccgagaggcggcggccctcggcgtcgctgtcgcgggccgcggggtcggcaccgagcgcggccaggcggcggcgcagccgggagcctggggtgatggcattgcgccgggccaggggcgcgccaggagccgggcagcagcgcgcgcagcagcggcagctcagcttgcgcagcatccagttgagcacctgcttgatgaggatggagatgacgttgaagagcgagtaaatgcagcacacgccgagcaggatgaagaggaagttgcccaggcggtagagcccctggttccggtaggcggcgtgctggctgctcaccaggtccccgaagccgatggtgctgaaggtgacgaagcagaagtagagcgagtccacgtagtcccagccctccacgctggtgtacatggccgaggcgcagcaggacagcagcacggcgaacaggcccaggatgagcagcacgtggtacaccgagggcttccagcccgccaggctgtcggcctccgagagcgcggagccgcggcggaaggtggcgggcagcaggccgctgcggcgcagctggcgctcccggcaggcgcgcatgatgaaggccagcagcgagatgatgcgctccaggaagaggttgaagaacaggatggtcccagcgcagccgaacagcccgtaggcgatgaggaaggccttcccgcccaccgtcgcgggggtggtcatgccgaaacctgtggagacagggcagggtcagcgcggtcctggccgcgcaggtggtcctcactgggcgagggtggggggtgtgggggcgggggcatgcaggtgcttgcgcggctcctatctcgagtggcaccactcaggtggaggaagaacagcacttagtcatttatctcccttggtggcacttaataggtttcctgatcttggcagcccctaaactgatggaggagacatggcccttcatcttggggacctataaacccaagtggttgggacaggtagtcactaggaaggacccatcatgacacaaaaaatagaaaccactgctgcacaggtgcaaaccactgagctacccacaaagccaacaagggacacctgctctcccactcctccaaatttttttttaaaaactgtcatctttattttagttcataaatacattaatatactagtctaggtgagttttgttgggtgaattacaaatatttacattagaaatcaaaaccaacatagatctcttcaaagatatctagcttcttatgtgcttgtgcactttttataccagtcttgttacttggaaactccactgcctacttgagaatggtgaaaaaagccaagtaatcttagtgctgtgactaattttcactttacaggcacttcgaaaaggcctttggtcaaacgatcatattttcttttttggggggataggttctttgtcacccaggctggatgcagtggtacaatcatagctcactgcagctttaaactcctgggctcaagtgatccttccacctcagcctcccaagtgataggactgcaggtgtatgccaccatgtccagtgaattctttgttattttttctaatggcagagaaaggaccatattttcttagtctgccaacatttcatgcctctggaattgggcctaaggccaagtgggtagtccgtcacttccctagttcttacagtgtgaatatggggtgacaagaaaatgtgcatttcaaatcaattcccagatgactccaaagtcttacatactagaatagcagacttttctgttcaaagggcagtttttaaagagttgtcatatgtgcccaattttttttcccaagtgtgccatagattttcggtccctccctgttattaaaaaaaaaatcagtttaccaactctgcctactaactaaaggaccccaaaattaagtgtcagtgctcaaaagtcaactgcagctcctcttctttcctcaagttatttggaattgtgagtgaatccgagccgaacaactgttgactacgagtttttctccaaaagcctggtttttaaatgtaacctgtagtacacctgggcagacagccttgttagggaagcattccatagggctttgccttaattgggattgttcactctgggaccaggtagagtgtaaccaggtagctagagttaatggtctctgaaaagagctttgtgaggctgacaaaaggattgcttgagagtagtccacccacacccttcagagactgagcatggctctgccattgggtgccggctccttctcaaccaaggatcaccatcagtcatccttgctcacacttgtggccaaagaaaggctctggcccagctgggtcctgtgctgctggtatatcaaattgctttgttctgggaggtctatacaactgcgtattgcttcaggcccttatcgttgttaacttaccacttgttcaaagcacaggctttaagggtgtctttatcaattgatttctgcagaaggtgtggctgcctgccagtgtgctcgcccatgccatccagggcagtgcagagtggcagctctgcctctcaactgagctccctgcccagtgctggctgtggtctgtgggacccgtggttgcctgactctggttatgggagggggtttcatctcttggtggaaagattcacttactgcttggagtctgagctgaaaaaatggatcatttgagcagcaccatgatactgttcagcaagtctggcagcgatcaggggcatccctgtttaatttgtgccctatggcagaagggctacctgtgctctgccagtggggtggggccagccctgggaaagtggagaagagtttgtcctatgtggcttactagtttcctaaacagactatagaaaatatttcttgtaatactttcagagtacattccttaagcctatgtgctaacaatcattttctagactgtctgaaggaaatgcccagttgcccgagtgtggtgttgatcttacgcttaatgactcaggtgaggggaaaatcttatgatgttacccatgttgaggaagatggattatgtccctagatttacagaaagtgaaaaaaaccaaaatagctgtgtaaccaagaacttgatagagggattttgctacattttaaagccacactcaagttcttgagtttataaagaaatcagctctgaatttacatggctataagtggagtgggagtatatgtgtatatttataaaacgttttagaccagtaacctaaatgtctaacaacacaactaaatgattgtctattcataaaaaggaaaactatacagcaattaaaaagcatgaaccatagctacttgaaacaacatggataaatctcacaaaaagaatgtggaacaaaataagctggacacaaaataatacattctgcattattccattaacataaaattcaaaatcaggccaaactacagccttttttagggatgcatgcatggttggtaaaattataagggaaagcaaggaagtaattttgataaaagtcagaattgggatttcctctagagcatggcagggggtagtagctgagaggggacataggggacctctggggtgctagaaatgtttttgttgacctgggtggtagttacatgtgtgttagctgtgtaataatctgttaaattgtatgttttgtgagtttttttgtactcatagtgagaaaaaaattttaaacttctagactgttagaactctcagatacccaattctgacgtacccatcactgtataggtgagggagtaggggctgaggggctgtgacctgcatgttggggacagactcccacctctttgtcctggcttcaagcctggtgcatagatcggtatacagaacactgcatctactcactgagggaacacaaagtctcttatagaaggataactctgttaaattcctaaggtaattgaaaatcctgggcctggaaaaccaatactttgtctaactaagaaaatactgaattggatttttcagctaaagcctcaaagctgagaacagtatgtgtacatttctccccattctaaagagaagttccagacacatccatgctggacttaataaaacagcaaaacaggtctggggctagcaaccccccacacccccacctccaggctgtacggaaaggctggggattgatgggatcttccatcagttgggaagttgttatgggtagttgttgtggcagtggagagtgctgtggattctttcactcacccccaggccaggggatggttggagcagggaaggtcaagaggacttatggagtgtcagcaagagcccggcagctcacttcctagctggctgggcacagccgctcacaggcctacccagagtggagcatggtgagggttctgggagaacccggcagtgtcccctggagtccagagctgtgctggagagttctctgggtgggaggctgactggggcagcccccacaggcaggggaggaagagggcagtcccaggggccatctgtacttcaagggcttgcttcatcaggagatgtgagggtgacatgggtcaccagagggtgacaagtggatactgaaaggaagagatctgaagagactgctcaagagggctgcctgctggagcaagggggccctaggaagaagaggctgaggggcagagggctggggacagcatgagagggagtcacaggaggagggatggagagggcagtgcccactcagggaatggggcagggagtggtccctgtgcagggctcccaaggacccataaatagatgccgtgaaagcacatatgcctgttctaacagggagccttgcagccccaccagcaaaagttaagaaggaatgatagtggctccagtgatgtaagatcacccccatgccccatccactgcgggtcccctgagccatgtgtcagcccagagctagagggggaggctaaataagctctgattagaagtgaatttgaagatttgattaaacaactgagaacgagtctcaatcttaaaactggtacttaattaacaacaacaacaacaacaaaagaggccgggcgtgatggctcatgcctgtaatcccagcactttgggaggccaaggtgggcaggtcacttgaggtcaggagttcaagaccagcctgaccaatatgcaaaaaccccgtctctcctaaaaatacaaaaaaaaaaaaaaaattagccaggtgtggcggcgggtgcctgtagtcccagctactcgggaggctgaggcaggagaatgccgtgaacccaggaggcggagcttgcagtgagccgagattgcgccactgcactccagcctgggcaacagagtgagactccctcagaaaaaaaaaaaaaaagagaaagaaagaaaagaaacaaagaaactggctgagcctggtggctcacgcctgtaatccccagcactttgggaggccaaggtgggtgcatcacttgaggccaggagttcaagaccagcctgggcaacttggcgaaactccgtttatactaaaaatacaaaaattagccgggcatagtggagtgcacttgtaatcccagctacttgggaggctaagccaggagaatcgcttgaatccgggaggcagaggttgcagtgagccaagatcgcgccactgccttccagcctgggcgacagagcgaaactccgtctcaaaaacaaacaaaaaccccaaaacacaaaaagacataaaaactatttggataactctagcatttacccaagatgttaaggaatctaaaagggagttcttaaagacaatagatgagacaaagccatttccagtgtcggcccatttaataaactggttccacctggattttctcttcattgtggtgaaagccaccacctaacaatgctggccctgcctgcatcatcgcatgtcatcatgacaacctatgggggagaacagctccattcaacagatgcagaaactgcaggttaaagggtgaaaagcagttgcgaagtccccacagcttggaaatggtggagccgagactgaaacccaggtgtgctagcatctaaagttcatgctctttccaccacattagactgtattctgagggcaccaaggaagctccatttttcttaagaaaccaaattgcagtcctccaggaccacagccaggggagcatcttcgtgggagagtggctgctgctcagagttgtgactcccatccttaagagtcctctgtcctctctggcctcctttctactgatcattgctgtccccttcacaggggagaggggccatggcctatcccctaaagagtctgccaaggtagactcataacctccccgtggcacagctcagacaagctgggctatttacataagacttgacccagggcttgaggacagcgcgaggaatgaggtgcagaggagactgctgcttctgggtgacagtctgcctggctgaccacagctggggtactcattggcctcttgaggccccccacaggcctgccctgcctgacctactcttgtgaggccaaggccatctcctccactctctgggggcctcttctgactcctccaaactcttccatgtctggactcctggcttctgcccaaggccatctattggagtttgggtttccagttgaggatctgcctttttcctggatgaccaaacctagaatgtgaccggcctcatgctccctcctcacaagggtgtggctttatccgagggcctcagcaaggcaaccaacaccagacatgaagctggtaagaccaacatccacctattcattccttcagcaaacatttactgtggacagcatcaggttggcagtatcatgcaaggctcagaaatatggtggaaaaccagacagatgcagttcctgtcctcagtctctaggctgccttcctagaggcccctcactgggtttcttagcagttttgtacagatcctaccccctttgctgccagcaggctcacctctgggacagggcgcatatagtctgggccagaacttgtcctggggtcttcttacggccctggttcagcttgcattcagcataacaacttagctagggagtgctgcaggccccaaatgatgctaaatactagactagctgtgtaacaccatctgcccagaatgaagggacaggtgaggcagaagggtctccgacagcgcacagggcaaccagtgaaagcgtccttactgtcctgttcctgaggtctctctgtgcctgctttactgcccttcgctttcctacagagcacactcagctcatcctgggagacaaggtgggggtggaggatggtccatccttcttccgcatcaaggtcagtaggttcagagctctgggggggtgctgagaccctgggacaggcttcctgctgagggcactggggcctatgcttgtgccactgcctagccagttgcctcccagagtagagaagcagtctcccaagctcttgcaatttgtggggagccaagctgctctggagaggggcctcaaagcttcagccagagaaaaggcaaacccagccaccctgagaatctcctcctccccctcaatcacaccctgcagaggcgtgatctgtccctgggttcgcaccaagcctgctattttgtttatgccacaattgatctgccatcccagtttgcaaagagcagacacttgggggctttattatgccactttgacaaaagctgtgaagctcgttcccacagcctgtctggtgccgccttcgcaaatggggccctggtgatggggccttcggagttcagctcagagagcatggaagtgagatggagaggccagcactgatctgtatcgtgcagccctgggcggcagcctcggttgggcccttgacacactcctcccatccaggcccccagccaccctgtgagggaggcactattacgcccaaaaatgcaggcaaggaaatgggctgagggaggggaagcattcactgaagttagtttgtacgtggctgagctggccctgaagcccatgccctttccacttgccagacagatgggaagtcttgactcattacccgctggagacttttcctgctgggctctgcactgtcaactgtgagagagggaaataaaacgtactgtacagtccaatctgggatacttctgagagtgaaagtggctctactagtaattaccccaggacagcatgtataaaccagggctgttccaagcaactgggacacatgattaaaatgcagattccatggcaggtcccgctcagaggtttatttagtgggtcagaaaatgggcccaggaatttcattttaacaaatgtctccagataaatctgatgtaaatggaatattcctttaagaatgccattcctttaagaaataatgttaataaggtattccagatgaccctattggttggaatctgtccaactacaaatattttgatttaaatttccattgacctaaaatttttgtggtgggcactgcagctctctccttaccaatcattctcccagcctgtactatattgagtagcagccaggctacttggagaacagactgaactccaggaatgggctctattagtctaggccaatcaggataatccagttccttaccatgactggctcaagaatgggtagacctaagtcaatcagtgcagagcattttcatgactacagagaaaccatgggaaggctgaggcgtggactcagtgggcagggatggaaaaagactcagaaatactgggcatggcccatggctcattagggttgccaggtaaaatacagaacacccagttaaatatgacttgggtaaacaagaaatcattttttaagtataagtatgtcccaaatattgcataggacatacttatactaaaatatagttgattatctgaaattcaaatttcactgggcatgctgtctttttatttcctaaacctggcaaccctactcatgactccacttgtcagcttggtacactcctctgagaagcttctcccaatattcccatctcatttgatccttcctgactggccagtgttgggattaagagcctcactttaatcaaggaacccaaggctcacacaaggctgagccctgcccagccaggccagcggccaggcctccccatgtccctctctctcctaacagggaggagtgggagatgggggagggctgtgggatggagggcggggctgccaacagcctgctccgtggctggaactgcgacatcgcctctctgggagtaggagtgggcttctggccagactcagtgggggaggactggacacttgagagggcactgggccaaagacttccctgggacatgtgccccagccctggtacctcagggctgcacatgtcagccatctccatgtcacacccccggggaggacaaccgaccaccgtggacaagccctgaaccttttgggaaagctggtgctaaaagaatagctggagaagtcactactgaggactgaaaatgcggagggtataataactgctgttgtgtatcgagcctcactatttccacgcaccgtgccaagtgctgcacgcgtatcaattcatttaatcctcacaacaactgcatgaggctccatgttttcactgattccaagtcacagcttttttcctctcatgttaacatctctaaaatcgtgcatcttacagtcaatggcctgatagtttatttggcagtattttaaattcctaatggtacgtaccatgatggtgtgttcataaccaatagtgtcttagatttgatgaactatagtggggatgattattgtccccagttgtgagattagtaaactgagttgcatttaacagataaagacattgaagttcagtaacttgcccaagatcacaaagcaagcacatggcagagatttgaaactagaggaaggagcttgcaatgtgataaagcagcaaatgtacaagagtttggaagaaggagaggtaggttgcttttggcaagagcagcaattctcaattctggctgcacaatagaatcacctggggaactgaaaataatccccaatccccgggtgcatccagaccagtttaggtcaacatcagaactgaggccttcctggtggaatgattaggaaagacatatggaagaagagatatttgtgttcagtcttaacaactgggtggggccgggcacggtggctcacacctgtaatcccagcactttaggaggctgaggcggttggatcgcttgagcccaggagttcaagaccagcctgggcaacatagtgggaccccatttctacaaaaaatttgaaaatcagctgggcgtggtggcgtgtgcctgtggtcctagctactcaggaggctgaagtgagaggatggcttgagccctggaggtcaaggctgcagtgagccatgactgcacccttgcactccagcctgggtgacagagcaagaccctgtttaaaaaaaaaaaaaagattaggtgggatttcaagagattgacagggagcagaggcctaggcttgggaaaggcatcccctgctgggacagtgcagtgcccagggccactgggcagggtgagggggttcagcctgctggtgaagcctggcccataggaaacgtccagtgactctggctgatggagcaggggaatctgtggaagaaggcaagggacaatgctggtgaggcaggagaagagggaattggggtaaccaaaggttaaggcgtaaaaacagtgggtgcagccagttctaggcaagattaggcagcacataggccacatcctcactcctgtgataagacagaagtttccacttcagcctctgattgattgtgggccaagctgtcacttcagcctctgattggtcacaggccagtccttcatggggtgtaactaaccctaggcctctaaagggcacctaggggtgctagcaaattcttttagctttataaaaaccctggggagaggcagaggttgcagtgagctgagatcatgtcactgcactccagcctgggtgacaaagcgcgactccgtctcaaaaaaaacccccaaaaacaaaaaacaatattcattcattcaacaaacatttatttgcacacggtgtagcaggctgtcataggcattagggatacagctttaaacaaaacagacaacattgactatcctggagcacacattctagtaacaataagcaaacaaacaaatttgtaaatagcataaaaaaaaaaaaccctggggagcactgcagtagagaggctcttgggccacctgcttgagtctgctcccactttgtggaatgtacttttgcctcaataaatctgtgcttttattactgcttttttctttttctttttttaaagtttattctttgagacaggatcttgctctgtcacccaggctggagtgcagtggtatgatcttagttcactgcaacctctgccccctgggctcaagtgatcctcctgcctcagcctccagagtagctgggactacaggcacccaccaccacacctggcaaccgttcttttgttgctttgtctttcattgctttattcttttgttgctttgtaagggtttttctattctttgtttaacgtgccaagaacctggacaactcacagtcaaggcgttccatctggtaacattgggagcacctcctagccacctgggactcaggttgaccctacaggagctttgtgaagtgagcattgcctggcacttttaggtgccagcatccaagcctagcacctggcattgtgccctgctctgtagaaacttctaggatctggtaagcctcatgttcagaagacaaactcagcaagtcttaactcctgcaggcttgggaagggcctccctcggagagctgagagcagaactaggaacagggacggtggtttcaggctctggcgcctccacctgctaaggaggtgacatggacacattccttaccttctcggaccctcgcttctccctctaaaaatggcccaatgccctacttatttatttattttttatttttttgagacaggctcactctgtcgcccaggctggagtgcagtggtgtgatcttggctcactgcaacctccacctcccaggttcaagccattctcctgccacagcctcccaagtagctgggactacaggtgcgtgccaccacatctggctaatttttgtatttttagtagagacggggttttaccatgttggccaggctggtctccaactcctgacctcaggtgatctgcccaccttggcctcccaaagtgctgggattacatgagtgcgccactgtgcccggcccactgccctacctctgaatgtcactgtgaagattaaatgaggatgtagttcccacatgcatcccacagtgcccgggacatagtaagctccccaaaagcaccaagcttagctgggaagcacgatgggtgaggcatggaccttatttcacagcaaagtggctcaggtgaggcaggcaaggaatgggcaaatcacgacatgacatatggatttccatggcagggaaatgcccccgtaggcacagtcaagcctggctctaccattggctcgccgttctcctacctcgctgggcctccatctccccacctctggctcacttcctgctttggcccctacgctgggtaggaggcccggctagaggttaggcaccatcttttccagtccccaaagtgagagtgtgtgtgtgtgggagagatatttttaaatggggctgttgtggaaaagctgagaccgtgggctgctctatttgttggcgcttgctggtttgtctgatttgcagagctggatggactgctccctgaggacagaagctcttggttttcttccctccgaagccaggcgtggggtgggagcatccagtgcacccctcttgcattgggtgcgcagtgatccggacagagaggctccagtcagccaggcacagagaaaatggccctctgcccctgttctgcttgtttttgtcttgttctctgggggcctttgaggtgactttcttcatttgatgacaacaagatgggaggcggggacagctgaggtggcaggagtaggggagctagggacagaggatgaaccccacaggctcaggccagtgacttctaacattagagaggttttggttaactgggagcaaatgcaagtgacttctttgaatcgactttgtacctcggcacagccttccttgctagcagggctgacttcaaccaccccccactctgtgctttatctctgggattaaggttttctctcctcaccagaaatcattcagcaaaatgagttattaaaagccggttaaccactcctgcctccgggtagctcccgtttaacaacctctcctggggagcagctgtcaagctcggccctgagctggcgggaagatgactcatttacatacagcccgtctccaggccccccccaccgccaccccaagatctgtccctgtctccctgatgactaatcctttccagggatgagatcactgccccttctaacccccccccccgcccccacacacagaaagagcagagccctcatctcagcccagaattttgggagaagactaaatccaagaccaagggaggcctttgatgggacaaagacgtgactgatgaacccggagtgaggagcaatgagatgaagaaagctctgcccacctaccccgtccctcactcctccctcccacctcagggcgctcatgtggggcttgtgtggggaacagctccagggtcataccacctctcagaagggagacagaccagccaggcgtgaggtgacagaccagcgggcagctcagagcagcaagacaatgtcaattcaatcactttacctcaattcctctatcacacaggaggagattttaaaaggaagtctctggtggtttgtaaagcaacaaatcctgctctcaagtggatagttccaagccctctcaatgaattcagttttatacacctggagaagcacagcctcgtcctttccatggagctacaagccacatctgggggcgctcagtgcccaggctgagggggcacgcagagccctcggggacgactcaatgcacagaggccactccttaagggcccggctccctcaaactgaggtgtccccatgcttggtcttcccacagaagccagcctggttggctgcttcaaaggaggaataaagatgaggagccatgatgcaaacaaacccacacctttcagctgcagccagggaggtgctctagaggcccacggagagctgtgtgtctgctctgctagcccgacctgcacctgccctatgggctggtaaaggggctgcccacagcacctcagcacatgggtctctctctcttttcatccagcccaaaatgtcaaagcacaagggtctctgtcagggcctggctgtggtcactggactgcggctgaggggtaaggtgcacccctcctctaatgggggcgcacccctcctctaatgggggtggggctggagctaatggcacattccactctcagctgccacacacagatggggaggttgatggcccgcacacaggaagtgagggatggtggggactgaatttatggagcccctatcccagaccaagcactctgctggtactttcacaggtgtaatccccagagcagctcctgggggaggtgtcattatgccggtgaggaaaccaaggctcagagaagtaaggcagcacaggtcccagccccactccacctcttgaggcctgactcagccttaggttcagagaatgcaactgtgatttttccctgagatgagcattcaatcatactgcgccagggtacttgctgtggccaaaacgcctgccctggatctgtggcatgactttgtgtcagaccctgtgcgatagaaggagatggaagctgaggttcagagacgttaatgaccttgaaggtcagggtcacagaaaatggcacaaccgggattgcaactcagttctgcccaatttcaaatctaccttcctgccacctccttgccttgcctattgtccccctcccttcatatgacctgggacccagactccctggttttctggaaatattctctctccttttggctcattctgtgcactgtcccagttggtggtattgaggcacagctctgcccagatcactctccagctcagctgccctgagctccccagccccacctttcaaggtcaggaatgacttatttccttttctcttcgcctgtctgaatcctcgccatcatctgacagcactttcagctcaccaggcatttaactgtgtgctgtcttgtgacagcccctgtcctgaccattgtcccagagatttaaccctttgtgtttttctatgttagcttgccagtgaggacatggcccatgtcttggacttcttgccaccctccagaatgcaggtcctcagggagcagctgctaaattcccaacagaactgacagtttgtccagtgatcaccagcagacactgtaccagaaacattgtctccatcttagtttcagttaactcaacatgtttttgagacctgctgtgtgccagacatgagggcaggggaaggaagactatggtgaataagattgcccacagacctccaggaacacacctgtagtcaaaacacaattgagcttactggctcactgcaatgaggaagcttggccaccatggattctggggcatctcagtcagagggtatcaaagagggctaattctaggagttgggcttgagttcttgagttaggtgatttatggaggacttaaggaagcaggcttcgctctggatgggatgctgccaaagagcggaagtacttctatgactgggcatcttaattcttagctggaagatgggaacgacatagcgaggccaagctgtgattggccaagaagcagcagttgctcatactaaccagatgagggatgtttggtctttttagtggtttggacgatgttcttgttttggtctgtgtttggacatgattatggggtgaatggtcttgtttttctctcactccatcttggtcataaggcggccttgcctgatcaggggttctgtgaaatgcttatgctccatggcagatcctcccagccccactgtgagtgccaggccagctctcggcgctcaggggctgccttcatctttctcaaaatgctgctgtgctttgcagcccataatagcattttactggatgccattcattattttttgtaaatgaaattctttccaagtgttccaatttacttggctatatatgtgcatgtgtgcacacacgcgtacttaattccgtacatggagcacactgctcagttgtgaaaatgggtgattttctttcttttttttttttgagatggcatcttgctctgtcgcccaggctggagtgcactggcgcgatctcagctctctgcaacctccgcctcccgggttcaagtgattctcctgcctcagcctcctgagtagctgggattacaggcgcccaccacgacgcccagctaatttttatatttttaatagagacagggtttcatcatgttggccaggatggtctcaatctcttgacctcgtgatccgcccgcctcggtctcccaaagtgctgggattacaggcgtgagccaccgcgcccagctgtgattttcattttaagtttcttctatttgcttttataaatatttcacattttctgtggtgcaaataggatagttgctacttttgaaaccgtaagttcactcccaacaagcactgttaagtttataaataaaaatgaataagatatgatccctgtcctcatacataatgaccacaatgccctatgaaaatgacagtaagggagatgtcaggggattccgggaagcaagagaagcggtttgggagggtgccccagagcaggtgccattggaactgagtagtgaagatgccttagccaggagatggaggcagttgggcacaaggtctgcaaggtccaggttggcattcaagggttcaggtgtcatgtggataagactttccagggagcacgtgtggtatgagaatgaaggcccctgaggaacttcagtatctaaagggcagaagaggagtctatgaaggagaccacattcattcaacaaacatttattgagggcctactgtggccaggaactgtgctaggcccttgggattcaacagtgatctaaaagacaaagtcccctaccctcaagaagcttacatttcagtatgggagatggaataataaactacaaacaattacgtggcctgtgagaaagtggcaagtactacaaaaaataaaaaatagagcaggctaagagggtgaggagtgtgcgggcagggaggaggcaggtcatggttttaagtggggtgggtccagggaggcctcgttaaggaacggatgtttgataaaggactagggtaagagtgtttcaggctagtcaacagcacgagcaaaggccctgaggcagaggggctggaaacagagaagaaaagagtgaaaaaggactgggcatggtggctcatgtctgtaatcccagcactttgggaggctgagacaggtggatcacttgaggtcaggagtttgagaccagcctggccaacatggtgaaaccccgtctctactaaaaatacaaaaattagccaggcatggtggtgcatgcctgtaatcccagttacttggaaggctgaggcaggagaatcatttgaacccaggaggcagaggctgcagtgagcctagactgcaccactgcactctagcctgggtgacagagaaaacaatggacaaagagattagccagcaaatccctcctgcacactttcagggcaaagtttaggtgatataaatgtccctgaaatgagaaaaaccatgactttcatttgattttaatgtgagggagaaacataaactagtagttttacaaaaagaaaaagaaatataatattcaagtagatttcaagcaacagcagatatgctgaatttatttgataactgtcttctttttctctgtcagcagagtctcatgcaattttaaaaggaaattcgatgaaacgaacacccatcaacatctttaatagctgcaagcaatgtggagcaaattttttgtcttatttaatgtggtcatcaccataacccagtaaagacaatatcatcattgctcccattttgtagacagggaaactgaatccaggataaataatgtagcttgcatgacaccaatcttcctcaagtctgagccagaatttatatctcccatttctcaacctcatctctcaagcctataatctttcagttataagaagggaaacacttgagggtgtatcagtttgtgttttgttcatagtgtttatatgctctcaatcaaggactgtttattaaaaaattttaggaggtggtagtcaaaaagtgtctctggctgcagtactggggacagactgcaggggtgagttcagcgagtctagttcagaggctgtggatcaaacaggtggggtggcccagaccaggagagtagccaaaaggggactaaggaagggaggccaaagggaggccacaaacgcaggagaggatgaaggtgctgaagctagaggccattcaggaaggaaggaatgacggggcaaggggtcagaaatttctagaagaatctagtaagatggaaacctaacagtcctactgggatttggcaactgggaggaagctggctctgtgcaggaaagaagggggcaccgctgtgcggacgccagactgcgaagggctgcagaaggagccgaaaggggaagaaacggacgcaggtaggggtggctgctgttaaagccgcttcccggggaggccaaggacatccacagctgaagtgctcaggaccatccacagctgaagtgctcagacactgcgttttctttatctcagagaggctgtgtgacttgcccacgtatgagtacagtggctaaatcacaagccctggagtcaagggtttaggttgatccagcccccactactcactggtggctgtcagcaagctactcgctgtgcctcagtttccccatctatcaagtagacagcactgccttacagatggttgtggggatcagaggggaggggacagctggcggatttagcagagtacgtggcacagaggaaacactaaatatgcttcttcagctccttatcaaggttaggcctccacaaagggtggagcagggaagagaaggcctcaccgggcagacctatcttggagaagatacaagcaatggtgctgaagtttcacaacagtgtcaaccccctccctcatgtgtgtactcacagctactcactttcctactctgtgccagccatgaggtgtagtcactgtgccagggggctgagtgtccggcctgggacgtgagagggcatgggctcacctgctcagggtttgaatgagaccccggtaaccgcagcagtaaagacccctcaaatgccatctctaaattaaaatgggtgatcagaaaatagcaggtgaacgatagtgccctcactgcccacagaagtgccttcagtcagatttagcgctccatcttctgcctttctgaagggacagtggaagcatccatttgaagactcttcctgtgtcttctgcaaaaccaaagaaaagccatcactgccgatgtctctctttaaagatctgttaggctaggcacggtggcttatgcctgtcatgccagcactttgggaggccaaggcagggggattgcttgaggccaggagtttgggaccagcctgggcaacatggtgagactccatccctagaaacaattaaaaacaaacaaacaaacaaacaaacaaaagcaagctgggcatggtggctcacacctgtagttccagctactcaggaggctgaggcaggattgtttgagcccaggaggtcaaggctggagtgagctgtgattctaccactgcactccagcctgggcaacagagtgagaccctgtctctacataaatcagtaagatccatctgtgcaattccttcctcctagaattcagaatctgaggtgctggtttcctgaggacacttgtgacttgctgccttttattgaactctgagtgccctattgcccagtttgagtgttccaatgggaagtgcagagccaccgtggccattcattgctgtagagctgcgccccagtacctgatacatccctcacccttttccaattgatttttagcttccttcatccctccctctttcccttgtcctcttcgtgtccacaggaagcctgttgggagcctgctatggcaagtgctgtgctaggacacggtcctgcactcttagagtttgtggttcagttattccagtttcagcacttacattcattcaaatgctttgtggaagcaagctggcttttagtcaccagcaatagcaatttctgaaaatcaccaagccacaccaaatatatgaaatatctttctctaaggtggtctttaaaatttgggctgactctcctccctctaggaatgttctgatgagtttcagtctgaaggcagggagatggtctcggtgacctcctgggcccctgttctgcactgaactgtatgcccatacattcataggttgagatcgtaacactccagtacctcagaatgttactgcattggtagaaaggctttttaaaaaagggaatcaaggtaaaacgaggccattagggtgagccctaatccaatatggctggtgtcctcacaggaagagtgtattaagatacagacatacacaaggaaaaccacgtgaagatatggagaaggtggttgtctgcaagccaaggagagagtcctcaggagaaaccaaccctgccagccccttgatcttagacttctggcctccagaattgtgagaaaatacatttccattgtttaagtcccccagtccgtggtactttgttatggcagccggaaggagactggggccgcctgtttgcttggctgcagaagccccacgtggctgcaccctggctcattctgttttctgtagcagcagcagcagcagcagcggcagcagggagcccaggatgcaaagcttggtttctgagccctgatcaggaggctgtgtttatatttatcctgctaactgcaggggactgtttattcccagagaaataacctcctgggcaggataggggcagccaaggaaccagctgcttccatcaggcctgctgggctcctccaggttctcatcataccacttctgtcgaggctctctctgacgcagctctcctcactccacaccaggcttgggcccaggggcacagcctggtcttcctgaggatgctcagacgcagggaccgactgctcctcacaagcaccctggcacatgcacagcccagggactggagccttcgcaaacaagtcacagtcctagtctgagattcagtgcaacactaggcgcttagtagatgctcagtaaacagaacaacaaggattttcttttttagttttaaaacattagtctacccatgccttgataaactgtaaaatgcctctgccacccattctcccttcttgctccctttcatgggagctctgaggggaaggtctctggggtgggttccagcaaccctgggcctgttctggggtcctgcagccaggttgggctttcaggagcctatatttcatctgggccccagtcacactacatagatttttgttttatcacagaaatcactgccacactgtgacccttaaggtcctcagcagggatggcgcgaggtgagagtatcaaagccaggtgagagcactcagatggcttctgcctttgaacgtgtgagaagctcactcatgcacagcgacaagcaagaaagacatgggaaactgacaggttttcatcactggctagtgaaaacacattttatacttctgggccaacaaatacttgggtcaattcacacattggcttgagaatgagttctttttctttttctttatttatttagagatggggtctcactgtgttgccaagcctggagtgcagtggctactcacaggcacaatcataacgcgctacagcctcaaacctctgagctcaagagatcctcccacctcagcctccgagtagctgggactgtaggtgtgcactactgtgcttggccaacgtgttcttttttgaggtgggaactttaatttacttgagcagatgtatcaacgtagctgtgaataaggagctaccagggcattagactgcagactctgacacaaccaccgtcaccacaataaatagcaacaaccaccaccacaacaagcacagacacctacatttttttttttttttttagctttgattactacactgtgttgctttcctcactgaggcttatgtggggttttctggttttaggaatcattttcacacacggtttatttacatttcttcacaaccacctagtgaggtaagcattatcctcggtttttagatgcacaatctgaggctcagaaaagtgcagtgtgaggtcactttgtgaataagtcatagaggtaatgtcagaatttgggtcagagactccacaagggctgaccctccttgcggttctctgaagacactgtagaaacccgtgggaagctctgctgtattgctgggtgctcctgttctgtggcaagacaacctagaaggtgatagggggtcttctccgagacatgtgctctgctggctctttggcagaaagggcagagtcggggatcaggacggtcatgcaggctggcactgcccaggggctgatcttccaggagctgggctagcaagctcgggatgggggatgggtcattccctccttctccccactgtcactataattctggagatctgtaaaaggatgtttaacatgtttaaagtctttgtttcccatccttctgccaaggattgagacatcgcccacccagcttcaatcctcatagctacttctgccactgatgggaggaggattgaggttctttctaccaaggagccaggaggatggctgtcactgctcctggaagcagggactcccagatgtggggataagtacgcagggcctgccttccctccactcttggtggcttccaaaggccaacattctagaaagccaaccacccatgtctcctctctttctattggagtgactctgctgcttcaacagagtattaaaaacaaagacagccttccaccctgacgtcagacacacagacacacgagcacgagcatcttgtactaccctgtgcccccattccccatcagcatacacgtggtgtttcggggataaagctacaccaaaggaaccctcccatacaggcttggtacagtctcagcctgtaacgcttccctttcgaagagctgtccctccagcaaggcctcataacccagggaacccctggcatctctgccgagggcataaaccatattagctctgaatcataaagaatgtttactgagaaccacatttgggaagacctttctctttcaaaccctttcttcccaggcccccagtgatggctaacaccattgttcgcagcgttcctactgaaacacattggtcgtgtgtactttcttgtctaactcatagattgcaaaagctataatttcatgggatttgttttaagcgcccttttctggcagatgtaggctcagtatgagcactctgtaattttccagcctcctaaatggccccctggcagcttacataccacatggtgtaacccacccttttcctatcctgcagacaacccaattactcacacagtcttcaccagggccctcctaggtgggtcccccaggctaggtcctgtgggggatgcagttgcacttataacaaaccatggcacatcctttctgaggaatactatgcatccaacaagagggatgcttagaaagttgattctgacatcacataccaatacacaaaaacaaaacccaaaattcatccagaaaatagactcaaggacaaaaaaatccctggagtactattttagtggtgaagctaaaggctttttttccctgtcactttttttgagcttctctctttttcaaatgttctataagaagtatctgttattcgagtgaattaaagaccactcgttttgtcattatttttaaaggcagagtctcaccgtctgggtggggagggaagtcatacacaagagaggagatggcaaggtgctaggaggttagatcatcactggcagaaggcaaatgaaggaggaggctccatgaagcctggatgatgaaggtgggctctgaagagggagtgggccttagatacatgaagggtaaaggacaggcagggatgctccaggcagggagaatgctatgaatgaagactggagggacagttcagggtcttgctgactagtttggctggaggaaaggctgcagtgagggtagcattagccacacttgggcttggaaaggctggggaccactgaaatgcaaagtagcttcccctgaaagaaaccagggaggctgctgtcagagagtggaccctttgggaagcctggatacagatggatgtcttttcccaattcagtcatttataagtagctcatatgtctctcaattcctcatcattttcgcagcaccaactttgtgggggagtagggggactagctgtggagtcagggacacctgggctagaatctcagctctgtcacttgctggctctttgatctgagaaagccattgagcctctttttgcctcaatttcctcatctgtaaatgagatgtgagctgtgctcacctccacaggatgctgatgaggattaaatgagaagaagtgtgtaaaatgctcagcatagtgctaatagcatgaccacctcaaaatgcaagccatttgtgctaactgatggacagcaaggaacagaatttctaaagagagtagataagaaaaaaatagagaagaggaggtcatggaatataaagccgagactgaattgcacttaacttcttttttttttttttctcaaataatttgctcagggctggggcagccagtatcatctacatgctctctccctcagggaggaacccatccaacactaaacttccagagaaagaggcaactatggacagggaaaagctgtaaatgaagcaagtgtcataagttcttcagtaacaccctctctcttattcaaaaacttccagtggcttcctagggtctagaactgtgagtcccaatgatcaggcttggaatcctttgggaactctgcagttattgcaaaggcatatcaatctacttggtcaccaattgttgtttgcaaccttaactttctcctacatggttatgctattactttccaaaaatatgtaaatggttttctgatgaagatgcacttaaaagtgctactgaattaattcagaggactttgtgtgtcaatatgcattttccctattaattaacggatactgaaagtacatgtaacttccatcatacaggtgctgtgaaactattcctcgcatttaaagcgattctcatgtttaaaaagttggaagcagcctaagcaaaatggcaaagccccatctctacaaaaactacaaaaattagacaggtgtggtagcgagcacctatagtcccagatactggggaggctgaggtgggaggatcttttgagccagggaggttgaggctgcagtaagctgtgatcatgccactgcactccagcctgggtgacagagagagactctcagtgtcaaaaaaatagttgggagacttctggttcaagatgattatttaattacctcaatttacctactctccctcttaagatcctatttaaatgatggtaaaaggacataaaggtgtaaactagcaataacacagggaatgggcagagggtttacagtggaagggcccgagaagtttcaacatgcttgtgcaagatggacagcttgagagagctgtaactgatgaaggcaggtggagaaacccacagctcagagggagtacagctgagaaggggagggagggaggggaactgccctgaagaaccctggagagacttgggtgtgggaaaggccatatagataatgggtagctgcccaccctctgccccaaaaagaaagcccgcagtccacaagccccacctatgcacactgagtttccagtccaattttctatttttaattcttaaatgtgagtggacagccacagttcagacatttgaggaaagcctgtaagccctctcttgcagctcctcctagcttagcctccttcatcttcaagggcactgcggctcaatcttcagatctcttcttttctggctcccacgaacacgccctgggactctgtggttctaaccttgacagcaactgaaattactctcatgaggagttttacaaaatgctaattcataagcccccacttccagagagaatgatacagttggttagggcacaacctgggcatcaaggcttaaaaactcccaggtaattttaatatgcagccagggttgagaaccactctcctaggtgatcttttctttttctttttgcgtctgggtctggctctattgcccaggctggagtgcaatggcacgatcatagctcactgcatccttgaattcctggcctcaagtgatcctcccacctcagcttccagagccccctagctgacattggcagggctttatttatttatttatttacttttgagatggagtctcattctgtcacccaggctggagtgcagtaccatgatcttgactcacagcaacctctgcctccctgtttcaagcgagtctcctgcctcagcctcccaaatagctgggattagaggcatctgccaccatacttggcgaatttttatatttttagtagagagggggtttcaccgtgttggccaggctggtctcgaactcctaccacatataagtggttctcactcctggctacatattagagttgatatggtttggatttgtgtccctgcccaaatctcatgttgaattataatccccaatgttggaggaggggcgtggtgggaagtgattggaacatgggggtggatttcccccttgccgttctcatgatagtaagttctcatgagatctggttgtttaaaagtgtgtagcaccttcccctttgctctcttcctcctgctccagccatgaaggacgtgtctgcttcctctttgccttctgacatgattgtaagttccctgaggcctctcctgccaagcttcctgtagcttgcagaaccgtaagccaattaatcttcttttctttataaattacccactctcaggtatcttcttcagtgatgataacattgctttagccagggttaagaaccagtggtctataggctggcaaatcccaaatttgtatctcaaacccaacctgtcccttgagttctagactggcctatccactatctaactggcacccggcttggaagtggaaaagtcatttcagaattaacatttccaaaaccaagctcttgattctccctcccaaccagcccctccttgattccacttcagccttccctatctcagtaaatggcaaatccatccttgcagttgctaagggcaaaagtcttagagcccttttttattcttttgctttctctcacaccctacatctgatccaggaacaaatcgtgccaccctactgtcaacacttatccagattctacacactgactttcgcttcaggccacgagggcgtagctgaatccagacttccctcccaccataatcaaccaggaaaccggaaaaagtctatgagataattattttcagacattggaaaaaaggtagttcaggattatggtccctgagagaagggaaacaaacaaggtgagcccttcaaaagccctggtttttgcctggtggcagctttcagacagccatgggagtggagagatccagacagagcccagaactcttgctgaattgaggggagagaaattcaggttcagggaggataaagcagctgtcactgcttaactgctgtaactactgtggagcactggagaggaaggaaccatcaagaaaaaggactccagaaatctactaggggtccctctttgttactcgcaaaggtctgaataacaatctgtgcaggtacagggtaaaacctagaaaaaaataagaccaaggaaaacaacttccaggaaatcacaatttccagagagctgtaaaccaaacaatttccagagccctcacaaagccaggaatcacctgagttcctatcagtcaaaggaggaaaggtttcactgaatccacaaggcattcagtagagaccccaaaaaggttattctttaatagtgtggctcatctagtcccagagaaaagactcctttagacctgcctttaaaaagcttaaaaacaagtctggaaaatatcaactgatctataaagaactgtctggcagaacaaagtccaaccctgcttgaaagagtacaaaacaatcaagcatcaacaatgtaaaattcatgatgttctgatctctaataaaaaatcagatatgcaaagaagcaggaagatgtgacccagaaataagagaaaaatagtcaatagaaacagacccagaaatgccagagattatggaattagcaaaggcatttaaatacctgttaaaatatgtaaaatatgctcaagatttaaaggagaaacataatgatgagaaaaatgggaaaaatttttttaaaaccaagtagaatatctcgagatgaaaaatatagggggctgggtgcggtggctcacgcctgtaatcccagcactttgggaggccaagatgggcggatcacgaggtcaggagttcgagaccagcctggccaaaatggtgaaaccccgtctctactaaaaatacaaaaattagccaggcgcagtggcgggcgcctgtaattctagctactcaggaggctgaggcaggagaattgcttgaacccaggaggcagaggttgcagtgagctgagatcgcaccactgcactccagcctgggtgactgagcaagactccacctcgaaaaaaaaaaaaaggaaaaatatcatgtctgaaatgaaaaattcactgaatagagttaacaacatactaaagactgctgaaaaaggttgaacttgaagacatagcaatagaactattcaaaataaagcactgtaaccaaaaaaagactgaaaagagcctcagctacctgcagaacaatgtaaattaagactaacatatgtgcagttggagttcaaaaagagaggatagggtagcaaaaataatatttgaagcaataatgtcaatctttccaaatttgagaaaatttataaacacgcagatccaaggagctctataaacacaaaggaaactacacaaaggcacatcaaaatcaacttgttgaaagtcaggaatgaagagaaatcttaacagcagccaaagaaaggaggcacaattacttacagatagagaaaaatattcacagacttttttttttttttttttttttgagatggagtcttgctctgtcacccaggctggagtgcagtggcatgatcttggctctctgcaacctctgcctcccgggttcaagtgattctcctgcctcagcctcccgagtagctgggattacaagcgtgtcccaccatgcccggctaatttttgtacttttagtagagacagggtttcaccatgctggccaggctggtctcaaactcctgacctcaagtgacccacccgcctcggcctcccaaagtgttgggattacaggtgtgagccaccacacctggccacagacgtcttatcagaaactatgcaagccagaaaacaatctttaaggtgctaaaagaaacaggaaaacaaaacaatgaaaaaaaccccacacttcagtaaatatgcatttcttttctgaaagatataatcacttctcactgcctccaccaaacatgccccggtccaaatcatcatcatctctcacctggaatatttcaaaagcctgctaatgagtccccacacttctatatttcccccgtacagttttttttgaacagcaatgagtggtcttagaaatcagatcatgttatgcctcttttgtctccctgctttttttaacctaagttttgcctcaggatctaatcatgcttcttctcaaaatcctcccgtggctccccatttcactcagagtaaaacccaaaggtcttgccgtggcctggagaccctgcatgacctagtctctggctactgctctgagctcacattctaactcccacttgcccctcctccaaacactattccagacacactggcttccttgcggctcctccagcaaaccctgcaagctcctcctaagggaccctggcactggctggagccctcttcctccaggcagccacatggctcactcccttacctcattccaagcctccactcaggggtcacatcatccaagagaccctttcagaccaccctacttccatcactttattcttaccctggttttgttctttttgcagcatttaccaccacctgacatttatttgtatgtttattttctatctcccccaactagaatgttagctccataagctagggactttgtctacttgttcactgctgtatccctggggattttcagttgctggcacatagtggagcgctcaagaaatatttgttgaataaatggatcaatgggaatcatgttttctggatgccaaattagaatacagggcctgctaactgttctggaaagtatgacgtgtgaaatcagtattaccccctaccccacacggcaccatatttttctggagctctccagttctagactcgttgacacataaaaatattttggtgctagtcctggggaaggcagattattggtttaagattcagttctagccacaggctgcactgtgcataaatctaggggactacatggagttctgaatgacatgtgtctcactacagtggcattacagagaaagcctggaaacattacaagggagtagagccagggccttgtagatactggctcattcaatcctgcaacccagaggagctgggcctcctcctgaagggcctgcatcacctccttccttcttgtttggccctggggacgaccggtggtggggaggtggggggaaggtcaggaactgagatagaatttatcagcgtgctggctccgagtctgcagctaggatgccctttagccacaaacagctataaaagaataagctttatggaaaaacattaaaaaagaaataaagcaagaatgtagatggaagtgaaggggactctagggacaaaaatgctatgaattaaggtcattgccacacaccaacctctgctgcacccccgcctccaccaatggtagtgcctttcccacctgcagggcacagggggctgccctcagcaatctccgagcagtgaggggagggctgccctgctgagcccagctttggaggaggggtatcctcctccagcctcagcctgcttcattccccacttcctttgtggctgcagcatcttcaactgccttccccccattatgagacatgcccacaaatctccagatgcattgttagaaaccctggggccctgtagagcctggcggctcatgcctgtaatcccaacactttgggaggctaaagtggacagattacttgagtccaggagttcgagaccatcctggccaacatggtgaaaccccatctctactaaaaatacaaaaattagctgggcatggtggtgcatgtctgtaatcccagctactcaggaggctgaggcacaagaaccacttgaacccaggaggcagaggttgcagtgagcagggatcgcaccactccactccagcctggatgacagagtgagactctggctccaaaaaaaagaaaaaaaaaggaaagaaatccccaggcccacggtcagcccctttgcctagatcttcctgtgtgggcatgatgtcaagaaatgaggggggaatggagagcaagaagacccaagatcagcagaggtcttgttgagtcttgttgagtgccgataaccaaattctgtctttggctcctgaaaatatctcttaccccttttcttttgctcctttccaaaggccacatgatcccccagttcctatccctagtcccctctacccaattcatcctgccacaaatattcagcatcctgggctgccatataaacaaatgaacaaacatttactggttctcaggctatgcaagggtcctccccatgaccctgtgaggtagacctcattgcaagagtatatagctcttcagtccaatgtgacgaattctgctctttgtttaaagtgtgaacaccagtagctataaaataaaattataacgcatagattatgaaccacttagagcgcgtaaagaaacaagtcatgttggcagtcctcttgaataagtttggaatcatatagcagttcagagctgaatatacaaactaagcacatattcctcagtgatttatcactgatagagatatataagctgttttttttggtggggtgggggggcacccaggatctcactctgtcacccaggcagaagtacagtggtaagctcttgataaagtgaggggacagttgataatggcctgatttaatgtttgaggtgaacagccaaaacaagggacttcacaattatctggttgtttgaaggtagttctagagactaacagtttagactaacgaggttgcctgacttaacggcataactatatagtgactaaagtgccagaatcttcttctaaaatagtcatgatcacattacacccctgttcaagaactccagtggtttcctgttgcccccataccaagtttaaatgtttccacctggctttcaaagccctccaatatgaccttaacctattgaagcagtttcacctgtcattgttccttaacttgcttaaggcaggctggtcctgacctcactcacactgttctttcaaacctgcctaccctgcaacctgagaggtggcatcagacatactggaaagaacaaaagatctggggtcagagaactcagctcagggtttagctttgccacttacatgtgaactcagccagattatctattaataaaaatataagcccacattaaagtgcttatgaaataccagggccagactaagtacctgcattcattgtctcatataattctcccaaccaccacatgatacaggtgttattatgattcccattttataaatgttaaaatggaagctttggaagttcatctattcaacaaacacaaggtactgtgctaggcaatgggaatataatagtggacaagagagacaagaaccctgttctcatggagcagggagtgagcagaggtcagggaacaaacaaacacataaacacgttatttgctcatgaacaggatgatttccaaaaacggtacatgttctaaggacaataaggcagaatagtgtgagggacagtgactaggggttagtgggggacactactgtaatcagggggaccagggaaggctcctcaagggtgacattttagctttagatatgaggcttgaatgtggttaagagaagtcagccatgccgtgactcacagagcagtgcgccaggcagcaggaacagcaagtgttaagtgcccagaagtctgatctgggtaagtccagcgtggctgtagtgcattgagtgaaggggaaagcagtgccagtgaggctaagaggggtcagggccaaattatgcagggccttgagtgtcatggtgaagagtcagattttttgcaacaggaagtcactgaaggatttcaaacaagcaaaggacttggcctgacttccgcttttaaagatctctttggctgtgtgtgaagaacaggctgtcaaggagcatagagaaagctgggggattggttagaacgctaacttagttgccccagcaagaaatgatggtgacagctggagtagactggtcgtgatgggcagcgagacaagtggatggaatcagaatgtattatgcggattgagctgacaagagttgatgatgaattggatatgaaagtttaggaaaaaaagaggaatcaggacaactctttatatggatgacatttattgatatgaagactcatggagcagtgtaccaaggagcaggaacagcttgtgaggggaacagtcaagagtgggatatagcaggaatcaggagttctattttgggcttttaaaagttttgatacatattgaatatccatgtggagatgtcaagtgggcagttggacccatggttctgaagcttagtgtagaagatgggttattcatcaatagataaatgggtttaaagccaaagggtgtgagggggatcagagtatgccatccccaaatatgtcactttagcacaaggattgttttgagctgcaggcaatttggaagcagcagatgcaaagaaagctccttatcctcccctatctgcctaaaggcaggacataaatttccctttgccaaggtgtcctccttaccctctctgtactcttaatcactggggaccccactgtcactctagagattttacaagattgagtctgcataacaaaccttactaaaaccaaagcttattctccattagtttccctcctatatttatcttcccataatttaccacttctagaagtccaaactccttttatctcatcattacttcacaatttatcactctttgttaaaatggtatacaacttctttttaggtaattccttttctatgaaggcctccatatgtatatgcaataaatcttttctcctattaatctgtcttttaattcagggccctagcggctgaaaataagaaaatgtaggggaaaagcttttcctctacaggtgagagattgtttggagacagtccagagtgaggactgagcatggggccctctcatactgaaaggtcacatagagatccagcaaaaaggaccaaggaaagcagccagtgaggatcaaggacagcatgatgttctggaagccaagagaaaagaggagtttgaggataaatggtcagccatgtcaaatgttgctgagatgctgaggacaggcaagtcatcactggatttttttaggaagggggccactagggaccttacaataacgtagtcactggaaaggtggggctggactcctgattgaggtggatccaggggagaagggcaggtgagggagaggttgactactcttctcagaagctttcctgtaaaggagggcagagaaatgggaaagtagcaggagggtgatgcagggtctattaagaaggaagaatatacatgtttgcataccgatggagtataaattaacaatgcatggggagtgggtaatgacaggaactaagccctggaggaagttagaggaagtgagacccagtgaagctggcatttgtaagtgggcacttcatccactgccacaggagagaaagcagctccacatggtgggtggatttaggggtgtgaagattacttctgattacttttattacctcaatggagtgtgaaagaaaggtagttagcagagagtgaggggaatgggaggctaaagatggaagagggaggataagtggtggacacagtaggaagtacagtgggatgtggggggtgctgccagtgtggagtgtccagctggtactcagggtcaccaatttaaagttggaccagtcagcatctctgcatagtttgttagccatattcagctgcttgagggcagatgaagaatacgtgggaagttggtattttgataggggtacaacatagggagagaggggcaaggaagttaagggtctctgaaaagggaatgaatccaagctgagttaaaaaagaaatgcaggctcaaagaagatggtggaaaaataagagtgggagtgtaaaggacctgtaggtcttacagccaaaggattatgatctcacccaaacagggtgatatcagaggatgggagctggaagcatgggaggtggtggtcagaggtgagatgtttagagtcaaaaactttgaaggtaatgcagttactagtaatagcaaggacatacatagatagaaccaaatgacctgctggggtgggatggaaagaaatatggttatagatgagatggttaaggagcccagttcttggatgcatcatctgtgggaggctggagaaggctggagaggaactcagtgaggcagacttcagtgaatgggcaggagatgcatgctggcaaccccaatgacagagcttgctatggtttgaatgtctcctccaaaacttacgttgaaatccaatggctattgtaagacttttaagaggtgagaactttaagaggtgattggatcatgtgggttctgttctcatgaatggattaatgtcatcatcactggagtgggttggttattgcgggagtgggctcctgataaaaggatgagtttgggctgattctgtcctgcacttgctcaccatgtgatgccttccacatggatgactcttgccagatgccagagccctctatcataaacttcccagcctccagaatggtgagtgaaatcaacttttttttgtttgtttttttttaataaattacccagtctgtgatattctgttatggaagcagaaaacagaccaagacaagctaaaattcatacccaagaccagggcccccagcattctctccctaaccactacattgtactgcaaattgtcacttggcaatgcagatttcttcattcttaaaatggatacatgaataatgcatacctgcccggctgaacaatgcacatcaaggagctttgtaaggcaatttccgtatgttaggcatacaatccaatctctgcttgactgcaccaagaggcccgaacaactccaatcagtacaggtgtatgacccacttcagctcttgttatatactctgctgaactgccttctgggtcatgtatattgctcactaatttgatgttaggaactgagatgccttagggattcggggactgtgaaggtagaaacggcagtaaggtggacttcatgcagctgctgggttcctgacattggttacaagttacatctctctttaaatataatggggtatgttgctgcttacaggagctttggaatgaatccctttgagaagcaaagccttcttttacaaagcaggtcatcatctgatcatcatattttactttttataaaacaggtgcctaggtagagttgggaatcttggaaacggccattcattcaaatttacattgattctgaaaatatttctgtagcccctcccatgtgccatgccctgtgccaggcactggagacatggaggggaatggaggagatagcgttctcatcttccaggaacccagaatctggcaagagaagcagatgctaagcacacagtcacacaagtgattccatgccaaaccagcaggaagtgtggggagtgacaaagagggtgctggcaggggcaggccctgcagtcccacttctgcactgacacaggcaaggacctcttccctgcctgccactgaggctgccagaccttcagaattagctcccatgcaatctcagctttctttcccgaccttccattttagaagagaacccagcaatccaaacctgcatggcctccaaaatgcaccccgcccctaggaaatgccaacacactcagcacaggcagaggcccgtgcctacctttccccctcgcacctgggctgtccctgcagaattcctggcaggtcctggtgttagcagctaaacaggctcacacgaggcgctcagaattcagaacacttggcagcagggaagaggatcatggccatttggaaaggattagagaggagtcacgcggagtgcgattcggagtttgcgtttatctcaactgaaactttccagaaagctaggacaactgattccaataaaagcttccccaagtatttttggaggcattgtgatggtgctgggccgtgtgggtgggggtggcttttcctggtttgtggaattgcatttcattactgattaaacttccgtcaaatgtgtgaagcaacctccagtttctaaggaatgtgtcctgggcaggtgaagagaaaaggcagaaccactggactgagaggtggaattgagcagggcctctttatggctaagagatgtggccaaggccagggccagataggaaatctgagtcagtgggaaaactaggaccagaagcccccctagttcagaactgaacttttcctactgctttctgagggtaacaagggctgaggcttagaattgtctagtttggtttcagtccagggcagggtcaggataaggacccagctgactcagagagccatggaaacgcactgccagggaggggagctccagaatgagctggctgccctgctgcacacctgccagccactgagagagcattaaagcaacggcccagcagaggggctcatgcacagccagcccctccagctgtaggagtggggagcccagcagggaggccctgggaggttctggaaacgtggtctgggcccagcttgctcagtttttattttttgttgttaatttccagcagtccagggttttcagttactcattcattccatccactcaacatatgttgattaatcacctactttgtgccaagtattatgctccatgattgacagaaattacctctttgctgcacttcgaagtagtcattcaatgcatagctgctgccatgatggttattatcatgttattaattgtaacagtgacaagcactactaagatgtagcttctgaggtggagaaagaagaaactacgttttctgcatacctactatgtgctgggccctgggccagctttagacacatcttaacccactgaacggtggcttacttcgcagatggggaagctggcatagaaacaaatgattggcacaggtctgagggcagtaagagggacttcacagtaggtccctctctagtggcaccatttgagctggatcttgaagactgatttcacctggtagaaaacagggaggaagggaagggcattccaggtggagagtacagcatatgtaacagcctagaggcttaaagtgcgaggtaagggggacagaagttaagggtggctagagaagagagtagcactggcaggcgcttggtgcaaggtctaggcagggtctgtttcaggacatgaccttaggcagagtctccctcaagccaaccacccttcaggaggcgagttctgagctggctatgtccccaggctttccttgctggtgtgcttaagggaggccctcctgtttttttggttttctgtcccgcctgtccatgcccactgcagctgtttccagtgcaaggctgagggttctcaggtctgggcgggagctcggtcctcttcaacaagttcccagagttctggtgagctctgtgggaagcacgtgctctaccctctccgatctggttggcagcctccttcacagagaggtactaggtggcgaaggatgggaagcaggcagccctcgctttagtgtagccactgacactgccagaagcacagcacagccaaatcccagagtccccaaactgtgcttcagctctcactgatgcctcctcatcctcctcctccacccacacaaccctgcagaccccaggctgggctatggttcttccccctctgtggaactgcacaattcagagacagcagagatcttgagcagtcaggagccgtggatcctctattctgccattgactgacttgctgtgtgatgccaagaaagttgcttaacctctctgagcctgtcatctgtgaaatgggatataattttctttgctgtcctaggatttttgggagcttactgagtaaacacagataaaaacacagtgaactggcaaacatgacatgtggcagggaggggagtcaatcagggagaccaacaatgcctcagttatccccctcactccccagaacaaaggcattggctgctggcatgatggagagtttggaaaggggagatactggtgggctctgtggcctcccctggccccagatcctgtcctgctccgggaggcttctgcctgggaagggggtcccggtgcttcctccacccaccagggagtcatggtagccctggggtgcagggagcagcagcctggcacccacacatggggctatttgctgcagtgccttccttcagcgaccttcacccagcagccatgacactggacccacctcagagaagtgtggcgggacctggcctcagccagcatctggcttccctgctactcttcaactccatgacctcctcctcagcctaagcactgccaagaggcctcagcacacctggaaacaaggagggtggccaggattgtggctgcccagggctctgctccgggtgtggggggcagagaagcactggatgtcactggtctaactcaccactcaatcattcattcagttatccaccaattacatccttgacaatgattaaagagcactgcgcctatgagggatgattaagatattctagttgaggacccaaagaaaatgcattttcaaaagtacccttccaggctggttatgtaacagcataggacacaacacacccgagaggcagtgaccaaccagagtgcagcaggtgccacacagcaggggggctgaggcccagaggactggaccatgcacagggtggtgtggccgggtgagctacagggaaggaaatgtgccttggcctcccctccttcacagagaggcagggcagggctcaccaacagggttgccgagatctggggagcagatgctactcatggttaccaggcactgcacccatgggttagagccttcagtctttaaagtaaccccatggggtaagaaccatcatggtcttcactttagagaggaggcaactgaggcaaggagaagtatatccactcaccagaaccacacagtttgaatacttaagaattaggacgtgaatccaggcaagcaggctggctgcagtgctggtgtgtttagagtcgacactaaactatactggaaggaaggatatgagccaatagtcttcccagatataagaacatctgagctaagaaggggctcaaaggaccttgggcattcccttcttttagtaagggagaaactgaggcactgaatggtgatatgtcctgcctaaagccacgcagccagttagtggcagagccaggtctagactcctagtgcctgactcaccgctgttctctctaccctagcgactccaagtgcatcagcataggcattgccaggagctcatgaggaatgcagactgtcaggtcccaccccagacctactcaacagaaactacttggtaagcagattcccaggtggttccaggcaccttacagtttgaaaagcactgctgcatgctatcctaccttcctggtctgtaacatctgttgctgttgagtataaagacactgtgaacattgtaaaatctgcaattacaagattctggatgcttcatcctgaggtcaccttggaatgagatcctctgggatctggaggaagcagatggaggagaaaccccagggctcaatttttctaagggcccaggcacaccagttaccactgacctgctagtaagccaggaacttagccccatgttgggggttggccaagcgcagggaggaggcagcactcacaagacagagtccggagcattctccaccacagccagtggccacttggagaggggacctagagtcccctggtaggtggctagggaatggcagggtttggggtagaacttcctggggccagagtctcatagcagtggtagccaagagttggcttagggtgagagccaaggggcttcagtacccttcttcattctctaccagcacctccccaacctcctggaaactgctgtgcttcctgcagtttcaagcccctccaccccctgttcctcaccaactctccccgtgtagaaactctgcagagagtatgaccgtgtctcttaaaaaaactttggtgaggatcagaggctggactctgcccaaagcacccaccttgggctccacacactttccggattgctggctggtggccccatgcagagcccccgaccccggaaagtcagtggaactggacggaaaaaatggaagggccagaaaacttggggaggactccagagctgggggtgacacaggaatagaccaacggccttttgttgtttccaagatcctctgaatctgaggcagccaaacaaggcatgggagtgctgctccaggtgtcagggatgggtacacttactgaacacttacccaaggctaccaccaccatctccagatcaagcaggagtttttacccaaagccccctcacaagtcactcagcctgccttctgctcctcagatacccacccttctctccagctcctcccctctgtgcgtagcgcaacactcaccccttctgggaagccttggtgccctctcagaactgtactggattctctacttgtctatgtgagcagtgtgtgtgtgtgtctgtgtgtgctgtttgtgtgagaattatgtgtgtaagaaagggtgtgggagagtgagagagatacacctacctttggcaatattgatgtaactcttctagggaggatgagagcgcaagctctcagggaatccccctttgacttgctgggtaacttgggcaacctctcctcctctctgagccttgtgtaaaatgaggaacaagggtaaattcacccgctttgggctggtcttggagatgctctagggctcttcagagaagacttcagggagcgggcggcaactgaggaaaggcccactggtccggactccagcccccacccctaattacagcagctctgctcctatttgctataatgggctgattgttggcttttgttgacaaaatggtctacatgcctggggaaagttatgaaggatctttgtggtgcttccagctagaatactctaggagtgtacctttgctccattcggcacaattctgagctgttcgacgcggaggcccttgggcatagtcaagactgagtggaaatatgttctctctcagctggcttggcccaggaatagcggcagaccattcctgggagtccaggggagagcagggggatccaggtacctttcttgtctcagtttttgatggcctggcagtgcccccacctgttttttcttcttacctttctccactctcccagaacttcccaaaggaagctgctctcattaaaacaagggaggttgaagatcctaacgccacaggcttgttcgggaggcagctcacctcctggaactgagtgcagtcctggagaaaaccaagtggatgtgcggcccctttccatggagcaattaggtggataactgtccagtcgctcctaggctttgtagaggcataggctcagatacaaagagaccagacagtctctcgctccaaaggggctggccacaagcaccatgaagacagcagtacccactgactcagcaatttcaccagctggaagtcatcccaaggagatatcacagaaagaaaaggccatcttgcgtaaagatgatcactgtgtcattactcaaaatagccccaaactgggaaacacccagctatccagcaataggggtagtgaattacagaacatcaactagatggaatattatgcacccactaaaattagactacgtgaaaacacagaaacaacatcagtaataaaatgttaataaaacagaagcagctcagtacacatcagttagtttcctttctttttcctacaaaaggcatgacaaggaactgcaggggaacgtgcagacatgaagagttgtgttagtgcagtggtatcatgaatgacttgttctcttattcatataataaatattgtttactatgggctaggtctgatgctgggtgctgaggatggagcagtgaatggtaatacatttcctgctctccacccagagtttcaaatttaaggagatattttcttcctaaatgtccttcaaagctgtcacagcatcatctttcaataaaaaatagttgatgagactgggcatggtggctggtggctcccgggtgtaatcccagcacgctgaaaggctggggtagcaggattgcttgagcccgggagtttgacatcagcctgggcaatgtagcgaggccctgtctcttaaaaaaaaaaaaaagtagccaggtgtggtgatgtgtgcctgtgatcccagcttcttgggaggctgcggtggaaagattgcttgtgcccaggaggttgaggctatggtaagctgtgtttgcaccactgtactccagcctgggcaatggagtaagactgtgtctctttaaaaaaaaaagttgatgagagaaatacgcaaggaaggatgcgcctctccttctggataatgtgtttcattccagatatcaaaactatctccagctggattacatacatgttagaagaaagttgaatgtaaatgtggtagtgacattttgggcttataatgtcttagtttcctttgtagcaaaaagagttttaaaaatccatgttgaaaaagagggaaaaagttaggacttgttactaatctcgtggctgaataattaagtgtgcctaattctgaaagtagcaagctaaattatgcagtgccaaaagtgacaactcttatacctacaccatcccgtctacagcggcatgattttagctttatagctaaaaaacgctgccagaaaacctaataaaaggaagcaaaaatatttctgtttatatcaagctgccatttgagaaagattttaaaatatgttctttcctatgtgtaaatctgacagcagatgcataattaaaaccccagtggagagtttccatttaatcttttcaaagttaactgataaacatcctttaggatgtgaagtgatgggttaattctgtttggattgtttggaatatctctgagctggaatactgtcttcaagaatattgtttcgtgctaaaagaacacaagacagttatctttatctttaggagttcatacaatcacaggaagtgcagacaacatgccaaaggccacacatgcatctatgatgagtgatgcttgtcttagatgttttttaattggcagaatgaataaatggatacattcacattaaaacaaacttgatttcaacccccagggaatatgtcacatagcataaatgggagaaataataattacccaggatttcagttcagtgtaagcaatcggtatgaataatttagaccacaaagtggatttttatttcgcttgagctattcagattgactttctacacagcctgaacggctgctgaataatcacaggcaaaattttccactggtaccgcactgtgtagacacacgtgtatctacacgattgcaaactgcccagctgtggatacggggccctgttcaaaccaaatatcaggacaaacattctacttcattgtggtgttccatgtaaccttgagtacacacagccatacctgaacctttcattacgtcttccaccaggtgaaagcccattcctgctccttcttcccctcctctatacacatgtgctctcaagagtgtgtgtgtgcacgtgtgtacacacacacgtgcacacacacatacacacactggtgcaaaaaagggcagaaagcaagtgacttctgtccttagaccacagtttgccagaagttctcctacttgctagtaccccatctctgccctttaggctggcttttgcctgtctagctaactaagacctgccagatgcttctaacttgtctggcctgtaaatctgtcttgtccttcaagttttctctggacttaatcagttgatgacgtgaccaatagaccagcagaccagtccctgccctggttacacacacatacactctctctcacactcagacagacagacattattaaatattgcaatctcaaacaagaacgttcccaccaattatatgcatgaaattggtggatattgcacaacttggtttctggacctagctgaacccctcattaactgtgtgaccactgacaagtcccctaaccctgtgccacatgagattggaccaaaaaggtccccttcttgttctaatcatcttcagtgaggatggccaagatacgttgctcataaatgctgtgatccagctgcccatgttggaatatgccttaatctctgccatgcagagtaagctttaacctttcaaaatacagcctgatacatacaatcatgttacggaatgaatggaaggaaagatttccaatactaaagtctagatgaatcacatatctgggtctacacaacacacacacacatacgtatgtccttttgattaggcagtataaatagctgaatcaaatcattttgttcccctgaattccacagcactgtatgaaccatatacactgtgatactcactcatcaaataaaactgagtatgtgctaattttcctcttcattggataaagagtcagataaagaatcctgactgcccattttttgtggactgaggttttgctccctgatctgttgaacccatacaagcatcaataataataataataattgtctttgaagattcaggccatttaagagaaaggaactatgtaagcagaagagaaactgacctgtggagatctttacttaaacctcatccaaatgcattttgcaaagagaaagctgaaatgccaattatgctacttggggattcagcagaacttatctgactgatggaagtgaccaatttgaaccactgaccccagaatatcccagcaggggcaataatcagcagagaccctgctacttttgtggctgtcttggcatcctcacagaggcctggttcaaccctgagctgtacacaggctggtttaaatgtttccccgcagattttggaagcaacgtgctgggtcactcgtaatataaccacatgcttcagtgtagccctcctacattgcttgcctacatctgaaaacacgaatcaagaaagagaatatagctcctttccacttgactaaagaacagtcaatcctgccagtagactaaaggctggggcatggaacaatttcccaacacactgacttgattttgtgtaaactgctgaaagagaagctttagaagctgtggctgggctcagaatcagtgcctccaaaggagcaccgaatgacagattgatggagctcatcagagaggcacagagaccacaggccattggaatggggccttatttggatggactcatggcccaaaaaggaaagggacactgccaacagcttcccctttagcctgtgggttccattaggaagccggaacatgtcactgggagaaagtgctatgaccacccaatatgtgcacaggtgcctctaggtggaagaaagggaaagggcgtgtttacaagaagaagagcacaagtcaacaatgagctatggatgcatgatgtcatcctctaggactaagcatccttagtacttttaaagcacttaaaaaaaaaaaaactctagttgctatagcaacttgatgcagctcttaaaaggggattttttttgagggggtcattttatatcttctatcaccataacaacatgatatagctttttaaagggtatttttatccaatttgtgtgtgccttggacttgggccatatttgccttttctatttaaaataatcagatcaagcatgacacatgaaaaatcattgaaggcaaggaagtgctttcatagactatacatatacacttagagagacatctctagctgctcatatgctgcacatggaggcagcctctctccctgcctccaaccagccatctgctgtggcttatcctgggcagttacagtccatgcctctgtatctgaactggcataccaaaccactccagaaggtgtgtctatgaaatccctcacttctcaagcccagcaaatccagccccctcctccaaaactgcacaggagagagtgccttagggtgactagaggtgtgaccagccaagtgccttcttccatcctgggattcaaagcaggagtggggggacacacacagccttgtcaaggtgataagcatgcgtttctgctgcactctatacaggtgagtaaccgagggtgggggctttgtttcacatgacacccagggcccagggaaagtgggggatgggaaaagtgagtgagaggagaggaagaaagaggaatgaaggggtggatggagagcaggggtggctccagaatttctccacaggagctcagaggcagcaatctggccacagagggaggggtgggggcctgaaggagtattgacacagcattcttcataaggttgagaaaacgtgaactgtttatatccaaaaaaagagagaagagatgatggaaagaataggggaactatccctgctcccagctaccccttggtaccactaatggttggaaaaagtggcaagggaacaaaaaaagggtcaagaaattggagaaggggctgggagctgggggagaacacaaggaagggaggcagaacaacagcagctgaagtcctggcctcaggctaacgggctttactttggggggcggtatagactgtaggagaagcaagtgggaaggagatgtagggaaagtgatcctggggcaagtggtcaccctctccagggtaaaggagttagaggccactgagggagaaaacagggtaaaagaagaaagcgggggagactatgaaaagaaataaaagcgccgagggtggagggagaaggggcttttgagatcatcctggagaggaaactgaggcctgggggttgtgggtggaaaacaggaaggaaccggtagcccttggcacgtattcttagaggagaaaacggaggctcacaaaggtcagatcacagagccggccagtgttggagcacaggcggcccggggtgagcgccagaggtgggctttcttccctcactgaaagccgggagggagagagagagagagaacgggggccggcggagaagagggcgagacgaaagtaagcaaagggacattagaagggaaggcagagccgagggacgcggaccgagcggccgagcagtggaaagggcggcaggtgaaaggcacagagaggaaagatgcgcgggggacgcgccgctcacctatggttgacaccacggtgcccacgaagtagaaggcgccggggaagtcccagcgcgggcgcagcgcgtcggcgcggacgccggcggccagcgcggcctcgtagtgccggaggaaggcgcgcagctctggctcggccacgccgtgcgcagcgctgaagttgcgcagcgtggcgccccagcgcgcccgcgcctccgcctcgccggggctctcgagcgccgagaagactgtggcacccgccaccaggtagaggccgatgagcgccgccagcagcacgaagcggccggtgtcctcgttgaggtgcgaacggcggcagcagcagcagcagcaggaggggcgcggcaggcggcggcggctacggcggggcgggggccgggggctgcgggaggacatggtccggagctcagccccggggccggggcggcgctcggggcccgggccacgacatccccccggcgggagcaggagcgtgaggatggtggccaggggtccggggccgccgcggagcccctcgccgccttcgcagagcccctcgtcgccttcccagagcccggacagaggggcgcctccgcctcctccccggcgctcaggccacacgcgagtcccgtggcccagcgggtgcccgggcaggggcgctcctctgcgcgccccgacgcctcgccggctcccgcggctccttacccgccgctctcgggcgcggggctccgcagctaggcccctgccgcccggtggccggcgtccgcggggccccgggcctcatactcctctccagacaggccgcgggctgcgggcggggtgggccgtggatcccgggcgcctaggaccgggacgcggcagcaaggcgtggagagagcccccgggggcgtcccatgaggcgttcgggatcggcgcctcctaggtgcgggctgtgcgggcagtcctgctcccgcccccggggctgagctggcggcgtcggcttcagagcctcggagccgagccgagtccggggaagcgctcctttctcagctccagccgaagagccgcccggcagggagaggcggagtcactggcgcccggggcggggtgttggggaggggtgagtagggacaggagggagggggtggagagttgggctgctgcgacgcctcccggtggctctggcggcaccaatgcggggcaccggagcaggtgtccgactgcggtgcgggctaccactccgccggggaacctcgtcttgctcctccctgcgcttcgcctctggaatctctcccttatctcatgccgcggtgaaactttgctcaagttggtggtgctctgaggtctccagggctggaggccgcgcgacgcgaatcgccgacactggattctcgggcgttagtccgaagtttaagttcccttcgttcactcctttgccctggatcgaaccgcagccccaggacgcagcgggttccactggaaacggggaatcggggagaggcggtcgctgggctccgggcgacctgggaacgagggcgtttgctccccctcccgaccgagcgggcggccggcgtcagcaccgcggacagcgcatcggtgccgcagccgcgggcgggcgccgctagggctgccaggggtccgaggcgcgggcaaggctgctcaccccgctgtgctgtgcaccccaaaccttccctgttttcctttctacctcccgtgtgcacccccctacccgccacccgaggcaggtgcggtcgctgaagcaggctgctgacagggcggggacgctgcggaatagagacgggggaggagtcaagcgcgggtagggggccaaggtgccacagggagaaagagcccaggcccggcggactgccgggctcctcgcgccaccccagctcaccgacccctctagcccggggcggggaataacaccctgggtgcggtagagagtagaggaatagaggaggtgtaggggaagctcactggcagctcccctgaggccggcgcggggaacggtgtgctatggaacgcccctgggaaatggtcgcccccctacgccccaccgcggcaggaaaagacgacggatgccccgcgcggctgcgggtgctcctctgctggacacaagccggctttgccggggccacaaaagttctggcgtggaacaccctcagtacaggcggaaaatcatcctcttcgggcagccagctccttccctgtcctcccgcttactatggactgcgggaagcaagaccctggtgatgatatgatggcagaaaataaaaataataatggtgactgtacttagatatcccaggtgggtgagcggtggcaaaaagcagacccctgccccctgccctaccgcccatttccaatcccgggctaaggtcaacccaaagtggtggcagcagcgtcagtcaattacgggtcatagtactaaaagtgttccctccactactcactgagcatttcccgccttcgaaactagggccggtcgcagacaggagagctgctgaaagctgaaaggcatttgacttggggtgttgattgtcccaaaccagggtgctctggagatttggttcttcccagatatgctgcctcagtttatagatggagccaagtacacttccctctgtggtagggacagatgggtggaaactccaccaccaccatttcagaactaggcttcctggcactggatggcatgtggctagttttgcagggctcttcttacaatgggcctagggtatcgttgtgtgagggggagaatatcttatccaccaagaaagtcgaacctccctcttttctggagcacagcagaaggtgtatacaaacacaaatttttgttattgcagactattgttattattgccaaaacagtcaactctttctccaaggctttggctcccctggactctccacagatgctgccctaggccctgttcccccagtacccccactcttaacagcttcagtacacagtgaggacagccctgtcatggacctctggggctggattccgcttggctggtcagctcttgacagaagccctgagatgtgtcattctaggagttgccctggagactccagatgtaactgaagggcattgccaggcctctcagaggctatctttgcccagacttcccaagcaaacacagggtgcttcgctgcagtattctctgcctctgggaccagttccttgcccagttggcagaaggcctgtcttgtcctccaacttgctattctagcttgattagcagcaaatctctggcatcaatctcagctccgaatgacctaatcaatttgtgtaatagggaaatgatgagttccctgcacataggcacaggatttttagggaaccagccccgtgataaatgcggcttttgcccactaaatcaatatttaagctactgacttccagctggctatgctcagagcctttacctcagccctgaattgctgcaatagactcctaaggacaagggcttgcttagtgtctccccgcttaggtccatcctgcctgcacctgccagtcatcgctgtgatcatgcccatctgatatgatcatgtgattgaagtatctaaaccacagtctccaatggctcccctaaagctataaaaatgtagtctttaaacccttgaggctgccattcaaagaccttgatgaggtgattcctaacaaatcattccagcctctccttctactaacttttacttattccccaagtactctatatccagcccaatcaccaggcctttacttgtgctgtggcccctactacagcactatcttctctcttctctccagctctttacaaaaaccagctcaactcaagttagacattttttccagaaagtttttcctttgtaggatgttttgagccaatcactttgatgccatcttttcaactccatgattattgaatctgctatgcatgcaaaaatttcagataagacacgcaaataggtacggcctctctttctcttttctgtctctctctgtgtgtctttctgccatacacacacacacacacacacacacacacacacacacacatgcacgcacataaacacaatataggagtgttaacccagaaaattaggtaaggtcaaatggaaccagttggcaactccactcctaggtatatacccaagaagataaacaaaaatgtaccttcacaaaaacttgtacatgaatattcatagcagcaccattcataatagccaaaaagtagaaagtgatcaatctgtaagtccattaattgattaataataaataaaatgtagtatatacaatgacatatttggcaataagaaggaatgaagtactaatatatactacaatgtgcataaatcttgaaaacatactaaatgaaagaagccagtcacaaaggaccacatactgtatgattccgtttgtataaaatatccagaatagacaaatctataaagacaaaacacttagtggttgcttaggggtgggggttcaggagaatggtagtgtctgctaatggggatggggtttcttttggaagtgataaaaatgttctaaagttgattgtggtgatgattgcacagctctgtaaatatactaaaaagcattgaattgtacactttaaatgaatgaagtgtatggtatgtgagttacatctcagtaaagctgttaaaaaacaaatacaatggaccaggcatggtggctcatgcctccaatcccagcactttgggaggctgaggcgggtggatcacgaggtcaggagatcgagaccatcctggctaatacagtgaaaccctgtctctactaaaaatacaaaaaaattagctggacttggtggcaggcacctgtaatcccagctactcaggagactgaggcagaggaattgcttgaacctgggagtcaaaggttgcagtgagccgagatcgcaccactgcaccactgtactccagcctgggtgacggagaaagactctgtctcaaaaaaaaaaaaaaaaaaaaaaaaaaaaaaaaaaagatatgaattgagataatctttatccaaaaaatggaaacaaatttatcccaaggaggccgggtgcggtggctcatgcctgtaatcccagcactttgggaggccgaggcgggcggatcacgaggtcaggagattgagaccatcctggctaacacggtgaaaccccgtctctactaaaaatacaaaaaattagctgggtgcagtggcgggcgcctgtagtcccagctactcgggagcctgaggcaggagaatggcgtgaacccgggaggcggagcttacagtgagccgagatcgggccactgcactccagcctgggcgacagagtgagactccatctcaaaaaaaaaaaaaaagaaagaaatttatcccaaggaaaataattgcttttagaaatgagaaaatttgaaacaatttagttgtgttacagagaaaattatgaaattaaatttgaataaaggagtttcctccaaaatactttctcttaaaaattaatctgtgatggtaaaattttggtgacaagttttgcattccaagtagtagcagattcaaaatgttctggttgccttcaaacctctttgatcttcttgttctcagaactcctctagtactcattgtctgcattacttattggcaattagctgtgtaacgggatacttttttttttaaatatggagaagatggttatcgctatcctgtgaagggtcagttgcgttgccttcttagtagtatagatgcagcagctcttctccccccattctcctggaattaggtttttataaaaccttttatgttttaagtcatttggcaaatgtttcctcacaccatgtttcacagagctggtaactgggaagaagtgaaccagttttacccagggccttccagaatggaagggaaagacatctgatttgtcttctgtgaatttaagattaaggggtcttgttgagaaaagcatggggagagtctggtcacagcccaggacctgggagaaaggccccttgaaataaaattattctggggaagcaggagtctgactggaggcttagacaagggtctaagtgctttggtgacacaggatgtaactgatgctggatgccctgtagttcgatctccctagaactgtatgggatttgaagacaagggttgaatctggacttgtgacctgagaagacagtagccttggtgcctgaagtggttccttatgataaagtgcatcttgagtggtaataggcaagaaatgtctcaaatggtacagcagcacttaacgataacatttgtaatagcacttacaatactgtcctccttttctttccattggcatttggaggacagggttcctgttggactgaaaaaaaacatgggtaacgtgcctctattttcatattgctcttatgtctagatgttctatccattattgaaggtgaaatattgaggtctgcaactacaagagtaaaactatctagttctcccttcaattatgtcaatgctggtgtcacatattttgaggctctgttgtttgctgcatatatgttacagttgttatagcttcttgatggatttaccctattgttaatagagatggtgtctgatttacaatggtttgacttgcaattttttggttctacaatggtgtaaaaccattgcacttttgacttaatgtgtagtagtcaataaattacattaagatactcaacactttagtatacaataagctttgtgttagattattttgcccaattgtaagctaatatacattttggacttaggatattttcaattaatgatggaaatataaaagaatttatcccaaggaaaataatttctttaaaataaaaaaaagggaaaattggaaacaatttaactgttctatagagaaaataatgaaattaaatttggatgtaaccctatcataatttgcggagcatctgtatatgatgtccttttttggtctcttataataaattttctttttcagacagggtctcactccattgcccagacagaagtgcagtggcacatttatagctcactgcaacctaaaactcctgggctcaagcaatcctcccacctcatcctcccaagaagctgggactataggcatgtaccaccatgcctggctaattttcttattttttgtagagatagggtctcactatgttgtccaggcttggtctctcaaagtgctaggattacaagcatgagccaccacaactggcctacaacaatttttggcttacagtccattttttctagtatttgtatagccacccagttctcttttggttaccgtttgcatggaatatctttttccattctttcattttcaacctatttgtccttagatcttcagttagtttcttgtaaacagcatatagttgggtcttgagactatcttataactcaacttgttaaaaatttgtgactgttcagctgctctctggttatttccaaataactgatgaacagatttttattgagaacctaccaggtataaagcagtgtactataaactgtgtgtgtgtgtgtgtgtgtgtgtgtgtgtgtgtgtgtgtgtgtgtgtgatgaaccttactctccctgcaagagcttagagtctggctggggtgataagatgcacatgtatgaagcagtaaggactatgatatagcagatacagttaggagctgactgtatggtgctggtcacgggaggtcagagaagggagcctgtaacaagggctgcaggagtcagaggaagctttggataacaggaagaatgggggcaaggcctaacagatgggtaaggtttggattgactgaaagagagggaacatcccaaccaggagtattgacctgggtgcaaatatagaagcaagaaaaaacatattgcgttcaaggaactatggtgggcgcgtgttgagtatgggtgagaggagagggaagagtctgtttcttataatccaggacctccattggtggcctctcagcctctcaatacaactttagggcatagattaaccgaccctgtgaaacccaaaggttagttttttccttctaaaatgagagtcggatatataatatatgtggactctggcttgatgaagccaattttatggcaaactttgttttcccacaaacatggccacactgaaaggcacaagctatgtctgcaggggaaaaggaagacaaattgggaacatactgggtgcaaagttgggggctctggtattaaaacctccttgggctcagttgccatatctgtctttgtgaagaatgcactatgtcatctttaagtcaccataatatttgaggattaatgaagctgattgctgcctgttgatagggagttttgaaatgaagacaagaatcccagagtgaagaggagccttaaagctttgagggcaactccttatttcctaatcctcttgtgtagaaagttgtgggttccttgtctgaatgtctttatggagtcctgtcttctaatgctgaatcactctttattaagaagtgattttttaaaaatgatttttaaatatctatttcaactctttcttattttaaaatctaatccagatttttttgttctctaggtaaggccattcatgtgttgatttttgtctcaaatggattttgatataactttttaagactgtataagtaatgcataattaaattctgataagacttttaaaaactatataaagtaatgcataattaacttagaataattggaaaattcaggaaagctaaaaataagaaaataagaattacccccaattctatcacattatgcacagaaaattactgttatcaatcattttaatgatcttactgcctggttggttggctctatctgtctatctatctacatatacatacacatatttgattttagtaaagttataggatattttacatactattttaaacttacttttttatttaacatcatacatcattcaagacatcttttgatttaaacatatttgttgagcacctactatgtgccaagcactgttcaaggtacctgagattgttcagtgaacatggagtttatattactttcatgtcaataaatacatatgaagtatcatttgttggcatagtgtactctaaaataaagttttagctgaatttcacattggtagatattgctggattcttaagatttcctactcttcttccctcttctctgtctttagttcatcactctcttttttcccctattagaatatcagcacatgtttgagtttggcttctcaatgagacttctagttcccacccaaatctctgttcaacctcttttttagcaatagaactcccattttatttgagatgtcactgtgaccagttaaaagaccctattttccattctcccttataaggtgaaactgtattttttaattctagcaaaatattatgtgggtcttccaggaaggctgcataaaagaaagctaattccacaggaaggggggcccttttgcccttctgccatttctccttcctcagtcatgcttcctagaatatagatgtgatgactgggactccagctgccatcttgaatcatgaggtgactttgaggatggaagccacagtgtgaaggagcaagttcctgcatgaatgagtctgagattggaatttaaaccttcaaatgtggtgagaccatcaacaggcctgaccttcatttgcttccattttttcctcttatctcccaatctcccctcttctctcaggtatttgtaccttgtgttctcatcatggttgactttcctgtgggatttttccctccacttggttcctctatattcttgcaattgggagagatgaaatgtcaataacttttccaatccaaaaccaataggctgtcagaaccaagagcaaaaacaaagcaagggaggaaggcttaggagaaagatgctagagggttgccatagctagtatttcatcatttgaatgagtcaggactctatgaatattgaactgatcgttttagagagttagaatatttgttttagctaggcaactctaaaaaggggatgagacccagaggaggaaagaatggaaggtggcattggaagtagatagattatggaagcaatgatttttataatgaaacattctcatttattaacttgtctgtggattgtgaaacatgcaaagacgagatttgttcattagacattaattaaaactgcaatgctgaaaatggatcacagcatagaacatgatgtttgatgtaaataaatgcgtaggaaactgggggtaactgttttacttgctaatagcccagaaatgagcattggtgagtggggaaattggaggaggggtgtgtagtaggagatgatgtgtggaggagtagcattggtgcagttaggtgtggggatgggttggggagaagagtcttggggatgcctttccaggtattacatgggtcaatagggcttctagggggaggaatgtttcttgtgaatagaaggtcttctttatagttgagcacatgagtgtggtcagtcagcttccctttttctccctccctccctccctttcttccttccttcctcctatgtaacaatttttttttttttttttttttttttttttgagacagagtctcgctctatcgcccaggctggagtgcagtggtgcaatctcggctcactgcaagctctgcatcccaggttcacgccattctcctgcttcagcctcccaagtagctaggactacaggtgcccaccaccacgcctggctaattttttgtattttttagtagagacggggtttcactgtgttagccaggatggtctccatctcctgacctcgtgatccacccatgtcagcttttaaacctgtactctgtgccaggcactgtgctattaaggatcctaactcatttaaaattgcctatatattaatgactgggtaggagggagggtgggagtaccattaggggctgttggaatagcagataaagaaactaaggccctgaagggcagtcagaggtactcacttagtagtgcatttgcagtctccatcaacccaacaatcccctgggccggctggccttgaagtggatggtattctacctccttatagtattggaccctcctgcatgcaagttccttggggctcttattgaatatgcaggcctttctgttcagcatattcagcaactcagagcctcatagtagaacaattggaggagaattgtcagatggtgatgagggagaatgaaaggggagacagaagacaaaagctggaaaagagaacagcttgagaaaggtttcctggaaagttgaaatctttgcatgcatattgagcaggagcaaaagtgctaaataaatgcattctcagacattgattacaatctgggtggggttgtctcactgtatgagccctcattatgttatacttaaaaagcataatatactgtaacctgagggtaataagccagccaaagcacttgcaggattcaccctgggagctatagccacccttagcattcttcataagcagattttatcaggagaaaacctcaggttggggtagaggaggccccactgagtgaaaatgccaggattcgagtgactctctcccctcttcccggttctcttaacagaagctatatcacaaagggccccaggctcattggaaggatcccagtttggtttgctcatttctttctccatcaagtattatggaacaccaattaaatactagatatgtggctagatgctggatacaagagccaaaattgacttggtttctgcctcattcagcttcaggatcaaaagttacacaagtcaatgaaaaatgaccatggtgacaatggctgtgaagaaagactatgttgtttcaggagatgcatatagggatatttgacttaggcagggctgagacaggtaggcattgaccaggaagagggtaagtgaatgacagagggcagctgtgcagcttggaatggcatgccaaggctgttggcaggaggagagaactatggaagaccactgtgaggtcatttggggctgggcagaggcctgatcctacagggctttggaagccctgttactggaaaggggtcccagtccagaccccaggagaaggttcttggatctcgcgcaagaaagaattcagggcgagttcatagactaaagcaaaagtaagtttattaagaaagtaaaggaataaagaatggctactccatagacagagcagccccgggggctgctggttgcccatttttatggttatttcttgattgtatgctaaacaaggggtgaattattcatgccttcccttgtagaccttatagggtaacttcctgatgttgccatggcatttgtaaactgtcagggcgttggtaggaatgtagcagtgaggatgaccagaggtcactgttgtcgccatcttggttttggtgggttttagccagcttctttactgcaagctgttttaccagcaaggtctttatgacctgtatcttgtgccgatctcctgtctcaacttgtgacttagaatgcctaactgtctgggaatgtagcccactaggattcagcctcattttatgcagctcctattcaagatggagttgctctggttccaacacctctgacagccccataagaattcctaagaaaaaggggaagccatggtgttctaagcagagggtgatggactcaccagctacttctgcctcacccaaggtctcattgtgcatcaggagaaggctgttcagagccttgactccctctctcttgcacttgccccatctggggatacccaactgctgtttgtcatgcgcatctgtgtgaagagaccgccaaacaggctttgtgtgagcaataaagctttttaatcacctgggtgcaggcaggctgagtctgaaaagagagtcagcaaaaggtggtgggattgtcattagttcttacaggtttgggataggtggtggagttgggagcaatgttttgtgggcagggggtggatcttacaaagtgcattcttaagagtcgggagaatattacaaagtaccttcttaagggcggggaaatatcacaaagcacattatcacaagggccggggagaatattacaaagcaccttctcaagggtggggagggtgtattgtcaaaaagtcaattgatcagttacggtgggacaggaacaaatcacaatggtggaatgtcatcagttaaggcaggaactggctattttcacttcttttgtggatcttcagttgcttcaggccatctgcatgtatacgtgcaggtcacagggtatgtgatggcttagcttgggctcagaggcctgacattcctgtcttcttatattaataagaaaaacaaaacaaaatagtggtgaagtgttggggcggcaaaaattttggggggtgctatggagatataatgggcgatgtttctcagggctgcttcaagcgggattaggggtggcgtgggaacctagagtgggagagattaaactgaagaaagattttgggataaggggtgatattgtagggttgttagaaggagtatttgttgtatagaatggttggtgatggcctggatgcggttttgtatgaattgagaaactaaatggaacacacaaggtccaaataaaagatgaagaaaaataggtattaaagggctaagaagtgggagtacccaggacatccaattagagagtgtccaagggggttcagcataattatttgcttggttggtgagtttttgggctctatccttgagtttttttatgttgtcatgtaccaggccagattgatttaggtaaaaacaacactcttcatttaaaaatatacagagtcctcctttttcagcagtgagtaaatcaaggccttggcagttccggaggacaactgcagctaaagagtcaacctgggcttggaggacagataaagtttgtgatatatctgtaacgctagcagaaaagtcattagagaggctgcggaatgttgtgacagaggtggatatgcctgctattccagttccaagagcaatagtagaggcagaaagtcctaggcctacaagtgtagggattagtgggatgactcttttttgttgtgttggtgtcatgagagggacaagcagttgttcattcccatctgcaaactggattttgggggtaaggaagactagagtacatgtgcccatccatttggcaggtaggcacatgtaggtggaagagccacataaaaagaagagaccttgtgtcaggcagaactggaaatgtaaagtgaaaaagtgagacggtgtactcaaagaggagtcctgcacctgaaatcttagagatccagcaagggcagcagccattagaggttataatggggattgatggtgcaactgcatagagggagaggtttggttttcgtggtatatgagaaagtgcatagtgtctatgactaacctttcactgctattcatggggcttggtataagcaagcaagaggagggcctaggaggagattcagacaagcagggggagggtagccaaggatggagtgagatgcagggtaggtgtcttccttaacaatagtgactgccaatgttttttagtttgttaataatgatagagggcttatcagtaatgtgaagttggaacgctcccatctctttgataatgtgtgtggctgggttctggagataaagagtaaaggaacgtttggacggtggaaggttgcctaaagggattccagtaggctgttgtcgggagatgcataaaggagcggcaacagggatagttgtttgtgtggttagaggtccaaatatggcggggtggaggggggtggaattgacataaggagaaaggtgccgtaaatagacgtggagaagtgtggcagcttgttggtgcaaaatatctggggagttctcaccaaatctgcctagaaagtaaagaagttcctcagatgggtaaagatgagggctattaaaggaggttcggaggtatagggagacaggagagtagcccagtcagcctgtagagcagggatggctgtgtaagagtgggaagaaagggaaatgcatggccaacaattatttgctagagaaggattggaggcagtgaggagagagtgggtgagattgatagtgtgctggaggtaactagggagaggtagagagtgactggagaatgggggcaaggataagagtgagtagaaaagtaaaaaaaaagaaagaccttcatcaggatagaagaattggagtgtaccttgccactgaagatcttctatccacttcaagagagacttaggggtggcggtttgaggtaaaaccaggagatatcagttatgatggtttggaggaaaagtgtggtatttacgattagttgagaatggtgaataggagtgtgactagacagaagatagtagggatgacaagtttttggggtgcagtccaagtagtgggagtgactgtgtaaagccctgttgcaaaaagtagggtaaggatgaatagacctaatagaatgaagggatgtattaggctcataagggttattactgctcttcagaaatgcgagtgagtttaagggaagtaggggagagtacttgcaatttccagggggaagaggagagatcaggctggctgtctgatgggcacagctttattctggaatggtgaacccaatggggagggtcctgcaggaggacggcagttgtggtactatagatgactaagtagggtccggtccatcgaggttgtagagtttgaggggtcagattcttaacaagaactgatcatccagctagggtgtcttcatatggctgggaatctggagtaggcaagagaagattagcagcctggtgaatttcctgtctagcctgatggaggactggaagatagtcgcacagaaggctggtgtctgggatgaagttggggccgagcaagaaagtgcgtccgtataaaagttcaaatggactataccctgtagcatctcaaggacaagctctaattctgagaagggcaagaggtaaaagtactgcccagtcctttttaaattggaggctgagcttggtgaggtgtgtctttaaaagaccgttagtccattctacctttcctgaagattgaggacagtaaggggtatgaagattccactgaataccaagagcctgagaaactgcttgggtgatttgactaataaaggcctgtccgttattggactgtatagaggtgggaagtccaaaccaaggaattatgtcttacagaagggaagaaattaccatggtggccttctcagaccctgtgggaaagacctctacccatccagtgaaagtgtctacccagaccaagaggtattttagtttcctgactcggggcatgtgagtaaagtcaatttgccagtcctgggcaggggcaaatccccaagcttgatgtgtagggaagcaggtgggggtggcggggaggggagcctgaacaatccctgaggagtagtagaatagcagatggaacactgagaagtgatttccttgaggatagatttccatgaaagaaaggaaatgagatattctaagaggtgggctagcggcttgtaacctacatggaagaggttatgaaatgacggcagaatagaatgggcctttgaggctggaaggagatattttccttggtccaagaaccatttgccttgtgtgagaagagatggatagatggaggttttagtgggagagtaggtgggagttaccaatgagaaggagaaaaactggccatgagggacagaagttgtaatgctcgctgcttctttagctaccttatcagcataagcgttgccctgagtgatgggatctgatgccttttgatggcccttgcagtgaatgactccagcttcctttggaagtaaagcggccttgagaagagtttttattaaagtggcattaatgatggaggacccttgcgtagggaggaaacctctttcagcccatataacagcatggtggtgcaggatacggaaggcatatttagagtcagtataaatattgatgcgtagtccctttgcaagagtgagggcccgagttaaggcaatgagtttggcttgctgagaggtagtggaggggggcagagtggcagcttcaatgatagatggaaggtactatagcatagcctgcctttgctggttagtggcgattaggcctggtaaaactgctgtcaataaaccaagtgtgatcagggtgaggaacaagaaagaaggaaatatggggaaatggagtgaatggcaggtggatcagagagatacagtcatgggggtcagatgtggtatccggaataatgtgggaggccggattgaagtccaggccaggaacaatggtaattgtgggagactcaacaaagagtgagtatagctgaaggagccagggagcagaaactatacatgtcaggtgtgaggaagaaaatagattttggaagttatgagaactgtagagagtgagttgagcatagtttgtgattttgagggcctctaaaagtattagggtggcggcagctactgcatggagacatgatggccagcctaaaacagtagggtcaagttgtttggatgaaaggctacagggcatggtcccagtccttgtgtaagaatcccgactgcacagccctgcacttctgctgtgtgtaatgaaaagggttgggatgagtcagggagagctagtgtgggggcagtatttaaagctgtcttcaaggaacggaaagaggagtgggaaaaggatttaggatctatggggtccctttgtgagtttatataatggtttccctttgtgagtttatataatggttttgttaggatggcaaaaccaggtatccaaaggtgaaagtatccaaccatgcccaggaaggaaaggagttgtttttttatagaagggtttggggtttgagagatcagccagacatgaccggcagggagagcatgtgtgttttcatgaagaattatgccgaggtaggtaatggatggagaagaaatttgagctttggagggggatacctaatatcccttggagaataaatattaaaggagcaggagggtgtcttgttgagaagattcaaaggaggggctacaaagtagaaggtcatcaacatattgaataaggtgagaagtggaggcgtggaaagaaagtaagtcatgagaaagagcttggctaaagtaatgagggctgtcactgaagccttgtggcggcagtacagcccaggtaagctgctgggactgatgggtgtcagggtcagtccaggtaaaagcaaagagaggctgggatgaggggtgcaggggaatagtgaaaaaagcgtctttaacatcaagaacggaatagtgagttgtggaggaaggtattgaggacaaaagaatgtatgggttgggcaccacaaggtggataggcaaaacaatttggttgataaggcacagatcctgaactaacccgtaagacttgtccggtttttggacaggtaaaatgggggaattgtaaggagagtttataggctttagaagcccatgctgtagcaggcaagtgataacaggcttcagtccccttaaagcctgttgtgggatggaatactggcgttaaagcagggtaagggtgattaggttttaatgggataataatgggtgtgtgattggttgccagggagggagtagaggtgtcccatacttgtgggttaaggtggggggatacaagagaaagacacaaaggaagctttgggttggggagaagggcagcaatgagatgtggttgtagtccagggatagtcagggagcagataattttgttaaaatgtctcaacctaataagggaactgggcaggtggggataactaaaaaggagtgcataaaagaatgttgtccaagttggcaccaaagtttgggagttttaagaggtttagaagcctggccgtcaatagccacaacagttaagggggcaagggaaacaggcccttgaaaagaaggtaatgtggagtgggtagcccccgtatcagttaaaaaggggatggacttaccctccactgtgagttacctgaagctcggcgtctatgatggtccagggggcctctgaggcaatcaggcagcatcagtcttcagccgctaagctgagcagatctgggaaggactcagtcagagagccttgggccagagctctagaggctctgggagtggctgccaggtgagttggacagtccaatttccagtggggtcctgcacagatgggacacagcttaggaggaatcccaggctgtgggcattccttgcaccagtgaccagatttctggcacttgaagcaacatcctgggggaggaggccctggaggaatgcctggccactgcaatttaggcgttttgaagttcttgtgtggtggagatgtggctggggtttctctcacagtgaaggcaagtaattgcaattcagaaatatgttgctgcttggctgcctcttctctattattgtacaccttgaaggcaaggttaattaagtcctgttgtggggtttgagggccggagcctagcttttggagtttctttctagtgtcaggagcagattgagtgataaaatgcatatcgagaataagacggccttctagccctgctgggtccaaggctgtaaagcatctcagggttgctgctaaacaaaccatgagctgggctgggttttcatcctttccttgggtagtttctttaagtttgtcataattaacagatttgtatgctgcctttttaagcccttcaactaggcaagcagtcatataatctcacctagctatacctgggggaatctgcctgatagttccattggggatcttctcggggaactgctctaatgccttcctggaggcctggctcatgaagccggtggttgtcagtgtgagattgggctagagaagaaactctttcctgttcatctggggagagagtagaagttaggatgacatttaaatcactccaggttaaattgtaggacagagttagatattggaattcctgtatatatttagcgggatctgatgagaaagagcctaaatgctggctgatttcagaaagcattcagagaaaaaggcacatgtaccctgactatgccttcagctccagccacctctctaagaggaaatttttgggcaggtggggaagagctagtcatggaacgaaactgtaagccagaccaggtgtgaggaggagaggtgatagaagggttgtagagtgggggagcagaggctgaagaagagttggaacctgattcagcctggcagggagcaacctgaggaggagcagtctggggaggaggtgacaggtcagatgggtcggtagaaaaggaagattcagaagactcagcgatgcttggggttggtactgaagggacaggtgggagggaaagaaggaggatttgggatgagttgcattgggaacagagactagggagggaacaaagtgtgaaaaatgcctggacataaggcacctcagaccacttgtccattttttgaccaaaattatctaggtcttgtaggatggagaaatcaaaaatgccattttctggccatttagagccattatcaagtttgtgctggggccaagtggtattgcagaagaaaataatatgcttaggttttaggtcagacgagagttgaagaggttttaaattcttgagaacacaggctaagggagaagaaggaggaatgtagggtggaaggttgcccatagtgagggaggcaagcccagagaaaagagaggatagagacacagagaggggggtggtacttgccacccaggggaggtggtgcttgctaccccagggaggtggtacttgccaccaaggtgaaggatcaaggcaggcgtccccgtggtgatcagacacctctgaaatgtgggtgaataatcaggcaggcatccgcacagtgattaaacaccgaggtaagactgttttcctgagtccgtgaccagcaccagagttttgggttcatggataaagcacgtctcctctgtctctaccagaaaaagaaaggaaccaaaattaaggaagaaagagattgaagggtggaaggatggtgagagagattggagaagagaatgaaaagaccgcttacccgatttgaaattggtgagatgttccttgggctggctggtctgaggacccgaggtcataggtggatcttctcacagagtgagggcgaggacagggtactggtctcccgaaggagtcctcctgtcccaggtctttggcaccaaatgtcatgcacgtccgtgtgaggagaccaccaaacaggctttgtgtgagcaataaagctttttaatcacctgggtgcaggcgggctaagtccgaaaagagagtcagcaaaaggtggtgggattatcattagttcttataggtttgggatgggtggtggaattaggagcaatgtttttcaggcagggtgtggatcttacaaagtacattcttaagggcggggagaatattacaaagtaccttcttaagggtgggggaatatcacaaagtacattatcacaagggtgggggaggatattaaaaagtaccttgttaaggttgtgggaatatcacaaagtacattatcgcaagggtcggggaggatattacaaagtaccttctcaagggtggggagagtgtgttgtcaaaaagtcaattgatcagttaggatggggcaagaacaaatcacaatggtggaatgtcatcagttaaggcaggaactggctattttcacttctttggatcttcagttgcttcaggccatctggatgtatacgtgcaggtcacagggtatatgatggcttagcttgggctcagaggcctgacagtgtttattcagccttagaaattcctctcaaatggatgtttccttcttcctgagcctactgcctctgcaagagtgggaggcctagcctttccaaacctggactgttgcatcctcctgttcctccacttgacagtcttcctctgcaacccaccgtccatggctggtttccttcctaaaacacacgctgacctttgcctggctccccagagcctagaggagcaatcccagtctcatttaaggagccctcaaggctctgctttttctgacctaacttacctgttgccttgtctcctttttccccaaaatcttcctaccttccctgtacatctgatgctttagccccaaggaccttcttggccttccccaaacaacacaccatctctgctattctctcttcctggaatccccttccctctttttactggaaaactgtaaccataataggtccattgtctgttgtgtacagcaaatcaatacaccaagatactgggatgcagcagagataagagatttaatcatagagttgcccagaaaagagatgagagggaacctcaaatccatctccctgaggagtttggggctagggtttttaagggttttggagtgggccaaagtgtggagaccattgattggtcaaatagtgcagggcgaagtcatgggacagggaactgaagaaactgtattcttatgctaattccatttctttgtgggagtcttcaaactggctggcatcagctattttgctggaatttgggatctgaaaaacatcttaagcgatccttaaaaaaaagccttatgattcaaacgtcagaaatcctctttatagaaacaatgggtatgcaagtggtcaggtgtcttgtgctaggagacttatagcaacaaggaagtgggtcaaagtgcagcctaattaacgcttagttataacaatatttctgtacagaattcttgttaaccatgtgaggatggcgtcaactccttttcctctgtcaacatagcaaaggaaatgccagaacactattggctgtcccaggcagggtaattctgctgctgcaggtccttttccctggctggactgaacctcttgagggcagatagtcacatagtacctggcccatggtggatgctcaagggatgatgaaaggagaggtcacatgttatatgctcccatttttgtgaaatttccagagtaaacaaatgtgtagagacagaaaatagattagtggttgccaggggatagggggaggagggaactggaaggtatgaggtttctttctggggtaatgaaaatagtctggaattagatagtggcgatggttgcccaatattgtgaatatactaaaaacaatggaattgtatactttaaaatggttacaatggtgaattttgtcgtagatgaattttatctgaatgtttttattttaaaaatgttaaataaaatttataggaggccattgattgagactgagctcctgcactaggcccctgtaggccaagccaaaatggaatcccttgtgctaaagtctcacatcaccaaactgaaactaaattgtttatcttaccttgcaaggaatcaggagaaagagagagataacaagcaaatccccaaacaagccagtgttattcctcacgataaggaagtcccctcttctttaaccctgaggaaaggaacctaaagtaacttgatgctaaccaatccactttgtgttcccagtttctgattttctcagccttttctgcctgtaaaaccaacctcctcggctcagctcatcataggaattttctaaattattggaggagatgtcaccccgattcatgaattgtaaacaaaagcaaattcgatcatttaactaaatttgttgtcattttgaattttgtcttttgacagaaatgatgaaaagatgaaggaataataaaatactttttcttattttctaatttgcttttatcccagaccctttttgtcattcttcagctactcccccatgtggaactattataatctaaatgaaagtgtttactcaatcacagaccacatctgaattataatcaaataccaattagcagtcttggattgatggtgtctgttacttttgctgtttgtccttttcctgctgaagtagaaactctgcagggagagaagctgtctagacctggtgggtgtcatctctaatacatccatctgtctaccttgctagagaccaaacttggactaatccctgcaaaagaaaaaccagcaaggagaaaaggcatcattaggaatgtagtttgtgacaaaaatagctcttcagagcttttcacacacacacacgggttcatttattcatcatgaaaaccagtgcggggcaagggggtaccttttgatggggaaaaaaagcttctgacctgccctcactagtgagtgggctgagggggtgagctaggctcttctgacctgttggttatttctgcaggataaggagagagaatgtgttgagctttctctgagtgaggcttgtgcctgttactctcattatttcacgagtagagcccagtctgcctggaacattggaaaacaacaggacatacaagcattgaaggccccactgtggccacttcaggagaaaatggcaaagacaagtcctgattaatgaagtcacctatgacaactccacttcagacaattaactcaagttcccatcttcagctcccggagaactgagacacatcattaactgtaaattatagtgactcctccaccctgaggtgtcctaaacattcttgtgaccagagaattttcagctgataaacttaagatatgatagaaaaaaatggagttggggaaccagttactctatgaaaacttttgtaagtagtttcccatggattaataagaaaatctccgctcatattacacaaagataatttcaaccccattatagacacatgatgttattatttgtggtaagccaacattttcatggcacatgcgatgttgccagtgacagagcaggagcattgccatcttggacaagcactgccattttaaagttccccttgatcaaaaactgcctaaatcaaacccaaagggcatcagcctaatggctaatgtcagtatgaccataaaccacaactgacatctctgaccagaaacattccaaccctaagataaacccctccccgaccaaggacatgccagcgccaagataacctcccctttgaccggagaaatgtcagccccaagacaatctcctctccaaccagagacattccaaccccacaataagcttctcctccacacagaaacattccaagcctgtgataagctccctctccctgaacccttaaatattcttagtctgtcagagagagtgctcctgaccaaaatcagccagaagcccctctcaggtttattctccgaaataaacctatctctgactgttgagctgctttttttgtatttcttgtcttctttctttaattcttacagcaagcactattttaagtgctgttggtaaactaacccatttagtctacacagcaaccctataagtagattactgttatccctttttacatatgaggaaatcgaggcacaggtaatttgcccaaggttacacaactagcaaatggcagagctggaatttgaactcaggccacctgggtccagagtccattcaacaaacagagctcacagggttgtgtggttagtgagatgggcaatccatgcaagcatgcaatttgggccaaaaggctcccagtgcaggacacagcacacagaagtaaatctgtgtttagtaggatttcacagaagagttatttgtgattgtgaaaagctttctgttgtgcagtttttgttttttttttcccccagagaggaaacagattacatggactattttcatatgtttgtgaactggccatttgggccagattaaggggtcaggcattggtggggaagggagtggaagaggtggggtcagcctcattatccagcccttccatcctacagagcactccccaaggctgcattcttcatttgaatgcatttcaaagtgcagcctgattaatgcttaattataacaatatttctgtccagaattcttgttaaccctgtgaggatggcttcaactactcttcctttgtcaacatagcgaaggaaatgccagaacaccattggctctcccaggcagagtgtttctgctgctgcaggtcctattccctggctggactgaacccctggaggccgacactcacacagtgctcagcacattcttcaaatgaagcattcttcatccgcctcctgtgccttcccctggcacactggattcctttcacattcaaaaagacctcacatcacctccctgttctctagagagaagtgccctgtttcttaagcaaagtgctaaacagagatagttaaataaattttcaagtaagtaagagagggcttcggtagttccctaatgtaggggcaagcccaaattattttaaaattgcattggagagactcagcaaattctgagtataagttggatgcctgctgacttgggcccagacaaaagacctagcacccaccttctccctgccccaccccactcccacctcctggcttcccgagaagctcagcagctgtgctagttcatccaggcccaggaactgagtggagaggggggctggggtccctgggatgggtcattcccaactgcagaggacagaagccttctggaataaaagccttctgccaggcatacccctttggtcaatccatcaccaagtctataatcaacactaaagtggtcctaattgtgtgggctcagggagtgctgggaaggaagacctggtgtgggcacagtgatcatggagggaggtcttagaaagagggcttggattcaagtgtgagagaaatggcagctccccatgagggaaggggcatgttttctctttcttaccagctgtattctcctgatccaaaatcattattcatcatcaaaataaaattccagagggccagcttgttctggcatggcaaggacagtcagatgacctgagggggcataatgaggggaaggatcatacagttagtggggctgagacactggtggcattgggacagatgagtggagatcacgcctatgccaaggaactcatcttcccctcgtgctgcagccttcaaaagtatctcagcacaagaagagggagggagaaagaaaagctacactttccagagtcctggagtggacattggctatttcttcccacccagactccattgcccttgaggaacacctcctcccctttctcagcccctctggtttggatgaggcagatcctgtgatgctcacccccaacccttgccacagggtcagaccaggacccaccctggccagttagagcattttacctgcctggcctcagggactggctcaggcaaatgagactcaaattaggggcttttgatgaatccactgggaaaagtgaagctttccttcagtggggatcactagctctagggataatgtctgatggaaggtccagaagccagcacgtggccaagcctgccgagggagcagcattgaaggatggagggagagagaccaagtcctgatgagatccttcaagtgcctagatttggagggcatggaagcccacaaattcatttttttttaaattaaccatcttaaagtgaacaaatctgtgatacctagtacattcacaatgttgtacaaacaccacctctagctccaaaacactttcatcacccccgaataaaaccctgtgctcatttagcggttactccctattctgcctccccccagccctggcaaccaccagcctactttctacttctacgagtttacctgttctggatatttcacataaacggaatcatacaacatgtgatcttttgtgactggcttctttcacttagcataatgttttagaggttcatccaccttatagcatgggtcagtacttcatttgcttgtatggtgtattagtccattctcgggttgctataaagaaatagccaagactgggtaatttataaagaaaagaggtttaagtggctcacggttccacaggctgtacagaaaacatgacgctggcatctgcttggcttctggggaggcctcaggaaacttacagtcatggcagaaggtgaagggggagccaacacttcacgtggccaagcgggagccagagagagtgagggggaggtgctatatacttttaaacaaccagatttcatgagaactcactcactactgtgaggacagtaccaagcagatggtactaaatcattcatgagaaatccaccctcatgactcaatcacctcccaccaggctccacctccaatattggggattacagtttgacatgagatttggcaaggacacagatccaaaccgtatcatatggcttaatattattcctttgtgtggacataccacattatttacttatttagacacagggtctcactctcacccaggctggagcgcagtggggtgatcatagcttgcctaatttaaaaaaacttttctttgtagagacaagggtcttgctatgttgcccaggctggtcttgaactcctggcctcaagcagtcctcctgctttgggctcccaaactgctgggattacaagaataagccactacacctcgccaacataccacattttgtttattcattcatctgttgatggacgtttatgttgtttccacctctgggctattgtgaacagcactgctattagaattcatatacgagtatttgtctgaacacctgttttcacttttggggggtatatatctaggaatggaatttctggatcacgtggtaattctgtgtttaactttttgaagaactgccagactctcacagcatctgagcacaaattccttttttattgtcccatttgactgaacaagatctcgtacatgccaagactgaaacctttactgtcccagggcctccagcagaatgtccctcactagtttggaattgttcctgggctggtgactgtgatggtgcaatccatagcccaggaatgaccacagctaagaagccttgccccaaaacagcccctttgcagctgctgggggaggcctgtctggccagtgactgtcagtcattctgtctgtgccttctgcctggatggcctcccacagagcagtgctgagaggtcactggctggtttgggctgaatttcgggtaggggcaaggctgtgggatggtctgtctctccatagatccaggcctttggatggccttttccacccgtcagcaggtatgggaatgccaagtataggtgctatgctctgaatgtttgtgtccctcaaaattcatgtgttgatatcctaacccccaagttgatagtattaggaggtggggtctttgggaggtcattaagtcacgagggtggagacctcctgaatgggactagtgcccttataaaagaggccccagagagtgaccttgcctcttccaccatgtgagaaggtgccacctatgacaatgggatccctcaccagctaccaaatctgccagtgccttgatcttggacttcccagcctccatgatggtaagaagtaaatttcggttgtgtataagctgcccagtttatggtattttgttatggcagtctgaatagactaagacggtcgggggataaccacggaaagagaaccaaggccaggacacttgtacttcacctaccacctatccagtatatggcattgaggaagtcactttctgtctctgggtttcagtttctcaagtgacaaatgagagggacctattaaatgatgacattgacagtctctggtcctgggtgcatctcactccatcctgctctccagctttccccatctctctgaatcttcataaaagtctaggattttgcagctggcaggggccatggagataatccggaccacctgccctggtgtctcttctcatctctcagagctcgcatgctggccgctgtgtgccaggcagctcctggagggcattcatgatcagcaccagcatcttcctgtggctgtcccagcagataaagcagttattactgatggagggacaatgaggtgtgctcgccacaactggccttaatgatgttggactccgcaggattgccttggctaggcagcttcctgtttaaatgcagggcctggagacaccaatttcgtctacaccaacagcagcattgtaagtgccctcaatgcctgttgcagcagctgtggagtgctgagcaacatttggggtgcattttctgtgtctttcttgtacacacacacacacacacacacacacagagctatcatgaggcttgccctctactacatacacctaagagtgcccctctgtaatatttcatcattttaatcaaatgttcactctttcacaacatgtataagtgtacttggtataccaaaaaatgctatcacagagtaaggtgctttgttattattgctattataattgcccaatccttataaatccaaaagatacaaatgacaacctcctaattgcaatttcaagaggagtctcagtaccaaaactttgatgttcattcacatgggaaatctaatgctcttggactggtattttaaatacaacatgatagaggccaacacttgggccctttctgtgggagtggggcaggctgtggtttgaagaacatcctgttcatgtcatggacccctgctttttgaagggccactcaattgccttattgaaagatgggtgctgtatgatccctggggctccatgccccatccctaggtgtcctctcaaggagccgagattaccatggctattggtgggctgaggggccttgatgacaggcagcaccaagggggcctgggtaatgaagggcagtgagggggtcaaggacctgtgtggagaagacttgggcagtggcgttcctgctttttaagtgctgctgatgttggcaaggggaggaaggcaacggatgaggatgggataggggcaggatgcgatgaaacgacccctaagtagttcctaccccgagatccagggtctgtgagtaaagctctgcagcccctgaggatttgggccatatggtttcatcctgccctgggaggcacccttaggccctcatctctcaagccatctgcatctccccagccaggaaagggtatgtggtcttctctgtagaaggtggcacaaagcaggcacacagtgccacaaaaaggcctcgctcttgattgactcatcaatgctgtgtgacatgtgaggagtgaggatgtgtgcaggagacccctgctcccagcactgtgcttaccccactggcccccaggcattctgccagctgggcagagcaggacagaggcacagagaaggtgaggcgctgtgtgtgtggctgtgtgcatttggggacatccatccatcaatccagtcagaccagggcaggctcttccttgggccccttctgttctgtcccttaggccaggaatatggaatggccaggaatatagactggccagggccaccggaatctgtgctaacgggaaagggctaacagagcctgacagtgagccaggggtctgcacaatggagaactctccactggtactgaccaggaacctgtgttgccctttgacctaggcaaaatagacagctgcctgtgtggtagatagtgaaaatcagaaaagactccagtgccccctcaatgtagttctcctttgtgcctgatatcccctcatcagcagttctcacctttgagttttaatggattcaaatggatatgtttctggagagggggagggtatcacacgtgaagacccttctcttcagcactgtatttctcccatgatagaagggcccttagcccccacccctgctgcccccaaggcctagagcgtggtaggggcagggtgcctcagtgggacagatgtgtagaagtccaaccttcttgacttccttgctttgctgtgagcatcacagcagtgcgcgaaggagggggcaggcaggggaaaggggtaggcttgtgtgaatggctgctgtgaattttaattcaattcagtctggctggcttactgaatcaatgttgggaaaacatagcgctctcctgggaggagaggtgtttggtataaatagaaggtattatcattaagaggcaattaggggacgtcatgtcgctcaatacagcgcaaggcagcagccagagccccagccgtgggctgcagagctacaaggaactgctttcatttacttgtccctggagaaaaagactttcctccattccagggctctctctggtcccttagccccttctctgctggataaattgagccaccttattctcaggggttgctcgatggggtcgtaaccacaccagtgaactaaccatagaaaggggttaccattctccactcaaactctgagcaagagcattgccttccctcacataccaccttactctttctaaacagctttattgaggtacaacttacatagcatacaatttacccatttaaagtatatgatttgtccaggggcggtgactcgcgcctgtaatttcagcactttgggaggctgaggcaggcagatcacctgaggtcagaagtttaagaccagcctggccaacatggtgaaaccgtgtctctactaaaaatacaaaaacttagccaggagtggtggcaggtgcctataatcccagctactcgggaggctgagacaggagagttacttgaacccgggaggtggaggttgcagtgagctgaagtcatgccattgcactctagcctaggcaacaatagtgaaactctgcctcaaaaaaaaaataataataataaataaaaaataaagtgtatgattcaatggtttctagtatattcacagatatatgcaaccatcaccacaattttagaacattatcacccccaaaaagaattttatatcctttagctgtcacctgtccatctccccaacacatgccagtcctaagcaaaaactaatctactttctgtccctacagagacttattctggacattttatgtaaatggaatcatatcatatgtggcctttatgactgccttctttcacttaaacataatgttttcaaggttcatttatgttttggcatgtatcgttaattcctttttatggctaaataatattccactgtatggatatactacgttttgtttatcggttcatcagttactgggcaggcatgtgggttatttctaccttttgactaccatgagcaagtttttgtgtgggcatatttttcctttcccttgggaacatacccaggcgtggaattgctgggtcgtatggtaactccatgtttaatcatttgaggagttccttcttgctctttttaaaaaaactattattttttttttccaggacacagagatgccagagaaatgcggtcagttcttcctcctcctcgttcttaacaacacttattaaataactactactattaactggggacctgctgggcaatcatttagcaagtatctctttagccctttttatgttccaggcactgttctggaagctgggggacagcagaatggtgaatggtgagtcagcgatgttgcttcaccactatgaggactttggcttttaccctgaataggatgcaaataacttggaggtttgttttttctgtacaggtttattgagatataattgacaaaactcaataaactacacacaaagtgtacaatttcatgagttttggtgtgtgtgtatatacacacgaaaccatcaccaccatcaagataatgaacatcttcccccaaaagcttcattgttgtgcttggcgattcctccctcctgcctgtctgtccctacccacctatcttgagtcaaccattgagcaaactacagattagttgcattttctagaatggaatagtatgtggtcttttttagtgtcgcttttaaaatttggcataattgttttgaggtttatccatattgttgcttatattagtagttcatttctttttattgttgactagtagttcattctatggatgtgccgcaatttgtctatccattccccagttgatggacattagggttcttccatgtgggatcttatggcagatgtatgtttaagtttataagaaactatcaaactgttttcctaagtgattgtattattttatactcccaccagcagtatataaaagtactatcgattgcagtttttttccaacacttggaatggcccatcttttaaattgtaaccattctaataggtatgtaatgatatctcatcatgatttaaatttgcatttctcagtgactggtgatgttgagcatcttctcatatgtttgtttgccatctgtttatcttctttaaagaagtgtctgtctaaatcttctgctcttttttttttaagttgggtttcatgttttcttattatcgaattcagagagttctttattaagagtcctctcaacaatgttttgtagtttccagcatgcatctctataggatatctgtgctcccacataccctggtgtggaatcaccgcctcctgggtgggctcaaggcatattgctatggttacccgccaggcacggcggctcacgcctgtaatcccagcactttgggaggccaaggcgggcggatcacctgaggtcgggagttaaagaccagcctgaccaacatggagaaacttcgtctctactgaaaatacaaaattagccaggtgtggtggcgcatgcttgtaatcccagctactcaggaggctgaggcaggagaatcgcttgaacccgggaggcagagtttgtggtgagccgtgatcacgccattgcactctagcctaggtaacaagagtgaaactctgtctcaaaaaaaaaaaaaaaaaatagttacccaattgactgatacagcaagaattttctcctggggccacttgctgggatcatggagatccttattaatacatggtatcagcagctgcctattctccctgccagggagtaccctgtggccaccacagggaatgatgagcctttctggctgccatcctacagacctgcaagagcagcccaagtgccttggagctttatggcatccaattccaagtagcaaggttaaccctataggagaggaatagcttttcctcacccattgctaggttcacagctgaggtcccgataacaaaagatagatcaacaagagatctatcagatcaacaagagaaaagatcaacaagagaaaagtataaaagtatttagtaagttttatgtgaaaccgattacagtttataaggaaatgaagacacaaagaaacagtaaaacctgtggatttttaatgctaggtttgatgaagaagtgaatgacggcggtgaagtatgattggattagaagtatgatctaatgctaacaaactaggggagcttagcaaggcccatttgtttggttcccctctgtgaccctttgtcttcagagatgagaatgttccttacctctcacacgagggtcttctgatccgctgtaggggagggcagaaaaatctttcctagatcagatggcctgcttcaggggagaagaggggaaggtgaaagtgatcttcctacttccactgttttgcaaatgccaagataccatatttgggggtagcatgccctgaaccccatcaagccaatctttcagagagccagctccttcctcccacatggcattgtgcttcctgacatgggcttgtcaatgcagctctgcctgtgtcccctgaatcattttcttggctactactataactttttccaggaacacacccacagatgagaaatagctagaccaatgttgttgatgccaaaagccaagaattagtggtggcagggtgaatctggagcccagaagaacttctgtgaatcttccacggggtgtttctaagattggtctactcccctcccccatgccccattatctcatgctgggttaaaaccatagatgccaggctcatctccttgcctctagactcttatctttaagcattgctgcacagtatgggccagattcattctcttctgttacaataaccatcatcttgcttccctgttcaggaaccatccatggctggggacagcggctcacgcctgtaatcctagcactttgggagtttgaggcaggtggatcacttgaggttaggagttggaaatgagcctgaccaacatggtgaaaccctgcctctactaaaaatacaaaaaaattaaccaggcatggtggcaggcacctgtaatcccagctacttgggaggctgaggtaggagaattgcatgaacctgggaggtggaggttgcagtgagctgagattgcaccattacactccagcctgggtaacagagtaagactccatctcagaaaggaaaaaaaaaaaaaaaaaagaaccatccatgactcctctgtgccctcaggatgagttctaaactcttggcctcatgttcaagaaagcccaacacctggtccttccctgtgtgtcccaaatactctgctccagccagcccagttttcttgcaggccccagcatgctcctacctctaagcatttctcatgtatgccctgtcctgtccctccccacacccacctgcccaaatctcacctctccttaaaggtcagtgcgaatcctagttttctatgaagtgttaccaacaattatggccgacttcaccatcttctgttccttagggttaatcagaggttttattttagaacttgctttcacttttattagttctattagttctttattagttattagttctatttatcagttctattagctcccttttagtgaggctatgctagacacgacacatatacacacacacttgtactttttttgcttggtttatacatgttggttcctcataagagttgttctaactcaaacagcaaaagtctggactcccagaaactctgtttgtagatgccaacatggggattcagagagcccaggtaacttgctcacgtcctacaatgagtgagtgttgtgggtgggctttgagcccatgcccacccccttcctgctctcacatgacctcccatggccctggaggacaggcagggctgagagcctcgagctgcaggggaagagaactgaagcacagagaggttgctcccttcaaggacacatgggagcaaatggcaaccaaacgtggaaagtgggtccattttaaaaagaattatagaaaaacactacataaaatttactattttaacctttttaaatgaataatttggtggcaataagtatactcccaatgtcgtacaacatcctcactatctaattccaaaacattttcatcgctccgaaaggaaacgttgtacccattaagcagtccctccctgttacctcctcccccagcccctcataaccatgaatctgcctgtgtctctgtgtatgtgcccattctggacatctcaaagaagtgaaatcatatgatatgtggccttgtgtttctaggctttttcactgggccctttcattttaatgctgcacttgtggtagctcatctgggttgtagtgaaaaattatgtgtcaagtggctgtatcaaaatggaatgaaccttttctcttgctgatctctcttttgttatagagacctcagctgtgatgttgctcagcctggaatctaggttttctgatgcctattggtgaagaaaatgcatcccactgcctgccccagtgctttaagtttgacccctagccttgaattgcctctatttcatgaggtctatctgtcttcttgcttttcttccagaccctactcccacccgaaacacacagcccctgacacagagctgggcatgtgtgggctctcactagcgctggctgaactgcctgcaccggcagggcatctggcctccttcagcggagagggcccagcaagcaggactccgaccgcctccactactccagctgaattccagcccctgctctcccgtctccaggtcagaacatcagcatttgaacttgagtacttcccccatgcctgtcctgcgggacttggggcttgtactccctctgaggttggaccaccctgaattggggttttccagctagaagaatccctccacagaagcttgaattttccttctgttctctcctttgctctgtacttctcagcaaaaagcatcacctataaatgtgaaggctgattaattctaagtctggggctagtgttaatacagacacagctggcgagatacagaattaaataaacacaaggtcctctgctgactcagcagttggtggaacaggggataagcccttgggcattctagaaagttctgcctgcccagtggtaattttccctttcaggtttcttacctggaaagaaattcccagccactcttgccagcctgtctatttcactaagccagagaacatattttgttgtaagagatttgaacattactttctgctctcaagggacccccctctatcaagtccaattttctgtccctgcctttaccattagagagtctctttggtggagcaaggcagtaccctctctatgcttttttagtgtctggtagaggcagtgccaaggggtggctgggaggatggttagctaccagctccatttcttttttttttttttctttttttgagagagagtctcactctgttgcccaggctgtagtgcagtggcacaatctcggctcactgcaacctccgctgcccgtgttcaagcgattctcctgcctcagcctcccaggtagctgggatcacaggcacctgccaccgtgcctggctaatttttgtagtttttagtagagatggggtttcaccatcttggccaagctggtcttgaactcctgacctcgtgatccacctgcctcagcctcccaaagtgctgggattacaggcatgagccacagcgcccggccgccatttgagaataaaaacactgcactttataatgctagcactgtttccacccaaatctgccatcgtccttcttccaaccaattgccctccctaaatcctttctagatagacattccgtagtcacaccacccctcgtatgaatgagttgatcaggcctttccctttgcgggaggcacagcttgcaggcccattttagttgctgggtctctgcatctcaaattctgggcatgaatatgggtaaatttttcatctgtgtcctacatgcctctgtgcacatgcaacgtgcagactgttcaccccttccaggcagctttcagactttgcttcactgtgatcagcagtgggtataagggatggtgtgcatgtacagatcccaagtacagcattggcttggggtctcatgccctctggcttgttccttaggctttcataggcctacataagtgactgatgtatttcctctctttttttttttcggggtcttgctctattatccaggctggagtgcactggcaccattatagctcactccagccttgaattcctgggctcaagctcctcctgcctcagcttcctgagtagttgggactacaggtgcctggcaccaaggccaccttgtatttcccctcttgccaccttaccctgaatgtgatctgagatccaacagtttctttcctggccattttatttgttcaaattgttaggctgttacaaaagatgctacaatgatcatctttgtgccttccatctgtcattgaagtaacctcaatgggagccatgcagacagggaaggatgttcagaatccagttggatttaaatatattcaagaggtgtggccccgacagattggaagagcataaaaagaattcagaatagtattaagcagtcaatagaggacttttaatgcagaggggaaggatctgggttgctggtgaggggctggttttgtaaactcaaatcaggcttgataattggggaagatataaaaggtaaggaagatataacccagagcacaggctgtgagaccaccccatttggagggtttgaactgggaatcacaaagtttaggcacaacttctacataatcgggctcaagttatttgttgttgtcatgagaaaaattttcctgggtgtctatagctccagatctcatgacccagccaaaaatatggtctatgagcaacccagcctaacaagagggtcatccaatttgcttggaatgttaatcccaatttcttgcaatggtaaaaatatttttttttcttagtgaattagagtctttaacccagaggaagtttacacttaattgtggatataggccaggcttggtggctcacgcctgtaatcccagccctttggaaggccaagacaggtggatcacttgaggccaggagttcaagactagcctggccaacatggtgaaacccctgtctcaactaaaaatacaaaaattagccgggcatggcggcatgttcctgtaatcccagctactcaggaggctgaggcaggagaattgcctgaacccaggaggtagaggttgcagtgggctgagattgagccactgcactccagcctgggtgacagagcaagactccatctcaaaacaaaacaaaacaaaattaattatggatataaaaatgcaaataaaaataataatattactagttttttaaaaattaagtttaggaataatccatgtatatttggtgttcttaaagtgcttgttaagagtaattaataagttagcctcatgagatggtcttttcctacccctcccctacagtgcttaaaacaataacagcattaattttgctctctttacgtagcaaaattgaggcctgcccaatttcaaggggaagagaaataaagccccacttcttcttagggggcaggcaatattgtagtggtcctccagggccatcggcttcccctgacattccccttgagtccctttaggttttcattaaccccttcatcaagatgcttccagcctccattgccacctagtcccaagttgcattctttgggtttcattatggtagtatcccacttccaggtatctaagtctatgtcaagtattaattgctgagcaataaaccatccccaaacatagtagctcaaaacaactaatttttctcatgggtcttcaatttgggggagacttggtggggatagcttatctctgccccacaccatactaactggagcagcttgaaggcaggggcctgggtcctctggaggcgcaatcactcaccgatctggcagctggtcctggctgtggactggagccttagctggggccttagccagcaaatctatacctaccttccccatgtggcctgggcttcctcacaccatggtggctgggttccaagggcatgcgtcctgagagaggcaggtataagcaatatatcctgttatggcctagagtcatgaactacacagcattgcttccagcacattctgcacagaagtagtcacgaaggcccagccaatttcaaaaggagggaaaacagactctgccttttggttgggaagcagcagtgttctagaagaacacgtgggaccaagatgtggccattttgagaaattgtaatctgtcacaattttgtacaggtctgtcatcggctgtgacctaccctggggtggagggtggtggggggtgaatacaaacacccaggtgctttcggctgagaaaaggatctgcagtaactgaaaggttatcttcttaagatagtcactggtatggggtgttcataataaaggcatatagaagttgaggaagagatgctcagaaatactcaagggtaggtttagggcttatgggaagcatcaccagtgtctgctacaggatagtaaaacaaaatactaggcccagcatggtggctcatgcttgtaatcccagcactttgggaggccgaggaaggcagatcacttgaggtcaggagttccagaccagcctggccaacatggcagaaccccgtctctactaaaattacaaaaattagccaggcatggtggtgggcacctgtagtcccagctactcagggggctgaggcaggagaatagcttgaacccagaaggtggaggttgcagtgagctgagatcgcgccactgcactccagcctggaagagagtgagactccatctcaaaaaaaaaaaaaaaaaaatactgttggttcagaagtcaggcccagctgtagtggttcgcatctgtaattccagctctttgggaggcagaggcaagagatcacttgaggccaggagttcaagaccttgctatgcgcaacatagcaagacccagtctctatgaaaaagttttaaaaattagccaggtggtatgcgcctgaaggctaagatgagagaattgcttgatctcaggagtctgaggctgcagagagctatgatcataccattgtactctagcctggatgacagagtgagagcttgattctacaaaaaaaaaaaaaaaaaaaaaagtcagggtgaattatattccctcatgtgatcacagaaggcagagaagagggaacccgacatctcagtctttcaggaaacattaagtgacagaaaatgtgaacctgagatcggcttggtgccctgctataactgagagctggcctgaccccgtgtgtccatctctcaaatctttctggtctcttcccactgaagggatggaccagtggctctccactaaatcatgccatcattttgtcataacttgttttgatccaacatagagtgtaaatcaatcattttgtttttacacatggtcccatatgcacgcaaaataaggaagtctttatccactgaacatattgtttaaataacagctaccaaaatacatttaaagatctttattgggatactaagactgtagcattttgggtatggtgaactagcttctctgagaaaacaataggcaagatcttttttctaagggtgagtgggtggaaggacggaaggtgggcatgaagtagctaaagagcacatgccccagctgttaaagccagggtgtttaatgtattaggtaagacggtgccatggaatagaattttccactataaaatttttcactctataccaaacctagaagtttttctcctactgccaaaacctcacagtaaggtgaggatagacccctccaccatcacagtgtggctttgaggaaggaagtgaggcctcacagagggcagggaaggagtgggagccatttctagacacagaagacatcctttattctaaaaagtggtctcctaaggagtctgccacctccagttctgacatcacagggagatgagcctgccaagctgcctcagtttcctcaatgcaatggtgacgtgactggtctgaagagacacttagtggggaaggaacactcaaggatcacttgtgcttggctgtttaatttgcgaaccacacctcccagcccttgccaggaggactggacaggccatggcgctcacatgatctgacagaaatatccagtgggcatttctagaggtggtcaggctccagcctctttaagcgcccaggtctgtggctgtgacctccatggctagatgctgcctatttctcttctagatcaaggctttcttctcctggtccatctcagaatctttaatggagataatgtaatatacaaagtaccttctttgagaaaattgctcatgtaattcctggcctctgtctccttggaaaaataatgaatggtcccaaaccataagagaaagccattgtacaacctcaacacacatgtctgggcagccctaaggagaaggactgccaacgccggagaaatacagcgactttccattggatttcagggtcatgcttggcccagctgctgtctcttttttcttctctggtggaggccaagggacccttcagatggactctgggatttgttgctacagctgtctcctagagcaatggaaaatgaaccagatttggaaatgcaagacctggggacaggccccaactcccctcttactagctatgtaactggggcaaatcccttagcctctctaagcctgcctacctatcctcacaggctggaggtggaccagatgagatggcatgagaaagagcctgctgggttctaaaactctctgtctgggctgggcgtggtggctcacagctgtaatcccagcattctgggaggccaagctggatggattgcttgaggccaggagtttgagaccatcctggccaacatggtgaaaccctgtctctactaaaaatacaaaaattagccgggcatggtggcacatgcctgcgatcccagctacttgggaggctgaagcatgagagtcacttgaacccaaaaggaggagattcctcctggacaaaataaaactttctgtccatatatagaagatcgtaagtggcactggctcagcacaaggcttcaggttcctcaatttggaacattgaacagatcaggttctgagtcctctgcaggatcttgaagacagaattgactattctcagttgacccctgggcttccctcgggacaggctttatagcctcacccgcttaatgcatccctgaagcctctcaggcacacagcatctcacagcagtgctattgagggtggactgtctgtgggtatgggaattccatatgggtgggtatgatggatccctcctgcaactggccactaacacagaatatagagagctggcttatggaattaacgaagacctcatagaaaagtgaaaattgggatgaaatgccaacatagcgctgggtgctgagatacgatcagtgaactcaaatttgtggctggtttgagctgggcactctccctcttcagctgcccagagctcccacctaccagaacccactctcaggaaaggcctgctgtcagccagtaacttccatctttgatatcagtggaagttacttgacccttctcctgtgggtgtctgcactcccaatgcagaatggaaggcattggtcccaagttgaggaccatcagccctcaactagcatgttagggataatcttttggggcaggaggattgccctggtgtccttaaaattcttccctttctctgtctgagtcaggctggacttggagaaccctgagatctgggctgtgaaacgtctcagggattactttccactttcggatgaaataaacaaatatagagaagtgtcatctcctccaccactataaaaatggggagccacccagccccccagggctcatctgacagctgtaaacaccaccagctgaaacccaggtggtgtgctcagctttctgttgaaagaggcactttagaatgagaccttctcaaggtcaaaggccttgagtccagactgggaaagagcccaatgtgcggtgtgatttcaggggctgggaaggaagcctcctctccccaccaccaaacttgaaaaaaaaaatagttctaatctgatccttgggctgtgtttaaaatgcaaattcccctgggagggtcacagtactttaagtttctggtgatttaccttgcagtgtgaatgagtcccagacctattcttggaagtttttattggaataaccaggtgagctctgaaggatattcaaggacagagttagctacgataatagagtgctgctgggggccgggcaggattagacactaaagtatattttctcatgttggtctcacaataactatgtagagttgggcttatccttattgtataaacgaggaaactgaggcacagacaagcaaattatctaagatcagtcagccaggagtagacacagctgggactggaagccaggtctgcttggccccaaagcagtgaggatctcatgggcctacactcctctaaggcagaggagaggagggtgctgatagtatcagaagggaagaatgggatccaaacagcagatgaaacatcatcaggctgtgagcctcctaatgcacagctccagggcttcaaggagaggctgttccaaaccaccctcaaggccaccatgtgccctgcacagtgggtggtgctctgagtctagaaaggagaaaacctagagcagtggttctcaatcttgggtgttgtcagggagcttgtggacacacacattgctgggccccatccccagaatttctgactcagtaggtccaaagggaagggtcaaatttgcaatttacacaatatcccaggcgatgctaaccctgctgatctggggaccacactttgcaaaccacctgagttagtgcccatctcaaggagtttctctctgttgaggtcaagatatgtaccggtaaccagcagagagatttagtagatgggagtgggggaagctgctgtaataaagagaccctacaataaatcagtggcttaaagaagatcaaagtttctcccttaggtgacagtctgcagtggatgttgtggtgcaccacccagaccctttcttcatccatttccccagctgctgggtgcattggttgttgagggctcttagcttagtccctctctgggaattacccttggaaaaagggggctgcctcacccaagttgtgccccttttgggagcagcctttatccaaaaaggactagtaggtatggcgtaaaaagtttccatccccatgcctcagtctaggacatcttggaagggccatcccaggtctagagctccccactggatcagtgcagggctcttgccaaacttcactgtggttcagtttctcctgccctgccacttacaggtgctcctcctgagagctttccccagcaaacctcttggggagtctgttcctagtcaactgatctaagatacagtcaaagtgagcattactggttggcaggtagctttgctgcccttgatcattgagggacccaagttttttccatcttgttctttatcccttcagctttgtcccaggttgaagccaggttgcaggcccctctgtgctccagctttgtgggaaatggaaagagaatgtagaggaaacacactgtgccttaagacatcggcctggaagtggcacacatcgcttctaccacttcactgtttcttaaaacatagtcacggggctccacacaaggaggctaggaagcacccagcagctgggcagcctggtaggctacgcctgctactttggaagaagagtaaaagagagggtggtgggtggccaggagtctccatggcaacctctgaataagaatttgtgtagccctgagaatctgtaccacaaagctcgttagatagggccgcaggtgtgagccatttactgggcacaaagacccctacagcactgtcattcatgtggacaaaaatttctagagctacttaggcattgctcactagggactctccataaaaagcagcactgcaggttttgcacaatactcttgtgctggccataacttgtcatttcttctccattcaagacagcttagctggacataagtgagacaaagtaacacgacagagataaccttcaacagactcagtcaaagaaaatgattcccaagcttcaatttttttttttattaatcacaaattacttgtaaaagtcttccatctgatcaagacgagtggttgcctgattttgcttgtgccctccccacttgagagcggggcaagcagtgtgggtttgacagtgccgacggggagggctggcttattgcacccggatagggcagacaatccttggctgtcacggaagtcttgtcaaaggcccaagcaaagggtcacatcatactgaccctaccatccccctggcttagagttcacagtccgtctttgttataactttgctgcaaacaccctcaacttgtttgcctccctcccactctgacaagcctttgtctcctccattctgtgcctgagatgccaaacattgctggagagaatcttatatttgggccaattcacttaatgtttattaccctaaacctcaaatgtgcaggcaacaccatggggcagtttttgccttgcatgcctcctcaggaaattcctgcacagcttcccactcagcccccacatccactttccctctccattccagccctttgcaggcgccttgttcttcatggagaaaatagaaagcattagaggagactccttctccaatctctcaccaataccaccagtgcccactgcacctcaccccagtctctagtttctgtctaaggccaacccctcctcttggtctataaatcttatccccaagtcctgagtttacattggcagccctgccggcagactcaatactgagctgtctgctcagcatccgcactgggtgtccagtggcagagggaaagcaagggctgtgctggggagacgagtgatggggaaaagctgtgggaggccacctccaccaggagtgagtgacccactgcctcccaaatacctctgatgggagggttatgcaaagcccccctcaattctactcccaacaggccacactctttggccttggagccgatggcctccctggaggtgacttctaagactggctctcttcccgagcgggtgggagagttggggctaggcttcggtgcttgtccttctctatctcagggggtgccaaattgcctgaggcccaagccgtgccagggaaaatttgctgacaggcctgtgtcccggtgtcccttctggggaagggaagggaggcaccagctgggtgaggagggagtgctctcgcagaggagcccctcccgcctgccctgcctgggggcgccaagagctccaggttctagatcagcagcagaggcatctcagtaagaagctgcctggtgccgggtgaggggcagtctctttactcaccctgctcctggcctgtcctctctccgactccccacactgtccaactggtttgttccttggccagcatctgggagccaatttattcagccctgaggtttgttttgttaaggactttaaaatgtattaagaaatgcgcgaagagctttgtcatcacttttccctttctaacgtacctgagcaattggatcaggaagtccttgcctgcctgtcctcctggcggaccaccagagctagccgaagtcccaaaatggggcaagaaggtagggctgtgtccccttcaagccactcctctggccaaatagcctgggctgtagcaatctgagccaggaggggtgttcatggaggagggtgtgatggctcgtggctgtaatcccagcactttgggaggccaaggtgggtggatcacctgaggtcaggagtttgagaccagcttggccaccatgccgaaaccccatctctactaaaaatacaaaaattacccgggcatggtggtgcatgcctgtaatcccagctactcagtaggctgaggcaggagaatcgcttgaacctggagggcatagacaagaggtgggcccaggtctctcttaggagttctccctgtggctgtggagagaatgcctgatgtttctctcatcttagcccaggcactgaagagagaatgcttgtctcaaaatgagttcagaggcttttatggattcagttgtatctccctccaaagaggtatgttgaagtcctaacccctggtacctcagaatgtcacctcacttggaaatagcattgtcatggatataattagttaagatgaagtcacgttggaggaagggtccctaatttaatgtgagtggtatctatttttttttttttttttggcatggtctcaccgtgtcacccaggctggagtgtagtagtgtgatcatagctcactgcagccttgaactcctgggctcaagggatcctcccatctcagcctcctgagtagctgggactattgtgacctaccatgatgactggctaattttaaaacaatattttttagagatggggtcttgctatgttgtccaggctggtctcaaattcctggctcaagcagtcctccaccttggcctcccaaagtactgggattacagatgtgagctactgtgcccagcctaatgtgactggtatttttaaaagaagaggtcaggctgggcatgatggctcatggctgtaatcccagaactttgggaggccgaggtgggtggatcacctgaggtcaggagtttgagaccagcctggccaccatgccgaaaccccatctctactaaaaatacaaaaattaaccgggcatggtggtgcatgcctgtaatcccaactactcaggaagctgaggcaggagaatcgcttgaacctggggggcggaggttgcagtgagccaagatcgtgccattgcactccagcctgggcaacagagcaagactctgtctcaaaaaataaataaataaataaataaataaataaataaaacaaaataaaataaaagaagaggtcagagtcatgcaggctaaagccagccatttgacagtggaggcagagatggcagcaacacatctctctgtaagccaaggaatgccaaaggcaccagaagccagagaggcaaagaaggattctcccctacaggtttctgagggagcatggccctgtcaacaccgtgacttcagatttctagcctccagaactgggagatgatatatttttgttgctctaagctacccagttgtggtgctttgttacagcagccctagaaaactaatacagagttgaaagcagcttcactccgcagcacccatttaaacaggatttatgtcgtctgtgcacagccagttaatggtccaacacatcctggaggttcatcagtcactccagtcctgaaaagccctcgatggaacctagtcaccatcaggacaaggagggtacctgtgtgtcgagccccactaggatcttgggcagagatcaggcctctggggtcagggtggttaatagacctggaccctaatccaggctttcaatatgtgttctgcaaagccacattaagggccaaccctgggaaatctataagatgcactgtcttactcaaagttaatgtgcttcagattaatgtctcagcaaaacagcaggttattattaaaggtcacaaacctttaaataaaaggttcacaaaccttcagagttgactagagaatatctgactctatgaatgttacatctgtgaatgctgaggctatggcaatgaatgaggtatcctgatacattccagcacatctgcatcctaccctaaatgccctggttggtcctggatgtgcagacctgtcctccttttccatgcgtcatgcttgggggctctgctgcacagctctcatgcacaccaccaaccccatgaaaactcagctctcccaaaaccacacctggctaatctgagaaacaaattcaggtcctcagtaatagtaacacgccccatttgttcacctcctataccctgctccaggcagcattccattttatcctcacaataactctgtgaagtggcctgttatctccttcttacagatgaaaacacagcagctcagagaggttgaggagttgacccaaggtcacacagctggtgatgggcagagctggaaccagccccagtccatgtgactccaaagctgcagctgtctccactctgtcctgatgggagggtcactctgccctcctcccaggagagctgcctacttcccgacagaggccttttacaaaatcataatccttgagaattttaggcaatgtgacgtgccatggttggaaaccattggagaggcaagtccttctagggcagtatttatgcctatgaattcaggaaagtctcaatgctcagttctgggtctatttttagctcctctccatcttgccactggcccaggagtggcctgaaactctgttggcctcctagggcagcactgctgagcagattgggctccatctattgaaatgctcatggcatttgagatgaggtgcttttcccaattaattctaacctgtcagttttgatttttttcctttgaagcccaaataacaacgtgtcacctttctcgacaaaaagccagcattggcgttgacttttctctttgggctagactcatggaaggtgccagaatcagggaactggagcttgtttttgtgtatataggggaaaaaatcttggagttacatagatcatgcaggatctattccatggaaagtaatgcagctattacaatgccaacgtatttattaacatgaaaaggtgtttatactacattgtggagtaacaaaaactgtgtgtagtataatccattttgtatttcttttatctacttatctgttttttttttaatcctaacttttctcccaaattaaacatgtatatcagctcttcaagtgggggaaattttttaaaaaagaaaaggaaaaggaaagaaaatacatacgtgtttaaatttataagtaaatttaaatactacagcaaatttactgttaagtgtggagctgtaacagcaaaccctggccctgaatttcagtggatactggtctctcaatcagttacaataaacttaacatttgaataaatttctgtgcggacccatattctatttatttaaactttttttttttttttccctgagacagtcttgctctgtcgcccaggctggagtgcagtggctcgatcttggctcactgcaacctctgtctcccgggttcaagaggttttcctgcctcagcctcccaagtagctgggattacaggcacctgccaccacacccagctaattttctgtatttttaatagagacggagtttcgccatgttggcctggctgatctcaaactcctgaccttatctggaactctaatctgcccgccttagcctcccaaagtgctgggattacagacatgagccactgcgccaggactcatttaaacatttaaaaattttatttttattgacatataataattgtacatatttatggggtacaatgtgatgttctaatacatgtatacattgtgtaaaattcaaatcagggtaattagcgtatccttcacttcatacatttatcatttctttgtggtacgaacatttgagatccttctagctattttgaaatatacaatacaatattgttaaccatagtcaccctactgtgcaatagaacgccagaacttatttcttctatttaattagttgtttaaatttttaaattttgaatttttgtgggtatataatatgtgtatatatttatggggtacataagatattttgatacatacatgcaatgcattataatcatatcatgggaaatggggtatccatcaactcaagcatttatgctttgtgttacatacaatccaattatacttttagttatttctaaatgtacaattaaattgttatcgactatagtcacactgttttgctgtcaattactaggtcttattcattctaactatttttttctgtacccattaatcatcctgatctatcccctatacccgcaccactagccttcccagcctctagtaaccatccttcccttctctatatccatgagttcaattgttttgatttttagatcccacaaatgagtgacaacatgcaatgcttttttttttctgtacttggagggcttatttcacttaacataatgatctccaattccatgcatattgttgcaaatgacaggattaattctttttttatgactgaatagtactccactgtgtatatgtagcatattttcttcatctattcatctgttgatggacaccaagggtgcttccaaatcttggctattgtgaacagtgcagcaacaaatatgggagtgcaggtatctctttgatatactgatttccttttcattgggtatatacccagcaatgggattgctgtattgtatggtaactctatttttagtttttgggagaacgtccaaactgttctccatagtggtcatactaatttacatttccaccaacagtgcatgagggttcccttttctccacttcctctccagcatgtattactgcctgtcttttggatgaaagctattttaactggtgtgagatgatatctcattgtagtttttttgttttgttttgttttgagacagagtcttactctgttgcccaggctggagtgcagtggcacaatctcagcccactgcaacctccacctcctgggttcaatgattctcctgcctcagcctcccaagtagctgggattataggtgcccaccacgcccagctaatttttgtgtttttagtagagacggggtttcaccatgttggtcttgaactcctgacctcaagtgatctgtcaagtgatctgtctgcctcagcctcccaaagtgctgggtttataggtgtgagccactgcgtccagcctcactgtagctttgatttgcatttctctgatgatcagtgatggggaacaccttttcatatgcctgtttgctattgtatgtcttcttttgagaaatgtctattcaaatcttttgcccatttttttagttagattattagttttttttcctatgaagctgtttaagctccttatatactctggtaattaatacttgtcagatgagtcgtttgcaaatattttcccccattgtgtgggttgtctcttcactttgttgattgtttccttcactatgcagaagctttttaacttgatgtgatcccatttgtccatttttgatttggttgcctatgcttgtggggtattactcaagaaatttttgcccagaccaatgtcctggagagtttccccaatgttttcttgtagtagttttatagtttgaggtcttaaagtctttaattcattttgatttaatttttgtatatggcaagaggttggggttgagtttcagtcttctgcatatagatattcagttttcccagcaccatttattgaagagactgtcttttccccagtatatgttcttggcacctttgttgaaaatgagttcactgtgggtgtgtggatttgtttctgggttctctattctgtttcattggtctatatgtttgtttttatgccagtaccatgctggttaacaaaactctgtagtatagttgaaagtcaggtaatgtgattcccccggatttttgggtttgtttttgtttttgttttttgcttaagatagctttggctattccgggtcttttgtgtggttttttttttctatttctgtgaagaatgtcagtattttgatagggattgcattgaatctgtagagtgctttgggttgtatggacattttaacaatattgattctttcaattcacgaacatgaaatagctttactttttttggtgttcttttcaatttctttcatcagtgttttatagttttcattgtagagatttttcatttctttggttaattcctagctacttaattttatttgtggctactttaatggaattttttttttcatttctttttcagattgttcgttgttggcatatagaaatgctactgatttttgtatgttgattttgtatcctgcaaatttactgaatttgttcacaagttttaatagttttttggcagagtctttaggtttttccaaatataagatcctatcatctgcacataaagatagtttgacttcttcctttccagcctgggtgccctttatttcttcctcttgtctgattgctctagctaggacttccagtactatgttgaataacagtggtgaaagtgggcatccttgtcatgttccagatcttagaggaaaggctttcagtttttccccattcagtatgttattagctgtgagcctgtcccttgtctctaattgtaactttgtactcactgaccaacttttccctgcccctgcctccctcatcccctcccaaacttctagtggtcactattctactgtctacttctatgagatcaacttctttagattccaaatctgagtgagatcatgtgatatgtgtctttctgtgcatggcttatttcacttaatataatgccctctaggttcatccttgttgccatgaatgacaggatttctttcttttctaaggctgaagaatatttcattgtgtatatatatcacattttcttcatccatttatccattgatggacacttaggttggttccatatcttggctattgcgagtagagctgcaatgaacttgggagcacagataactctttgacacactgacttcctttcctttggatatatacccagtagtgggattgctggatcatatggtagttctatttttaattttttgagaaacctccataccgttttccataatggctctactaattaacgttcccaccaacagcgtaggagggttcccctttctccacatttgtatcatttgctgtcttgttttttgatagcagcaattttaacaagtgagagataatacctcactgtgattttgatatgaatttccccaatgattagtgatgtccagcaatttttcctgtaacttttggccatctgtatgtcttcctttgagaaatatctattcaaatcttttatcctatttctaattggaatctattcaatttttacttgattttctctttagaaaaacttaaaacccacagaaaaattgcaagaatggtgtaccattacaatcaatacccaaatttctttcacctagttggattgactaggatcattttgccacatgtgctgtctccatgtggttctatatatgtcacccctcatcacctaacactgtgctgaataaatgaatggctggagtggcagaaaggccagtccttaaagggcaaggggggtcatacagtgggcactatctgaggtccagtgggtagctggaggagaaccagaagcagacagacatcacaggcagagagcagtgtaagcaaaggctcagagggtggccagtgcagaacttcaaggaggatatagatctggccaacaggatgtgagagggaaggtggagatgagcccggaactggggagattcccaaaagtctcagctacaacccaaaagtgacaaagtgtaaggggagtgatatcatttagatctgtgtctccaccaaatctcatgttgagttataatccccagttggaggtgggaccttgtgggaggtgaatggatcatgagggtagagttctgataaaggggttggcaccatcctcttggtgctgttcttataatagtgagttcttgtgagagctggttgtttaaaagtgtgtggcacctctctgcccccctctcttcctctcgctctggccatgtgaactgctggcttccccttccccttctgccatgattgtatgtttcctgaggcctccccagaatcccagcagatgctaccatgtttcctgtatagcttatggaactgtgaaccaattaaacctcttttctttgtaaattacccagtttcaggtatttccttatagcagtgcaagaacagactaataatacagggagccactgaaaggagtaacgtgagcagttttgtgcattttattttattttattttattttattttattttattttattattttattttattttattttttttattttattttgagacagagtctcgctctattgcccaggctggagtgcagaggcgtgatcttggcttattgcaacctccgcctctgggggttcaagcaattctcatgcttcagccttccgagcagctgggatcacaggcaaatgtaaccatgtccagctaatttttgtgtagagatggggtctcagcatgttggccaggctggtcttgaactcctggcctcaagtgatctgcccacctcggcctcccaacgtgctaggattacagatgtgagccaccatgcccagccagttgtgcgcattttaaagatctctctgctaccatgatgaagagggactttcaaggtgcagttggagggatggaagagaagacaagttatggtccaggacaaagacaaggaggcctgaacaggtgagaggggccagaaggatgtagaatgagtagctcttggagtgactgcctgggtgtggtgaggtggggaggattcaggacaactcccagggtctggtcaggaacacgtgactagaggccagtgctgtttctccagatgggcaatacagaggagaagccagtggtgagggagtggggagtgaaggaggcactgacttcagtttttgatgcatggaagctgagtggcctataagacatttaaatggaacacccagcaggcagttgaatctgaatctggatctcggggccaagactggtctggggatggaaatgttggaatcataagagacttatggataggatgaccgccatcctggatggcaggtgcagcccctgttcatgcctatgttccagcatatttattaattgttccctctttcacttttccagtttgagcaatattttgttttgttttgtagagatggggtctcactatggtgcccaggctagtcttgaactcacggccaccttagcctcccaaagtggtaggattacaggcatgagccaccgtgccttgccaagtttgaacaataattaatacagtcaccctaaaaagggtagatcagtcactccctgtattcacctaacacttgccacccctggcctggcatggttctgtgggtgtttcatgctgtatgtggttaatcactagaggtctgtggcctctgttcttgcgtatctcccaccgttcttcccttgctatctttcaggtagatggtgcctaagaaatatttacctgtcccgtggttgagagattcataggccccaacctactgaggggagagaaggtgggagaagctctataagttatcttactggaggctggtggattaaggggcacccttggaccaagtccctactacatatgggatttaggaaatgtagagagaaacagggaatctaaaacattccctgttttcataactggcccgtgctgctccgcttccttcaccccttgcgtgggctgtgacagctggagtgagtttgcaggcctctccctttcagtgcctcctcagaggcagtgtggctgcctggctctgagtgagaccttttggaacccaccctgctgacaagagccacaccctgaccgtccttggacaagccctgtccacctccaccttctgctgttcccctccatgtggcctttgctccagccacattctgaacatatcctgaccatgtttgcctttgggaccagtaaagccctttttccgtaccctcattgcccctactcctatgtctattaaaatctacccacttggctgggcatggtggtgagccaccagcgcatggagcacctgtaatcccagcactttgggaggctgaggtgggtggatcacaaggtcagaagatcgagaacatcttggccaacatggtgaaaccccatctctgctaaaaatacaaaaattagccaggtgtggtggtgcatacctgtaatcccagctacttgggaggctgaggcatggagaatcgcttgaactcgggaggcggaggttgtagtgagctgagattgcaccactgcactccagcctgggcaacaagagcaagactccatcttaaaaaaaaaaaaaaaaaatctacccactcttcagagctgactcaaacatgacctggtgcctaggagactgtcctggattctccctgctggaggcaaggctcccttcatccagaacgccactgtggtccccactgcctccttcatggtttcatctgagttcttgccttacttactgtttggaactcagggtggagacgctttattttacatttttgcatttctccataatgccaaacatgggggtaattatggtgtgtacagacaacatgtggaatgaactgccacatattttgtctccaggtaagagggcagcattaagggttatggagcaggaggtagcagggtgaaggaatttgcattcattcgttcattcattcagcaaatatttattgacagcttctgtgtactagacactatgttccatggtacatttagagaaataaatcttcaaggacctcattatctaaaggagaacaaaaaggagacatgtaaacaaagagtcaccaaacaatgcaataagcaccataaaacagcaaggccaagtgcacagatggaggaacccattctgtctcatggagtctggtagcgtttcaccagaaaagtaacatttaagctgggtcttgaggcatgcctaggaggtcgccaggtatcaaggaaagggtactttttactgtagagggaacaataaaagcaaaagcactgagccccagagaggcttgtgtagtggactggaaggcattcactggggaagaggagaagacaataagcatgagggtaggggaggcaagggaatgccaggagatgaagcaagggagggagaaaggagcctgacattgcaggcagagggcaagttttaaggtgagtgaagtcctggtgaccacagcagcattacaggaattacaggcaagttttcaggtgagtgaagtcctggtgaccacagtggattacaggcatgagccactgtgccttgccaagtttgaacaataattaatacagtcaccctaaaaacggtagatcagtcactccctgtattcacctaacacttacacagagtggaagagagatacggtcctgagcacacagctgctccccacccgcatttacctggggcttccctgaattgtcagtcatgactgccttgctttggattgcagctccctgcagggagctgcccaccttacaccactgagttgctggcagctgccacagaggccagccacctcctcaccgactctcctggacaagcacttctgaggacagagtccttgtcagggctggtttcttggctgaaccctcctttgccaccaacagagagatgcctgcacccctcaagggcaggcagatggctaggcctgccctctcagctgggcagcacactggactggccgtgccctttcaagtgtgcaggagttggcaggagcctgcaagccagtatccaccctcccaggtatccacgcttggcagcctcacttgtctccagcctgtgttcttgcagatgaaactagcagaaggaaggagcttgctgccagttggctccctaattttttttaaatcacaactttgatgtttcctagtctgctgggtgacaccagttgtccttgtttattactgcttagtgctcccaaatggtgttggtcagcatggagtgcagggattgtctccttcttcagaccctagcacttaccagtccctggtccttgctggcctgcctggaggcctgtctcgttgtgaatgtttacacaaatggaaaatgtcagtgtttaatctgtaaagggagcccagattgcaaagctccaaaaagaaacatctaaaggtgagcatccttcctctaggtgtgggacattacaatgtcacatcaactcacatctccacattcacttagcacctctgtgggcaagaggatggggaaggctccctgaacttccagagcttcctaaagaaaaagacaaagttacaacttgtaaaatcccagagtcagtgtcacagtgctgtggctaactgaactgtcaagcagatgcaacttgccccaggcatggacaaaaaaggtttagtgggctgggcacagtggttcacgcctgtaatcccagcattttgagaggccaaggcgggtggatcacctgaggtcaggagttggagaccagcctggccaacacggtgagacccccgtctctactaaaaatacaaaaattagccaggcctggtggtgcatgcctataatcccagatacttgggaggctaaagcagggagaatcgcttgaacctgggaggcagagattgcagtgagctgagatcgcatcactgcacttcagcctgggcgacagagtgagactcagtcttaaaaaaaaaaaaaagttcccgatgagttaggctgggaactggggatggatagcgatggggaatggatggagatgcttccaggaggaaaaggacatgagaggtggtgaggaaatttcatgctagagtaatgatagaaccagaaggctgaggggagagctcaggaacatagatgatgggcaagcctgagggggtgaggagacttgaatacctgtccagtgagttaagcccttctgtgctcaggagaagggaggcaggcacacccagtcctggctttgccactaatcagcctgagccttgggcaagatacttctccctctgggtcagatgaggggggtggatcacagcaaaggttcccaaccaggaggacaggggtgctttacacatgcgcgcgtgcgcgcacacacacacacacacacacgcatgcatctagagctagttctggggtatctctggggatgttccctggacatgtctgggtgtttaaagatgcttggtgcttctggtgtggatcactggctgaagtcatttctaagatcctgttagctctaaaatgaccatgtttctgaggcacgagtagttggtgacatggccggtgtgaagaaatcactggccagcccagcactgtcctttaaaaccagaggctgtggattcacctcatgtgtagacagtgcgacggaatcaccggggtgatgcggataatttcagaacaaagctggtgctgggggctgggggtggagagagcctttgggcctgaatgatccagataattgcagtgctggtgatgccctctcagcatgccccagggtgggtggtgggagcccattagtcatggggtgggctgaggcgaggtggctgaggaacagggaataaataaaaggagtgagcagccatgtctcaagcaggcctgcaagggcgggggtggctgccagtgtcccaggcagggtggctgagacatgagtcacacccggagacgctgacctggcagcacccagcctctctaggagagggaaggaggaggcgggcgctgggagttctgaatgtcaggattgcctcttgctgtatccttgggcttgagatctttgtcatcccttatcaccaccctttgcaaagctacatggtggggacacctctgttcatagctcttctgccactctttatccttaggctatcaaaagctctacttctaccttaagggccatagccactccgttatcattctggaccatagtaaccagagcattctgacctttagagctgccctatgtgaccattctctgttttagacagccggcctggtgtgtgaatgggagggaggaatgagctttgttactaccttctcagcaacctgcttctccccaaggcctcagtttgttcttgctccccttcaagtgtaacccatggcccatacaggagatcgtcttcccagagacgaaggctttcctaatgttcagagaagatccagacccccaacccctggacaacatagacagctcttcaggacgcctgaaaagccagctattgacaaatctgcctaacactctcgcaaactccattttctacagggtgagatgcagacatctttccatgacacctgtggatgctctacaatctggcccaggctgaccatatcctgcctggagggccgggtaagtggggcactcaggcttagaacagccacatgccttcccctccctgtgggacccacttccaagggagccagcctgaggcttgcatcactgtttggtctcctcctacccttccagatcttcctggtgctggagttagtgcccccttttttctcagctgagtcatgaccctcacccagcccagcccagccccctaccctagatctgctcctacacctgattgatgccctggcctcaggcagggctggagcttggggctggtgcctcgggccttcagccttgcccagggcagcctgggcagaagctgagattggatgtcatttgtcaaccttggcagagaagtactgaatgcgtcaaaataattgaaggttatttggtgcctgtgggagggatttttattcccaaggattctgctggaccatttggggcagccctgtttggctagctgagggttcctatgttttccaacaattggatgtttacagtatctgtgctcttgctttttaaaaatgtcctcatttagaatagcttcctttttttatatgttttcctttttatcttttaagtgggaaatgggaggtgagtatgaggggacaattgtgaagcttgcctgtgctccaagttagggacatgagaccccttcacccctggttttcccctgtaatccttccagagctatagagctgagcttgtattcaagccacagacagggcccttgaccttgaaccagacaaggctgacagccccggagcaggagcgctgctgtgaaataactcggagatatcctcccagagcagtgaagaggctggaaggagtcaggaagcctcaaatccccagcctctgacttacaaagcacccagacctccctcaggactagacagagcagccatttcacccagagctgcctccattccagcactgggatgtggttggtaatgtgagattctcactatccaatgccgcaatcagagccatatgcggctatttaaacctcaatttaaatgaattaaaattaaataaagtttaaaaaccagttcctcatccacactagccacattttaagtgctcatgagccacatgtgactggtggctgcctcactggacagcacaggttcagaacacctccgtcatcacagggctctcttggcaggatttatgggtcccctttacgctgagctgtctacccctgttgcctaaatgcctttcctacctaacagtagctgttcagtgggtgcattggccctacagactctcccaagcttctttctccaccagtagaagtagctatgtggccttgtgaggtctcccttctagaaagaacaggtagcatgcctctgacaaccacgttgaccaggtgacctgcaagcatccccaggatcaactagcaacctaagatttgctgcccaaactaatgcttctccctgtccagtggacacttctcaactaggctgcccttctgtgtcactgctgctacttagtcactcgttgactttggaagaagaggcccttcagaggctccaatgaccaagaacattcccttccctactcctcagtgtcacgccccgcctcctcccaagcatcaccatcaccaaaaataaaactgccttggtatcctt

SEQ ID NO: 57 - DNA, 222168 bp, Homo Sapiens
ccgcagacgcctgggaactgcggccgcgggctcgcgctcctcgccaggccctgccgccgggctgccatccttgccctgccatgtctcgccggaagcctgcgtcgggcggcctcgctgcctccagctcagcccctgcgaggcaagcggttttgagccgattcttccagtctacgggaagcctgaaatccacctcctcctccacaggtgcagccgaccaggtggaccctggcgctgcagcggctgcagcggccgcagcggccgcagcgcccccagcgcccccagctcccgccttcccgccccagctgccgccgcacatagtaggttctgtctgggactgggcagggccatcggggctgggggggcggggcttgtgggtaaggcgggcggaggcggggaccctccgcccgatgatagggctggaggaggaaggggcgggctgaagaaggggaaggtgggaagagcccagccggggctacaaattgggtgaagcgctgaggttttagtacttccgtttgaggagataggcaaaggttatgcaggtttttaatggcaggcctgagacaggaactcaggtctcctgactcccattctgatgagggggcttgtgggcaaggggtgcgtcttttaacctccatcctttttttttttccttggtggtcgaagagttttactgattttttaaaaaagtgctggattgggtgactagaagaaagctgcccttaggtctccagtttttaagactgcaacagcatggctcaatatttgaaatcactacggttaaaagcagtcatattgtgcagttccccagtgaactctttttgtagtttagattataaagtctgaaatacagtttgggtggataaagtttcttaggatggtatagatgtgactaatcatggagtccttcctgttgccatccttcaacgcaataagtacgtttgtttgtttttaaaccagagatactgccacaggaaaagcccaagggtgacccctcacttgggtcacctgcacagtatttttcagattgaggctgtggaagggcattgaagactggtgtttagccacctaccgtgttttaatgtaggtggcagcttgggtgcttcaaaatcttgttcctttcgtatatatttctcccttaaaatgattactcctcttctgttttttttgaggacgagctacgttttcatgaattcaccaaaattttgcacccaccatttaaagggtagctggtgaaggacttatgtatgcttttggcaagttttctgccaagaaaaaattcataatcttgtcacatctttagtgatgaacataaaccttttaaacaggaaacacttaaattgcagtgaacatgtcaaaaatgatactgttcttttattacctatcttttcccctctgtgcctttgctacataactgtttatttcttagaggtattttatttagcatatgtaagtagggtgattcaagttttataattagagaaagctgaaggctcattgaatcaagaccggtagcagccttggtttcaattaattctaaacacggcttgagttgctgaggctcctgactatcagactctaccttgtcttttatggtgttaaaaacagttcacccatagggttttccagagctaaaagtagaggattctttgaagagtggatggcaaggaaccttgtcattcagttgtaaggtttaaattgcttcacatacgtcaggccttctcagagtagagataacacatcattttctaaccttcccgatataggctacagaaattgacagaagaaagaagagaccattggaaaatgatgggcctgttaaaaagaaagtaaagaaagtccaacaaaaggaaggaggaagtgatctgggaatgtctggcaactctggtgagttgtgggggattcttttttctcctcagtcatggctctggtattctggaattctccagagggcagaagagcgtattagaattgtgtcttttttctttgtggagaaaggtcccttttgttcctgagcagagtggccccctataggtgatggtgatgtgtataggaggttaaggggatggtagagctacaattctgcaatttagctgtagttctcccaactttctcctttattccttctagctatttttgtcctggttataaaattaaaacattcttgctacagaaatttcaaacagtacagaaatgtggaaggtaggcagtgatagaccccataatccctccctttgagtgaggcccactgctattggtgttctgtatatacttccagattttaaaaatttgtacatgtgtatatgtgcatagtcataagctcaaaaattagtttaaatatattttacagattatattatattctatactaatttgctactatctttttctacttaatagaaaattttgaacaattttcagtatcaggacctgcagatctactctccccgcttttttttgcttagagctgctctttgtgtatgtaaaaggcattgaataaaaacagcatgcctaggctgggcgcaggggctcacacctgtaatctcagcactttgggaggccaaggcaggtggatcacctgaggtcaggagtttaagaccagcctggccaacatggtgaaatcccatctccactaaaaatacaaaaattagttgggcgtgctggtagttgcctgtaatcccagctacttgggaggttgaggcaggagaatcacttgagcccaggaggcggaggttgcagtgagccaagattgtgccactgcactccaccctgggcaacaaagcgagactctgtctcaaaacaaaaaacaaacaaaaaacagcacaaaaataaataaaaacccagcctgcctgagtgcctgagttcctggatttctagaggtggtgttgcatatagacagttgagcagatttttctctagttttatggtaccagagaatttgtgataagggaagacaggaaatccatctttattcattatcctcaggaaattaggtaaagagaatgagaaaaaaaaaaagttccaattcagatagaggtatctgtccaatggagatatatgtaaaatattaatccttccataaaaggtaaaatttgaattttagggtcaacatgaaagtgttagtatgaaataactacaggaatggagatgtgtggctaaggagaaaagtaaatctaaaacttcacctttctggaggggtcatgcaaggaggcgtgacttgagagaatttgccacggttaatgttacaattctggggcagcctacctttcattgcttgattattctgcatagacccattttttaggtctacaaacactgaatgagcacctatgatttttattctagaggctttttgtagctcatttatttttcctaagaatgctttttgccctctttttttttttttgagatagggtctctcgctctgtcacccaggctggagtgcacttgtgcaatctcagctcactgtaacctcctgggttcaatctctgctcactgtaacctcctgggttcaagcaattctcctgcctcagcctcccgaatagctgggattacaggtgcgtgccaccacacctggctaatttttgtatttttagtagagtcagagttttgccatgttggctaggctggtctcaaactcctggcctcaagtgatctgcccgccttggcctcccaaagtgctgggattacaggcgtgagccactgcacccggcctgttgttctctttttatagaggaagaagtgggtgatagatgaagagaattgatgattatcacagttaagtaacttaactaagaccacatggggacagttgagatggaatgttgttgaaataagacaacacacttggcatattttaaaataggacctttgccacttgttaaaaatggcactaaggaagaagggggaggatcattcactagtcagaagctgggtgactgttccacttcagtttattttattttttagagacaggtcttactctgtcatccaggctggagtgtagtggcagggtcattgctcatgtagcctcaaactcctgggctcaagccatcctcctgccttagcttcctagtagcaaggaccacaggtgcatgccaccatgcctggctaattaaaaatatatatatttttttagagacagggttttgctgtgttgaccagattggtcttgaattcctggtcccaagccatcctcctgcctcagcccttcagtagctgggactgtgctcctgagccatcatacctggcaagttttttgtttttgtttttttctaataacagaattattaagatatagttcttggggccaggcacggtggctcacgcctgtaatcccagcactttgggaggccaaggcaggtgtatcacctgaggtcaggagttcgagaccagcctggcccacatggtgaaaccctgtctctgctaaaaatacaaaaattagccggatgtggtggcgggcgccagtggtcccagctactcaggaggctgaggcgggagaatcccttgagtctggaaggtggaggttgtagtgagccgagatcgtgccactgcactccaagctgggtgacagagtgagattctgtctcaaaaaaaaaaaaaaagatacagttatgcaatatgattcacccatttagcatgcacaattcggtggcttttaggatattcccagagttgtgcaaccatcatcaaagtcaattttagaacattttcatcaccccaaaagaaaccctgtgcccattaacagccacctcctgttctgccccagcactccccagccctaggtaaccactaatctactttctgtgtatagatttgcctattctgaacatttcatataaatggaatcatacaatatgtggcctttggtgtctggtttcttgcagttactgtaatgttttcaaggctcatccgtgttgtagcatgtatcagtacttcattcccttttctaaaaatattcattttctttattgtggtaaaatatacataacataaaatttatcatcctagacatttttaagtatacagcccaggggtatttagtacatttatattgttatgcacccaccaccaccatccatctccagaactcattttatcttgcattcctataactctgtacccattaaacactgactcactgtaacccccttcccccagcccctggcgcctaccattcagctttctgtctctatcattttggctactctataatgcattcattcctttttatttccaggcagtattccattgtatatatccacctcagttcttaactcttcaattaacaagttattttttatacctgggatccacgggggaaggaaacttttatactcacaagcaaacttagatacatttgaaaagccagttaagtacgtatttttgaaaaccaagggaataataataaagtaagagatgcatagtccattttcacactgctgataaagacataccagagactgggaagaaaaagaggtttaattggacttacagttccacatggctggggaggcctcagaaacattgtgggagttgaaaggcacttcttttttttttttttcttaatttaagttctgggatacatgtgtagaacatgcaggtttgttgaaaggcacttcttacatggcggtggcaagagaaaatgaggaagaaggaaaggtgggaacccctgataaacccatcagatttcatgagacttattcactatcatgggaatagcatgggaaagactggctcccatgattcctcccactgggtcctcccactgggttacctctcactgggtccctaccacaacacgtgggaattctgggagataaaattcaagttgatatttgggtcggggcacagtcaaactatatcacattggaaaagattcaaaaatatatttttagcataaaggaagtcatggtaaacaaggtaactgtatattggaaaagtcatatttagaagaaaagagtcactgtatttcttcggagattcttagcctttagcatataagacatcaaaggttttttatttttaattatagagggttgtctttttctctggttgcttttaagattttctcttaatcactgattttcatgtttgattttctttctgccccatataatctgcaggaacccatatttgattttggtggaccttgtctctttcccccacacccgagacagcctgtgctgtctagcacaggctggagtgcagtggcacaatctcagctgactgcaacctctgccccgccaagtttaagcaattctcctgcctcagcctctggagtagctgggattacaggcactcgccaccacgcctggttaatttttgtatttttaatagagatggggtttcaccatgttggccatgttggtcttgaactcctgacctcgtgatctacccgcctcggcctcccaaagtgctaggattacaggcatgagccaccgtgcccagctgcctttgtctggtttttaatttttatttcttcatttatttttatcctgtttagagctcatttaaagcttctcgagtctgtgggtttataggtcttattaaatgtgggaaacttttttggttgttattgtttcacattttttctgtcttcctgtctcttgtgtctccttctgagagtttattacggggatgttaactatttggtgttatctgttaagtcattgaggctctttccatttgttttccaggcttatttctctttgtacttcattgtggatagattctactgctctgttttcaagttcagtggtctttttttctgctatgtctaatctgctgtaaatctcgtttaataaaatgttcgttttccatattgtatgtttcatctccagaagttccattttgttcttttaaaatattttccagttctctatatgaattatatctcagtaaagctaaaaaaaattccttttgctcctctttttgctcatgttttcctttacattcttaattatatggagcatatttataaattgtattttcttgttcttatatgctaattgcatcatatctgtcatttctggggctgcatcccttgacagatttttcctattttttgcatgtctagtaactaattatttggatcatggatatgttgaatctgtgttgtctcctgctggagtttgtatttctttagagtgttggactctgttctggcaagcaattaaattcctttggatcactttggtctttttaaggattgtttttaaacttcggtagagaataatagcccttactctagagcaactttagtcacattctacggcttgacctttttagagttagaaagggggtgcatagtagcagtagcacaccattatatcgtatttccacaatacagagacagtagacattagtaacattaagaatgtaaacacagccatatgctacctaatgacagtcagtgagggaccacctatacaacattaatctcataagattataataggtatttttgctgtaccatttctatgtttaaatatgtttagatacacagatacttaccattgtgttacagttgtctctagtattcagtacagtaacatgctatacaggtttataacccgggagcaataaactataccatatagcctaggtgtgtaggaggctataccatcatctaggtttgtgtaagtacactctctgatgtgcacacaatgatgaaatcacctaatgacacattcttcataacatatccccatcattaaatgatgcaagactgtcaacacctgtagtaagttttaggcagtgagtatttattattcatctagtagcatctgccagacataagagtccctgattatttcatctctgtttttaacactttggttttaaatactgtcaaagtcaaataaaatatagggacaaatctctaaaacattttatttggggcggggcacggtggctcacgcctttaatcacagcactttgggaggcggaggcaggcggatcacctgagttcaggagttcgagaccagcctggccaacatgatgaaaccccgtctctactaaaaatacaaaaattagccagatatggtggcacacacctgtaatcccagctattcaggaggctgaagtaggagaattacttgaatccaggaggcagaggttgcagtgagccgagatcgcgccattgcactccagcctgggtgacagagtgagactctgtctcaaaaaaaaaaaaaattttatttgggaagcaagaattgcaatttgggacatacacacagaccaggtggtctttggtatgtttgaagcacaaagagaaaattggaggttttattaaaaaggagaaataagccaggagcagtggctcacatctgtattcctaacgctttgagaggccaaagcaggaagattatttgagcccaggagtcagagaccagcctaggcaacatagggagaccctgtctatacaaaaaattaaaaaaaaattagttggccatggtggcacttgcctgtagttccagctactcaggaggctgaggtgggaggatctcttgagcctgggaggtcaaggttggaaaaagaaaatgtattgttttgaacgaaggttcattggtacttggaaaatttggagtaactggcaagctctgattagtgaatgactgcaatgggtaaaactagccatagagtcacagcaggttgttttagcagctatcaggtaaaattggtttcaggttacagtaggcagtttcagcagctaggcttgcagagaattacatttttggagcaatgatatgtgctctcagtgctttttcccctggcctctctactccatttcaattgagtatgacaagaatgacccaatttatatgatcaactttcacaatactttttttttttttcccagcaaatacaactccaagatcttcatcccactttcattccaggcagtttttttttatgtctataggagggaaactctttgtataacatacacacttatagtatatttttgaagagcgatacaaatatacatttcaaaaaagagagtaatagtaaacaaggtgaatatacatttgagaaaagagtcaaatttaaatttttgtggctagaaaattcacaggagatctaatgaaagcctgtgaagaggtttaaatataaatagggaaaattttaaactattttttttgaagcaacaaaagcagagatttattggaaacaaaaagtacactccacagggtgggagtgggccctagcaagcagcttgggagcaattttaaacttttagaaatgaacaaaacacaactcttgccctcagagtgtttttgctttaatagggaaggtaagaggtgataaatgtgtgcagtcccagttcctttacatttaatagcaccaacctaatagtagtgctctaaacggtgaaatactgtgttctagtacatggtagggatccagaaaatgatagtttcccttcttttatggattgcttgtttatgaaaaactgccaattggcagactgtgatgagtgccacagggagatgtgatcttgttagaggaacacagagaaagaaaagatgattttaagctgtgaaaattagcagaaggttttatgggaaaggtagatttgagatgggtcttgaagaatgaatacaattttgacatgcagaaagcatatcatgggcaaagtgatggtgtttctgagtatggtgatttggttttcttggtaaacccctgatgtcaatatcaagtctttccgcttgagctagtaagatttcccagtcaagagtcctcccagcttctgcctggaggggagtaggagtgctctggcttcctgggttctggagaggccgtggatctcagcatacattgtgtctgtgttcctaatcgtccttctgggttaggtacagtactccatcaactgtgcttgttttgcctttccagggaagaaatctccagttggctgctgatgtggaggaaggacagttgtctttgagcttggagtatggtaggggtttagggaacaaattgctttgaaccaatcctctttattttagaacctccctttattcctttccagagctactggtactctaattcctgagtcttttgagcattttgtgttgtaattagagttggctcttggttttcctaattactgacttagtatttagctctcaggtgtgctgaattggttactgttcatttgttttcctttctagctttagatatctcatttgcagttgttacctctcctctctgtccttatgggcttatgtcttcaaaaaaaaacaaaaacaaaaaagaaaaaaaacctctactatagtaatgaggtttcaggaatgagtgaaattgcatctgtgtttaatatgccatctttaccctgaacccagtgtttctttctttttttaaaaaaatcacattatagttagattcattgctttattgggaatctacctctttaaaaaattctatgctggttatgaattgacataatgagaccaaaattactattgttctgttttcttcttatttgctgcctaagagccaaagaaatgtctgaggaccaggaatgtttcaaagtctctggaaaaattgaaagaattctgctgcgattctgcccttcctcaaagtagagtccagacagaatctctgcaggagagatttgcagttctgccaaaatgtactgattttgatgatatcagtcttctacacgcaaagaatgcagtttcttctgaagattcgaaacgtcaaattaatcaaaaggtatgtaactgctatagatgagtatccagttacctagaatagtgggttctgaagtactgtcaggttctctgaggtcattcatggcaatggttcctaaacttggatggtcttctgaatcatctgagggagcttttgtgttttagtttagttttcttacatccctggagattcgatttactgtgttttgggagggattaattggtttgtatgggaacaaaacaaaagccttccaggtaattctgaggtattgcctggatcaggagcccttgacttggagggattctttattgagaattaatacaagcacagtttcttacagtcttccttagagtttccatgattaccgtggaaaatcatgatgggcaacttagatattttgaggtttcagttgaaagcttgatagatagaaagtaaattcaaatgtaagccaaatgaacatgggctttttactttatccactatttgttttgagacttttaatggttttcataactgcagaatcagggaatttaactcatgctccatcattgaaatctgtaattcagaatagtgattggttcgcaaccttagctttacattggaatcacctggagaacttcaaacaaaaattgccattaagaaccttccctcagaatcttatctaattggttttcactgacaaatgggcatggatattttttaaaagtttacattttattttgtattttatttttattgatggagtcttgctctgttgtccaggctagagtacagttgtgcgattatagttcactgtagtctcaaacttctggtctcaagcaatcctcccaccttagcctgcagatgaggtgagactaaaggaaaagcagtcattttaatctgtagctgtgattgacaaccattgaattagagaaatggttctatatatgtatatgtatgtgtgtatgtatatatatgagtcattgaaattctaatgaaagctgttggcctttttcttcagaaaaattctcaagccaacaaaattttgcctataattttcaagatttcacacctttcccacaaagcccagatccatgaactcctccctcagccaggctaatattgattgacttatcttagatcatcaagaaaaaaaaggtgtttttgtttttagtctcttttaatacttagaagcagttcacctaagtatagtggttattaagcatagaagtcataaagtttatccattaaagctcactttattgataggagcatttactccaaggtctcagaagagcgtatacattattgctttatacatagaatgaccaacttggcatgtccacatcacaggaaattagaagtaagtagacagagggggcacgtagaagcagtgccattattacaggtgataagctgtttgatggcatggatagacgtggatgaatggcaaaaagctactgagtgaacataaatgccccatggtccaggaccattagggtggggtcagcaatgccataactctcaataggtttcgaaatatattctgatcactctgaattgtccagacaaggttaaattgagttcagcatactgtctctgggaatatgaaatagaatgtaatgtatctgatgagtatttctatccaaatcattttttttaaagttgcttattttgttacccaggtattaatatgtacaacaaaccctcatgacacaagttttcctatataacaaacctgcacatgtacccctgaacttaaaatgaaagttaaaaaaaagttgcttaatattcaagtatttagattgatttaattgttagcatcccataaggataaaacttttttttcctggaagcttatctcatttcctaaaagaataaagtataaagtaagaataagtttttacaatgtaagaaatatattttctgtgttgattaacttttatactacatagtatatacctgcatttaatatagaatacatactatattccatgacataaaagtcatggaaacaaaataggaaactcatcaaaattaaaagcaaaggcattcttaggtataggaaaattgttatgcaatccttggggtgttgcttcgccagctgtaaacctctgtggctggtggtgcctttgcccgagtttttacttgggcctgctgggctcattcctcccactcggcctggcaggctgtgcttggcttttgcttttggcctgaatctcgcagctgccaagggtgagccaggagtggagtggtgagggtgaggggtgtgtgagcaggtgaccatggggtctggcccctgtgcactgccaggcatgctggcttcggcagggtgggcagctccaggtgccagcgtgagtgagggctggaccaggcgtaccacaaacagcttccacagctggcaccagggaacacagtggcgcccagaagcttggagattccaggaactgcagagccccagagagggtgtcatagacctggcttaggagcccctaggtctgagctccccagaggtccacagctcttctctcctgtcttctctccttcttgttgctgcaatgtggcaagcaagagatgggtttcaggcctgtttgtgttacagctcttttagccctgccattcggtgggtcccaggttcttgtcctgcttccaggaagaatgaagtatgtggacgagtggagggtgagcaaggcaaagaggggcttccttgagtgacagaacattgaggggagacccgcagtgggtgcttctttctgcaggcagggcatcccatcaagtgagaagtgatgagccttcagccgagaggggaccctggagtgggtagctcctctccgcaggcaggttgtctgcttgtctcttcaagtttggccgagtctggggatttgtatgggcttgagaggaggaagtgtgtgctgattggttcatgggctgccatgggcgggctcagaaaacaccgtaagttctaattctggttcgtcagcctggcccccaggcttcaggctgttcctggcttgaaggtggggcttcacccggacctgaccctttctgctcaggagcctgtctgcctcctgccgtcatccatggcacccaggctgtttgtgccatggggcacctgcaggacagctctgagctgccctcagccctctccttggcctccttcccatgttcatcagtgtccaaagtccagagggggccgaggcagcagggggctggcatgttagcactgccctgagcatgtgcacacccagccaggttgcaacagttcctaggcttggccttaactttgagatcagagtgggtgctgggagctgggagaggccaggcagtcggagcaggtacttctgagcctgcagagggagggggaattccctttctgggcccttgagattgcagagatgcccgggtccacagccacagcttgggtggctgtggctgcagctgcacccaggagggtggggctcctgcctgctcccagcccccaagagcacagggatgcccaggtttgcagccacaactgggcagccacagctgtgcccagggagcgtgaggctctcaccctgccaactcagaagggggcgaggcttcttccacccatttctggctcctgtcggttctgtggagcatgcagccctggctgcgcctctcctactgcagctggcgttacggcagtggctgctccagatgggctgccattgccatcataatgacctggatttctcttgccaacctctccatgcctcaccgtcttcttattgctgatctttggaggtttgctggactgcactgttcaaataaattgagttttttttgaaaagttagtatctttacctgatgtcccggtgaagctgaattgttttaaacatttgggaactacaaagtgtacatgtttctgggttttcttttggattggggttcccatttctgggccattttgcttctctctcactctcccctcttctttttggtcactagatttttaggccatatttttcattgtagggggagctgggtaaatttttagaagttggcagtgacagagtggcaattaattagaagttggatttagccaactataaatttgtctcatttacatttttctaaattaagtctaataagcgaggaattttccctaagctgtgaattggaattaattatggttcctcacagaaaggtaagaatagtaggagtactaatgttgaaaatgtggccttgtgctgtaaattttttaacagctctttctcatgtttctttaccaagagaatcatggttctttctttctataagaatttatagaatgtgctgtcttttacagtgtgcttggaagtataaaacattaagtgcagctttatctgttggcatgctttgctcaaagtggttttgccctactcctgagagagagccagatttgtccccattggccttttgtgcattacacaccttagaataaataataaaaagaaaataagtgttaataataatagatttaatgaaatcaaatttaaaaacaagtatgtaaaacattaagatatttagactttcaaaatttgcataaaaattctatgatagcttacttggttcataattttttttaaccttctactttgaaaatatttgtaacctatggatagtttgccggaatgctacaatgtgcttctataaacttttcatctagattcactaagtgttagctttttgccagatttgcattttccgtctctgggaacttattattgtggttaatatttttaaaactttatacatcttttggttgccaggacacaacactttttgatctcagtcagtttggatcatcaaatacaagtcatgaaaatttacagaaaactgcttccaaatcagctaacaaacggtccaaaagcatctatacgccgctagaattacaatacatagaaatgaagcagcagcacaaagatgcagttttgtgtgtggaatgtggatataagtatagattctttggggaagatgcagaggtaagtcgtcttttcaggcactattttatatttttcttgtctagccttagatatttttcagtatttttgtttcattttctgaccttatataaaagctgatttgatcaatcaccttttaaaaaatactgttatgtaaagtaaaaactaaaaatgaacacaagaaacttggtgggaaccagacttggtgggaaaaagtgaggggtctctattggaatgttagcgcttattctccgtggtactaggccagtactttttatccatccaaagttaattggatgagtcaattagtgaataaaccgtaatcatgtaaatatgttttctaatgaagactcaagcaagaaaacatttttgagatgtatagaagttcctctgtttactcttaatttatgaattttcatagccaggaacaaagttaagtctcaatggaagaacacgtgaactttaccagctaccaccagaagttgtttgaagttttacagatctctttgggtgtcagtcaacttggtgtcttagtctaaattgggattgtgccaggtgtggtggctcatgcttataatcccagcacttcgggaagctgaggtgggtggatcacttgaggtcaggagtttgagaccagcctggccaacatggtgaaaccgcatctctactaaaaatattaaaaaaattagcccggtgtggtggtgcatgcctttagtcccagctcctcaggaggctgaggcaggagagtcgcttgaacccgggagatggaggttgcagtgagccgagatcctgccattgcactctagcctgggcggcacagcaagactctgtctcaaaaaaaaaaaaaaattgggattgtatttaatgttgaaatatttattataggccctagtcaagaaggttgaaagtgaaatttgaacatttcataggcaaacttagggaaagtattgcagatgacacctttgttggaagtcatgaatgcttgtgatgattctatagtttgggacctggttggattgtacactagagagtgatgaggtagcatgtctgtgcttcttggatgggaagtaaagacttggccaactttttttcttcaagtttcctaaatcctctgtggcaggcaagcagcgttctcaaagtcagatgcattatgcaatgttctgtgatattaaattaggctctgagataatgtcaccatgttttctgagggcaggaacaaatatgtagttgtcatcccctaggcgaaggagagaaactgtctaggttaaacggtaaattcagacctgaccacggtaaaggctgatgtttttctgcccttctgtgagggactaatagagttcagagaaggggtgaggttggggagcgagagtgttagaattagagttccatggcttcagtgggcaatatctaagccatggtgctttctagaggaaatcagggaatcacatggtgcttcatggttctatatttctatcagtcgtgcatcattaattagttagccagcctggggtttctctttttactttttcaatgatttctctgtccggatgggttcatcatttctgcatactctgtagtgtcttctaaatgtcagtcatttgcacatgccatgtagcaaattcttactcttttacagtctcatgatctctgtattggatagtctttgtgtagggaaagctctaaggatgtagaagacctgtcatatttttctgagtcttttatagatacagatgttgatactgaagttaggtcactggaactgcccaaaatacattaaaccataggcttctatacagggaacatttttttaaactttttattgacatagtacacatttagattaagtgtacaaatcctaaatgtataccttgattaatttttaataaagtgaaccaacatcacatagggaatcttaaaatataaatttattgatattttcttttttcattttttagattgcagcccgagagctcaatatttattgccatttagatcacaactttatgacagcaagtatacctactcacagactgtttgttcatgtacgccgcctggtggcaaaaggatataaggtcagctttggctttaacttgtggggaaaggaaattgggattctcctccagagagtgcaaacgtgttttgtaaggtggtaggtaggcttcaattggtttagaattttgcattttacagaactgaaagtgtttcataattattagtattatgtatttatgagtttttaacatattgttagatatttagggtaaatttttaaactctatgatagtgtttcttagcaaattatccacccttgtcaactcctttaaaccctacatctgaacgttgtggactgattattttaaccatttcagaattgacgtttaaacatttcgaaatgagtttttacaagtcattttttatcctttgatagcaatatttcttatttttgttgaaggtgggagttgtgaagcaaactgaaactgcagcattaaaggccattggagacaacagaagttcactcttttcccggaaattgactgccctttatacaaaatctacacttattggagaagatatcctttttggacgggagtttttctcttaaatgatacaagggctttgttggcaggttttgtttgtttgtttgtttgttttttagttgctctttgggaactttttagatgagctgagaggcattaaggtgaacccttgattaggtgtgctattcaagagggaagtagtggctggaaacaagcatcttttcacatgtcatagtagaaggcaagttcatcatacttcaagagcaagaaaaaaagcaaccctaataaaagacgatgtcaggttagtatctgatttgaaattatatcttccttagcccatttgtgggaagtagttaggtgcttagggcctacaagctcctcagggtctttccaaagtgagacctaaaaagtaacttattgaagccaggcgctgtggctcatgcctttaatcccagcactttgggagactgaagtgggcagattgcttgagcccaggagtttgagaccagcctggacaacatggcaaaaccccatctccacaaaaatacaaaaaattagctgggcatgttggcacttgcccgtagtcccagctacttgggtggctgaggtgggacaatcacgtcagcctaggaagtagaggctgcagtgagccgtgatcatgccactgcattccagcctgggtgacaggagtgagaccctgtctcaaacaaacaaacaaacaaacaaaccaaaaattcaaaatgtgaaaagagaactggctgaagtcagaattaagacagagttaaatgcctataaaatatagtggtagcccgtcttcattaattgttaactttataaaaattttattacttttgaaaatgggctgtgggtgaagttttctcacttggtaagaattttcaatgtgcataatgattgcccctaaatttacggtcatttataaatgcagtgtgttatttgatgccaaataatttcaaaagcaaaattgtcagtttcaaaagccaaataattatatgtaaaattagaccagggtgcatttaaaaaaaattactatgggggtggaatcagttctctgataatggaagaatggagagataagaaggccttaaatgatactgtgtgaaagtattatttctgttatggtttattacagatctgcttatttctcagctcatctaattctaaggactgttttgttccatgaatactataaatagggaacagctatcactcaaaatgggctccaaactattaacagccttgtgttgttctaagctgatcaggctgtaagaacctggtatttttattttttcttttgctaaagcttgagtctgttatttgaagcccatttctagtacagtccccctccctgcttttcctttgctgcttttatgggtcctatgtcctgatgtccaaagatatgtccagactttgccccaaatcagctttcatccctgagatttagttaatggactcattttatacacacatacacagacatacatgcacatataatgtatatatgtttctgttttctcatgtctttaaaaaattgtcttgctatatctgggagcttttaggtacattaaaaaaggaaaataatttacacccttttagtgtatttatactttgaattgtggaattaaacattatgggattgttaaggattcaagtctcagcatcatccaagtgatgaagtgggttgatatttgggcctccatggggtctggtgtactccactaagccctttggaagtaagatactggttatctgtctttatgctctttatatcttaggaaagataaggcatgcaactatgatccaaataaatcagaagaatgaatactgggcagaagatttttgcaaagggcagaagtactgtgtgaaatgaaccatcattttattatttttttctttatttttatttttttattttgtagagacagcatcttgctttgttgcccagggtggtctctcaaactcctagccttaagtaatcctaccaccttggcctcctaaagtgctgggattacaggtgtgagccactgcgcctggctgtgaaccattattttaaaggagaaaatagttaatattattggaaatttagcatattaggatttagaatttagcatataattatttttctttaattattattaaatgtgaatcccctaatcaagctggatgatgctgtaaatgttgatgagataatgactgatacttctaccagctatcttctgtgcatctctgaaaataaggaaaatgttagggacaaaaaaaagggcaacatttttattggcattgtggtaagtactttgcaggtgaggaacaaatgttagatgttcatggtatctctaaatatgatctatcatgtatggtttataataaggatatctgatgaagtgtaccttcagataattatacaagaaaaacatttttctcacaatattatatgttaaatcgctagttacaattttctcatggctacttggtacttgtagcagtccattctcacgttgctataaagaaccacttgagactgggtaatttataaagaaaagaggtttaattggctcatggttccacaggctgtacaggaagcatggctgaggaggcctcaggaaacttacaatcatggcgaaaggcgaaggggaagcagtgacatcttcacaagcacaaggctagcaggagagagagtgaagggggaagtgctacacacttttaaacaaccagatattgtgagaactgtcatgagaacagcaaggaggaaatctggcctcacaatctaatcacctcccaccaggtctccccctcagcattggggattacaattcaacatgaggtttgggtggggacacagccaaaccatatcaatactctatgctatggagagatccagatggtcttggtccatgtgccctgagattttaaggttgaagatagacacaatggcagacatatgtgtggacaatgtacagatagcagaataaaacactaagccaacacaagcatggtggcaaagtgttctataaatttcctctagggatttgaaattaaacatgaatgactatggtattatatctagatttggaggaggggatagttaaagagaaatgataattggctgatataaaataccatactaaattaatattaggattatttacagtcagttttctagataaatgtaatttgtgaattatagttttatttatttatttctttgagacggagtttcacccttgtcacccaggctggagtgcaatggcgtgatcttggctcactgcaacctctgcctcctaggttcaagcaattctcctgcctcagcctcccgagtagctgggactacagtcacccaccatcataccaggctaatttttgtatttttagtagaaatggggtttcaccacgttggacaggctggtcttgaactcctgacctcaggtgatcagcccacctcggcctcccaaaatgttaggattacaggcgtgagccaccacgcctggccaactcatagttttattgattttctggcagtttatgaataaatttgctcatttacagacttacgtggactctgctaaaggtcttagactttttaaggcccttcagaacaatcagacaccccttttctgttgtaagttaagcacaaatggaactctgtccaagtgaaaactaattctctttgctttttctaatttctacggtcagtggcaatatcaacaaaaattcttaccatctgaatgtctccaatgtgccttttaataccttattttgactgcataactctgtgttaacttgacatttgcttaaccaataagcccttctttcagagagttagcattcctgttggtgttagacagctctaaatgatatttttatccttgagaagcacgttttatctagctacaggcatttggacctatatacaaatagtaaagttatttacttttaagctttaacatatgtaatgtgctattttatatttacctaaaactccttctaaagaacagagttgatagtatataattcctacttagtgcatttagaaataccatctggcttaccgccagagttaaccatgtgtgcgaactgggactcggaaaaatgaaaacagccgtttgcccttcaagcattttctttggggctgtcctttacttcagcaaccacttttgggctgatgacatcctgagctctgggtccaggctgcacctctctcgagctccaggctcctgcatccaaatttttattgaacagagatacttagaatttactctggctcctcaaactcagtgtggccaaaattgatcttatcttcttttaccctcgacactgttttccctgtcacaatgggtgtcactcattgcctggtcagtacctgggagtcaccttttgagtattggtaattagtctgaaattcaaagggctttgctgttgtagtatcactgcagtcaggctctgtgccttcagtctgggcagtgcagttttatacacactgattttaggtttctcagtgtgatacatatcacacagggtgatagatattgtgggtattacagtgtagaccatttctctgattaaagaaaaagggaatttggctgactgaaaaatttgttactttaacatctgtacctggtttttgtaaatgcttggtttgtagattggtatataaatttacatgtgtatccttatgtactgatagtccatctctctaggctctagagaaagcctctgggctagaattaaggatgttccttaattacagttagaggagctataacactgcctccaacccataagatccctgggtgtccattccctccagaggtgtctgtaatccagactttgaagatgataatttccttgcttttagttggagcttctagttccagccttgccaccttaaacgttatatacaaatgtaaatatagtgtgtgtattcttttgggttttgctccttttgtttaccattttgtatgtgagatttatttacatgtgtcgctgtagttctctcattgccttttcctatttcattttatgatctacagtttattcattcctgttgatggacatgtgcattctttctagtttacagttgtacagagaatgctgctgtaaatatttttgtatgtcttgtatcgtatacaaatgcctgagtttctccagagtatatccttgggggaggaattgctgaattatagggtgtggatacttcaacattcctagataatgccttgctgttgtcagaagtggctttccatcagtagtatatgaacatagggattggtgatttttcctctttttagctaatgcagcctgtaactagcccccatggctttcataagcatccgtagtggctaacagtgtggattggggagtagtcagatttcctgggtttgaatcttgactctactccattgtcactctgggaccttggctagaaacttcctatcacttctccaaaccatgatcttttccagtttatctttgctattattggcttaggatgttagggagcaggttcaagttggcatgattattctactggatagactgtctacttgggcttcattcagagtttgataaagtatacattttatgtgttactttgatgtatgaagtagtaatttactacagtactggtggtctggttactaggaccatgtcacttgttactttgagtgataactactatttgtacagtgctttatagtttacaaataattcctgtttattttataatttgatccttacaataaccttatgagagaagtaggctggtttggttccatttacagaggaagaaactgaggcctggcagtgtttggtaacttgccatagtcactccgttaggtatattaactccaggccttgtattcagggcggctctcggaaatctgatttatagtatcatttagatatctgtgagtctgactcttcgtgtaagagtcctgaaaagcagacaggtttctaacactttagaaatagagtacatacatactcctgagtgtatcatctttactttttccatgtttatgctgtgttatagccataactggggaaatacattttttctgtaacattatatttgtatttgtttttagggagtgcagcctgccacaggcgaggttgtgtttgatagtttccaggactctgcttctcgttcagagctagaaacccggatgtcaagcctgcagccagtagagctgctgcttccttcggccttgtccgagcaaacagaggcgctcatccacagagccacatctgttaggtaagttggcacatcactggaatataataccgattctgaaacttaggtttagttccaaaactgatacttattaaagttgctaaaaatagtttttacttacaaaaattatatttccactgtagtagtggaaatttaaaaaaaaaagtaaaacaacaaagctgggcatggtggcacatgcatgtaatctcagccacttgggaggctgaggaggaaggattgcttgagccccggaatctgagaccagcctgggcaactaaggtgagatctcatatctaaaaaacaaatagaagaaacaccacctacccctactatcaccttaatgtagaactttagaaggcagtctttttgaagaggtttctgatatttaatgatattatttgataattatggggtttatgatatttaattattggtaatcttcagtttctagagataatttagagttcacttcttacaaagtttatgtaactttggagatgctttgtctgtgctgcaagtttcaattcatggctgtgtccagtggttttgtttactggatctaagatcagaccacttacgtatgaagcagtgtgctaggcgctgtgcgtacagaggaagaagatgtggttatgatatatgtctggcagagtttacaacctcacatgagagtcagatgtgtgcatacctaactggacttaaaggcatgatgtattaagtgctaaacgtgaaggtgccttgttggaaagactccgtactgccacctggagtgtggtgggaaagagaccagaaaggtgtgctggggcttcagcgaagtagactgtatattgacgaatttggactttggactaggcagagaagcccatgaggattttcatgtagtaggtagacaaatcatttagaaaatcgaggccaggcacggtggctcacgcctgtaatcctagcactttgggaggctgaggcgggtggatcacctgaggtcagcagttcaagacagcttggccaaaaccccgtttctactaaaaaaaaaaaatacaaaaattagctgggtgtggtggcagacacctgtattcccagctaccccggaggctgaggcaggataatcgcttgaacttgggaagcagaggttgcaatgagccaagatcacaccacttcactccagcctgggcgaaagagcaagactcttatctcaaaaaaaaaaaaagaaaatcaaactgattgattaagtgaagttccatatgtttctttgtccttagtgttgtgttcattttcatttgaatttaatttctttcgaagtagctttcataatttgtttttctgattataaaactaatatatgttcattcagaagacaaaaaaaaaaggataaattcataagttgaattctgtaacccagagaaaatgactgttaaacattttggcacattatttccgtgtgtgtatatcacttttttccatttgtgaacttgcattcctgctgcaaaatcacttttctattctgtggtttttttttttttaactttacaattccccatttttaaaaactttattgcagaacatttcaaacatacacaaaattatacagaatagtgtcatgaactcctgtcactctattagccagcttcagcatttctcaggaccattctcatttttctacactccctccccttttctctctcccttgattattggctttgaagcaaatcctagggagcatcagtttatcctctaatatttcagtaggtacccttaaaaacaaaataagtacatgacattgtcatataagtgtatcataatttatccattccatttttattatattcatttttccagtattataaatactgttatgatgaatatccatatacagaaatactcatgtgcgtttctgatgatttccttaagataaattcctgaaaatggaattaactggatcagaaggtatgaatgtttataaagctcttgattgcttgctagaaatggtaatatcaatttatacttctaccagtatagtctaggagggttctttgaacctttgctcacattgagggtgatcatttaaataatctttgccagtcacatagatgaaaaattttgcatcaaatctcttcattttgatcttaatccttttctgaccatgtgttcaaacttgaataattaaaagtcaaacagtaaacttgtaaggagagctgcttttacagaactaaaaaaattaataaaatctggaaaaaaatttttaaaggtaggcttctatattgtattttcaatatttcctatcatttccttgctagaaatggtaatatgagaaatggtgatcaagagctttataaacattcataccctctgatccagttaattccattttcaggaatttatcttaaggaaatcatcagaaatgcacatgaatatttctatatatggatattcatcataacagtatttgtaatactgaaaaaatgaatatagaaatggaatggataaattatgataaattatgataaatggataaattatgatttcctgtctttgatttagttcatttttctttatattttattaacttagtatatattttattaacttagtatatattttattaatttagattgagtaaagtcaatcaattttatcaacacattcatttttttgttttctgcttaattttataaaataacaatggcgaaattcaataaaatatcaaaatatttcataatgacattgtcaaaagtgaatttttgtttgtcaagcagcattcattgactggtgatattcctaaatgtttgttcatcacatgagatttaaaagcttgaatttggcatatcaaagataatttaggtgtcttatgtgggttttaccaaatttaatgcctgcttttgtcttattttaatttgaatttctctagttagcattgtaaataattttctctatgtttactgaccgtgtgtaatttttcaatctttgcacttttttttgtatcctttgatcattttcactttatttgcatattggactaagcgaagtcaaaagttaaatctgcatttctgtggagttcctacagctaatttatatctatggacagaatgaagtagaggaaattcaaaagttagcaggggtcaaacagtgtggactcttgtgactcagggtttgagttggaaaactagctcttccctttagtgactttgagtaagttatctactgtattgtccttcagtgtcctttatattgggggtattaagagtgcttacctcatggggttgttgtgaggattaaataagttaatataggtaaagcgcctgaaatagtacctgctgtagaaggctctctgtaagaggaagtttttttttttatattttaattaaattttctgtggctgggcgcagtggcttatgcttgtaatcccagcagtttgggaggccaagtcaggcggatcacaagatcaggagttcgagaccagcctgaccaacatggtgaaaccccatctctactaaaaatacaaaaattagccaggcatggctaaagttttttgtaggtacataatagatgtatatatttatgggttacatgagatactttcatacaggcatacaatgcataataattacatcagggtaaatggggtatccatctcctcaagcatttatcctttgtgttacaaacaacccaattatactcttttagttattttaaaatgtacaattaaatgatttttgactgtagtcattctgttgcactatcaaatgctaggtcttattctttctattttttttgtacccattaaccatccccagttcccttctcagcctctggtagccatctttctactctctatctccatgagttcagttgttttaatttttagctcccacaagtaggtgagaacatgcaaagtttatctttctgtgcctggcttatttcatgtaaaataatgacctccagttccatccatgttgttgcaaatgacaggatctcattccttttcatggcagaatgctactccattgtatatatgtactacattttctttacccatttgtctgctgacagacacctgggtgctcgcaaatcttagctcttgtgaatagtgctgtagtaaacatgggagtgcacatatctcttctatatactgatttcccttcttttgagtatatatctagcagtgggattgctggatcatgtggtagttctatttttagttttttggtagttttttttcaaactactctccatagtggttgtactaatttacattcccaccaacagtctgtgagggttcccttttctccacatcctcaccagcatttattattgcatgtctttggataaaagccattttaactgaggtgagatggtatctcattgtagttttgatttggatttctgtaatgaacgatggtgttgagagcttttcacataccaggctgccattgtatgtcttcttttgagaaatgtctattcaatttgtctatttttaaattggataattagatttttcctgtagagttgtttgagctccttatatattgtggttattaatcccttgtcacatgggtggtctacatacattttcttccattccatgggttgtctcttcactttgttgattgtttctgttgctgtgcagaagctttttaacttcatgtgatcccatttgtccatctttgctttggttgccctattaagaaatctttgcccagttcagtgttctggagagtttccccaatgttttattttagtcatttcatagtgtgacattttagatttaagtctttaatccatttttgatttgatttttgtatatggtgagagatagggtctagtttcattgttctgcatatggatgtccagttttcccagcaccatttgttgaaaagattctttcctcagtgtatgttcttggcaccattgtcaaaaatgagttcactgtagatgtatggatttatttctgggttttctgttctgttccagtggtctgtgtgtctgtttttatgccagtaccatgccattttggttactatagctctgtagtataatttgaagtcaggtaatgtgatacctccaattttgtcctttttgcttaggatatatttggctattctgagtctttcgttgctcatatacattttaggctaattttttccatttctgtgaaaaatgtcactgatattttgatagggattgcgttgaatctgtagattgctttgggtagtatggatgtttgaactattcttccaattcatgaacatgtaatatctttcccttttttgtgtgttctcttcaatgttttacatcagtgttttatagttttcattgtagagatctttcacttctttggttaactcctagatattttattttatttgtagctattgtaaatgggattacttttttgatttctttttcatattgttcactgttagcatatagaaatgctgctggttttttgtatgttgattttgtgtcctgcaactttactgaatttgtttgatcagttctgacagttttttggtagtctttaggtttttccaaatgtaagttcatctcatctgcaaacaagaataattagacgtcctcctttccaatttggatgccctttatttctttgtcttgtctgattgccctagttaggactattatgttgaatagcagtggtggtagtgggcatcattatcgtacttagaggaaaggcttgcaatatttctcaattcagtatgataatagctgtgggtctgttttatatgttgcttttgttatgttgaggtatgttccttctatacccagttgtttgagagtttttattatgaagcgttgttgaattttatcaaatcctttttcagcatcaaatgaaatgattatgtgtttttttttcttcattctgttaatatgatgtatcatagtgactgatttgcatatgttgaaccgtctttgcatctctgtgataaattctacttggtcatgataaatgatatttttaatgtgttgttgaattcagtttgctagtattttgctgaggattttcgcatcaatattcatcaagagatattggcctctaattttctttatttgatatgaatttgtctcattctggtatcagggtaatactggcctcgtagaatgagtttggaagtattctccttttttttttttttttttttttcccagaatagtttgaggaaaatgggtctagttctttaaatgtttggtaggattcagcagtgaagctattgggtcctgggcttttctttgctgggagactttattatggcttcaatctcgttacttgttattggtctgttcaggttttggatttcttcgtggttcaatcttggtggattgtgtgtgtttaggaatttatccatttcttctagattttcggatttattggcatatggttgctcatagtaaccactaatgatcctttgaattcctgtagtatcagtagtaatgtcttctttctcatctctaattttgtttatttggggtttctctcttttttcacagtctgggaaagtcttaccaattttatcttttcaaaaaactaacttttggtttgttgatcttttgtattttctttgtttcagtttcatttatttctgctctgatttttatttttattttatattaattttgggtttggtttgctcttgcttttctagttcttcaaggtttatcatttggttatttatttgaaatgtttcctcttttttcatgtaggtgcttttagctataaacttccctcttagtacagccgtcactgtatcacataggttttggtatgtgttttcattatcatttgtttcaagaaatttttaaatttccttgttgatctcttcattgacccactggccattcaggagcatattgtttaatttccatgtgtttgtatagtttccaaaattattcttgttttcgatttctagttttatttcattgtggtcagagaagattcttgatattatttcagttttttgaatgttttaagacttgttttgtgacctaacatatgatctaatctcgagaatgtttagatcattcatgctataatgatcagatcctctacatgctgaggaaaagaaagtgtattctgcaaccattgaatgaaatgttctctaaatatctattaggatcatttggtctgtagtaaagattaagtctgacgtttctttattgattttctgtctggaagatctgtccaatgatgaaagtggggtgttgaagtatccagctgctattttttttctctctcttttttttgagacagagtcttgctctgtcacccagggggcagtgcagtggcatgatctcagtacactgcaacctctgcctcccgggtttaagcgattctcgtgcctcagcctcccgagtagctgggattacaggcgtgcaccaccacgcctggctaattttttttgtattttagtagagacaggatacggggtttcaccatgttgtccaggctggtctcgaactcctgacctcaagtgatccgcctgcctcaggcatgtatatttacaattatcgtatccttttgctgaattgacccctttgtcattatataatgaccttctttgtttccatatttacaaccagtaaacaatacagtattaaatttgcaagtacaaaatttgttttgtttttggtgatatcttcttgtctgttttaaacactggtaagtagtttcttgtatctcagactaagtaccccatttttttcttatgctatatacctaaaggtaaaaacagcagtttttgtcagttactggttaataatattttattaattttgaagacataatatgttaaagctgtgtgaggaaaggcaaaagaatggcttggaattgtggagtgtctatcttaaaatattagggtttttggtattcttaactttaaccacaagaggtctccaaaggatttgatattttgtgaattactgtttaatggttactaaaatcttcacatttctttttatatctgaaagtacaggtttatttactttgtatcatattgtgacttagaacaaatattagagatgatagtaatctaaaattattactcctaaataatgatacactatcaatttttcttagattatttatttttatttatgtaaagtatgtttgtaagatttcagcctgtgtcttagggaatcagtcttactatcttgttacactttcttttgttgtaaaaatgtagagaaagaaacaaatggaaagcaatagtctcgagccctttatcaattgcagttaaggttgctttagcttagaaatgttgtatgtttatagaaatggttgagaggaaagctttagaaagcgataaacaaataatatttactagttctcaaggaaactgacttttcaggtgaatcaggtgaacatcacaaatgacactcaattttgcgttcaaagaaatgagagcttcctgagcactggcatagccaaggaaggctgtatgaaggaggtggggtaggctggtacatttgcagaatagaaggctttgagttggtaatggggaggggggaagggtatgttgtgtgtgtatggaaatgatatgaggtctgaggcacacaggctggaaatattagagaagtgtgaagacagaagggagatttctctgattagagggaactttcatgttgagaattgagaaagaaagggtgaaggcctatgaaatccagcaaactggtatggattcctgtagaaggcagtaaggtttctgggaaaaggaatggcatgatagaagggaagagatgagtgtactgcctagatgggacagttgaattttaaaaataaatatttccctaaaggaaaaagcggatacagagaaaagaatcagatcaaggagcttagagaatgccaatagttgggaataggagcaagaatacaaacagaaggggaggaattaaagagctaggtggagaaccaggacaaggtagggatgtgtagttataatttgtcacacgtggtataaccaatgatgtgagctaattttttacattattgactctgttatagtttactgaaactgtatgacattcagaaagatacttggttaaaaactagccttagctcattgatatcatttgaaaaagacatgtggaagaatgtcctgtggtaccacagtgactttagctatctgacctttgaaataaatgcttgaacacataagtgcttcctcaaagatagatgtgtatgctgcagatttaaagaaaacattgaaatcttaatgttggggaataagaataacctctactatgtttactttcagtgttagaaataccttattattatgtctttttggccacagagagccttacatcatctgaggtttaaccaaaagtattatctaacatgattctttatgcggaggcatagtaccacctgaatgtcacttatggtgacacgtgtttgaaattaccatagtagcattttcattttgtgttcatctcttattaaattaatttatatagtagaaatcacttattactttatgttattgtactttgactttcaagtttttaatggaaaatatttagcagagttttggtgccaaaatgaagtgataactgtgagactatataattatcagaggaattgttatgcaaattaggtatctgtgttatgactgaagtccaacttctttctaatgtcatttgaattaaacattagtataaaggtttcaatttttttttttttaaagaatgagagtaaaagaaacaacaggtcttactcattaatttggttaagaggaagtgcttcacacatacgaaatgttattaagtggtcggtacttgatggtaccaatttcgtgattgcagtgttacagttctatcaaagtttaataagctcaattctgtgggttcatatgaagtcatttcaatataattcttagatatttagagccaagtaaatgtggaatggcataccaaacagtgggtagcatatagatatgaataacatggtgcctaaattaggtgggaaggtgggactgggtagaaagagggcattccaggaagtgtggtcacaggatgagaaaagggaattgggaacatcgagttgactggagtgttaggaaaatatgggtcaagagtagcctgcaacagaatgtagtgcagaagagctgttcagtgagtatttgctgaatgattatgtttaaggccagagaggaagactggagctgtttcattgaggatgctggctgggcactagtgggaggagcttatactttatttagatgtttctcaaatttggcctaccaaccttttaatttactactttgtgttagaattttcttatttaaatttgttaaattataattttaaaatttacaaagttaatacatgtttgttgtaaaagtgaaaaaagtctattttaaaggaaaaaataattcttgctaacctcctcacccatttcacttaaattagttttattataatgtgacttaaatatttataaactgaaaacttagtgctctaggttttatacctattttaacaggaataaagtccaagcaaaatttgagattaaagtaaatgtatgaaacaaataaaatataaatgaatgattgtttggtatgaagggtgatgttctgctgctaaaaataaactgttcctaccagttcaaggggatatatccccaacggaagaccgagttctttttttttttttttgatctttattttattttattttattttgagcagtttgaggctcacagcaaagttgagagtaaggtacagaataaaagtgtcatatcatcagtattctccaccagatcctgtgctatgatattgctgtaatatgctgtgtaaaggctcaaacctttcctgcatgatttttttaaagagtaggggtctcgctctgctgtccaagctggattgcagtggtgcggtcatagctcattgcagccttgaactcctgggctcaagagatcctctcacttcagcctcctgagcagcatactaatcaggcacatacctgtagtcctggctactcaggcatgcaccaccccttacagctaattttttaaaaaaaattttgtagagatgggttctggctattttgcccaggctggtctcgaacttctggcctgaagtgatgctctcacctcagccttgcgagttcttggaattataggcatgagcgactgcatttagcatcttccagtctttttctttcttcaaaccacagtatgacttaagtggtttgccctccgttgggtaccagtgtaccagttccatttttgttgttgttgttgttgtttttgagaggaagtcttgctctgtcacccagactggagtgcagtggcacaatcttggctcactgcaacctctgcctcctgggttcaagcgattcttctgcctcagactccccagtagctgggattacaggcgcccgccaccacacccggctaatttttgtatttttgtagagacgtattttcgtaggggtttcgctgtgtaggtcaaactggtctcgaactcctgacctcaaatgatccgtccgccttggcctccaaattgctgggattacagacgtgagccactgcacctagccatccagttcaattttaaaactactgttttatttttctcattaaactttaaccgttaagtgctccttattactaatgtgatcttaaacataaacagaaatgcagaaactgaagcacgtagcaatattcattttaaaagctgataatccagttgatctaagaccttaacctaagatcatgaaatcagttcggtaggttgtgactaacattttaaaaaaatacagtagaagttaccagagtatatcacgtgtagtaagggtaagtatttcatgaaattcctttttttcagttttatctgtttatagataatctgtctgtatatgccttctaatcctctctccaattcctatcatgtttgtaattgtccatgaaaataattaaactcataatttaatatattaatatgattaataaatgttattcatagattattttatatatacattcttattacctgaaactgatcagatactgcccagaaatatatttttgaatagcacaactgaaaagtagttaatatttagactacgtatttaaaatcctaaagctgacatgattcacagaccagatattgcctacatagaaaatctagaagtgacaaattatcagaagtaataagaattcagcaatgccattaaatataagatcagtttataaaaatgaatagtgtttcagtacagcagcaacaaatagaaaatgaaaaaaattttaaaagatactatttaaaatagcaaccacaataatattatctaagactctatttaccaaaaagaaaataaggtcttaacgaaaatttggaaactttactgaaagatattaaagaactaaataaatactggaaagatgcaacacgttcatgaatggaaagattcagcataaagatatcagttctccttaatataaattcaatgcaattcttttttttttttaaataacaattttgtgagtacatagtagggtacaagagatgtttttcagtgcaattctaatcaaaagggcaatgaggtttttcacagaaactgacaagctgcttttaaaaagatagatcaaagggccaataataagtaagacagcactgaaagacttagagctatttgccctatcaaaactcaaaacttacatatatatgtgtgtgtatatatatatttatatatgtacatatatatgtttatatatttatataaatatatctaaatatatatgtatgtttatatagataaataaacatgtatatatttatatagctaaacatgtatgtttatatagataaacgtgtatatgtttatatagataaacatgtatatgtttatatagataaacatgtatatgtttatatagataaacatgtatatgtttatatagataaacatgtatatgtttagatagataaacatgtatatgtttagatagataaacagtatgtttagatagataaacatgtatatgtttagatagatagataaacatgtatatgtttagatagatagataaacatgtatatgtttagatagatagataaacatgtatatgtttagatagatagataaacatgtatatgtttagatagataaacatgtatatgtttagatagataaacatgtatatgtttagatagataaacatgtatatgtttagatagatagataaacatgtatatgttagatagatagataaacatgtatatgttagatagataaacatgtatatgtttagatagatagataaacatgtatatgtttagatagataaacatgtatatgtttagatagataaacatgtatatgtttagatagataaacatgtatatgtttagatagataaacatgtatatgtttagatagataaacatgtatatgtttagatagataaacatgtatatgtttagatagataaacatgtatatgtttagatagataaacatgtatatgtttatatagagagataaacatgtatatgtttatatagagagataaacatgtatatgtttatatagatgaatatatataaacatgtatatgtttatatatgtttatatagatatatatatacacatgtatatgtttatgtttatatagataaatatacatacacatgtatatgtttatatagataaatatacatacacatgtatatgtttagataaatatacatacacatgtatatgtttgataaatatacatacacatgtatatgtttagataaatatacatacacatgtatatgtttagataaatatacatgcacatgtatatgtttagataaatatacatgcacatgtatatgtttagataaatatacatgcacatgtatatgtttagataaatatacatgcacatgtatatgtttagataaatatacatgcacatgtatatgtttagataaatatacatgcacatgtatatgtttagataaatatacatgcacatgtatatgtttatatagataaatatacatgcacatgtatatgtttatatagataaatatacatgcacatgtatgtttatatagataaatatacatgcacatgtatatgtttatatagataaatatacatgcacatgtatatgtttatatagataaatatacatgcacatgtatatgtttatatagataaatatacatgcacatgtatatgtttatatagataaatatacatgcacatgtatatgtttatatagataaatatacatgcacatgtatatgtttatatagataaatatacatgcacatgtatatgtttatatagatatacatgcacatgtatatgtttatatagatatacatgcacatgtatatgtttatatagatatacatgcacatgtatatgtttatatagataaatatacatgcacatgtatatgtttatataaatatgcacatgtatatgtttatataaatatgcacatgtatatgtttatataaatatatatgcacatgtatgtgtttatataaatatatatgcacatgtatataaatatatataaacatacatatatacacacacacatatacacacacacacacacacacacacaaacacatatatatatatgttttttggagatgggagtctcactctgtcacccaggctggagtgcagtagcacaatcttggcccactgcaacctccatctcctgggttcaagtaattctcctgcctcagcctcccgagtagctgggactacaggcatgtgtcaccacgcctggctaatttttgcatatttttagtagagatggggtttcaccatagtgtccaggctgatctcgaactcctgacctcaaatgatcctcctgccttggcctcccaaagtgctgggattgcaggcatgagccaccatgcctggccaaaactcgaaacttataaagcaatggtaagttagtatggaattggcatatggagagagtagcaaatgaagcaatggagcagaagaaagatggagaaaacaaattcatgcatacataggaagttcatatggcagagatggcattagacatcctgggagggagggattattcaactgatgctgcagggacaaacagctttccatactgtaaaattaaaccctacttcagaccatacagaaaatttcagttggaaaatatatatgtattcattacctcaggatctgaaaagatatcctataaatgacatacacaaaaagcacaaatcaaaggaagtaattagtaagtcatgtagcttttttacaggttgctctaggtattacattatatatacataacttatcacagtgtacttgtgtcattgttttaccagtttgagtgaaatataaaaactttacctctgtctatgcttctttatcctcccccatttataatataattaccttaaatattataattgtcttaaatatttagaaagcgttataatttttccttgaaccatcacacataatttaggaaactcaggaggggttcctattgcttaccttgctgtttctttcctgatgttctaaggtttctttttttttattttttcctttttgtttagagaacttcctttaaccattcttttagagtagctctgcttgtgtcagagtctgttagtttttcatcatctgagaatgccttgatttgcctttcattttttggaagatattttttgccaggcatgggattctgggttgacaattattttttcagcacttgaaaaatattttgccacttccttctaacctttatggtttcagatgagaaatctactatcattcaaattgttttaccctatagctaaggtatgatttctttcttgctgctgtcaagaatttttttttttttttttttagtttttagaagtttaattatgtgtcatggaacatatatctttggctttatcctttttggggttcactcagcttcttgaatctgaaagttgatgtctcttgccaaatttgtgaatatttcatctattatttcttcaaggtttttgttgttggtggtggtgttttttttgttgtttttttttttttttgcctttcttttctcctcttgggactttgatcacaagaatgttagatcttttgttatagtccctggggctctattcattttatttttattgcagtctgtatcctctctgctttccagatttggtaatttctattgttctgtttttcatttcactgattgtttcatctgtttcctctattgtgctgttgagtgcatccactgttattatatttttcacttctaaaatttttgttcattttttctttttttttgagacagagttttgcttttgtgcccaggctggagtgcagtggcatgatctcagctcactgcaacctccgccccccgggttcaagcagttttcctgccttagcctccctagtagctggtattataggcgcctgccaccacgcccagctaatttttgtattttagtagagatggggtttcgccatgttggccacgctggtctcaagctcctgacctcaggagatccacccatcctagcctcccaaagtgctgggattacaggtgtgagccactgtgtccggcccatttttttgtttatgccttctattacgttgcagagaatttttccttgccttgactttctatttttccatttgtttcaagcatgtgtgtaattgctgttaaaacatttagcatggctgctctgaaagctttgccagttaattctgacatctctgttatcttggtgttggcatctatcgattgtcttttttcattcagttggaggtttggaggttttcctgttatttggtatgatgagtgatttttggttggaaccagtgcttttttgtattatgttgtgagattctgggtctcatttaagccttctgttctagctggctttccctgacactgcttcagcagggtaggggtgtgctgcctccttattgccaggtggaggtagaaacccaggttgcttggtttccgttgaaacccgagggagatgggtgcttcttgttactgctgggtccctggaggagttccagcttcccatgtggcctccactgggccttctctgacaccatccccgtaaggagtgagaagggagtctcagtactgcctagtgggtgtggaagtccagtctctgtctggtgtttcgcctgataccatgggggttaaagcctcagtattggccagcaaggatgaacctcttgtttgctactgtatggctgacactgacacaatcccaactggagtttggagtgccttctttcaccagtgagaatggaaatctggggtcccagcctttgctagcatgggtgggaccacaggtttttctctgatgcttggctagagtagagcggttattggctaaaagttttctgtcttgctaggcttcctcttctctgggggtttgttgaggcttttttgtctgtgcctgttggtctttccgggttgtcagctttttcagctccaagtctgggttttatgctacaaaaagtaaacctggggaactcaccgtcatactgttcctcacatcccaagttcactagctggtctgctttctgctcacctttcagagtcgtcttatgtttgtttgacatgtaatatgcagggagtggtacttagagtaggagtggggaaacatatctccattccttcttcccagaagcagaagttcttcaatcaagatcttattttagagattgctctatgtataaatgaactttgcttccttggtgttattttgatctaattataataaaatttggacttagattatattgataatgccagtgtgcaaattttaactgcaatagaattgaattttgcacatgggtgaatctgattgagaaaaagaaaatcctattttttataattaaaaaactgcttttaatatttttagtgctgtttacagtttaagaatgttagtatatttttaaaagcacaaccagtggggaaaattctatcccttttcttggcaaattaacaatctaagcatacaaaaatttataggaaaattttgccagctctccatcagagtgctgtcatgatgattagttcatatttccttcttacgaagcttgccctttcttgtttatcacccacagaaaagcatcaaagttaaaaattaaaagtatttgaaggaacctccataccaagtggattcagagagcccagaggtcagaaatcgtgcagagtcttatgttgacagaggaatggccctgccataagaaaggtgcctgagttatacaaggtgttggcagctggagccaagttacacctggtttacttacctgatataattttaagtgcttcacaaataacgttttttaccttcatagttaaatatttacttaaggtatattaaaaacatataatcagtgaatcaaacctgtgatttcataaatgtgttgcaaagaaagattcttaagttggtatttgagttaaaaatgtgagttaacttaacaagaactatcaggttatagtagtgatgtccttacaaatatgtcagtattattgaaggtaaaggggaatgactgaagttaaggaaacatgttggagcaattgtaaaggcaatgtgtgtcacattttctgccacttgtcatttagattgtgtaagctaaatctagtataagtgggaccattgtttgaatgaaaaaaaatccaaacttgagatgtagagaaatatagatgaatttgaagcccagaaaggacatttaagctctcttaagatgagttactccattttttatagtagctcacctttttaaaggtattttatcctgctgtcaagtttattttattaaattggataccaggaaattctaattgatttttttatatcaaacaaatcgatgttatttatttatttttgagacggggtctcactcttcctcaggctggagtatggtggcaccatcgtggttcactgtagccttgaccccccaggctcaagcaatcctcccacctcaacctcctgagtagctgggactgcaggtgtgctcaaccacacccagctaattttttttgtagagatgaggcctctctatgtcttctatactggttttaaactcctgggctcaagcaatccacccaccttggcctccccaaaatgttggaattacaagcgtggaccattgcgcctggccaaaatctgcattttgatggatgtttccagtagattctcaagttgttgatacatcttctaagttgaacattattatacagtcattcatttattcatccttaaacacagttattgagtggctgctgtgcgccagctttgttactaggtggcaaggatacagaaatgagaaagatccctcctttccaagttcttatagtctagaggggaggtagtcatggaaataattgtaatgaaagcgctggttgaaaatatcttagagttactggcagcccttgagcatcatgctagtttgctagaggggtgtgttagaattgagactggaagaatgaatgccagtcaggtggaggtgtgagagagcgtgcttttcttaggaagcagaaactagtttggctgggttactctgccagcatgagcaggcaacctgaggcaggacagacgtgttttggagagaaagggtgtataaagctggaaaccatcattctcagcaaactgtcgcaaggacaaaaaaccaaacaccgcatgttctcactcataggtgggaattgaacaatgagaacacttggacacaggaaggggaacctcacacaccggggggcctgttgtggggtggtgggggggacggatagcattaggagatatacctaatgtaaatgacaagttaatgggtgcagcataccaacatggcacatgtatacatatgtaacaaacctgcacgttgtgcacatgtaccctagaacttaaagtataataaaaatatacaaataaataaaaaataaaaagagaatcaagagtgaaacggtggagtgagaaagcggcattacacagggcctggataaagagtttcctgtgacagagactgagctgagatggctggtgatggggaccgtagcctagtgaccctttgtgtacccagcacctatcaaagtagctcacacataataggtgcttaataaatgcttggtaaatgaatgattaaataagtgatgtttagaataaagagaataatgggtatctcctatttgtttttcttaacaaaactgatttgggttttttaaacatagaagggttgttgtaaggctgggcgtggtggctcatacctgtaatcccagcactatgggaggacgagatgggtggatcacctgaggtcaggagttccagaccagcctggccaacatggtgaaaccccacctctactaaaggtacaaaaattagttgggtgtggtgtcagcacctgtaatcctagctacttgggaggctgaggcaggagaatggcttgaacccgggaggtggaggttgcagtgattcaagattgcaccactgcactccagcctgggcaacagagtacaacactgtctccaaaaaaaaaaaaaaaaaaaaaaaggttgttggagtagctggaaatctatacattaacatatatggtaatcaatgtctatttacattatatagatttacattatacagatgtagccaattcatttactcttttggaaagatcatattgatttcttatcgttttttccccattatgtttatttctttaaaaaattttttaatatcactgtaaattgattgaagcatcctgacatttccatagatattcctttacagcaaatattaatgggatctacatggctaagttactgtttaaagattgatattgatgataactaggcactagcctcccctctggcgcttgaaaccttttctgttgtggtattcgtaggaaatctctttttttctttatattttgtcttccccattttcctcattcctcttttcgagagcagaagataaatataaagttgactactttgtcattctgtttcattatgtttattagacggtagtttcacttaactatttagataatctagaattagaaaataaattgtgggcctggcagggtggctcatgcctaaaatccgagcactttgggaggctgaggcgggtggatcacttgaggtccggagttcaaggtcagcctggccaacatggtgaaacctcatctctactaaaaatacaaaaaattagctgggcatgatggcacgtgcctgtaatcccaccttctcaggaggctgaggcaggagaattgttcgaacctgggaggcagaggttgcagtgagtcgagatctccccactgcactccagtctgggcgacagaacaaatcaattctggtagtagagatggtagtgactaaatggaagaaataaatctcatatgctgtaggaaaatgtttgccactgggaaaccatttaaagaggaagtgttattagtattaaaaaatctgtcattttgaaatttctttttaaaaattacattaatttcttccctggtggtaatgccattgtattttcagtaggttttttttttagtcctgatactttttgtatatctagctagcaattttaatggatgtgcttaactcatgaaaatccagattttaaaacatgataagttaataggtgatagttattttataagaacatttgccatgagtttatttaaagaatgagagcttctttgtgcattttcatcaagtgcattctcctcaggaatatatctccttgaaaagaaaaaatggggtgtatttgcagtaggtttattgatagtcgaataggaagaaacagcatttgagaagtgtggagaaaagatcttcctgattactacagagacctcctaaagtggggccagactgcttgaacagaaagtttggaagcaattgtgtgaggtgtgctgcatttgttttactaattcgacttgatttttgtaaatacacctgttcatttgggtttgaggatttaattgcataaagactctttatttagctaaagcgtcttgtcctcatggcttttcccagaagtttgtgttataaatgttaatatattaaaagtgcttttaaatgatttattattagcatcttaaaaaaatcctacactaaatattaaagtagtctttattatttcaggtgaaggcaaagggaaacagtacgagttgcaaggtagggggtaaatggaaaggaagaaaaaggaaagacaggagatgaagggaaagattgagtcccatcattcttgaagacacattgttcatggcttcaataaccctggcacagccctctgaagaaagtgtagttatcctcttctttctgcaaggaggcagagatgctgtgaacctctcttgaagttacaggatcacttaggtagtaagtggcaaagcccactagagccctaaccctgtttgatactggtgagttcacctgctatcattaaggtgtaacctgacagcaatgtaaaagacaaaaatcccccttcactgaactccaaatacagttactgtctgtcctcaggatctctttatttttttcttctccttttcatggttcaaggagagatcccttttaatctcttcccttccagcaaagcttcctttcactttctacctgaagtcaaaaacttgaggccagcttagttcagagctcctctgggcttgcttatctcccagcctttgtggactccttcttgtccatttgtctttgtaatgacttcttcctgtcgaacctccctgctgaagggagacttcttactaatttctcttattttccctgcttgcttgctttgagattattttcttatctcttgttttcaggccaggaatttcttcctcctgccagcttttttgtgaatcctttttaacctctggcccaagtcttgatccctaaagcagtaaaagcctatggaggcctggtatggtttttctgtacagtttttcctccctcccttctttttctacccttctttctgaaaaaacaacagaaacaaaaaaaacccaaaaaccctctgatacttgattttgtatcaataatcaatatacattaatataaaatttattaatataaattgacttaatatacacaatactgagttttttccaggcttttgtggaagctccccactgcagtccagaatgctccgtgaccaggtcctaggattctttcccttggtgccattgtgactgctcccttattttataccttcagctctgtccagttctcttcttggcctggctgagctgggctctgcacctcatgggagtggacatgaatcctgaacacaccatgtgggtgtactgggttgtccccaaccttaatgtgaaggcaagtttagagaagaatgcatgatgagtgggcttgcatgcctccctgatggccatatgggagcatgaccacaccacagggttagtccttacctggtgggagccactgggagcagaggagtgctaggtatcgcatggcatatttaagatagtttgtgtccagccatgacatttcaagtgctcattaactgcatgtggttagtagctactgtataaggcaatgtagttttatagacagtagcacagctgtatgcaagagatgggcctagaaagacaggtaacacttaactagacagatttgggggaaaatacattcctcaatgaaagcaaagtttaaacaaggttgaaataatttatttaaaaaaaaaaatagctggctgggtgcagtggctcacgcctgtaatcccagtactttgggaggctgaggaaggtggatcgcttgagctcaggagtttgagaccagcctgggcatcatggtaaatccctgtctttactaaacatacaaaaattagctgcgcatgatggcaagcagctgtagtcccagctaattgggaggctgaggcaggagaatcacttgaacccgggtggctgaggtggcagtgagccgagatcatgccactgcactcctccctgggcgacagagcgagacaagcaacagcaacaaaacaaaaataaaaacagctaatgaagttcttattatgtacctggtacattctgccattactgaaattaactgatgtcatcttcacaacaatcctttgaggtgattacaattattatttaatatgtccataataaatgacaggtttaggaatgtacatttgaattgtggttctgactgaaacattgggcagttgaggaagtacttgataaagtgattagtgccctttttaagtgtgagcaatttctagttgctaagtcagggtatcatttatgtatgaattaccttataggtaagtatactttacattcttttatgtaactcctaactatcaacctccagatatcacaaagtttacttgtgggtgattaaattgcttaagacaagagattgcccacccatacagaatttctattgcttctgccttccagagaacagtgggagcagcctggcctgcaggttgattgtcagattctgcctccctcccacctacttattcctccagagagacacatagcttagcctcctgtcacactctgtcattttcctggggctgcagagcaaagggctccctcaggttaattctgaagtcctgtgtatgctgaagtctgcttgaagaaggagagaagcttccatcttgcatatttcctaatactttatctttccttctgtaacaacagtgcacagattttacttcaggaatgtgtttttattcactcctgctgttatcctgtatactaaagtagtcctttgtcaatgtgctgatgtgctctagaaacatataaagagttttttttttaattggtttgttgactggacgtaaacactagtataacactaaatctaagtgcagagagtgggcagcctgattttgttcataatctcaggggaatcttttataatgggccaggaagcacgtgtctgtggtttctgcatagggcgtgttctgtggtgcccagccagctgtagtatgtcctgcgagatttggcctgcaggccacaatggtgggcttctgggaggaagaatcttccttagaagtcctgccctttgacactccttctgctgaagtgtcctgatctcagtggggctccctgattttctgttccggggtctatcagcactgggtctatcagtgctacccacgccgccgtgactgtgggtcactgagggtgacctgcgtgggtcccatgggctcagcctggccttcccaggtcctacaaggtcctccttactgtccgtccctgctcagtcaccaaagaatgacttttttgaaagtacaattccagagttaaatactggctaagtgtagaaaacaatactggaattcagtcttcacctccaccagtcctcatggtgagatgaagtgtttatgggtttctttgttgtaacctcaaaagtggaatgcatttcctggttggtgctgcttgccctccaggtgcttagtgagtgaagcttcatcttccagatttctctttgtggcttagggtatctgtatgattttcctgcttttgttttcagaggtgctaggctgtgctgatctctctggagtgattatggtgctttttgcctggtaagcccatccttatgtgtaaaaatcaggatttagatgtgaggcaaataaggtggtggtgattttgttttacagagagattttcactttgcaaacttttagaccttttcaaattctaatttgatttgatgtatttaaataacaagttatgtaaaaacattgaaatgacccattttacagaagtttggtttacaaacccattgtttgtgtaaggtaacatacctgaggccaggagcatgatacctttcctctagtcttgcccttgtccctcgctttgggctccagctacatcagagtaattgccatgctcacaaccccatacagtgagagcacagaataatggtctgggtacagtctggggccagacagcctgtgtttggactctatttttcttactacctgtgaatcttaacctctccatggctcagtttccccattcaaaaacaagtatatgttgatagaacgttttatagagtagcaagcattaaatgagttaatacagtgcatgaaacatagtgctcattaaatattacctcctgttattcattcagcatttatttctctaccattcttaagctattctcacattgtgcaatgcatttttgtcacatctgtctttttaaatattctgtatactaacagtcttattgctttcatgaagctgccctacaatttccagttgaggttctaatcttagctgtacattgggattacatgtggattttaaaaaatgccgatgcctgagtttttggcctgtgctagagccgcttgtagctgcttgtaagaattgactgttatagttccaggactttgtaccagacggtgaaagcattggtaacttgaaatcaactatgttgggaatatttgcactcgtaattggcaaatactaccacagctctctcttcaatctgtttgatgttctagtgatttgtttataagcctgtctctctcaataggtgttgaccattttggtggaatgtattagtttgccagggctgctgtaacaaagtgccaccaactgagggcttaagcaacagaaattcattatttcatagttctggaggatagaagtaaaaatatcaaagtatgaacagtattggctccttcttgaggactgtgaaggaaggatctgttccaggcctctccttgacttgtagacggccacctccttcttacgtctcttcatatcgtctttcctccatgcatgtctctgtgtccatgttttccctttttacgtggacaccggtcatattggattagggcccaccctgatggcctcactttaactctctgcaaagaccctatcttcaaataaagtcacattatatactgagggtgtggacttccacatttgaatgttatagggacataattcaactcataacatagggcgaggacattcttttccacctccctcctcagtccgtttgtgcctgtggtagttgcacagtaaagatttgtagatttgaaaaggaaataccttttggctgatgttatttgtatatacttttttattcattgagctatgaactccagagttagtatggtttaaaaaaactttttttgttgttttgttttggaaacagctccttcttgggaaaataagagttagtatttctagagaaaaatgttagtttagaaagagtagttattttaggctaaggcagacctgagcttgttaatgaacttgtggactcaaaaggcgtatgattgagtgaagtggtcttgattttgtgtcagtggctgacaaaaagcttttaatcatgcatgaaaaaaatgtttgtgatgaatttccactgatttgaaaatgtcttaatgttgctagtcctcttcaggattatgtaagactgtagagttcttagaagagtatggcctttcttgctttttctcaaaggcaaatataatgtcaggtaattttgctgttatgctattgaaaaaatacctcctgagtcacaggaagcataaattattttttaaagatttaccatgtgttaggatgattgtgtcatatattaaatatataatggatgacatttagactattatcatctcgaagcatgtaaatatagaatatactttttgaagttagttttcttcaaaacgagagatatttctcaccattgctttttgctgagtaaataccagaattagaatcttatgccaaaaatatatttggagtacacatttgcacaggaatttgtttttttccagactttttaatagaaaatctttaggtataaattacatacggcaaatataaaaagttttatttttaatcaattttaatcaggtgtaatttatatgcaataaaatttatacattttaagtgtatgagtcaatcaattttgacagatacacacatcaatataactaccacccaaattaagatctagaacatttcatcttcccaaaacgttctctttgcctttttgcagtggttttctccccacctccacctcccactccaagcaactactgttctgatttctgtcactataggatagtttagactgttttagaatttcacataagtggagtcagtacagtgcatacttttttgtgtccagctcgttttactcagcataatgcctatgcaattcacccatgttgttgagtgtatcagtagttcattcctttttctcactcagttgtattgcatcatatgcatataccaacatttgtttatttacttgctgaacatttgggtttccagcttttggctattttcattaaagttactaacatttgtgtactagtcttctcacagatctatattttcattttcttcacataattaggagtggaattgctggattatgtgggtaagtatatgttcactgtataagaaacagccaggccaggcacagtggttcacacctataatcccagcactttgggaggccaaggtgggaggactgcttgagcccagaagcttgagaccagcctgggcaacatagtgagaccctggctctaaaaaaaaaaacaaaaaaaccccaaaaagccagatgtggtggcacaagcctgtaggcctagctactcagaaggctgaggtgaaaggatggcttgagcccccgaggttgaggcttcagtgagccataattgtgcccctgcactccagcctgggtgacagaacaagaccctgtctcaaaaaaacaaaacaaaaaagtaacagctgaagtaggttttggagtagtagttaatttaccctcctctcagcagtgtgtgagagctgtagttgctccacattcttgctgactcttgtcagtcttttaaactttagctattatagttagtgtatggtgtcatgttttatttttaacttgctttttcttgatgactagtgatgttttcatgtgcctattggttattcatttatgtatctcttttgcccattttgagacttggattacttgtattttttagttataagaattctttatacattctgaataaaaatcctttgtcagttataggtattgtgaatatttactcccagtgtatggcctgccttttaattttcctgattatgaccttggaacaacagaaggttttaatttggtgaagtcagatgcattagtgtcttcttttatggttactagtgctttttgtatcttaagaaatctttgcctactccaacatcatgaacattttctcatattttattttagttctatagttttagcttttaattttaatatattaaatagttggatttaactttggggcatcatgatatgaggcagggattgaggttcctttttctttgtacgtttaccagttgtttccacactgtttatagaaaagacttttatatgcattgaattatgttgatgccaaaggcttcattttgtctttgtttttaattaatatttatttatttattttttttagagacagggtctcgctttttcgcccaggctggagtgcattggcacgatcatagctctctgcatccttgaactcctgggcccaagtgatcctctcagccctgcaagtagttggggtacagattttcttgtggagatggagtctcacttatgttgcccaagctggtctcaaactcctggacttgatcaaaggttttgttttgaatttgactttgaaaaatgacctagatttttatgttcttatattagatattttagactttgactttctaggatgtcatttaaaaatgtttttaggtctccctttttcttttttctttttttgagacacagtctctgtcacccaggctggagtgtggtggcaggatcttgattcacttcaacctccgcctcctgggttctagcgattttcctgcctcaccgtctcgaatagctgggattacaggcgcccactaccatgtctggctaatttttgtattttcagtagagacagggtttcaccatgttggccaggctggtctcaaactcctgacttcaactgatctaccctccttggcctcccaaagtgctgggattacaggtgtgagccatggcactggaccctctttttcttttttttcagaagttattgtatttatcacataatagaaataaagggtgggatgggagctctagaaatctaccatttcagcttcttccttagtagacccacattagcgatgaatataaaatagatatgtgtgtgtgtgtgtgtgtgtgtgtgtgtgtgtgtaccctgagctaatggaatttgtggaacatttggtaaagctcataaatattgcacaactggtacaatcttaagtaatcaattctaagtttttagggccgggtgcggtggtggcttacgcctgtaatcccagcactttgggaggccaaggtgggcggatcacgaggtcaggagatcgagaccatcctggctaacatggtgaaactccgtctctactaaaaatacaaaaaattagcctagcgcagtggcgggtgcctgtagtcccagctactccggaggctgaggcaggagaatggtgtgaacccgggaggcggagcttgcagtgagctgagatcacgtgagatcgcgccactgcactccagcctgggcgacagagtgaaactccgtctcaaaaaaagaaaaaaagagtttttaacaacttttgttaatttttcttatgtttaataataattatagataagcttttctttacctttggttttctcatatttgaggactgcaatttaaatgatcttcaggaacttcttttcttcttgtattttgtgaaatgaaatgcttttaaaggcatttcaggcatcagaggtagatgaggtggtattttgggcagtggcagttgtttctgaaatcacacattagtagcttttcctatcctttatcttctgttcccctggagtgaaaaaggtgctgttggaggcaaaatttgtggctactgaaaatattccttaatgctggtagcttcttgacttcgtgcctttcttacccaattacatctattctaaagctgtcccacttcttttcctttgagcacatgactactgctatctatctcctattcttaaccagcattaattacactgtgtattagatactgttttaaaggctttatgtttgttgaccgacttaatcctcataaacacccttgtgaggttgctgctgttattttattacgggttttatagatgaggagactgaggctcagagatgttaagtagcttgtctaggttatacaattactaagtggcaaaactggaagttgatacagacttcctggctctaaagcacactatgtcatacagcctctcaggaaaaacacagaagggagcagctattcccttccttcacctttacttttgactgcaaaaggggtaatattttatagcacaattaaaattattttggttaatattttatgaaatttctttcccttataatgcatattacagtctgaatttctctctggtggtaaagtttctgacaaagcatctgtgcttaaaacaaagcagctttatttatgaaggtatttctttacaaaccacagccctggtatccagcagaaagcatgggttgtctttacatgtggttattcttctgggaaagcatcttagaggaggtgagccttgacctgcttgttaactgagaatatgtgcacaggtctggggtatagtatgtgtagattcgtggtaaaaagacttgggattgtgaggggctgaaagattacgaaaggataggggttttaaaatattattactaaggagttctgtccttagaaaagatttctaggatcaagaaccaagagctggacgatgatgacaacaggcagaaatgagtggcttctctcagcccttgacttctctgccattccctcccccttcgagtgttcccctttcctttggtttccaagttgcacgctgatcctcttagtgtttttaacctcattgcagacagaagtactttcccatcaggtttgccaagacagactagaatttttttgttagaattttacctttaaaaacaaaaccaaaaccaaccattacaaaagaagcaaaggtataatcaaaagtgtagaaaaaactagaaaaaaagttttagaacaacacgagtttacctagtatagactttctgccttatggtaatacctcctgtctctcttagccttttgaacagcccagctctcattgtgctagccttgagtctgaggccccatggagttcccatagtggggaaattctcaatcctcccttgctcccaaacaggcctctcctttgcggataggtcctggtgtgtttcttcacctcaggcctctttaagcctgaagaagcgtgggccctacatctgcttttagttttcagtcccttgtggtaagttggctaaggccctttcgcctctgttggtaaggaggggttttttgggcctccagaacctcccacaggtgctgtgtcttcctgttggctcattccgaggaggactcaccagctgactgtcaaactgggtcttcctcaccttggttcactgttggccatgtggacttcagtaggggctgccatccttctaagaagctatgcgattgtgtctatttccttctctggacagcaggagacccctttttgaagacagcacattttctttttttcttcttttttttcttttttttgacatggtgtctcattctgttgcccaggctggagtacaatggtgtcatctcggctcactgcaacctccgcctcctgggttcaagcgattctcctgccttagccccctgagtggctgggactacaggcctgcaccaccatacccagctatttttgtatttttagtagagacagggtttcaccatgtgggccaggctcgtgttgaactcctgacctcaagtgatccacctgtctcggcctcccacagtgctgggattacaggtgtgagccaccacgcccggccagcactacactttctaatgagtttttattgaaaaaaattttagttgaaaatgaagctgttggctcgtaagtgaaaagcttgaaggcaggctggaatcaggcatggctggaattgggcatggctggttgtaggggctctgctctttcctctcctcctgtgatggctgcctcctggtgttccacaaggtggcaggatgctccagtgctctgtcctgactcccagcctccagggttctagtccagggaagaggaccagcatctccttctgggagctcctgtataaatcctgtaatccattttttctcttctttctcttttctaatatgccattttattttttaataagttgtatattttagttcaaaaaatggaaagtattttaaaaagattatgaggtaaagagtttcttccatcctgtcccttttactattataaaaacacccttcattgtcctgttttaatggtttttattcgaattttatttttcctggtaataagatttgatctcatactttctttttatttgtattcacctaatatatacctctaggcagttgttgtttttcagccatctttttaatttgtaacctttctgaattactttgttttggattgcactcctatttgtagcatagaattttggggtttttttcccctctgtgatccaatctgaatttaattttcttttaataggtgaatttagccctttaatatgtcagatatatttgatattagtttatactattttgtgttatattttctatttttatatcttttaaataatctttcacgatgtgatctgttttctttgcatcttttttttttgttggttttgtcctggtggttggttttagaattataatttcaaataatgcccttagtcttctaagaaagtggtggttgttccctactgtgagcactgataaaattaatgagtttcatagtaattctaatatggagatattaaagccaggttaccttgtctgtcctactcagtcaagaaccctgtttcattctgtcttcagaggagagaatgaattactcggcttggaactcatcagtgctattattaccaatgagttcactgtcagagggggccttgtaagttttcccagaggatactgtccacctttaacaaggctctttttgtctatgagtttctaaagtcggtatagatcatgcaattggtaagctgacatttgtttgttcacagttgaacattagttcagagtctctgttggtggtctgttatttgatgccagagagtcaccagttttatttccaagcagacattaaaagatattattggttctgaagttcccttgttttaatgtgggctcaacacttgctgagagagcatttagtttttcaaaagcaatatggtaggcaacagagaggcatgttacatgtgaaaaggatttcttttttttaaaattagaagctttaatttaaccgtctagcttggcatgccctgtgtaatgactgagagaccgagatgactgtcttgttgtgagtcccaccaacaaggacagaagggaggttgccaccttgggaggagcacatcttctgttcatgctcctctccattcaggaggcttcagccccacagcacaaatagcctctgtagcggtcaagggaatgtggttttataattttttagatctgggtcaattatataatcatagataacttaatttttttgatgcagtggtatttactgtccacctctaataaagcaggtgaatcatagactaccattggatacatgtctttggagcagatttccatccatttttactccagtcctatggtggctaccggtattgttcttgtcgcctgctattcttaagtctgcagtttgcctgtgactcaccccaggaaacctgttgaaaatgctcgctctcctctaacttcctgctgaattcagatttagcacctttcgggtgggaatctgtacttctttgcaggtgactctgatgccggtgtcccacagactacagtttgaggaaatcaagactgacagttctgcaaggtttattaccctttaatttttcaaaaaataccttcagcaacagagaggcatgttacatatgaaaaggttaaagtagaaattttcctaaaatctatgtgacagaattctggtaggatgctaggcatgtgtgcagaatttcaaatagactttttttttttttttttttttttgagatggagtctcactctgtcacccaggctagagtgtggtggtgcaatcttggctcactgtaacctccgcctcccgggttcaagcgattctcctgcctcagcctcccgagtagctaggattataggtgcccaccatcacactcggctcatttttgtatttttagtagagacagggtttcaccatgttggccaggtaggtctggaactcctgacctcaggtgatccgccctcctgagcctcccaaagtgctgagattacaggtatgagccaccacgtctggcccaaatagacttttgtttcagagatacagtgatttgaatttatcataacgttctttaattaagaaatccaggaaaatagagataggagattttataactttaaccagtttgaaaaaatatttatgtgaagatggtttaatatacagattgcagaacgatgaatttaacattcttgtaaagcttccaggaaagcctcaaggataagtgacaagtccatttttatcaaacttaatgggtttctaaatccttatctgcttatcaaacaaaattttaattagaactgtaattgagtaaccagctgcctcttgtgttcactctaggaacttgtctaaaaacattgtggagctcatgtaaggtcattcgtttttgagttgctaaataaactttattgcagacttctaaaaatccaggtattgaggaagtctacaggaagataaaaattgataagaactttgcagtagttagtccgatactctctctctctagtggattaaggtagaaaaatccttcttcagcaccacagatgggagaatatcctccctcttaggtttcttcctgaatcagcttatgcctgcctaggcttgtagtagaacagataaagcctttggacctagctactcttggtttgaatatctgttaatctgttatctcttcattactttggacattgtacttaatgtctcaagttcaatttactcatttttaaaatgggaataatgccgcccacagcaaggagagccgtagttctggaacttgtactcattcattcctttattcagcactactttataggttgagtacctgttttatactaggcactgttccaggcattgaatacagcagaaataacactgacaaaagttcccatcctcatggatcctagtgagcagagccatttcacaccaggtgatcggggaaagtttcactgagatgatgacttgaatggagacctgaggaaggtgagggagtcagatcaccataaaaaattactttttaacattattattatttttctttactattttctgcttaatcctactagaaagtaagctctatgacagtggtgggtggggggtggtatttgttttgttagagaattttagatgtgctctgttgtattagtttgttcttgcactgctataaagaactacctgagactgggtaatttataaagaaaagaggtttaattggttcagggttccataggctgcacaggaagcatggctggggaggcctcaggaaacttacagtcgtggcagaaggtgaaggggaagcaggcaagtcctacatggctggagcaggaggaagagagagggggaggtgccatacactttcaaacaaccagatctcatgagaactcactcactatcacaagaacagcaagggggaagtccactcccatgatccagtcacctcccaccaggtccctgctccagcactggggattacaatttgatacgagatttgggcagggacacaaattccaaccatatcatatatggaagcacttttcctgatcacagaaatggggagctattgaaggagtcagagggcaagtgcaatgtcttcatctttagtgctctctctggcagcagtgtggtacaagggcttgaggggtaacgtgcagtaggcactccataaatgtctgctaagcatttttaaaagtgatcattctgccattcactatgagccataagagtagctggtagaaatgcctgtgaatgtttaaaagcattatatagactctatttcagaattgtgttgactaataaaaaatgctagttttccctaccccacacctatctttcaactgctttatatttatttctttattagatagaaaattcctcagtaaacttttatttagagtaattcctctttatgatttttttgttctaaaggtcgattcttaaaagaaaacttgttgaagtgctctaaatggaagtctttttttttatttctctcctgtgtcttttatgatagtatctgacaactatcttttttttgtttttgcagagattgggttttgctctgttgccaggcttgtctcaaactcctggcctcaagcgatcctcctgccacagcctcctgagtagctgtgattacgggtgtgagccactgtgcctaacaccttttttgagaaacttatatttttttacatatttattcttgattcataatatttatacatatttatggggtacatgtgatattttcatatgtgtatacaatgtataattataaaatcaggtgtttaggatacctgtcacctcagacacaacatttctttatgtcagacatttaatatcttctagctattttgaaatatatgataaactattgataactgtagtcctaccctactgtgctatcaaacactagaacttattccttctatctaactgtatgcttgtacccattaaccagcttctcattacctccctccccaaagctctggtaaccattattctacctctatgagatcaacttttttagctcccacatttgagtgagaacatgtgatattcgtcttttggtacctggcttattttacctaacataatgacctcagttccatccatgttactgcaaaggacagggtttcattttttggggggggctgaatagtattccattgtgtgtatattccacattttcattatctgttcatccattgatggacacttaggctgagtccataacttggctgttgagaatagtgctgcagtaaatgtaagaatgcagatatctttttgacatactgagtttgtttcctttgaatgtatacccagtagtgagattgctggatcatgtaatagttctatttttattataaaaaattcttttaagagagggtgtcttgccctgtcacccaggctggaatgcgatggcataatcatagctcgttgcagcctggaactgcttggttcaagagatccttcccacctcagccgcctgagtagctgggactacaagtgcactccaccatgcccagctaatttatattattttttttagagacaggctatgttgcctaggctggtctcaaactcctggcctcaagctttagcttcccaagtagttgggtctataggtgtgagccatcctgcccagctagtaggtctattttaagttttttaaggaacctccatactattttctataagggctgtctcagtttacattcccaccaacagttatgtaagagttcacgcctctctgtgtcctgaccaacactttttgtctttgtgacaatagccattctaacaggaatgaggtaaatatgtcattgtggttttgatttgtattttcctgatgattaatgagagcattttttttttcatatattggccattctttcagggcctttgcccatttttaaatttggttatttgtgtttttggtattgggttgtttgagtttcctatatcaaaatacttctaaattcagcgtgatgatggaacattggtagttgcttatgagataaaacagactcttggattaaagtaaaaagtaaaagtttcagaagtaatttaattttcggagaagccagtaaaattggaatcatttgtgttttatttgaaaaaattaaaatatggtacaaatataagaatataatacagatatagaagaaggctgctgaaaccaccatctagtccaggatatagagttttggcagtcactctagaagctctctctgcctcctcactgtcatagccctcagaggaatcatgatcctgactttgtcattgttatcaccttcttaatttcctttgcagttttgtcacccaagtatgtatccttatggtttaattttgccagtttattttttaaatgtcttcaaaatttttaaaatttatatttttagagacaaaggtcttgctatgttgcgcaggtgagttgggaactcctgggctcaagtgatcccccttctcagctccctgagtagctgggactacaggtgcataccactgtgtctgactttttataaaaatacgttttaaacctctttatctacaggttccctctccatctctttttattcctatcctcacctttggttttttttttttttttttgaagaaactcagttgtttttcttgtggagttttccaaagtctggattttgctgattacatatccatagagtttaagatattcctctgtattttctgtaaattggtagttgaattgagaggcttaataaaattcaggttttttttttttcatagaagaggaagagaactttgtagattctattttttcattgggaggcatataattatctctctttttgtgaattgagtagccattgatactcagtagtgatgaacaagtcttgctttttaaagtatcattatgaacccaagggcctaatgtattttggcttcattgcagttgttattcttcccagtgctcaaaatggcccattattgggcaaagagagtctctccaagttgacctctgtgccattttgccatgatgctagtaatctttagtagcttttttgtgtaacaagttagtctaggatcatcttaaacattttcagtcccagacctggaattagtcatttctccagtaatccttccctagtttcttttagtaggaaatggtatttttttttttttttctgagacggagtcttactctgtcgccaggctggagtacagtggtgcgatctcggctcagtgcaacccccgcctcccaggttcaagcgattctcctgcctcagccgcctgaatagctgggactacaggcgcgtgccaccacacccagctaatttttatatttttagtagagatggggtttcatcgtgttggccaggaaggtctcaatctcttgacctcgtgatccacccacctcggcctcccaaagtgctgggattacaggcatgagccactgtacccggccaggaaatggtatttctaaaccacattctgtgcaactagggaggctatttattggataggtcaaactatattaagaactcattaaaaaatacttctgattcaaattcagggctaaagagtttttatttaactttttcagtctgacatctatatctccttttccccaccatgtcgacaatcctggttcttatgtaagtactctgattttatcattcaaatatcaggtatttaatttgctttatcccacattactgaatctatgttattaaaattatatattataaaatgccattgcatttaaaggtcttacgtttcttccccatttatttcacagttgtaatatatctgcatcatcagagcatatagccattaggtactataccttctttcttatagcctccattgagagtcttagttctccaaacaaatatgtattacatgctcaccaccaattcttatatccatgtctttctagtcattttggttgtctgaaatttattctgtagtatggttgttcttacaccttagtgtgcatcagaattacctggcaggcttgttaaagcgccgagtactgggcctcactggcaggttctctggctcagtacatgtgggatggggcctgagaatctgtgtttctaacaagtccccaggtggtggtgatgctactggtctggtgaccatactttgggtatagctctctgtggcctttatacatggaagattggctaagcttaaaattcctggcttacagtttatttctttgagtatcttaaatacattactctattgtctgtagggtaaaacattgcggttaaagtttggcaactctgtttttctttcttttataaacaacttgtcattttggctggaaataattttactagattacttactgtgatggtcattatgggttgatttccccaggtatgtgatgtgttttttaaatatacagtgtcaagtgatttttctgtttctttgctttgccctctttgccaactttgtaccttgggggcaccttttatacacgttttaggtcttctttgccaaccttttgtatttgttactttctttcaatctttcaaatctcctctttcatttctttttgactttgaaaaaaatttccccctttcatttcctgcttcttatctttattatctgtagtatttattcagttgtgtgccttctagactatcgttcattctgagaagttttccttttgtctctaattcctgagttctgcccgttgatttctgagtttttctaaatccaatttgttttcttaataatttttttaacttgttagggttttcatgttttatggagatatctaacatgattctgttgtctgtagagatgttattatgttttttctttttttttcttatcataactttggacaggatttgagttgggtccttttctattactcatttttatgcaaattcattttcccaaacttttagaagaggcatgggttcaaaatagcttttctgacttcacagttctggtagtgttttttaactccaagtattatttataaacagttcatttttaagtgtacagtttacacaactgtaagtgtaagtggtagttttacacaattttgtaaccactatcacagtcgagatgtggaagaatacttttaccctaaaactttccatgtgcttttgcagttggtcccctcccttcacatctggccctaggcaattattaattttccaccagtatattttaccttttacagaatttcaaatacaggatatcttacaatatatattaaaattttttggcttgatttctttcacaaaatatgattttttgaggttcattttgctgcatattgtcaaagtatttgaaaatgtgacagctcattttctcctggctctgttctgtagtacttttgtctttttaacaattaccctgttatccttttctccccattttagattctgttcataggagtttttcctcagggtaagatttgtcctaaaaaagtgctttgcatcactggttttgtgaattcatagggcctagagttctcaagccccttcaggctttactgtggactccttgtagtcactattatcaaatatacaaactgcactcccaatttcagctcctcaaaatgtcctactgtgctttccagtgagtacctcgttgctgttttgtgttgtttctgttttccgattgttagagttctgttgcttttgtctgcttcttctcacatggttgctgatagcatttgtatcttattgttcatcccacctgcttgcattttggggttcttaatatcttgagatgcagttatagtgtagtacatgttatctgtgggttttagtttggttattaaagtctctttttatggcaggatttagggagactgaaaaactatgcttgaatctaacaaaaaacaacaattatttcaataaaatattatatcaaggaaaatagcaaaaaattacaaatgtgtgttacattgataaaatgatacatttatttctacttttcataatattgagggagggagtgttctgcttttgtgacgaggtatagccatttgtgtttctgtgttttctgtatcttttacatatgtctaccacattactgtctgttgtcttagattgtaaactaagaaacagtgattgttgtgtggcatatgcccatgagaatttgtttaactgtttttgtgaagaaaaaaaatatataaactatagattttctgtcataaatccttctttctgaattttaacctaattgtaaagcaaaataggtaataaagtttcactattgtttatttattacaaggcattgtaattgaacttttaaatcaactcatacgatctccttgctcaggaaggaaaatcataaaaatagaaaaaagcttgctttattttggtgctggggatggtttcaagtcttttttcagttttatgtagagaccaagaaagtgttctgcatagggagccaaagaaaaaaatattgagaaactttctaaagtatcttaactcagttgtttatagtatagctttactttacagataacttttgatgttcttagatcattagatatacctacatcaatatacataagataagcttccaaaggaaatactctttgctttgggaatactctttcctatcatctactaattttcattatagcagcagtcttttatttgtataggtcagtggttctttaactttaatgtgcagtagagtcccctgatgctgggccgggccccacccaacacctgttcctgtttcagataaagaccagagagaggtatgtgtacgtatctaagagtgagcacaaccaaagctgtataaaaccttcatggaggaaattacagaacattactgttggatataatagacatgaatagaagaatataccagctttgataatgtgatacctctatttaagatgttatttctctctaaattaattcattacatatcaaattaaaataccaataagggctgggcgcaatggctcacgcccataatcccagcactttgggaggccgaggtgggcagatcgcttgagtccaggagtttgacaccagcctgggcaacatggcgaaaccctgtatctactaaaaatacaaaaaaattagctgggcgtggtaatgcctatctgtagtcctagctacttggggctgatgaaggaggattgcttcagcctgggaggtcgatgatgctgcaatgagccctggtccagcctaggcgacggagtgaaactctgtctaaaaataaataaataaataaataaataaataaataaataaagtaatcccagtaagtttcttgtgaagaccgaaggtaagtgaacctaaaattcacaaagaaaatcaaagggccaggagtagccaagacaatcttgaagagcaaggtagggaccttgccactttagatatagatgccaagccctagaaattaagagactgtggtcgtgatacagagatagacaaaaagaccagtggaacagcatggagaatccaaaaacatatatagaaatgcaatatgcagtgaaagtaacattataaatcatcagggacgtatggaatgctaattgctgctttgatcattaattatatggaaaatgaaattgtatttataacttcacactatccacaaagataaattctggtgaataaattcagaaagcagatcttaaatttattagaaaatataagaaataataaaatacttagctgctgttaaaatgtaaaaagcacatgtatcttcatgtataaatcttagaaatagtgtaacattgaggataaaatcaatttgtatggttatgataaagtaccactcatacaaaatgaaaagcatgaaatgatacagttttttataaaacatgaaaacatgcatggtaatatacatcacattcaagataatgtttgcttcttttattaatttttttttttaatttgagacgatgtttcactcttgctcaggctggagtgcagtggtgtgatcacagctcattgcagccttgactccctgggctcaagtgatcctcccacctcagccttccaagtagctgggactacaggcatgtgctaccgtgcctggctaatttttgtattttttgtagagagagccatgttgcccaggctggtcttaaactcctgagctcaggcagtcctcctgcctcggcctcccaaagtgctgggattacaggcattaagccaccgtgcccggccagcgtttccttctggaaatcgtagagggatgtgattagtgagggatatgtgcaggctacaactgtaactaaagttttatatttttaaataaaaatgttttaaagcaacatgtgacaaaacattaacaccaaatgaatatcaaacaacaaagaaatagttgaagaaattgtggcatctatatactatgaaatatttttcagccattaaaaagaaggagttgtagctaggtcatttttatggagggactttcaagaattattaagtgaagagaacaagacacagaaatatgtttataaaatcatctcagttttataatgtagtaatatataatgagcatatattatatatgcttgtgtatgaccaaaatatgaacatgaaaaaatatggaaagattcattctaggctgttaacatgagagataacagtcatgggagtgagatgataaagaaagaagagaaggaggacagaatagggagtcaaaaaacatagaaaaagaaaatgcattacccagcatgcatgctatgattttgtttatgtacttaggcaaatttttatacatatttttaggaggactgtagaatcactttaaagagtgagagttaacctaatttactatatttgactggagactgtgatagaaacagatttagcagaaagtccctcaaagaaagagttactcagtgctgtattctgttgctagattatttaaacaaataacgtaatcaaatcaaaatgatgcttttcagtttttctctcttcatatttagtaacataatggaccctaatttcaatgagtttttctttttaaataatgatagatataaaatactcacaatgtgctaggtgatataaaatagcagttaataaaaagtacttggccaggcgcagtggctcacgcctgtaatcccagcactttgggaggccgaggtgggcggatcacaatgtcaggagatcgagaccatcctggctaacacggtgaaaccccctctctactaaaaatacaaaaaattagctgggcgtgatggcgggcacctgtagcttcagctactcgggaggctgaggcaggagaatgatgtgaacccaggaggtggagcttgcagtgagctgagattgctgccactgcactccagcctgggcaacagagcgagactccatctcaaaaaaaaaaaaaaaaaaagataataaaaaaattaaaaagtactcattttaatattttatgaaatagagcattttggcagagaaactttagctctttctttctctctctttcttcaacttgggaaagaataaggaataaatctttatcttttttttttcctcttctggccaagacctaaataccagcatttcatgataatggataagttatctttgaaattttccttttttctttcagtgtgcaggatgacagaattcgagtcgaaaggatggataacatttattttgaatacagccatgctttccaggcagttacagagttttatgcaaaagatacagttgacatcaaaggtaaatattttccctgtatgtcctcaagttgaactgatttgaaatttggataaaggtattagtatgattctcaatttaatgatgactaggtagttattataaatatgtgggagaagaagagctcactgttgttgtgctcatcagaaacactattgtactgcagtcccagctactggttagactgaggtaggggaggatcgcctgagcccaggagttcgaggcagcaatgagctattatcatgccattgcagtccagccggggcaacaaagcgagatcctgtctgttaaaaaacaaaaagaaccattgcagcctcttttgaaattatgaccagctagtaagttgatggttttgacatattcatcagagtggaaggagttttgaccatctttcctttttgcttatctttaaagatggctcattagtatctttgtattttatagactgtttggatgataaatattctgatgaagactagcattttgaaaggttggttgccaaaattaaaacaccagaatctagtgacaggtcgaaatattttaggtaatcattatttgtctaattcacatgtccacaatcaggcattaatgtttactttcatttgtacctcacattcctgccagtccagcttatgttagggtccattttgtggatggtgaggtgaatagacattttccctcttggcataaacttggcttcactctaatcttcatcctactccatatggaggaaatttatctctgtcacatgctagagagtgttcatcatcagctccccatcactgctccatttaagcatcagtgtctagttagcatttccttgcatctaggcatcagtgtcttgttagcatgtctctttaatttcatgatgccttggtcaaataaagtgtctgagcgtgtatcccacttctttttatttttttctgtaaggtctcactctgtcacccaggccggagtacagtggtgcaatcttagcccactgcaacctctgtctcttggactcaagcagtcctcccacgtcagcctcccaagtagctgagactacaggcgtgcgccaccacacccagctaatttttgtattttttttgtagaggtggggttttgccatgttgcctaggctggtcttgaactcctgggctcaaacgatcctcccacctcagtctgccaaagttgctgggattacaggcatgagccactgcgcccagccaagtgtatcccacttctaacaccagtgttcagtattaccgagaggtcatcttatgttcaactaaagacctgataaatcttaagactaccatgacctatccgtggtaccagatttacttaaaagatatgggccagaaaacacaccttacaagcagagcatgtgttgctcttagtgggatagtcctcacagcagactttgtggcagtgcccgggagagtgtatgaaggaaggagactcacatcaagtgagcgtaagcgccaccctggcttagaagctccaggcccttgaggagcctgtatttcttgctgcagtctctacaaaagacacgccagttgacaaaagtcaacgcactaagggaaggccaaaactctgtagtcaggtatttataattcttctcagtccagatgtaatttactgatatttggtcatttttaccacaggcagtgctacttctaacacattgatacaccatctttgtcatgttttctggggaagaaagctagaaagttaaaagaaaatcaatttctcagtggaacggaaaggtgttgttagcacttcatttacactctggttttataaacacctatagttaaaattaataagatattttactgatttgtagagaacatcttgtaatatatgtttttttacttctaaaagtaattaatgcttattgcaagaaagtcaaacagtgtagtcgtatataaggaaaaaagtaaagtgcctgccctcaaacttgtcctctgcccttgcagcttatatgtcggaggggttatcattaacaatttggcatatatccttgtgtaaaactccacacatacacacataaacatacacatatagttctctgtatttgtttaacataactgggatttattcgttcagctaattttttgaatgcctattatatgccaggcattgggcatacaataaggaataaaacagacaaaaattcctgctcttttggagtttacattctaatggtgagagatgtacaataaagtaaactagtgtgttagaaggtgataagtgctatgaaaaaaataaggcaggggagtgggttgaacttttaaataggatggtaaaggaaggcctcactgagaaacagcacttgaacgaagatttgaatagagactgaaggagttaaggaaaagagccatatagacatatgaaggaacagtatttcaagcagagacaacagtaagtacaaaatatcttaagtaggagagtgcttggcatgtttaaggaatagcaagtagtctgtgtgctggaacagagtaactgatggggagaacattaggtgagctcagaaataaagaggagatggcaggcagtatagggtcactttaagggctttgacctctactcttaatgagttgggggatgttggaggacttttgagcaaaatagtctaatgatctgatatacattttaaaaagaattcctctggctgctctgttaagaataccctgtagggtgcaaggatgaagcagtgagaccagatggaaagctgttgcagtgtttgtggtgagacatgaaattgatcagacaacttttttccctcacttagcaacatgttatagatggccttccatatcagtgcagataattggaagtcattccatttagttggtacataataaccaggatttacccaactttatttaagtactacgctgttaatgtttatttaggtggtctctagtttttttttaatactccaaaagatgttttaagtcaccttctggtacacacatccttgacatgcagtttggagtatttctagacaaaggggatgggcattttacattttgaaaaaacaacctgttcttcaaaaaaggttcattccaccatcagaaaaatgccctttttttccatgccctgggtattagtaatgatttacatttttccaaaggtcaattttaggagatattgtccaaattattattttggtaaccattaagttttacttaaaatttgtgtttaataatgctaacaagttaatggttctgtttattacattttttaatttgattaatttaaaagaatttttataacaagttaatatattctgttttctaggttctcaaattatttctggcattgttaacttagagaagcctgtgatttgctctttggctgccatcataaaatacctcaaagaattcaacttggaaaagatgctctccaaacctgagtaagtgattcctccaaaattaaaaaaagggggagcttatattatgaacatttcttaaattgaatttggtagtactatacttagagaagcttgcctgctattgatagaatactagggtgcaaggatgagctgtttggtattgttgctgaagaatattaaaaatatattggctgggcacggtggctcatgcctgtaatcccagcactttgggaggccgaggcgggcagatcatgaggtcaggagatcgagaccatcctggctaacatggtgaaaccccgtctctactaaaaatacaaaaaattagccgggcgtggtggtgggcgcctgtagtcccagctactagggaggctgagacaggagaatggcgtgaacccagggaggtggagcctgcagtcagcccagatcccaccactgcactccagcctgggcgacagcgagactccgtcccaaaaaaaaaaaaaaaaatgtgtgtgtgtgtgtgtgtgtgtgtgtgtgtatatatatatatatatataaagaattctgtcaaataaattgtattcatgatagctatttgatatattatagttttgactacaaaactgtgctttatactaactggacccagaaatagtattaaaaagcattcataaaaatttaccacctttcttattcttggtttcagttcttatttcatagaccatgaagttagagataaaagggccagctgctaacacagctttttacaagagtgattaactgtggattttggaaatttaaaagctcacaattgacattctaggaaaatactagtttgataaccattggaatagaaaaaagtagtagggtactttccttgtctttttatattccgccttcaccagccccttgtctttgggtctgtcaagaatcaccctccattatattgatccagggtgcatcagctctgtcccattctgcacaagtgggaggggagataggtgctatctcagcaaaatgacagaatagaaattaactaggaaacaaggaggtggtgctggttcaaggttgctggagagagtcaaagaaaggcaggttccttggggttctttttgtaatgtctttgatgtgcgttctcccgtgtggtactagaacagagtatcatttctctggaagcaactttatcctatttaaaagcaatctaaatgcccatcagggatccttgtgctatattcatgcaatgtaatgttatatagcagtgaaaatgaatgaactagagctattaatatatgaccaatgcttaaaatttcatgaacagtatattaagccaaaaataaagttgctgaaggccacgtagtacataccattatatgaagttagaaacatgtgaaatcgtactctgtactgcttaagaatatatatgtagttagagaataagtgaagacatgcaggggagtgatagaaaattcagaagcagggtttcttccagggggaagaagggaaagtagtaaaggttggggatggacgtggcatagtggagttctaactgatgtttcatttctgaatgtgggtattgtattaatctatacattttttagtgtggccaaaatgttttattttaaaaagtgtcagcccggcattataccctcattggattctactttaagctccaaaaataaacttattaaagagatcaatctgtatggttggttgtgttggggctttgtaaaaaaaggggtgacaagatacctaccagtttgacttgttcatgatagggaccctgtaagtgaggtacaattagtgataaatagcttgcccattaagacttgtgtttgtgttcctgtatcaccaagcaaagaagtattaatgttgggataaggaaactaacttagaaatcaggccctgatgtgtttagaagcaaatgaatttggacctggaaagatgtgtcctcctcatatatatatatatatatttttttttttttctttttttttttttagatggagtcttgttctgttgcccaggctggagtatagtggtgcgatctcagctcactgcaacttccgcctcctgggttcaagcaattctcctgcctccacctcccaagtagctgggattacaggtgcacgccaccgcgcccagctaattttttgtatttttagtagagacagggtttcaccatgttggccaggctggtcttaaactcctggcctcaagtgatctgcccacttggcctcccaaagtgctgggattacaggtgtgagccaccgtgtccggcctgtcttcctcatatttaattcgaaataagaataataccaaacaataaaacaagatgtctatatatactgaaattaaaatagattcttttcaaattacctgaagtaacctcttgataaactgaagctgaactttttgcatctcataattgatggtggaggatggtcaggaaactggctctgctagtgacttagtgtatcatctaatctacctgttgggtacttccatggagccaaagccaaaagacataaagtgctctgctttgtatatattcccagcatccagcataagcccagcacctagtaggcttttattatatattattatatatagtattaatataggattaatgaaagaaggaaggaattcttcattctgtgagggtatatttcattggaaattgccaaaaggtcattggaaaccaagattaataaagatagtgatcaaactggtactctagttttgcttaaaaacgaaatgtggtgttcatgagtggcatgtaatttgaagatcattctaaaagagtaattctgtagtgcttatattttgcaaaaataatgttgcttcttaaggtgattactttggaaaaatgaatattctccttgtagatgaaaaattcagttgcattattttataaacatactttatgctgctgaagttttggacttttatttacaaagctatgttatcaaggggaaaataaatttcacttgagttgacttgtttagtaaatgctttcacaaacgttgctgcatatttcataaaaatcatgatatacgtttatttaaaggtccttgtgccattagaatagaattttagatagtttgagaaaatataccatttcagaaattattcttaaggatgatttaagtgaagttttgttaagacacacttgaggttctaaagttattttgagagtttaagtttgtttcaaagaaaaatagtgtaacaaaataaatagaatgtgagggatattatttattataacagaattaacctgatgcctaaatttatgaaattcagaggaatccactttttgttgttagaaatgaatgcttttgtcattttggatggtttttattaagattggagtggtcacaacttcaaaaagatattggaaattttaggaaagagtgagaaaatccacccaagataaactgtaaaaccttttttttaaaagaaaacttcttatgataacagaatgataacatgtggtgattacctttacttactagtgaaagaaatagcttaatatataagctactctcatgacatctaatggctagcagccagggatgctgctaaacatcctaaaatgcacaggatatttccctaaaaaacacattatttggctccaaatttcaacactccaaaaccaaacaaatatattacaggaaaagaaactacagaccagtatcttttgattataggcacaaaaatcctcaatgaaatataagtacatggaatcaggaatataaaaacgattgtactccatgactattggatttatttcgggtatactggcttggtttaaaaatctggaagccaatcaatgtaatctaccttatcaaaaactacatgatagtctcaatagacaggaaaaactctgcataagattcaacaccccttcatgataaaaaacgctcaaaaaactacaactaacgtggaactttcttgacctgacaaaggacatttatgaaaacctcacagacattaaacctgtctgttgttgttaagatgcagtattgctcagatcagtctctaagttcagtgcaatttgtatcaaatcccagctggcttccttggagaaattgacaagctgatcctaaaattcataggattcatatctctgtttcaaaacttactacaaagtgagtaatcaagacagtgtggagggtgggattaaaaaaagacagtgtggaattggcataagcacagacatgtgatcaatgtgatagaattcagagtctggaaataaacttatggtcatttgattactgacaggggtgttaagacaattcagtggagaaagaatagatttttttcaaacaaatggtgccaagataactgtctgtgcaagagaatgaagttggacccttacttcatgtcatatttgagtttggaagataaaatggaccaaagacctgatatgagttaacactgttatactcttagaagaaaacataggtgtaaatctttgtaaccttgaatgaggcaatgatttcttaactatgacatcaaaaacacaagtgagaaaagcaaaaatagatacattggacttcatcaaagtaaaagcttttattcttcaaagaacaccatcaagaaagtgaaaagacaatccactgaatagaagaatttttgtaaatcatatatccagtaagggacttgtatctagaatatatatatatatataaactcttacaagtcaatggtaaaaagataactcagaaaatggacaaatgatccatacaggtttttctccaaaggatatatgcaaacaaccaagaagcacgtgaaaatatgctcaacatcattaagcatcaggtaaattcaaatcaatgccacagttagataacacttcatactcactaggatggctataactaggaaaaaaaaaggtgttggctgggatgcagacaacttgaaatcctcatacattgccaataggactataaaatggtacagccattttggaaaacagtctggtagtacctcatgacattcactgtgtgatccagcaattccactagatgttacttaagacaaggaaaatatgatgtccacataaaaacttatacaaatgttcataagagcattagtcacaatagccaaaaagtagaaacaactctaatgtccatcaactgaagaatggatacctaaaatgtgttatatgcatacaatagaagatttttcaaccataaaaaggaatgaagtacagatacatgttgcaacatgatgaaccttgaaaatattatggtagttgaaagacatcagtcacaaaaagtctcgttttgtctgattccatttatatgaaatgtccagaataggcaaatccatagagagaaagtagattagtggttgcctagggctcttgggttgttggggggaatggagagtgattgctaatgagtatagagtttctttttggagtgatagtatctagaattacatggtggtgatggttggccaattttaatatactaaataccacttaattgcacactccaagtgggtgaattgcatagtgtgtgaattatatcaataaagttgatagacacatacacacttatcttttaaatgtcagtagtgctgagattgaaaaatctttgtctctgtctattttaattctgttcttaaggcaatatccttctgaggcttataaccaatgcctcatgtattttgaggtatttctactctggttggagagtgttccaagccctttgtgaactctggtcactgttcactactattttctggtagttatttccatggtcccacagaggtccctaaacgcctttgaggactggtacttggccaagagttgaggtgacccttcagcagatctctggagctgtatgtgcagctctgttatctggcattctgtctcacaaattctagtttccctgcgcccaccaaagaggcagtcatgttgtttacctcatttgtttttcctctctcagggtcacggttctgcaccaagtgttgtccaatacctgagaagttttccccctcatgtgttttgtccagttttcttattgtttatgattggaggacatttctcatgcagttacttttttatgaatgaaagcagaggtcaggtggcacaattgaacactgcacagaaagaagagaagagggaggctggagaaaaacattctatgaagtttaaaacatgattaccggccaggtgtggtggcttatgcctgtaatctcagcactttgggagggtgaggtgggcagatcacctgaggtcaggaattcgagaccagccttgccaacatggcgaaaccccgtctctactgaaaatacaaaaattagccgggcatggtggcaggtgcctgtaatcctagctacttgagaggctgaggcaggagaatggcatgaacctaggaggcggaggttccagtgagccaagatcatgccactgcactccagcctcggtgacagtgagacttcatctcaaaaaaaaaaaaaaaaaaaaaaagttgagcacagtggctcaacgcctgtaatcccagcgctttgggaggtcaaggccttcggattgcctgagatcaggagtccgagaccagcctgggtaacacgatgaaaccccatctctactaaaatacaaaaaaagcagccacactggtggcgggcacctgtagtcccagccactcactctggaggctgaggcaggagaattgcttgaacccaggaggtggaggttgcagtgagccgacatcgtaccactgcactcaagcctgggcgacagagcgagactccatctccaaaaaacaaaaccaaaaaagaacagaagagcgagatgtatgaagttagaaaaactgtcctaaaaattgcccgtgttctaaaacttcaggaaaattaatcttcacttaaaaattagcaatgggaaaagaaccaaattcaaatttcttacaaaattattatgagaaaaaagagaataaggagtaggatgtcattacagataatgtatacatgccagaaaatcatggtcacagattaaataaaaatgacaatctggctgggcgcagtggctcacgcctgtaatcccaacacttgtgggaggctgaggtgggcagatcacctgaggtcaggagttcaagaccagcctggccaacatggtgaaattccatctttccaaaaatacaaaaaattagctgggcatgatggcgggtgcctgtaatcccagctactcaggaggctgaggcgggagaattgcttgaaactgggaggcggaggttgcagtgagccgagatcgcgccattgcactccaacctgggtgactgagcgagactccgtccctcacccacccacccccctaaaaaagaaaaactactgttttaaaatgagctaaaagacactaagaaaatgatactagatgtgaaagaacataactaagaagtatgaaagattggaaatgaggtgataggatttaagacagaagtataaagaaaaagatcaatttaggactgaagcgtaaacttgaaagaacataatagcgaataaatgtaatacatatagttttagagtagaatttaaaaagagggatgtgcaaaaaattaacatagcaggcctaatcacaaagctttccttagaaaggccttcctgcaagcttggcccttgactggagtctgggaccttgaatttcgggagagttttcaccatttcgtgatgagagtggctcactgtgccttaactgtttgtgcacacagtgtggtttatgctgatcacctaccttcttggagctggaattttggtacatggtagggagatggtgcctatgggaccagtccggcatagaaaccatgggtgctgagtctctaatgagttccctggtggacagcatttcacacgtgttgttacaattcattgctggggaaatttaagtgcatcctgtgtgactccgcctggagaggattcttggatgcccggttccccctggactttgcctcaggcaccttttcctttgcctgattttgctttgcattctttcactgtagtaagtcatagctgttagtattactctatgtcgagtcctgtgtatataccatgagtcattgaacctggcagtggtcttgtagactcaacatacacctttcccattatttgcctttctaatgggcttattggcaggatttagaaatgcaaagttagtcatgttgtttaattacagatcaattataagtgaatctacaaccctgaagttttgtaatatagtacaatttatattttataaatcaaattaactgccaaaaagttagacaagtgatgaatttatgaactctgaaagctgtacacacagaaatgttttcagcaatagatttcatgtgttatatggtagtttttgtcattgtttccattttaaaatgatatttaaataagttctgtacccttgttgcctttgtctgtcttttttttaagcagggttagagtaatatggagttgatttctctgtccagcttttgacaaagatgtttccctcccactattgagggaaaaaaagcatctattgtatttttggtgtctgaaatattgataaaactattttcccatgttatatataagatttctatgcaggttcacaaagcatgaattctagccagatgttgttggtgagtttcatttcaaagcacatagaatttgtcttcttctacaatggtaaataatttagaattgcttgagtgtttcaggtcagtgatcggatactattggataccttaggatgctggtagatataacccttagttcaaaaatatatataattctaatggaaataggtgctaacagaaggaaattgcatttctattgggaaggaagactccaactccagaatacgtataaatttatacttataaatacttacgaaatatatgggaactccagaagcatggttagtccttgtagttgcttgataattattctagatgggaatcaatctgatttaagattgcccagtggttgatcttttattaaaatcaatgtagatatcagtttaaaaaaactcttagtgcatctgatttgaactttagattacttgtttagtaaggacaaaaagaaaaaacaaaaacacacacagcaaaaagaaaagacaaaaacacccataaccaaccaaataaaaaaccacacacacaacacattaatacttacgttaataccattgattaaaataacctatacctttgctctctaaaggtctggggttgtgagctaacttaaaaaccagcttggttgttcacagttactggtttccttttgatattgcagatatttggtaattatatgtagatgaaggctgtaagccttctaccccaccccctgtataccaggtagtgggttaattcaaactgaattctgccactcatttagatactttttagcaagcaggcacaaaaacagtcatgtaaactcttctctagctctatgaaattacaattctgtctttttggtattccgacagtaccttgtttcagtggttcacttgaggcatgtgcaacattataatagggacagttcacttttagttggagtcagggaacaaaccctgagataattggtagaacaggggatgctttcagaatccgaagcctaaaacaccatcccttagggtatggactgttggatttataggattattataccctgttcatatgagggaggaggcaactgggcagtatttctggacagcccacaaactgccataccaccgtgaaaaattatgtcttacacatctgttgttgacagaagataaaggcagtgagctgagatgcttttaggaaaggctgctagattgtggtttcttgattagtctcatgccaactgttatggcctggatgtttgtgcccttcaaaattcacatgttgaaacctaatgactactgtggatatattaagaaggggccttttactaagtgattaggttatgagggcagatcgtttgtaaatgggattaatgcccttatattaatagaaaagacttaaaggaactgtttgtccctcctccatgtgaagacacacagaaggtgccatctatggggactgagccctcactagacaccaaatctgctggcaccttgattttggacttgacagcctccagaactctgagcaataaacttctgtttacaaactgcccattctgaggtattctgttataacccaaataaacaaagatgccagctaagcaccgttctagagtcgacgtctgattagggcactaacatgttaactagtcacccctaggatggacttagttaaacctaattgtcagaacagcggaagtaaggactcatatctaaacacataggtaactggttagataccaactcagagcccaggctatcagccaaacttccaacttagatctttgaccatgaattcatgtgaactcttgtcagctacatagccaatcactgcctaattgtttcttcctgtaaataatgttttacattttataactgtctggctatttcacagacatttctggagctttgtgattcaaagggaaaaatataaacccaacctggttttccctaggaagatggcagatatttgtagaccctctactgtctgctaagctgtacaggtggtacaaaatgattgccttcagggagcttagatctattaaggagggtagaggcacaacataaattgctgtaattcaagacaaattaagttaactgctaccagagggagagaaagggctgaacacttgctatcctttcagttttggagttgcttcccgctgaaaatcattaacagattatcgttctttggaagctagatcaaacctgtcacagatacattacactaccaaaggacagcattgagttactaggcaacgttcctaatttgaggtaaagtatttctcttttccagggctttggggccttagtcaaaggagtcatctagaagtgaaggaatctctttttgggtactggtttttcgggctctgatattaggttctctaaagttctgggtgagggcttgttttcttaactcgggaaactggatgttacctaaatttcattatagctatgagaagggtggttaggtttatagcacaaacacttatgcctttcttttgttaaataatttagtgacctgctgttattttccttgcctttaaaaataagctctcaagcctgtaagggctgttgacagaaacatctaaggactggctgataaaggatattgaattactgcattagtactgcattgattagtacttcttaacacgaattggaattgtacatacatttattagtcatgctgtagctcattctcaaatctttttgaaatttattgaacttctaattttgttttggatagatactgagacaataaggagagtgtgaatgctttaactcagtttaaggaaataacagtgttttatacccactaaatttggccatggtaatgtgtgttttttttcttttctcttttttttttttttggagacggagtcacactctgtcacccgggctggagtgcagtggcacaatcttggctcactgcaacctccgcctcccgggttcaagcgattctcctgcctcagcctcctgagttgctgggactacaggcgtgcgccactacacccatctaatttttgtatttttagtagagacggggtttcatcatgttggttggccaggatggtctccatctcttgacctcgtgatccacccaccttggcctcccaaagtggtgggattacaggcgtgagccactgtgcctggccgcatgtgtgttgttaattacagagtaaataacacttgttgcatatgttagaatcttttttttttttttttgccgaggcgtagtctcactctgttgcccaggttggagtgcagtggcgtgatctcagctcactgcaatctccgcctccctggttcaagtgattcttgtgcttcagcctcccgagtacctgggactacaggttcgtgccaccatgcctggctaatttttatgttttttagtagagacgaggttttgccgtgttggccaggctggtttcgaactcctcacctcaggtgatccgcctgcctcagcctcccaaagtgctgggattacaggtgtgagccactgcacctggcctagaatcttgattaaaagtatttatcaagatgatctcatgctaaagaataaggaggacagttttaagtatcttgacatatttttctagctgattacacagcttttcatgaagatgtggctactgtgcttggctaatgataaaagaccatgtttggttctattcctagagcaaaaccaaaacaaaatgttgttaccattacttccctttcctgttcttgttttttttttgttagagtaactatctttgtcttgcatcaatctacttaacagcaccagcgttaatggactacaacagcctgatgaattttcattttgctccttttgtttgattttctatcagaatgctaatttttgccataatgtagctggcatgtttctagttcctgaattagttttttatttctttatgcacttacatctaggctaattatatttgattcttttacaggaattttaaacagctatcaagtaaaatggaatttatgacaattaatggaacaacattaaggaatctggaaatcctacagaatcaggtcaggcaaatacaagggctagttgattataaatcgttttgggaaaaacttctgagtaaggcagcagtctgtttttagaggtacaggtgaaaatatagtgtctttagctgactgcagtattaattgataactgtagctctttttggagaatgaactgtacataatatttctctgggttttttggggggaatgatggagctgccctttttaatgactgaggggcatgcttatcctgacaatttctgtaacatcatttctatatcatgtagttttttggaaaggcatcatcactgaaaatatgaagcggattttttttgtctacttggttatatttttctatacacctttagctttttcttgaaatgtttgcagtcttatttaattattcaggttataggtttctgggatattcagtttgactgtaagatgcataacatttcagtttgcaaactttctttttttttttttcttctttgagacagagtctcgctctgttgcccaggctgggttgagtgaagtgatgcgatattggctcactgcaacctctgcctcccaggttcaagcaattctcctgcctcagcctcctaagtagctgggattacaggcacctgccaccacgcctggctaatttttgtatttttagtagagacagggtttcgccatattggccaggctggtctcgaactgttgacctcaggtgatccacctgcctcggcctcccaaaatcctaggattacaggcgtaagcaaacgcacctggcctcagttcacaaactttcattgtttatttgtcctttgttgatgaattaggaagataacggggagattaaacttattgctttcatttattaaattatcacttgggaagatgagacattatattataaaattaatgttatcctaacaaagtaatagagataaaaagcaaccccacgtcatttgattaagtactggagaatcatctgaaccatctgagtcaaaggagttaaaactcttcagaaatatttattactattgcaaattaaagtaaacactgaatttattctcctgactcctgaatctgcatattattaactagtttctctcagtttcttcctgttccagtctgttctagtatgctgaattcagatgtatttttgttcagtaacatttttatcttgtcatcatccaaaagctgagaatctgtcctgccggtctgtctcgtcaactctgtagccatctccatgataggaaataagtagtaggaataaagagacatttctcggctgaaggagtgctgatagcctgcagccagccctggcattgtaagcgttccctgcttctgccgcatcttccctgttcaaatcctactacaacagagtcagttctgaaatcaaattcctaaggcagaaatcatctggaatcaaaatacccttcaaaattccttcctttattggaccttgcaccattttagaagccgaagctgagattaacatcttctgcttgtctttgtacttcaacttcacccccaccgcccctcgcccacctttccaaggagcaatggaaagaggtgcagggtaggagttgggtgtcagcaagaacaaggatataataggacacgtatctgtccctcctctcttgtctgagcctgcttctccaggggtgtcagggaattggcctcctcacgggaccctttaccccagtcaggccagtcaagctgtggtctcaggagcagtgctgctgctgatctgaactgccctccttagcctgtccagccatcctcagaggaacctttgtgaccttgtaccttctctgtgctctctccattgaactcctgaggcctgagagcttatgtcacaccttttctagttgattcctggcaggtggcattgtatcctaattacgagtctttttccaacttggctataagcaccctgagggtgggaccatgtccttgctatgttcagcacataggaggtactctggaagtagctacttacagaggagaaggaaaaaagaaaggattaaaaaaacccggccgggcgcggtggctcacgcctgtaatcccagcactttgggaggccgaggcgggcggatcacgaggtcaggagatcgagaccatcctggctaacacggtgaaaccccgtctctactaaaaatacaaaaaattagccgggcgtggtggcgggcgcctgtagtcccagctactcgggaggctgaggcaggagaatggcgtgaacccgggaggcggagcttgcagtgagccgagatcgcgccactgcactccagcctgggcgacagagcgagactccgtctcaaaaaaaaaaaaaaaaaaaaaaaaacccaactcaagtggaaacagccattttaggtctcaagatttaaatgtctcagtgggctttgtactactgtgaaaccttggttaaaattaattatgtctagttaattgtgatttttttttaaggacccaaattttaagtggcaaaagcaaacttttctaaggatttagtaaaacaaactaaaataaaatccttcctgggtaaatacctagagtgcagtgcaagttcatgtctatctccagcaccttgttcagtgttgtcatgagagcattggtttataaaatggtaactgtgaaataccaaaggaaaattaagtcatcttcctatgttgtatttcccaaggtaggaaagtatgcaattatattttaaagatgcttagataaagcatctttatcatttcaaaagaatttctgaataatttattctttggtaaccaaaaactataaacgatcccttttctgtgtaaaatgtcagtacttcattctgtatgtatgtattcatctgtcaaacattaaatgaacacctgttatgagccacattgtgctaggtatatatgacatttagaatcggggtatatgaaataacaatttggcacaaataattgtctagttaataaaacttgttttctggtctttcttagactgatatgaaaaccaaaggaagtttgctgtgggttttagaccacactaaaacttcatttgggagacggaagttaaagaagtgggtgacccagccactccttaaattaaggtaaaaggaattctttttggggtgtttaatctgaaattataaaattttgaaattaaaggcattttaaaaccaaggttaccattgtttttaagaacacagttttaaattggagaacattttattttagaactgagcaatagactggctctctagtattacaaggatttttttcctcattctcgtgaatgagcctgcctgcagattggcagacatagggcgttgtcccaggaaagtgaggatagatgccttttgtggagggttttgaaggctagactgaggagttgatagccagagggagttcattcagtgattctgagcatggggctgatatcatcagagctgggcttgtgtgtaggaggggactaagtggtagtagtggtgggatcaagttagcaagttcatggagaggtgcccaggacctgagctacagcagtaatagcaaggagtccaaaagaggggttaggtgtgaaatgcttagaagagtagagtgagtaaagttggagctccctaagggaagatacttgaatccagtgcctaacatacagtgatttccaaggttgtctgcacatcggaatcacctgggatgcttcacaaaatactcatgcctgtgtccagcccccatagattgtgatttaattggtctccagcatgaccagggagttgagatttaaattttacccagatgattctgatatgcagataaatttggagattctgacctagaacagtgcctggcacttagtagaagcccagttaatgtttattgaatgaaaattgttatttattgcacactttctatttactggtgtttaatactcaaaatcaccttctgagataggttcttgaaatgaggaaacagattcagagagcttcactaacttgcttagtgtttcatagctggtagagataaatataagatttaaaaccagcattgactccagagaccttagcaggaacaagccattatcctgaatagttatacctctggctagaccagagtgaatatggtgtgatggtgaagagaaccgctatgtgttggctctgtcagctgagtgagtcactcccactaatcctcagtgttctcacctttgacatggtggaacacctcatcacagcattgctgtaaggaataaaattttgagctctttatctcacaccacacagtatgctaggagctttatgagcattgtctcttttaaactgcacagcagcctcactaagcagatgctgttattagccctgtgttactctgtgattaataaatagtcactattttcaataatggattgcagatgttaatgttggtcataggcttgaagacactgttatgggttttgctgttgttttcttctttttcttttgcaagtttttttttttacaatgccaactttaaaaggtcactaaagttaactggacaataatctaggcagacatcactttacaaaaaagagggaaagcccaaaatgccaccttctatagaaaacgcacagtacagttttattcagagcaaagaaaaaagaaacttgatcatactatgagaaactcagccataggtttggaatccgtattcacaccacacattcactgaggacaatattctgctcatacgattgatttgctactgcatttcactgctgtttgtctgatattaacaattttaaacagagcagggcagctagtatttggaacaatccttacagtgtgacggcgtcaaggacgtttcacttctgttcacaccgctggttcgcttggcatacctgggtttcctcttcttcagtaaagtcatttttgatattggaagtcttgcgaatcttctcaggacttttctccttgattgtattggcaacagtcttgtgtgtaacatcaagcaaacctttgatgtctaagtagtttgcaggcagaagtagtacaaaaagtattccttgatcgactttcaggaattgttggtcctaaggagggatctcctctgttcgttttctttgttcgcatcatcctcgggaggaggacggccatttttgtggtgggtacaccaccaaatgaccttttaaaaatattgctgcattaactttggtagaggagctgggtcgttatctccatcatccattctcatatcttccaacatggtcttgatagtcacagattgtttggcaatttccacatcaaatatctccgcatcaaaactcagcatcttaattgacggcatggtgtttgagcttaaggagaccactggccagaggctcatgagagcagggcgacatcagcaaagaagaggaaggcagaggacaaggacactcaagacatggtttggatgatgataattaccaaatcttttcagatttagtgggtcactccgatttcttttcttagccataaagaccttaagacatgggaaactgatgaggtaaagaagaaatcctgaaaatggaaatatcttctttagttcagcattctaatgaaataagcagaccttgtagagcagacgcagacaagatggctttctgtggacaacagtgtaagggatgcagcattgtggctgctggaaaggctgcctaaacatctactacaattcttactgtgtttttgcttacatgttacagcagaaacagactcactagcagacttttccatgtaaattaaaattcttcatttccaatgttaaatttcctttttttttgtgtacccaggattaatttgagataaatctagtagaccatgttgtctgttgttaggcgccgaatcatgtatctctggggatcctaccttcccagaaaggcagagagaaaatatgccaggcattcaacactgatgttttcaagtatgaacttttcactgacctaacactgatgttagccaaaaacaaacacacgaaccttttctttgcccttttattttaggtcatggtttttaaacttttatactcctaatctattaaaatctatttcaaaagaattccagtttaattttaatggcacttgcaacgtattccaaacaaatacctggagagaatctgctgattagtcagtggctcagctatataattagtcatgtaccacatgacaacattttggtccttggggattgcatatacagaggtgttttctatgtttagaaatgtttagacacacaaatacttaccattgtgttacagtagcctacagtatttagtagagtaacatgctgtctgggttttagcgtaggagcagtatactgtaccatatagcctaggtgtgcagtgggctgtactatctaattttatgtaactatatgctctgtaatgtccacagaatgacaaaattgtctaacgatgcattttccagaatgtatccccatcattaagtgaggcatgatggtgttgttgtttatactgacataagtgccttactgatcacatcagtggctcatccagacaaatattctgtctctgacattgactgccaaaggttagtttagggtctggttttcttctacagtgagatcgtagaacaaataatggatgacgaggggatttagcaaaataatgcagatctccccaggttctgcaagatcccattgtttgtcagtcatccatgaattctcctaaatcccttaagctcctctttgtatttttatcttgttctagctcttaagggcaaacacacagttcataagtctaggaccaggcattcaagtttcagaagactttccactcccgtcaccttttattctataaaatggtctctttggtgcaaaattttaatagtgacttttagaaagtaaaaatgatttttactttacttattgactgattcaaagagttcacttagattattgaggctggattttactgtactgatatcacattagcttttataaatagattattttttcttatgtgttctcacctgtagtttttatcagttctgctaattttaggcaagaagattcttcagtgtagttgttttttaaataaatgcatgtcacattggcatgccattattcttaaggccttttaaaattagattatatcgaattaattttttttgaggttctgtctttggacttctttcagttgatatagtcttgtcaattttttatttacacacacacacacacacacacacacacacacacacacacacccatatgtatgtcattggttttgtcaaaaagcctgaaaatgcaaattctgcttgtaaatattggtagaggagaaaaaaagaaaaccgtgagatgagtctgtgttccagactcattggtgggttatgtgggatgagtctctaaaatggtgagttaagcaaaataattaatttccaaggcagatttgtttatcttagaggtattccactttcagtagcatactatatactttaaaaattaaaagaaatttagtttctttcatgagtacctctttcttctacctgtactttacattttttaattaaaaaaatttgtaaagttttatctttaattgacaaataattgtatatatttgtattagggttctgtagagggagagaactaataggatagatgtatataaggagtattgacttacatgatcacaaggtgaagtcccactgtaggctgtctgcacgctgaggggcaaggaagccagtctgaatcccaaaacctcaaaagtagggaagccaacagtgcagccttcagtttgtcgccaaagggcagagagtccctggcaaaccactggtgaaggtccaagagtccaaaagttgaagaactgagagtctgatgttcaagggcaggaagcatccagcacaggagaaagatggaggcctcaagactcagccagtctagtccttccatgtttctctgcctgcttttatcatagccacactggcagctgattagatggtgcccaccagattgagtgtgagtctgcctctcctagcccactgactaaatgttaatctcctttggcaataccctcacagatacacccaggaacaatactttgcatccttccacccaatcaagttgacattcagtattaaccatcacaatattcatggggtacaatgtgatatttcattacatatatacattatagaatgatcaaatcaagctaattaatatatctatcacctcaaacatttatcatttttttttgttgagaacatttaaaaccctcttttagctattttgacacacatacaatgcattaactatagtcaccgtactatgcaatagatcaccagaacttgttcttgtctaaccaaaactttgcaccagttgaccagcatctctcttttccccatctaccctctcccctagcctctgatgaccaccaatctgatctctacttctatgagtttgactttatttgattttacatataagtgagatgatgtggtatttctctgtctgtgcctggcttatttcactttgcattatgtcctctaggttcatccatattgtcaaatgatagaatttactgcttttttttttaaggctgaatagtattccagagtgtgtgtgtgtgtgtgtgtgtgtgtgtgtgtgtcacatttaaaaaatctattcatctattggtggacactttggttgtttccatatcttgataattgtgaataatgtggcagtgaacatagggagtacagatatttcttcaacatactgatttcaattcctttggatatatacccagaaatggaattgctggatcatatggtaattctatttttagttttttgaggaactagcatactgttttacaaagtgactgtactgatttataataccaccaacagtggacaagggttcccttttctccacatctttacttgttatctttcatcttttttaataaaaactaatctgaaaggagtgaggtgacctattgtggttttaatttgcgtttctctgattagagatgttgagcattgtttcatttatctattggccatttgtatatcttttgggaatcgtctattcagaccttttgcccatttttaaatagggttatttgttttcttgttattgagtagtttgagttccctgtatatttggtatattagccccttatccagtgtttgatttgcagatattttctcctagtccctgggttgtctgtttactctgttcattgtttcctttgctgtgcagatttttagtttgatgcaatcccattcgtctgttcttgcttttgttgtctatagtttggttcctgagcatcccaaggctttttctcaagtctttgcacttgttagtctttgtacttcgtggtctctctacgtagaatattcttctgtttctctttaatctttacagggttaactgcttgtacttgaggtctcaacttaaaacgttgtgttaatatcttcggagaggttttatttgacctcctaatctaaattatgttccttgtatcactcattgatagcatatagggtttaatcatgattgttacctatgtttatttaatatgcatggggctcttacattatctgtacaaggggtcttcagaaagttcatgtaaaatgcatattatgaaaaaactttgcatagatttcaaaaaattttggcaccaaaataaactcatactaacttgttagagcatgtctcaataggatgtagtttgaggcattaacagggataagatatcagtttgaaaagagcttctatcagaacaacatgaattctgctaaaaattaaagcgagaacaaacaccatatttatggtgaagcttgggtggaagagtggtgacatcattaatgctttatgaaaagtttcatgagacctcggaataaacaccacacatctacaactatctgattttcgacaaacccgatacaaacaagcaatggggaaaggattctctatgtgataaattttgctgggaaaactagctagctggagactaaaagtccaagatcaaggaatccttctgaggcctatcagggagaatctgttctggtcctctctcctacctgctggtggtgtgctggcaccctttggcgttccttggcttgtagatgtagctccttgatctctgccttcatggttacatggtatgcttgctgtatgtatgtcccttcacacagtgttttttaataaggacatggtcatattggattaggggtctacccttactgcagaatgacctcatcttaataattccatctacaataaccttatttccaaataagataacattttgaggtagagggataaggacttcagcatatctttttaggggtacacaattcaacccaaaacaaataggcccattatttccagattttcttccttttggcacacatagactgattatacccatctctttactagaaacaagtgttttgattattatttaaatgttttgctcatctattcaacgtctgatgtgaggttgtaaataaccattgaattttgtaaaattgccaatcttgtgcaattttgtgtttgtagtacagttctctgaaaagttattctcttatctttgacaaatatcctggacagtatctgtccaggtgaaggtatgtatgcaaagtgttacattaattttagagatgaaaaagaaacatttatatatatatttaaaaataaaggaaaatgcctaggaagaaagaagcagaggtctgaatctgagattcgaagaaagaaaagtagccaaggtggaatgggagaagagctgaggtctaagaggtaaggtgtgttactctgggaacatgtctttgtataggacaagcagaggacttaaagctctgagggatcaagggagtagaaagaaaatgtcagtctagtgaactaatctctaactgtgctttattttttatctgtatttttttcagctatctttagagatagttattctgttttagagataagaataactaagtctcagtttttccaaggtcatccagccaagcacataggggaccttttgaaagcatagttttggagttaatgatacttcagcttgagttctgattcccttttgtcactttggagaagttatgaatttgtatatacctcagtttcttcacctgtaaaatgggaattaactacctacctcattgtggtgttgtgaggaccaaatgagacagtatatgtaaaaggattagtgtggttcctcatagcaattttttggtcaagaaggtagccatggtctttagaataccaaaaaattggaagcagtgtaattattagtagggaaagggaaaataaattgtctggttatatattggaatattatacagcagttaaaatgaatgacttaagtctatgtgtatcaacatggataaatctcagaaaagcaatgttataaaagaacacataaatgatatcactaatttaaattttgtcacacacaatatcctgtttaggggttcaaacagaagtggtgttttcttgtcacataggcagtcaagacaataataacttctgggaaatgagaaaagggttagagatacaggtaggctggtgttttacatgtatttgcaatatttaatttttaaaaaattatacagaaaatacacacacatgaattttttataatgtactgctatttgaccttcactaccatcataatcaggtgaaaatgagacccatgcacatctgtctagaaagcccatgttgaacttgagagcatctgttttccagcacatcttgcattagaaagacagaagacagccatcagatgaccaaggcttccagggatggcagggggaaggctgggtgcttgcactgtcagtttctaggatctgcccaggtcatttcttttcctgaatctggtacttgcctgtgttttcttttgcctgtagctaccgtcaggaatgtagggagactttaggaggattactggtgagtaggtagagtcttttatgggggcctactctcaaaataatataaccatgaacaattgaggaatgtttttttgtggtcccttttatttatgctctaaacttgactagttctgggaattgaggaatctcaacctcacgttctgattgactaagtaaatgctaatgtgttcgttaacacaaaaggcaatgcattggttagggaagctagctgttaacacaaagaccccaaaaagtctaatggctctaatgttgtgaaagttaatttcttctttttttttctttgcataaacaatccatggcctttccacattggggggtggggtgagactctcatcacataggcagttaggaaccccagaggctcttcagttttaaacgtgtagcttccaacgtcatcttgagaactgatattcagcagtggaaggagaaagaacagggaggatatacatttatggcttttatgtgaggcaggccttgcattggcacatacccttctgcctaaatctgattataagcagaatgcattccgatggtcacagcttactgcgggggctagcaaatgtctgcttgtttttcaaggaataggaagaaatgtttagtgaatacctagcagtctgttgccagagatggtttttgttgtttcaattccattgtacattcttcttagcatttaaaaaattatttgaacttttgaacaggcaatatcttcacatactttaaaagtttgaaaatctgaaaagttacacagtaaaatgtttgcttatcattcctgccccacatctactcagatcccactaggtaatcatggttattactttatcatgtatacttccagaaaccttttgtttaaaaaagcaaatatgaattttatatatatatatatgaaatctcttcctcccttattacatagatggagccataatatacccagtactttgtacttggctgttttcccttagtagtataagatagttattttaaattttgtattattcagtctcagtgacaaggtggcgttcccagcgtcagggaatttctaatctaatctggtcaaggtataatctactagtaaggaggaagagatacaagtagtggaagcttttgtactaaaatcaaatacttacctgttactcactctataactcaataccacatttagagcaaatgagtaatacctttataagtcaaattagatttttagaaaactgctttaggaaattaggcatgctaagataattcttggcatttaaatcacataattaagggaatagaaaatggtttgtgttaggaaatagatctttgactacatttttgcatgactttctgatgtactaagtacattttagtggtcaatgttctctacattaaatggcttttgttttggtaaacccatatgtttggagtattaatggttgtatttctaatttgttaccctggcccaaatgatgaagtaatagaatgttgcatatttccttccacttaacatttaatttgtgttaatgaaaccaaatgtcacttttaactctggaacttctaaaatgaactacaccgggaagccctctgtattctttgtggtttcccatgttccatgagccagcaaccgggtgttcacttgcagtgactctggtttactcagcccctggggatgcattactgctcggaaatgggaagggagagtagcaggtggtgcgtaattgagagctgtgtttgattgggactgacctggtgcccctttcctctgccggtttgaatgagagtttaaaggaggaactgctgctgctaagaacaaaatgaacccgagtgcctcttactgtttgtcccgactgtcagtgcatagggattaactaacatccaggaacttttagctggcctctgctttgttcttcaacattcggaccttcagtgagctctagacctgcacaaacgacctgcagcaaatggcagctttcatttgggctgaggaagaggaatattggagagaatgaggagaaggaaataaatatctttcctttttggcccttcctgctttatctttctccatctttatgcctttattaatgaggattttccaaatatcggtcttcaaaaatgccataagaagacttcattttctgtggttttaatgtcataaaatatctccttatgtgaaataactagatatgctggatcaagcataacaaacatccctttaggacattgctgaatctgtatttaaaacataagggaagaactgagggaacagatggaaaaaggaactggaaatggaagtgaattgactgctgcagctgccctctgggctcctgcagatcttggtaatcaaaaggattggggttcaactgccttgtgggagacaggagacagggtcttgggtccatttaagttagagataccatagtaacgtgagacactcaaaggactgtggtctcagtagagaggtgacaaatacgtcttgacctgttcttgcctgaggaaaacgtttctaagaattcttaaccacaggccctccctcatagattttcagtttcaatttatactctgtgtggtctggcaatttccaagctgtgaaacttatttaaaacagtctgatggtactcacataaatcaccaagttaaaaaaatacaaaatagaataaaaaatatgagcatggaaaataaatactatcaaaagggctcagattgatttaaaaaggaaacacagacaattctttaagactgaatggactaaagaactcattcatgtaaccaaaaaccatttctgccacaaaaactattgaaattaaaaaaagaatgacttaaataagaatggatcttatactccaaaaagaaagaaagaaaagaaaacaacaacaacaaagcaggatatgggttaaacaagaatagaggaaataactgaaatgcaagataatacctgaagaaattacctagaatgcagcacagggtggcaatgtcaggccttcagtgtttcttctctggatttttgaaacagctttctaactggtattcctgacactgttcttatgtgcatccagactattagccttggatcccagctcctgtgatcacattttcaaaccttcaccctccattttccactaatcttttatagacaatagctaatcttttactcaatagctacccccaggaaatcctccctgatcctaaaactgcatttgttcgttaggtgctcctggcctgtgttcccattgtacctagatcataacccagttataatcttattacattgttatcattaatgctttttaaaaagttttactattcatcactagagtgtaaattgtttgtagactagcaaagctctgttaacaattatagccctaatgtctaccactttgtacaattagtactttgtaagcactcagtaattgttcattgaatgtaagaatgaatggtgtatgtgaaaggtgaagctatataggtctaatgatgcttagatcctaggaaagggcctatggttcatgtttctgacaggagattatttaggtagttcatttagccatttcacatgaccaatgtgttaatgtctgaatttaatctactcgttctgtgctgtcttaaaagtcaaacttttcagtaaaacgaaaccaaacaaaaaatacacccctagcagtttgtatttcagctccccacccccaccagacaactttttttaaacattttatgttggtaggtacatagtaggtctatatattaagggtatatgagatatttgttgcaggcatacaatgtataataatcatatcagggtaaatggggtatccatcaccccaagcatttatcatttctttgtgttacagatattcccattatactcttctagttatttttaaatgtacaataaattgttggctgtagtcaccctgttgcactctcaaatactagatcttattcaatatatctaactatacaaaattatcttaagtttgaattatagaggcattttcacagtagcaaccagtaggtactgactccatcactgacaatagctataggtcacactctgtgtttctgagtgacagccacacatggtagatactcatgtcaccacctagtttatcttcaaatgtgaaggactccagtgacactcacatttagtcctttcatctttggtagtaaagatgaatctttgtcatccccaggacctcttctttttgtttgtttggtatatggaatgaaatgactcaggtgccttctttcagttaatttaagttgtatagtaagatcaaccgtagaatactatcagtcatcttggaataatatctttatcatcatccaattgatgatgcttcttccagttttgtttcctgttgctatcactccatctgtcattaattgcactaagataataattctctattgtgtggcctgacatactgttttattacaattatttggaaggtcttgttactactgcacattaaaaaacaattctaaggtatgtgaattgtttaatatttaaaaatgtagtcattcttgcttatttccattctgatcttcgtacaggagttgaagatggaattatacctaaccgcagtgatgagaaatttgtggtgaacagtgtcacataccctttcactctctccctgcccatttagacctccataattattaatagttacattgtgctttctcaatgcaacctactgtccagtctcagcacagcgagtacttcagatcattactacttgtcaggtttagcactcaagatcccaggactagcttttcttgtataattcccacttgttgttcactttgcacaaaatacctgtttacatatctatgccctaaggtttgtccatacatagttatttctgagctcatattttggatgctatttatccctcttccatgctgttctttgtagtgtctactacacaaaatttgtaacgatgtggtaacagtaaacatttatgagtggttgtcatgatgtagcaggtactgtgttaagtacctgacatttattatttcattgaattcttgtactaacaccaagagttagggctcattgctcttctcattttataggtggagaaactaggacaaggctaaataattggtaaatggcagagcctgggtttgaatcaaggccacctgacttctgagcccaagttggtaacctctgaggtagtccttaaagaaggttgggttaaaaccaaactgattgatagtgaacatactgcttttgcctgtgttggcactagactaaaataaaaaccttttcctttatgttttcccagattccaaaccaacttggcctaacctttcaagtctctaagaaatttatagttttatatctattaaaaaaatcttctggtagacttcataaatatgacttagatttttattaaacttttttgctcgtatctttctgtatctcagaaaacctttaatttttgagacagtagctatttgtgtaggctgtcttatatgttcacagatggcattattttatcagtcctcaaaccatctgtagcatcaacttagtctattccaattggtgtcatctttcatttatgcaggagtgagttattaaagtaaaactttatatttgtataacattttgggtaaatgttagagtaaaacattggtttattttatcacaacaatcctttgcaaagaaaatttattttttccagctcatcttgatttactttatatgtagtcttcagaatgaaattgaatcgaataactgtttattgagcacaaattgttatcctgaaatgtagggataagaaatgacccctgtgttcactgaatttatagtcttgtaggaaagacagtgaagtagtaaattcccattgaagaagaaatacaattatgattaccattatgagaagggaaaagacggtagtatgggaaatgatagtaaagggattaagtctggtctagtgaatctagaaaggcctttcagaggaagagagggtaggagttcgccagacgaagtgtagctgatgggtggtagggaagaggaaaataaccttctaggcaaagtaagcagcaaatgagaaagcctccatgtcagagagcttggagtaactaagtcattgaaagatatgcagtctgactggaacttagagtaggaggaagagagtgacacatgatctcaggggagacccaagagctaaacaggcatcagttgttttttaggacaattaaagattctggatttgaacctaagattaatagcaagtcacagatgagtttaaagcagaggtgtgacatgaacagatttgggctttaggaaaaccactcaggctgcagtgtggagaatgagttggaaaaaggaatggaagtggggaggaaagttaggaggctgtttcaatataatttggacttagactatagtagtggctgtagaggtggagagtggtggatggattacagagtccaccctgctgagaatggaagagccagcccgtgtgtgtacaaagctctgtcttgctctcctgcatcgtactaacaaatggtccttctgcatgcaagagtatgagccagagaaaaatggaacaaaaatgaggcctgaagttagtatagaagctctgtattatgaaaaggcatgatctcacaggtagttaaggataataaagacaaaagcactcactaaatcgaaagtcctcagtctgattgtaatctagccaggatcctgatctaagatttgcttttcatatcagtgtgtatgatgtcaacagaattttgagagacaccaagtttattcagtggctgatgcctcctttcccccaaaacatcagttcattctttcatccacttgtttatttattcattcattcatttacaaacactttaaatccttactgaggacttactactcaccagacatgtttacttatcttagtttttaatactacagatggtcattatacctagtgtgggcctttgatgtttataggtacttcatggaccacatctcattgatgatacatttagtccatcagatttccgttttaagttgagtcatcacttaaggtgtagccgttggtaaaatcccgcagcactgatctcctatgtatctgaatgtcatatcctctgcactttctattgctactccccaatctttggtcagggtcaatatgtttaatttaattcattcaaacagttggtcagttcagccatcaccaccaccactaggtcgtcttgttggtcattgtttaactattatattagccaaggtaatgcaagctatcagcaaacaaattctccgtctaagtggcttaaatacattagaagtttatttcttgctaatataagttcaattggtaacagatccgggaatggtggattttctgctccactgtgggctcaggctgatggagttaccatgaggctcacaagcttgcctagctggcaaaggggattaggagaatgtgaaagcttattcaggaagtttttatgggccagggctagaggtggcttacatcattcccacccatgcttcagaactgaggtacatggccatacctaactacaggggagactgggaaatgtagtctttgtgtttgcttggtgagcctgtctttgtcaaacccagctagtgaatttccttgtatgatacctgctctttgattcagataataataagaggcatggaaggaccagatatattgttgtaggactttttccttagttcagttaaagacagcgaggttgggggagggtggtcctcatcacacagccatgtaaaattaggcccgcagacaattcgaaggaggagaaaaatggaatttattgggcaaagagcaataaaaagggaaacaaagactctccaacaagacagaacgagaatcttgctagtatgcttcccgcctcacagactgtaatcccaggttccacccaggaggaggaggggccaggctcctccctgctgccaaaggcgtgaacttctgtgtctccaccccagtgcaccctcctctcaatgcatacgcccattggagttttgtcagggagtccttcccacatgactatctcagtatgaaggaggagtttcctttgtgcctaataagtggctgtgtcacattcctgggcattagagtgggaaatgtctatattctgaattcctaacatatctgattattgctattactcttttctcacagggaaataaatgcccggcttgatgctgtatcggaagttctccattcagaatctagtgtgtttggtcagatagaaaatcatctacgtaaattgcccgacatagagaggggactctgtagcatttatcacaaaaaagtaagtgtgatagaaatctattaaagctgacagtgttcttcagcttgaggacactatatattaaaagaaaacttttgagagctctattattattttattttgtaaaatcttacaaatagcatgcgagagtagctgaatcctcagaaattttaatagtacaaattagagttattccaatttttccattgtagaaaataaagttttctcatgtgccttaactacagcaacatagaggcccttctgttataatatagggtattctcctgtttcatcctgaaagtacagactattatcaaaataggaaatttatgtagacttgttattttagaaaaaaaaaaccttatttcttttgatcttagaacaacttattgtttcttaaactatggaaaaatctgctagtataacatctgtggtggtagttagtatgcaaacaagcttggatattgaaggtgagtaaaggattattttgatttttatcacttaagctttacagtttgagtcatagcaaaaatgagtcattttccacggttagggaaataatttaggttatcttcaaaatatgcctaaaattaaaaaaattattaatatttttaaatgataaaacactataaactatggtgttttactttttgcagaagtcattcacataccttatactctttgttccttatcaaaactttatgacattgagaagttactatttttattaccttcttactaataagaaattatatctaatgctatatatgtgtgtgtatatatatatgtatatatataaaatgctgcaaccacttgaattaccttggctaatatgatgatgctcagaggtttagtaacttgctagtaacagaatctgtatttagacccaggattcttgactgtgttttcattggctgtgtcttttggatgctatcatgtttgatgtagttatcttgactgccattttttttttctggttgccacttttcataagcaaattttatttttcctccaaatgtaactccttgccaatttaataattttactgtgtaaccatttttatgtgcctaaatttttattttattttgttttattttgttttattttattttattttaattttttattttattttatgttatgttatgttatgttatgttatgttatgttatgttattttatgttattttattttattttatttttgagacagacttttactctcgtcacccaggctggagtgcaatggcgtgatctcggctcactgcaacctctacctcccaggtttaatcgattcttctgtctcagcctcctgagtagctggggttacaggcacccgccactatgcctggctaatttttgtatttttagcagagatggggtttcaccacattggccaggctggtatcgaactcctgacctcaggtgatccacccgcctcggcctcccaaagtgctgggattacaggcatgagccactgcgcccagccaatatgcctaaattttagttgtgaccaatttttcattagtgtttctatatttttcatccccttttacccccacagagttttactagaatgataagtactgcttctaagaatacttgaggtgcccaagaggacttacgtaactgttttacatgcctcagctaaatttgaaaacaatgcacaagccagaactggaaatactgatcctggggagaaagatatatgagttggttatggggccggggagcctattgcatcattattgggtacaccatgttattgttttgctggcaatagcagaagctgtgctgatagtcgcaagttttatggtagacctttttgaagttgcaatgtgggtgccaaaccatttgttgtttttatccttggctcagagcctgaaaattgatgcatattaaccttctttaaacaacagatctccaggcaccttgccttaactacttcaaaggattcactgacagatgtcagagatttgaaaacagaagcaaagctgaaaatctttcagtggctactcaaatgcacaaagtcaaagtgtccatggcatcaagatggcagcatcagttcatggggctgtgatttctattccaccttcctgcctttttgtaaactttactttgatgtttgtattgcacagggtttgtgtatttataaaagtttcaaaactctagtaaagtcagaatctaattcatttaaaaagtggccggtatgcagtgcaagaatgacttattttggaatttcaaaatatagtttactaacggaacttataactcacttggaagccattccttgttgctgttttagtgtttgtttacacaagaatgtacctaaagattagtttgaagggtgaagagtagaaatgatctggtaacaaaccaacttcaggaaagctgaatgctttaaaccaatgttttatagattagttggctggctctgtgtacacaccatcaaacatatgtctgttctttattattagattactctaaataagcttctactgtgtacaccacatagtgggtgatgtcctgggtacagattgtgccaattatgtgaaattcataaaatgagaaggaacactggatgttgtgggaagtggttagcataggctgtatggttttgtggaacgtgccctggaatatgtaccaataggtgtttttatggtgataatgatagaggatctcaagtgagctgattctggtataaaatagacatttcttcttcttctttttttttttgaaacaagatctcactgtgtcacccatgctggaatgcagtggtgcgaccacagctcactacagcttcagcctccagccttctgagtagttgggacaacaggcacgtgccaccatgcccagctatttttttttttttttttgcatttttttgtagagacaaggtgttgccatgttgcccaggctggtctccagctcctgggttcaagagatcctcccaccttggactcccagtgtgttgggattacgggtgtgagccactgtgcttagcctaaaataaacatttcttttgatggcaaaatgttaaattcaaatcctgtaaatagtgctagtcacaggaacccataataactttgctcaagaactgttttgtaagaaattcttaagtaactgccgaggttggtgaatacatttaaaggataatcgcacttagcaaatgttgaggagagtgttttcagaatttcctaggtgaaaatctttttttagctaagcaggaataagcccacagctgcatgttcagtgtggcacttaagctggggtccttcccatcctgtgtccagtgaggccctgccaccatacttgtgggtctgtgctcaagctctcccagtgagacagctgctgccagaagtagggctgaactcctggagagtgacttcaggagcagccacttacccatcctcagctttcttgtagcttcttttgagttcttttgcttaagaaacttgagaacaacctgctgcctctggctttcaacatgattgtaaagcactactggttttcaccttgcttctgttgctgacttaactttacattgtgtctcagcttggaaaattaatcattttcttgggattacaataatcataagaggttaatattcaaaattatattgaaaatgtttgtgtttgtttctttacttttgttaaaaggtatcattaattgactagtggccaaaaagcttccaggtttcacatttatttaaacagtccagcttcctgtatagggtggggagggggtctttctggagaaaagttgcctcatgatacacttagaattcaacatttgctcagttggacctaacttcttattttttttgcataattcaccctttgtggttagtaattacctttttgaatacgttcttagccttaatctatttcatatatactatctattatgtgccttattactttacccctaaattgttttctcatctcaagacagttcttttcagccaacattttgtcagttttattttcctgagctgtcttctagagccttctaacttgatccagtctggactggttgtccccatatctgttgtatagtactatcttagattccctttacttcccttgagttgaatcttttattttctatattccatgtcttcctcttcgtttatttcttcattttggtggagtatatatcctctagaaccttcctgagaaagcacgttggaagtaaatcttttgaaacattcatgtctgaaagtggtttttttgttgttgttattattgttactaccttcacatttgattggtagtttggattggtataaaattctaggttttagatgacttcattatctttacttcctcttctgttgaatttttcatttctactattatgctttaatttccaagaatttttgttttcttgtcctccaaatgttttttctttttaaaagtagcatcttgtttcatggttgtagtatcttctgtttcatggaagatattattaatatttttagaagttccctaacagggcagaatccatattggtacacaagtctttttggattcttgatgtaaattgtgtctccgttttccttaaggacagtttaaaattcagataccttgagtcttttaagtcaattactgtttatttgtttactttatagcttctaacatattattgctgttgtcttcttttctagtgtgtttttttccttttttttttttttttttttttttgagacggaatcttgctctgttgcccaggcaggagtgcagtggcacgatctcggctcactgcagtctccgccttccaggctcaagcgattctcctgcctcgccacctgagtcactgggatcacaggcgagcgccaccacacccagctaatttttgtatttttagtagagatggggtttcaccatgttggtagggctggtctcgaactcctgaccttgtgatctgcccgcctcagcctcccaaagtgctgggattacaggcgtgagtcactgcgtctggctggttttatgccgttttaaacaatctcttaactgtcgtttcaagatggagagaaattagatgcatgtgtttaactcactgtttaccagaagctatgatataaaaattattcatgttcatgttaaaaaaaaaactacagtagtatgcaggggtatgcagtaaagggtaaaaagtctccctctgccacccttccatacctactacccagaggtaaccagagtaagtcacatgtgttacctcctaaaatttttattgatatttagattttttatttatatagaataatgtatatcatttaaagaatacaaagaaagtgttaccatgtaaatacataaaaatatatacatatatggtatatgatataaacatactgtatatattcaatgtatgttgaaattatggagttctatactgatgcaaacagatcttaattttcttttagctgtttcgtagtactacactgcatgagtttttcccaataagatcccaattgatggacatttatttcttattcatctttttaaattataagcagcgctactatgaatattcagacacacatatttttcactatttgttagtctatttttagataaattatttaaagtggtgcttattcaaagggttatgtgcacttttttattacgaagacatgccaagttgtttttcaaaaaggttagtcctctgctaagagtatataaaagtgtcttttttttcttttacatcctgttacatggttattgtgaagcttttaaatctttggcgttccgataagtgaaaaatgctatcctatatttctaatttgcttgtctttaattatatatgaagataatcgtatacatacttgctgttctctttctatgagctgcatattcagtttgtttagccattgttctttggattattcatctttttcttgtcaatttgtaagagcctattatgtttgggagaattttgccttgtgtctgttatgccttacagatattatccttcacattttttaacttgtttaacctatttttgctatatggtttatgttattttaaaaatgaaaaaatactaaacaagtattggctttgttttccttgcctaaaattatttcctttatacctttaaaatattacatagtatttaacctcatttagaaaatatcagtgatattttatttcaactaactagttaatagaaaatttaaactttcctcaattctgattctaacttttaaaagtcactaattaaacttcattttcatgtatcttatgctatttcataaaaaatatttctattttcagtgttctacccaagagttcttcttgattgtcaaaactttatatcacctaaagtcagaatttcaagcaataatacctgctgttaattcccacattcagtcagacttgctccggaccgttattttagaaattcctgaactcctcagtccagtggagcattacttaaagatactcaatgaacaagctgccaagtaagtaccagaccctgaattcttccttttcaccagtcagtataattcagtgcatttgccatttatttgtggattcttaatctttactagaataataatagaagttgcatgagtacatatataattagaaatgtgattggaccctaaaagtgttacattacagctggaatacttgctacctaaaatttaggcagtttaccatctaggacagatatagtactcccccacatatcagatgatggaaaggtaaaacacaggcaaagccaagcattagtagtttattaaccccaaaatgagtgtcagatatcttgtactcatttcctatatttccagagatgtctttatatttagaatctgtaaaagcaaagttatcctttaaaaggtagttataacatattgcacaaaacattctatgtaaatgaaataggatttgacatttacgtttgtctttgttttctgcataggcaaacaacaaataatttatctcttggttttaccatgggaatcatgaagttaaaaagcagaaatgattttagggtaattttgaccatcctcagagaagttaaaaaacaaatccataagtgcttagtgacaattggaaccacatttttctgacttccagtgctttcctcttttatcacactatgaaaaataagcgataactgctgtaattaataaacttcgaatatgtatttgcatgttttgattttttagagttggggataaaactgaattatttaaagacctttctgacttccctttaataaaaaagaggaaggatgaaattcaaggtgttattgacgagatccgaatgcatttgcaagaaatacgaaaaatactaaaaaatccttctgcacaatatgtgacagtatcaggacaggaggtaatgtcaagcttacttttattttctattagttttactctagtagaaaagctattttaaaatgtaaatagaaatctgaggataggatatgtattatcttttcaaattttctgttttattccttggaaatatgttgtaataacttgttttgataagagttattttaatgatagtgttttattagtctcttgttaaagtaatgcaacttaatgttatatgtatattagcgttatctgttgaaattatattatagaaaatctcaattactatgaataacaacttatagaattcatttgttctaaatccaggaaagagaagttagtctttgatccctaccttgcagatgatgaaatgatacaaagcctgtgttgattggctcatacagtgattaaacggtggggcttcctcctaaagttaagagtatagctgctaaaaaaaacaagtctagagtgaaaaactacagttagtgagtcttccataaaattatggtactgtttagaatatgtttcttgggggtgtgtacttctgtttaaagtttgatagtaatgtctgaatgagaaccagaaaaggaagaagtatgccttttaaatatggttgtgcttttcagtcctattctgggtcttgaggcatgctactcctatatcttatgtttaataaaatatgaagattcaaactgagggagtttgagaaattctgttttattaaaataccaaattaggaaacttatggttaacttctatagaatgagcattttattcaggattttcaaaaaatagatatttttccggtggggaagaacttaatttcaaatcaaatttttaaacatttacattgttttgtgtgttttgccaaaagattgttgaatgtatagttatttgaaataagaagctctacattaattgagaatgttcattaaagtgtttattagtcttgtgttatttcatagatttacccattaagtcaacctgtcttctgaactaaaattattaagatattatactcagcagacattcacaatgccacatagagctctatataacagaaaaatgatttgacaatatttatacttatgtttattgtctgaacagacaaataccaaatatttaattgtaactcttgtttttgctatgcagtcatgaccttgcaaagtgaaaactggcctaaaggccactattctggctattggtttaaaatcagatgatcaacactgctttagttactttaataaaagatatgtagtagaaaagtggctgccttttctactacatttttttttttttttttacagtggagaaagtaagtgtaagtgccaattctaccatttacatgctatacgaccatggaagagttacctctgttgtaagactattatggagaccaattaagttaaaatacatgaaagtgctttttaatcataaagtgctatgcttatactactcatataataacaataatagtaatacagttaccatttatcaagtacttgttaaagtctagaatggtggtaggtgcctacatatattatttaattcttataacaatgcccaaaagggtcattccagtttgttggaaagaaaaccaaggtttggagtagttagataagttacccaaggtccgaagcacaaatccagcccacttctgccagactctagtctttctattatattaatatcagtatttcattccatttattaattccaaatattaacacaaagattctcaacaccatggattttatctgacaaaatctagatattttagagctcatagtattcaaaataaaataaagtttaagtcttggaaagacggtcctggattcatttggcagtttttgagtaaaaatgagagaaaattatcaggaattcataagagatagtagactggttattcattatgagtgtggcattgaggtttaaaaagtacagcatggagatcaactaattgtattaaaaattattaggaagatcagttatcttttatctttactaggttaagttgatgaatttgaggaacaaagtttcttcgttattgatagtaggatggattcttgttggtttttaataatcttctctaggattttagtagaatgttaatacaaaattgctttcatagaaccttttgaaaaaaataattctattcattggaacaccaaaggaattctaaatattcaaaattgttttaatcaaattctgttttaaaaacgactacagtggctcacacctgtaatcccaacactttgggaagccaaggcaggaggatcgcttgagctccggagttcaagacctgcttgggcaacatagcgagacaccatccctaaaatataaaattagccaggcatagtggaatgtgtctatgctccctgctactcgggagactaaggtagagaatcacttgagcctgacaggctgaagttgctgtgacctgtgatcatgccactgtactccagcctgggcaacagagagaaaccctgtctcaaaaaaaaaaaaaaaggactaatgctattctcaaattatttagaggtacttaaaggactaggaacagactccatcaaatatgattatctctgagaagtgagggaggcagggtggaaaacccttattttacatttattggtgcttttttatgcctttctgttctgacattttatttctatacatatgtcttttgtaataaccttaaaagacccattatagcagccccatgtgagccacgtgatggtatgtggatcttgttatttttactaaaattagataaatgtgccagtctgtaaatccagtgttattttgacaacattcatttttcacctctgttcccagcttttatatactcattagaatactaaagccttattgtatgattccttattgtctctatgtaaatattggcttagaagaaattaatgaaagcagaaactttatatttttatgtaataatgtacatacattattatgtattatgtaatgaacgtatgtatgaatgtttgtgtgtatgtatgaaagtatgtatgtatgtaatgaaagcagaagtttacatagtttactgcttctgttgcagtctctatcatattttatgaatatataccaattatctcttaaccttgaatgaaatgtggaatggaaatggggcaatgtttacattgggggcagtactgataagtattattattattactaagggaaaaagaaaaatattggaaaaaatctttagaaagggttttattaattgacagcatgcagcatatccaaatacctgtttactggtttaaaatgtggaaaataatctgttacatctgagtactttttacttagatttaaaatatagtaaaacatccttaaattattaagagaatgaaattgggggattggaggaatgggttaagtgtggtgctggagaaaacagcagtttctggagtgagtaagagtttcggcaagcctagcaacgttgccagcccagtgataccacaggctatatagattgaataacaatatctggcatttaactaagacagaattgggtcccaggagaagaatatgagagattgcttataatgaatcaaggcagactactcacatcaacacctaataaacaaagtcaggaactgtagaccaggaaaagttgctatgagagctttctaagattactggaatgtatgctatttttctatgttagttttcttttctttagtaataaaattcttaaaccaaaggcctacctgttcattcttagaatgtttgaaaaaaagaatagctagagaaaaatgttgtatcttattgtcagtatagaagagaagaaaagctagcagaagacaactctgaggaggaacccaggctgaaactctgaggattgctgagtgaggaaaagggaccctcaggatcagtccaaggaccagaccctgtctgaggatgtgaccagaggggtttaacttgtgccttcctgactctcgctgttttcccccctgcagtggcactgtattggctctgtgtatggtagcccgctgtagtgattgtgctcctagagtagaacttttgatacttacagattgaatagttgtggtccaaactgttcccaaggtgctccttgttcaaaatgtccaccatcccttagccagtaactcctgtggagctctgtgttagtcattatgcatctggatgtgtccttcccaaatatcagtgatccaatcagtctgttcctgaattttgctgtttgcctttagcatagctctttccagaattattttataaaaaggccaacatttcttttagtagaacactctaaaacagcagaattatttagcacagtttaaaagtgattttatctttcccattagtgatattttttgtggtttttcaaaagttactttttgtagccaaaggaggcttgttagactcttcactcttaactatttaagtgggtgtggcagatttgaaactgtagtaattctctataaatgagggcatcactagttcaaaacagttttctaatgatgaaattttttagattagccactaattcttaatataattaatgtaaaagctacagtgtttctattaatgggaaaaataaactcaagaaccatgttgatactgttattaatatgaacattataaatacctgaaggtacgtgcatataataaaactgataaatgtgaaaaagttctcatagctctctcaagatgacaaccacacagtttctgggttccattctgctcaaaatgggtttttataaatttatttaaatgaatcattgaattagttcttttgtttttctttttgttttttattaagacagattcttgctctgtcgtccaggctggagtgcagtggcacaatctcggctcactgcaacctccacctcctggattcaagtgattctcctgcctcagcttcccgagtagctgggattacaagtgcctgccaccacgcctggctaatttttgtattattagtagagatggggtttcaccatgttggccaggctggtcttaaactcctgacctcaggtaatctgtccgcctcagcctcccaaagtgctgggattacaggtgtgagccatcgcgcccggcctgaatttggttgcaataatacagaaatgcaagcacactgagaaaagataatacataactaaggctaaaaatgaatggtgtgatagaacttcacttgcttcctggctgatttcagagaaccttatttgcagagcacagttggatctataaatatattatgaatgtaaattaaaatgacaggagatattatctcaccccagttaaaatggcttttatccaaaagacaggcaataacaaatgttgatgaggatgtggagaaaagggaactcttgtacactgttggtgggaatgtaaattaatactaccactaccactgtggagaacagtttggaggtccctcaaaaaaaaaaaaaaaatagagctaccatatgatccagcaatcccactgctaggtatatatcccaaagaaaggtaattagtatattaaggagatatctgcactgcagtgtttattgcagcactattcacaacagctaagatttggaaacaaactaagtgtccatcaacagacaaatgggtaaagaagctgtagtatgtaatcacaacagagtactatacagccataaaaaagaatgagatcctgtaatttgcaacaacatggatggattatggaggtcattatgttaagggaaataagccaggtgcagaaagacaaactttgcgtgttgtcacttacttgtgggagctaaaaattaaaacagttgaactcacggagatacagaatagaatgatggttaccagaaactggtagtggtagtgggggtggaggggatgaggggatggttaatggatacaaaaaaaccagaaagaatgaataaaacctagtattgataacatggtaattataatcaataataatttaattgtacatttttaaataaaagagtataactggattatttgtagcacaaaagataaatgcttgaggagatggataccccatttaccctgatgtgattattacgcattgtatgtctgtatcaaactatctcatgtaaccaataaatatatacaactaccatgtacccacaaaaataaaaaaaagatactatggttcatataagtgaaaacttgaagaaaactctcatatgggaagaaacactttcttctctttatagttagggaagtcagtgctttcctgtgaagagacttttacaggatttcagttccttggataaaaactatctaaaaatcctctctgttcagaataggggaggatcatatctcagactggtgtaacatctagtaattgaatattttaaaattttatatacttagaaattcaatcttttatgagtagtagaattcttaagataagtgagtattaataaatgaaagaggtggttaatgaaaaagccatcagagtatacatataacaatattagaaacatgaaagcccaagtattacaaatgttttatgcaatacaaattgtactttgtcccaagtagtgaacccttaattaataatatttgtctgtattgacatatatacagtctgaaaaacaatactggacttatcttgagtgtttaacaatatataataaattgttataccacaatttggggaaagctttaaaatatataatggttacttatctaaatctctgtttatttgtatttgttttagtttatgatagaaataaagaactctgctgtatcttgtataccaactgattgggtaaaggttggaaggtaggtttaaaataaatttttttcttacaatgcattatgatgacatctgtatatctatgtgctactgggctcatcgtagccacattcttgaaattaaaagcaattctttttacttattttttctgatggaactttttttttttttggaggggatgtagtcttgctctgtcacccaggctggagtgtagtggtatgatctcagctcactgcaacctccgcctccctgattcaagggattcttgtgcctcagcctcccgagtagctgggaccacaggagtacactacaacccccggctaatttttgtatttttagtagagacggggtttcaccctgttggccaggctggtctcaaactcctgacctcaggtgattcacccacttcagcctcccaaagtgctgggattacaggcatgagccactgtgccctgccctttcttatggaacttttaaccaaggagatcattacttttaactctttatcattgattttaaaacatttttcaaaaaggtatcttatttttacacatttattttcttgttttgtaaattattgctttatttttatagcacagggtacacatggaagaaaagttgaggaaccttcaattgtaagattaatttagttgcttttacttcatggtgaatgctatgcctgacatttcttttaagaagctgcaatttcattttctacctcactgagctccacatttctttattcttaatgccttccttggcacataattattataattctttacatctttttttttgtaacccagatcatgaattgatgaaaataaattaatcaaaaacaaatttagagaaccacattgggactctgccttttctccttggttagatactaatctccaggagaggactcatttaaagacaaggtattagggaagtatatacagctgtgaatagtatcttttgtggaatatttattagtactgttatcaataagttgcacaaacatgagatgaaaatggtacatttgcctcagatggtagaagagggaccgtagctggtaatagtgtacagacattctgttttaaggatgaagggaaattttgacataatgtgtgaatgattgttactttattacatatataatatatataatacatatatacaaaaaatataatacaaatatatatatatatatattttttttttttcttttttttaagacagagtctcttttcgtcagccaggctggagtgtagtggcgcaatcccggtctactgcaacctccgcctcccgggttcaaatgattctcctgcctcagcctcccaagtagctgggattacaggcacctgccaccacagacggcttttttttgtattttagtagagatggcgtttcgccatttggccaggctggtctcgaactcaagtgatccacctgccttggcctcccagtaatttattattttaacttaaaaagagaatgtttattatccattgccacatcatcagatgttgaaggcacaggcatggatttctttcattctaataccatctttttttttttaatgctaccagaagctgtactttagatttgagtattgttgattctaggggatgttttctctttttgcaggcattctttcctttatctgtttttgtcctgtaccacagctaatgaatgaaatatgcattatgaagagaaattaccaaaaaccatgttagtctatctacaacaataactgaaatatctccctaaatgagtttttccagaagataaagctttgataaatatgttggcctagaagtctagatgatataattttaaagcaacaagcaaggcataaatcagtgacaccatctttcacatgttcagtaatgtaaattgaatcaacagataagatagttagggaaaggttcattgcagtttatctgtttggccatagggttttgacagagatgagttagaacatcaggagtcagattttgaatgcaaaaggcccacccctaatccagcaacttggcaaattaaagtgcaacagtgtattacaagagttggggagcaaaaaaagaccagacaccttgaccttttcttcttgaagatttatcatcataatgacagcattaacagcagtggcaaccgccaccaccaccaccaccacaaccacaatacttacaggcgctctcctaagttttatttgtttgatcctgtcaacagtacctatgaggtagatattattatccccgtttcatagatgagaaaagtgatatttagagaaggtctgtttcatttgccccaaatcacatagctagtaagtaagtggcaggactggagcctcgacctggcttctctgactggggacccatggcatcccctgttgtgctctagctactgaacagagagcagagatgatactcaagcccagatggggagcatgtggtatttcttcctatccagagccactgtgaatctgcacagatcacagtatcctgaagatctttcttaattgcctcctgacttaatgcattgctttctttgtaatgcttttttatttttcttttttcactgaaatacttcaatcatacagaaaagcccataaaacaaagaataatacaaccttcaccaatgtatctacctcccagctttgtcttattttcttttaccatatatgcttctgatcttttttaaagagcattttcacttagtataatttaaagaaaaaagctttctgcctatgaaataaaagttctaaactctgactttgctatatgggtataatttgaaatgcattttaaaaggcttcctgagcaaagtcatattctttggaatcagtagagttcaggaccataattaaagaatgttcttctgtttacagctgtttactttcaaggttcatcagagaataataaataactaattttctaaagtgatggcatttcggattttttactaaccttgatttcctatttgtgttctttcccctcttctagcacaaaagctgtgagccgctttcactctccttttattgtagaaaattacagacatctgaatcagctccgggagcagctagtccttgactgcagtgctgaatggcttgattttctagagtgagtttacaatgaaaaaatataatctgactttttgctatcagaaacagactggaaaaatctttccatcaaaaagaaaatagagattacagctcatgacccaccataaaatagttgagtacatgtgttctctgattttatttctttttttttttttttacttttttttttttgatactgagtcttgctttgtcaccgaggctggagtgcagtggcacgatctcggctcactgcatcctccacctctcaggttcaagcaattctttgtgcctcagcctcctgagtagctgggattacaggcacccaccactacacccagctaatttttgtatttttagtagagacgggatttcgccatgttggccaggctgatgttgtactcctgacctcaagtgatccgcctgcctcagcctcccaaagtgctgggattacaggcttgaaccactgcacccagcccgaaagaaattcttaaaatctactgaaagttaagatgaccctctatacacccttcacctaggttcatcacatgttagcatttgccacatttgctttttatctctcatgtattttttttcctgaaacatttggaagtaagttttaggcattgtaacactttacccctaaatacttaagcctacgtctttaaaaataaggacattctactatataatcttaacaccatttattattacatctaaaaaaaattaacattaattttttttttttttttttgaggtggagtctcactctgtcacccaggctggagtgcagtggcgcaatcttggctcactgcaagctctgcctcccgagttctcccacctcagtcattctcccacctcagcctcctgagtagctgggactacaggcgcacaccgccacgccctgctaattttttttttttgtatttttaatagagacggggtttcaccgtgttagccaagattatctcaatctcctgaccttgtgatgcgccctcctcggcctcccaaagtgctgggattacaggcatgagccactgtgccggccaaaaaattaacattaatttatgaatatatttgaatttcttgaattttcccaatgtccccccgccaccggctttagattttaaaatgaaagacctaatcaacttttacatgttgcatttggtaattatgcttctttagtctgtttgaacctagaattatctgccacgttttttgttattttaccatggtattttttgaagagtccttgccattgtctcaaagaatgccttatattctggatttattgatagtcatgtgttcatattggcagttttaagtcatggcatgctggccaatgtttaacagccagctctttggaaggacagtcatgtttgtagagtttgctgatttctgtagtgtaaacactcccaccagggctgatgtcaagctaccactggactggagttgggaagagatgtacacagttgattttcatgagtccataggaaccagctctagaccaccactggtctgagtactttatatataaactcagtatttttcacgtgacccctgtaaggctaagtatcatacccaacttacaaatgaataaagtgagatgcagaaataagaagttaatcttccaagggtaagggttggagcccagattcagccccagccatccggcagccagatgtctggcctttgccagcctgcccatggtgagcctgcaggcatcagtctaaatacatctgttagtctctcactttaaaaccataaacaggccaggcgcagtggctcacacctgtaatcccagcagtttgggaggctgaggtgggcagatcacttgaggccaagaattcaagaccagcctggccaagatggtgaaaccctgtttctactaaaaatacaaaaattagccgggtgtggtggcatgtacctgtaatcccacgtaactcagtaagctaatgcacgagaatcacttgaaccggggaggcggaggttgcagtgagccgagattgcgcctctgcactccagcctgggcaacagagcgtgactgtctcaaataaataaataaaaccttaaacagtaaaaattcagtgacgtccttcagggagctttattgtatttcaagtaatcaacccgacaaatgaaaaaaactaaaaacaaaaaagatatgtgagaatttttacaagctagtaagttggtatcagtcttttgccctgaggagtcttgaattgtaagaccaggaagagattccaatttacttaaatcttttgagactagcttgactcagagtcttgaatggagggatggaaattttgtctattcagtttcttttctatttcacttttaattttctattttaagggttttcagggcctttgagtgtttcagttgtcctggctttttccttagtattaccactgagaatgtgaaaactgaactaaaattacacctttcagtcttcaaggactcacattctagaagggtcctgggatttggtgaggtaatttcatgttcattctattcagaccttacataatttcatagatctggcttctattctcttgtcattattccagactaaagaaagttgaggtctcccaggctaatcatcctggtgttattcttgattctttcttccttttggtccctttatctgttaccaagttcttttttttttttttttcctcgctctgccacccaggctggagtgcagtgatacaatcatgactcattgcaatctctacctccccagctcaagcaatccttccacctcagccccctagtagctgggaccacaggcatgcagtgccacacctggctaatttttaagtgtttttgtagagacagggtttctctatgttccccagcataatcttgaactcctgggctatgtccaacctgttatcaaatttctgattgtctttttccccctttgaggtgtttctttgatttgtcccttcttctgttgtcttctaacagcccattattacctcaaaccattcttactgtattggccttctgactgggccttctactaggttgacccaggagtttttattatattatccctaggctgtaattgagagttgcgaagagtgagctaacagtaaatataacatcatagaagcatatgatactctaattactaagtgaagaaaatcatgtaaagtaaaagtatgatacagttttatatgtgtatatttacataatgcacagcatacagacttttatatttttaaagattatatatgcttattattgtattactaatatgcttattggccatgtgtatatctttggagaaatatctattcctatatacatatgaacatacatacatatatatatgtatatgtagactcaaaatgttaactgattatttctggatggtgaggttactggtgattttaatttctttactttgcaaatgcagttggctcttgatatctgtgggttctgcatccatggatttaaccaactgcagattgaaaatattcaaggaatgaaaaggatggtagcatctatactgaacacatacaggctttttttttccccttgttattatttctgaaacagtacagtataactgctatttatttatagcatttacattgtattatgtgttataagtaatctagagatatttaaagtctatgggaggatgtacataggttatatacaagtactttaccattttatgtaagggatttgagcatgttggattttagcatctgcagggggtcctagaaccaatcccctatggatactgagggatgactgagcatgatttcagaagttcctataatgtacatatattactttcagaataagaaaagtgtattaaagtttttatccagaaaaagaatattggctgaaatttagctagagcattttgcaactagagcccccacttgagagcagcattgattgttatgtacactatttattgaggtaccagatggtgtgactatgatatcattaaaaaaatgattaacctcaatgaacctgacatcagaggattgaataccagcattacaaatgtatttgtcacttactgaggtactaactgttgtgcattagtcacattacttttgatcaaaatgttgtcagaaattaaggctgtagacactgctgtggattaaatcctcccttgaaacatgtctctcttttttttgttctagaagatggactgtgtatattcagtaatcttctcaattgcaaattatttaaaaattgaattatatcataaaaaattatagaaattcatttgcaaatattttcaatttttattaacttcagatatcattgagcaacacttcatggtaaacttctctagtcatcataacactataacagctttagaaccaaagtgtcttcatctgcttcctatggacccagcaatatcttttggccagaggttaaatcatagtgccttgacttcatccttaagttggttggtagcatagtgataaaattgcttgttgttatgctataaacccagtctaccagattgttatctgcattgaccatttttcagcttaccatttttctaagtatggataatctctttgaagtttggcaaagtgtatcaaatggacaaagaccaagatgtcaaacaagccttctttaagagttatgatgttataggtttatgatagtttttcattttattcatgtcttatttataccattgacatcagaaagagcattgttgttcatatcaaaataattacttatcccttcttgcttttttgttgttttaactgaaatgggacccactaagagctgtgttaactcatttccatcttaagaattagatcatcagagatagctaccctcaagtcaagctgctgagtagtagcaaattagagtcttgaggacctgggcaggacctgagaaggaaggaaagagtgagaaaaaaattgaccatttgttactgctaaagctttgatactcatgtccagagaggcaagggcagaaataccaaatatggctgctttctggcaaaagagagggtgcctagataggaggaccggatgggtcagtaattagaacaaagacagcatacgccacagtgcaagagggcaacaagtggtcagatctaaagtcagagccatggctgacgcagtggctcatgcctgtaatcccagcactttcggagactgagacaggtggactgcttgaggccaggaattcgagactagcctggccaacatggggaaaccccgtctctactaaaagtacaaaaatttgctgggtgtggtggtgcatgcctataatcccagctactctggaggctgaggcaggagaatcgctggaatctgggaggcggaggttgcagtgagctgagatcatgccactacactccagcctcggcgaaagagcgagactactacgtcgcaaaaaaaaaaaaaaaaaaaaaaaaaaagggaaataaataaataaataaataaagtcgaagccagagcaggaataacaaggcaaagtcagtgggcacccactcgggtttagggtgactcttaactctaaacacccagggcagttaggtcaatgcaacatgtggcatcttcaaaactagagagcattttattttgttttattttattaaatgtttgtgggtatatagtaggtgtatatatttatggggtacgtgagatattttgatacaggcatgcaatgtgaaataagcatatcacggagaatggggtatccatgccctcaagcagttatccttagagttacaaacaatccaattacactctttaagccactccaaaatacacaattaagctattgactatagtaatcctattgtgctatcaaatagtaggtcttattcattctttctatttttttggacccattagccatccccacttccctccacattttaaagtggtgactgagggctgcctgtctgatgctaggggcctgtccgttttgtgtttgtggttttgcacagattctaacactgttggtgggaatcgtattatttgttttgatgaactttaattcagtgagaaatagataagttatattcattatgttctatctactcagtaaataagtatacagtatactgtgaatatatttttcggttcacaaaaaacagaaataaagctggatagttaaaatgttgtttctagtatctggaaaaagtcatttatgtacaataccttattctaataatactagaaatatcagaagttacagttttaaaaagtcataatgattatataggaatagtccatcattctagtagtgtaatctggatatctttttcaagctaggaagcactgtagaaatctttggatttcagtagtaaacagactgtctcaacatttctgaaacccacactacaatagagaaatgtttttaaagagaggcatttattgtccgtttgttgtctttttcacgtttttggatcatctttaaaaggtcgtacagaatatctgagctacactattttttaaatgtagaaagtaggcaccttctgatccgtggtcagacgcgttacccattgcgctactggccacatgaaaaaatgctcaccatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaacctagttcaaccattgtggaagtcagtgtggcgattcctcagggatctagaactagaaataccatttgacccagccatcccattactgggtatatacccatgacccagccatcccattactgggtatatacccaaaggactataaatcatgctgctataaagacacatgcacacgtatgtttattgcggcattattcacaatagcaaagacttggaaccaacccaaatgtccaagaatgatagactggattaagaaaatgtggcacatatacaccatggaatactatgcagccataaaaaatgatgagttcatgtcctttgtagggacatggatgaaattggaaatcatccttctcagtaaactatcacaagaacaaaaaaccaaacaccacatgttcttactcacaggtgggaattgaacaatgagaacacatggacacaggaaggggaacatcacactctggggactgttgtggggtggggggaaggggggagggataacattgggagatatacctaacgctagatgacgagttagtgggtgcagcacaccagcatggcacatgtatacatatgtaactaacctgcacattgtgcacatgtaccctaaaacttaaagtataataataattaattaattaattaaaaaataaattaaaaaaaagtaggcaccttatttctattttatttctatgtatgcacaaaaataaggcaagatgctagtaggagtctgtaaaattgcactgtgaagtagggtgataggaagagcacagtttgagtctaggctcaattgctttaggctaactgctttttctctctgaacttcatttgtaaaacttaggtaatgaagacctacctttatggttgttgtaaagaatatgtagtggcttcttcgtagtctttgattagtaaatgtttgttttcctttcagctttccttttggacctatttacagttagtttattacattttctcattttccagtctttgaagaatttgtgacttatcaccacctacttaaacattttttgtgcctcttaatctctcttggaggcagagtagttactataaagatttaagctcagctatatatttcctgttacttaaaaagatactttatacttggccattcttaaaaattaagttttgggtcctttttgtagtttaattatgtacacttcacacatccacaattgatcactacatacagatgtccacaatttatacgacactacacacattgacataaaatactatgatatgagataatgggataatttaagaaaaaagaaaaaagtattcatgtatgttttctgaataagtttttcattaaaagccatttaggcttttagatcaataaatattatagttttaagtagccagagacttgaggcaatgaccattatcttttaaaaaacaaatctgaaatttagtttttatatgcattattaataagataactgaagataagtgaaaaaagtaccttttccccttgtcttcaataaatatttattacagtgtttattttatgccaacattataaactagatgttaggtctacaatggggttaatgagatgagatagacaacctgctttcaagaagcttccagtttagtgtgagagaaaggtgttgaaactgttattccggatttggaggatgctgtgaaggagaagcacaagggaagctgatccacatgaatatttcatgatgttattgaagcaaaatgaaaatgactgctatatttatgttatatcttaagttcaaatgtcagggtcagatgaaatctgtgatatattcttaatggttgatatctttacatagaagttgttttaaatttatatacaaaacagaagcctcaataatttagttattatattaaaaagtaaagctgtttggtgtaatctccatctctcttaactgttaggaatgcctgctgatcatctgtatgcttacactagctgataaagtgattgcttgttgtagagctattataggtttaagatatcagtttgctcacctttttgttgttgctgctgcttccgtaggaaattcagtgaacattatcactccttgtgtaaagcagtgcatcacctagcaactgttgactgcattttctccctggccaaggtcgctaagcaaggagattactgcaggtaagatatttttcattttcctctttatcagtgctttagataagatgacattattcaattaattatagtgtctttattataaaatattacagttactcaaatgtgttagactcttgggaaagctgaatgtcatacatatgtagcttgatttgaaaattaaattcatttcttgcttcctctgtcactgagtacaatgaaagcagatgttaaagtttatgtgggtgacatttttataaagtttcagcactcttttcatttgttagcttttacttgaacacttttataattataaaagtttgattaggcaagaaaagactgagaagatagggactgaggggcattttagtgatctgttccttttgttaagagcccatattcatcccactattctttattgacctctaaacatcccaacatggaatatttattctctttttcataaaggatgttagcacaaacaaatctaactttaaaattcagatggctgggcgcatggctcacgcctctaatcccagcactttgggaggctgaggcaggcagatcacgaggttaaggcatcgagaccatcctggctaacacagtgaaatcccatctctactaaaaatacaaaaaaaattagccgggtgtggtatcacgtgcctgtaatcccagctactcagaaagctgaggtgggagaattgcttgaacccaggaggtggaggttgcagtgagccaagatcgtgccactgcactccatccagcctgggcaagagagtgagactctgtctcaaaaaaaaaaattttttttcagacaaaactttcatacaagttgtatgtcttccaaagcttgattttatatatacttaagaaaaagtaagactaggcttggtggctcatgcctgtaatcccagcattttgggaggctgaggcaggaacatctcttgaaaccaggattttgagaccagcctgggcaacatattgagaccctatctctacaaaaattaaaaaattagctgggcgtggtggtgcacacctgtagttccagctgcttgggacactgaggattgcttgagctcagaagtttgaggctgcagtgagccatgatagtgcccatgcactccagcctgggtgacagagcaagagcctgtctcaaaaaaaaaaaaaaagagagatagaatttaaaaaatacaaaattaaataaagttgttcaagttcaaatgttttattctttccaggaggcatctagattattcccttcactgccataggtgtcatcagtatgctttcttgctatgcgtgttctatcctagtgtatcctcccagctctgtgagttatcctttgcatcctattctgccaggaagcgttttgtcattatataattttgatagcaacagaataagtcgatgtaaattttagtgcagaaaaaatcacttaaaattttgttccaaagtgaaaatcttcctggtaaatcatatcagtgtcatgaatattatataatgatttcacttggcagagcacctaggattttattttaaaattaatgtcacaaatactttcatttttttcttttacaatgaatttgtaacccacctagacaaaaaatcttgtcttcagaattacactctaaaatccaaaaactatccttttttcataattttaagtgtctctctccaacagatgatttcaaagtatttactcagaagacactgtagtcactttttttttttttttttcctgagacagagtctcactctgtggcccaggctggagtgcaatggtgcgatctcggctcactgcaacctctgcctcccaggttcaagggattctcctgcctcagccccctgagtagctgagattacaggcgtgtgccaccacgcctggctaattttcatatttttggtagagatggggttttaccatgttggccaggctggtcttgaactcctggcttcaagcaatccacctgccttggccttccaaagtgctggaattatagacgtgagccatagcgcctgtcctgtagtcactttctttgcaaaatgtgagagcatctgggattttattagccagatatatttaagaagaataatttaggaaagtagtatttattggtgttatgagtaagttcagaaatgtggttacacatgaaagttctgagtcaaagaactataggaggtcattggtaggatattatgcttttgaaaaaagaccaatgaatcaccaagaaactgatgaaaagatgttcaatcttagtaatcagtgagtgcaaattaaaacaatgggataacgctgtttacctgttatgttgacaaacattagaaagtttaataataccaactttaagtgagggtatgagaaaacaagttaactttcatatcctgcttgtaggaaagtagattggtatatctactcttgtctattaaaataaaaaataagcatactctgtgacttaggaatcccactttaaaaatttactctagctttgggaaacacttggacttgtacacgtggagatgtgtataggattgttcattgcatcatcgtttataagtaagaatttggatgcaatctaaatgtttaacagtggaaaatgtgtagcagctttgaaaatctgacaagaagtgatcttcagtatactctactgtaagggcctattgaacctaatttcagtttcttaaaggccatctaaagaacaaagacgaagtttactttttttcctttaaaaaggagagtaaaacttactctgtcttacacttaccatgtgggtttattggattgttttataaatgtaagatgcattttgggatctttagtgatcttattttttctgtatcttggaacattttgttatttcttcatcctgagtattgttttaacattgtttatcatttgtttcaactataatataaaagtctaaaatgaaaagaaaatgagagaatgatgatgcagaagtgaggggagaaatcactatcacgtcatccttctgttttcttcttgtattgcccgcattacatcatcttccaagaaggtataaaagaagagtgcagatgccacagttggagtctgcttctaattttcattgaacacagttgaaaattcagaatttttcgttgttcacccgtaaaggcaaagagaacaaaattgacagaaggcctttcataattattagcttaatcagatgatgaatgtgaagagaaaaaaaccagtgccctgcatattcatggtgatggtgaaatttcatgtatcagcaaaatctgagattctgaatgctcagaaaatatcctaggtgaattttctcaaactcaaaagttggtatgtgaataatatatttgtaagggcaaaatgaactctgttattctcgtccagttagtcattcaataggaaacattcatcatgtaatatttggtgacaagaacctggactgtcctgttttgctgaaagatgtgatagtattcttctatcttttataatatttattcactaaaatttacttgatacaatttataggttacaatttatagacagacaggagattgaaaggatatagatgatgtagaaataaaggtactcatttgattattctaattggtgttgataagtcaaaaaatgaaaatattttgcaattatggagcaaagatgaccatctctttaagaaaattatgagctttaaaagatttcaaaaacttcttcaagtatttgcatttttgttgatacaaatgtgaaaagaatcagaaataatcagctctagaacctattagaaatgtattgaaatttggaatttagtatttatgaatgaatatgttctagatgcatgcttgacggctgatgagcaatgacattcagaatgtcttacccatttcagatatatatgccttgaaaaccaggagaatatggaataaaacttttgagatttgctgtgtttaaattcttattaaaatttgtcatgaggttgattttttttactatccccttattctcatttctgtaaaattatttgtgaaatgactttaaaggaatatattaaatccagatagtaaatggtgaaatctattttttgtgtgtgtactgagagttaaaataaactttgaattttttaagttacagaatgatagattacagtatgacttttccaaagaaatcacaacgagtgtgatgcatacataaacataaatgcacagaagaaggttggaaagggtagacaccaagctggtctcagtagtaacatctgggaaggagagctgagagtagggcagggctcagaggtgcttgaatacacagctaaagctgtagataaaacagatatagaggtctttaaaaagcataaagaacatcaaggtcaaaaaatgattcttgtatcaaagtaaaagatacaaaagaccgtagaaagatgttttaattgaacagcgtatgaaaattttaggtcatttcatttccaagtccaacacatagtttatattaataattacatctagaaataattttatgtgatttactttattgtattcattaatgaaaataagtagcaataatctgaactgttatctttactaatgaaaatattggtttgatctcagacaacaatagaaaaatgaagaataaagcccagcatggtgacatgcacctatagtcccagcctcctcaagaagctgaggcaagaggatcacttgagcctaggagcttgaggctgtagtgtgctatgattgtgtctgtgaatagtcactgcactgcagcctgggcagcacactgagaccctatctcttaaaaaaaaaaaaagaaagaaaagaaaaaaaagatcttgtaaaggtaaactacaagggtgaagccatttataagactcttctaaagtatgtgcttcagtgcactattataataataaatgttttcccaattttgatcttatagttcaaatttaacttttatactcaaggttttattctggacatatgttcttaaaatctatgtttaaagttttgttttctgtcgtacaaacagagtactgaaatttttcatgctatcttagagttttttttttaaggctatttccatgcctagtaaattgaaacatatttcttttttgcagaccaactgtacaagaagaaagaaaaattgtaataaaaaatggaaggcaccctgtgattgatgtgttgctgggagaacaggatcaatatgtcccaaataatacagatttatcagtaagtaccttatgccaaaaaataagtcgatgataacatcccaaacttttacataccaaagaaacatttttataattaaaagttacccaaatttcaactttggctttaaatgggctaagcctggacatagttttatatttaccacgaaatgtggaattggtgctatttccaatgcaagattatcaataggtttagtaactaaaagtttagttctaattagttatcctaggtaacccaataaaaatattttacatttgtaaatacccaatatgcaaatagagttggaattataccatagttttgcaaattcatgttagcatgtagtgttccatcctttgtactgtgactattttcagatattctatgcaagaatcagagatgcctttgcagattccagtgatgagaattttcattataggggctggatttctcttacataacacaaatgatcctgaatacttaatttacttaacacatacttactgagtgcctgtgtctcaggtaatgaagtattaggaacagagactagtaagcaagacagaactcttccctgccctcacagagcttgttgtatagcagagaagataggctagtgcaatacagcttagtgcatggcatgatagaggagaccaggatggcctggggataggtagcaggttggcctaacccaagggcagggaagcattgaggaatgttccccagggaggagataccaactgaagaatgagtcagtgcaggccaaggtattgaaggggagtattccaggtagaagaaccagcatggcagatattggaagtgaagcatagcaggaggaattcgaggaactgaaagatgatgagtaaggttggagtgcagagtgtgaacaaagaagtgttcagagataaggaagaggccagttcactcatatcaagaaatttgcatttttacccctaaaagattaagaatactagcaagagagtgatagaagctgggtaaaaatagtgaagttatggcagggtgtttgagttccattgtcaaagctaaatggagctgggcactgaagtggtaaggattgatcttattcagtaatactcctgcatagggaagagtccagtgtgaactgaacttgacttcattttggcatagatgactgggtgttttaaagggaatacgagggaacagggaaagggaatgagctgggggaggagagagagtgaggtgtggttatttgaaacctatctgggtttactaattgtttgcttataccacatttcaaagagtcagctctctggtccttaagaagacaattctgggtgatagatttacatcacaaaggggcagaaaaagtatttataattgcaagctttctaaggtaactgttctaagaagggcttcagcatctggctgcctgtcaccaaattttggctggaatggcgaatcctggcagcactgagttttctcaggcagatacttttagtggggctggggtcatcctaaggatgcagccttgagctgttagaaactatgctagtggggtaacttctaagtagggagggtggacaaaatcatttttactcaaagtctctaggtttttataggtcaaagttgagaactagtccagaagagggctcagagaaaaaacctgatgagaatttggtcaaggacatggggtaaaacggtatggtgatgggtcaaaaaatgaatatgtagggagtagttatgtgagagagaaggtatcagagaataaaatgcctgactttcagatatcaaatgtgctgtttttctggttgatggcaagatcttatgtatggctatggaaggtgggtagcagaagggagaaggtctttggagatgaagagatcaaggaacagagtttgggaaaaagttgtccatgtgaatgttgaaatctaagataacagcaagatatgccatagaggaaaacagggatccaggtgtctgagattgcgagaaatggcgattgggaatcctgaagtttatagatagcttagattgaggacagacagtggtaaagccctaaagaagagcttctgaaccctgaaccctgaggtacatggtccatggttggatgtggcagaaaggtcagcgcccaaatgagagagctgcaggggaataacaaacagccagccagttttcattttagtgtatgaaggaaatgttaagcaaggtggttagaaacagaagtactaaggaactcttctgaggacagtgaaagaattgagatgtaggggagcatttggaatgtagatcagagaaagctcagagtagtagcgagctgggactgtaacagagtattctacctcgggctgtgagcagaggtggcagagatgtgtggcatggtgcatttggctggccatgagagggggatgtgaagggaaatactttgaatgacatctagtttaatttataatatggattttcatatcataacaagacttgttggtagtatataatgcatgtcttagtctgttcaggctgctgtaacaaaatatcatagactgagtagctcataaacaacagaaatttattcctcagagttctagaggctggaaagtccaagatcaaggtaccagcagattcagtttctggtgagggcctgtttcctggttcctagatgacacctcacatggtggaatgggtaaagggtctcttactcatgtattcacacagtggaagggataaggggtctctctcaggccctcatgaacttgtcatctcctgaaggccccatcttctaataccattgccttgagggttaggatttcaacatacaaatttgggagagagacaaatattcataccatagcaacctaagacccaatgtctataaacttgttcattcttttttaggaaatttttatatgtggtagtcaaacaagttaataagtaccaatctttttattgtctttaaaaagaagactatgtctttgagaggccgaggcaggaggattagttgaagtcaggaggtcgagaccaacctggccaacatggcaaaaccctgtctctactaaacataaaaattagctgggcatggtggcgcctccctatgattccagctactcaggaggctgaggcaggagaattgcttgaacccaggaggccgctgcactccagcctgagcaacagagtgagactgtctcaaaaaaaaaaaaaagaagactatgtcaacataagaattttttttttcagttctcataataccagtaggatatagcttttcttgagaaagtaatataagttaaatataaactaagcaactaaatattagaactataagtttcttaaaataatttcctgttactgtttccctgcccatctacttgacctcaagaatattacccttgggattgacttatttctttttttctttcctttttcattctttttctttcaaaacgtatgttacactttaataaagcaagatttgaagaactaaaatagccttctgtctaattacaataatgttttaaagaaacattgaactcttacatttaaatctttacaaagtaaatggagtaatttttttttcaagcaggcacctcagaatattccagaatattcgtttctattacatatgctttttctaacttgagtaggagttgatatagaactgttgctatggtgaagtgcattctatttttcagggtaaaaatttatatatagggatagtgttgagaaagaacttacgtaaaattcaatttaaaatattttatggatgttaattataaaatataccctgaaaataatttcaaagttaaatgacattgttgtttttgataatcatgtggttttaagaactggtgctttgtacatgtaactataagtatacttttctgtattctgtattacatgaacttattatagtgcttctgaataagccaactttctgcccgcttttcctctcccagttttaagaatactttttaaaatactctttctttttgtccccttccttgattcactatataatccaagcatttatacatgtggtcaccgctggagctccctcctccaccctgcccacctccatggattctctactctgcagccacagggcttctggaacgtgccatgccactctcccttttgaattcatacttcacactccagccagattggacttcatgccgttcccaagtcactgtgcctctgggacttggcagatggttttccctctgcttagaatgtcatctttccccaccccacccactcccgcctcacacactccaacatccacccacccaacacccacccgactccccagctctggcttgttcaagtcttgccttggatgtcagctcttgcactcagccttcctttgcccagctgggatgggtaaccctctcacataccctcgccactctatttctccacatctcagtacttattccaccaaattataatcattctttttttatctgcctttcccagtggactgtaagcatgaagagaacagggactacatctctgtcacctatgtgtaatcccaggatcagtcacagttctctggcacatagctggcacctaatcagatttaataaatcagtaaggattagctagaagccttcagcagtctccaagtctcacttgaaatttttgccttttattttctacacaaaatgttttttttcaggatattatatggggattgccccaatttacagaataattttactgtcaaactaaaagggaaatttgggatcttttagtgtaaccacgtcttcatacttctgagtaaactatggttcagaaaggggaaatgatctgccagaggttgctcaggttgggtcgtcttgaactgtttcccaaaacataaacatattttaaggcaagccagtgctttccaacctttttcactttgcatcacacagaaaatgatagtattttaatggaacactggattaaaaggagaaggaagaggttgctcagaggccaaggaggctggcccagggactgtggccgccccagccccacccaccacctgtgggttaaggggtcagtatcttggcacccctgtcaccttgtgaggcagcccaggactgctgcttagggaaaccccagcgaacccactgcaatctcaactctcccaggattgtttgttaaaccaaatgactcttttttttttagtggatggattttcaacagcagttaaagtcggggttttcagttcatttgtagggtttttgtttttagtataaaaaatataaatttcaactaatggaggggaggggaaagagtggttgacagcttctcagtttgttgggtgggaagaaaatgagtcaaacgtgcacaacaggaagattcccaggaagcactcgaaccctgtagctctctagcccaagcagaattcacagcccaggtgttttattgctggggcagggtagacattgagatgctagtcacagtcccttcttgtgagatcaagatgggcctagggtgcttcagtcattagctccgcatgtggtatggaatgggtgctcacacatttgttacatgaacaagtgcttgaagctggtaaagatgaacagatttcccaattccttcccttatctcagtacaaataatgtctagctggcccagaaatacttgctttggctgtataaaagtttaaaagactagttacagtaatattcataagctgttgacaatttgtgcctaattaccaagtggaacagtaataatacataccataaaatatgtctgagctttaagcttaatttaattccatggctaaattatattctcacagattctgctgtaaaggtgtttttcacatagcatgatctttgaatcatgagcccatggattaaaattctaggaaacattaatggcaattgaatattgttttcttgtcagtcctttcctctggttctcctctctcctgcttctgaaacaatggatagagaaggacatttgtctgataaagtgttctgacctgcactgctgtctctgcccagaatggccctcccctctcttcttatctcttacctgtctgcattgattggactcacactgttcctgcaggacccaacaaaacactgcctcttcctgagagccttcaccatcctctggccagaaaaaatccctttctattcaagcactttctttgctctgtttttaaagctctcacatactacttttgttacacaagtgtagtgggaaagtggctcacaatggtaggagatttaaattaaaatcctgctctgctgtcatttcactctcattttggatagaccacgattacttgctgggccttagtttcctcatctgtaaaaggaggtggttaagctgggtcacagccagccctcacacccaggggaatgtaaattgggcaggatccaggtgttggagggatttaagtcctgactttggcatctcaacatgcagctggtgccgctctccagcttcattttccctctttctgtttctagttcaccttgggttaaaagtgcaaagatttggctgagagctcgtctggaggaggctttgactcaagagtctcttaccataacctgctgttgattgacattttcgaggaataaaacactttgaaactaccaaactttttcagcagtctgcagctgttataaaaatagttctcccataattcttctttaaagacagttgtcaatatttatacctgtcaaggaagatagcacttttttttttttttttttttttttttttttttacagaaaattagcttttcaggtcttagaaattaacatgtgacagttttattttattttttttctgctgtacatctgctgacttcagggatattatgactgtccattattctagtgtactcaatgatgaacacatggagtgaaagcatgtcttctcctatttagtagtgactatgattccctgtcattgagcaagcgtccccattgagacatgtcagaggatgaacttcacttaacattccagttctgcgacttagttgctgggaaagatatttagctttaggcctctgtttcctcacctgtataatgggaatccagtaatattagtattaccctgtgacattgttgtaagaactaaatgaagtgatacatagaaaatcattagcacagtgcctggcacttgttatctgtgattttcttaagatatcttgaagtttgtcttttatttttagatcttctcttcccccacagaagttgacattctatgtggaagttgcttagttatcacaagttttgactcactgtttagatactggataaacaatactaagatcttattgattgatgctattcagacagatattgccaatactaaagggaacacttaatagaatgtacttctagtctcttcataggtttgccaaggcagtcctctctagttgttatccagcaacatagtcccttcagcgcaatacttccagcttttgtttgctatcattaattaattcattcatccccctttagtttcttgagaacttgctctgtgtgtggcctccttaggcttggtgctagcccagctttgggcactgtctaggccagtctggtattcccagtaggctccagagtgtgtggagaggtggttattgccaactttcagattctggctatttggttagaacattcactcatgctaactggtcctgccgatagattttatgtgtcttttatatctgggaacccttgatgtgtgctgcctcaaatacgcacgatctttctaaaagagattagcacattagatgagtgaaatttcttgaccatttccttacttattgtgtcatcttgggaaccgtggaaacaagggggtcatatattcttgacagatttttatagagaaagcaaatgattgtttttgaaatgtaaacatggtggaaatctctgctgtaatgccttttgtgtattacattcatctctttgatctatttattgggtgccttctttgtgccaagccttgttctaggcaacggggatgaactagaagacacaattcctgctctcatgagaacttactttctagaagtgagattggtaataaataagcaagaaaattcaggtaatttcagagaaggttgaaaacaaaataaaatgggctgatgtgatagagaatcacagagcagaggggcttctgtagattgggtggtcaaggaaggtgtgtcctgggagttgatgtttgagtgtagacctgtagaaaggccttaaggcaggaatgagcatgttgtattctggcaggtggaaggagagcagaaatcaagtctggctagcaccaagtgaacatggtggagggtggtagaagaatggatcggaggcagacatggcctttagactgtgacctttagacacttagaagtgctctgaggatctggatgagggcttttagcaaaaaacaagttctgttttactttttatgacagtcactctggctgccctatggagagtggattgtgggcagaggagaagcaggaagacccagcaggagccactgcagtcacctgcctgggcagtggcactgggcatggagacaggaggttttatttacctagaggacctcctgattcttcagtcttgtgtcttttttcctgctggtgtttactagagtgcctgatgtacaacttatctcgtgctggcagtctcttagggcttactaagaaagccaccatgttgtcacctacaaatatttgagtttagtgggttgaacacatttaacttctaaagccttgaagttagttcttctttgacatcctcaaatcctggggcaggggtggtgggggctggaaaaaatctgtctctacaacagtatccccaagtctgcccaggttcaccatgcaccacttttcccaggtacttcatgcaaacgaattccacaacttctcatcttccaagcaaatctggcacagagctctggtgccaatttaattcctgctctttcattccacccagggccacatattcaagcaatgtacctgaatttaggatgagagatcttatttaattcaactccctgattttagaggggaggaaactgaagcctagagaggtgtattggcttgtccagagtccacactagaaaccacctttcttttgtgggccaattctttattcatgtttatacttttattttcacactctgttattttcttgcttatcaaggctctcatagaaattgacgccacagtgaaaatttttgtataatacttgacatagtatgcattcaatgaacaaatggttgttagtactctcattgctgtagaatccatttacaaataagtgttagattaagatttgaaatataaagaaagggaggaaattgctccttaattccaaagatagccactgttaacattttggaatgtttcctttgtctttctttgtaattttttttaagaaatagccattttttatataaaaatttttatatcctgctcttttagttaatattataacatgaatattttcctatattcttaaaaagtcttaagataacttttaatggcttcatggttttcaacaatatggatataccataattgccttaatattttctctgttgtatctactctttgctgtcatgaataatcctgccatggtacctcacagaattgattctttaaaaaaacaaaacaaaaattgggggcacatagtaggtgtgtatatttatggattacatgagatattttgatacagacaccgaatgtgtaataatgttaccctcacatgagggtaactggggtatccatcacctcaggcatttatcctttctttatgttacaaacaatccagttatactcttagttatttttaaatgtacaataaattttgttgactatagtgaccatgttgtcctatcaaatactagatcttattcattgtatgtaactatatgtttgtacccaaggaccattcaccttcttcacccctactacccttcccagcctctggtaaccatccttctgctctttatctccatgagtttaattgttttaattttcagttcccacaaagaagtgagaacatgcaaagtttatcactttgtggctggcttatttcacttaacataatatcctccagttccatccatgttgttgcaaatgacaggatcttattctttttttatggctgaatagtactccattgtgtagtgtaccacattttctttgtccattcatctgttgatggacacttagtttgcttccagatcttggctattgtgaatagtgctgcaataaacatgggagtgcagctgtctcttcaatatactgatttcctttcttttgggcatatatatatatacctagcagtgggattgctagatcatgtgttagttctatttttacttttctgaggacctttaactcttatccataacagttgtactaacttacgttcctaccagtagtgtacaagagttaccttttctccacatcctcaccaacatttgttattgcatgtcttttgaatatgtcattttgactggggtgagatgatatctcattgtaatttcgatttgcatttctctgatgatcaatcatgttgcacctgttcatatgcctgttgtttgtatgccttcgtttgagaaatgtctattaagatcttttgcccatttttaaattttttttcagtttttttcctgttgagttctttgagctccttgtatagtctggttagcgttcctttatcagatggatggtttgcaaatattttctcccattctgtgggttgtctcttcactttgttgattgtttcttttgctgtgcagatttttatttaataacttgatgtgatcccatttgtccatttttgctttcgttgcctgtgtttgtggggtatttctcaagaagttattgcccagaccagtgttctgaagattttccccaatgttttcttctagtagtttcatagtttgaggttttagatttaagtctctaatccattttgatttgatttttttacaaggtgagaggtaggagtccagtttcattcttctgcatatgggggtattgaagagactgtcttttccccagcatatgttcttggcacctttgtcaaaaatgagtgcactgtaggtgtgtgaatttgtttctgggttctctattctgtttcattggtctctgtgtctgtttttatgccagtaccatgctgttttggttatatagctctgtagtataacttgaagtcagataatgtgattccaccagttttgttctttttgcttaagatggctttggctattcagatccttttgtgtttccatataaattttaggattattttttctatttctgtgaagaacgtcattggtcttttaatagggattgcattgaatctacagattgctttagttactatggacacttaaacaatatttattcttccagtccatgcatgtggaatatctttccctttttgtgtgtcctctttaattttttgcattagtttatgtagagccctgggaccttgaatgaacataggttgtagtcagacagtggtcaccatgggccttgggtgagacccagtgttgtgatggcttcaggtctgacccagtgagcattgaagaattaggtatttattgtagccttcacagtctagcttgtttgtacttgttcttgggaaggctttccaagtattcaaagggacttgagtgttctgatctaaatctgtggtcactgcagctatgtctgcattagggggcaccccaagtccagtaatactgtagctcttgtagactctttgagttaccaccttggtggtcttgcataatattctggaaaattccctggatttctaggcagagactcttgttgtcctcctttactttcccccaaacaaacggagcctgtctctgctgagccacctagagctgagggaggggtgactcaagcacctctgtgaccaccaccactgggactgcactgggtctgacctgaagccagcagaatactgggtcttacccaaggcccgtggtaaccactgtctgactaccatctatgttcactcaaggtcctagggtctacagtcagcaggtggcaaatccagcctgaagggctatcattgtttataccaccatgcctggcaatagtgaatgatactctgggagggaagtaattaatttgaccttaatgatatgtatatgattaggcagccttgttctttgttagccttcaacaatagggatctttttggtcactgtcacaggagtgaagacagaatgacttaccttgtaatgtttgttttctgatacattgggccaaaagacccacaggaatccacccgtcatctccagaaagtgaagtttttatttgaagtttgttctagtgtaacaactttcatcacatttcatgtttcaatagatgccaaagcaaagcactgagtgtgttggtatttctgttgcctgcttcagcagtgtctggctctcaaagttgtagccttgctacctaacctgagaccaaaatagccaagagcgttaaaactggtatgtgggttgggaaacaaacatagtgatcaggcaagccattttagaaggggtggtggaaaaaacttctccatacacttaagtcttcttaatattattttttacttttcaagcatctaaatttcccctaatgcacacaattaaatactgaaatatacattagaatttattcattagaaaatttgagatactctacactttaaattgaacttgtaccgtagaacttttaaatgattaggaatgtatgttttatagttaaaagagattacttagagtaattttttgtcttcactttcaatatgatgccccccccccctacctttttttttttttttttttgagatggagtcttactctattgcccaggctggagtacagtgtctcaatcttggctcaatgcaacctctgcctccagggttcaggcgattctcctgcctcagcctcctgagtagctggaactacaggcatgcgccaccacgagctcattattgtatttttaatagagatggggtttcaccatgttgccctggctggtctcaaactcctcaagtaatctgcccaccttggcctcccaaactgctgggattacaggcgtgggacaccgcacccggccccaatatgatgccttttgatgacaaaaaaagccttaactttaatgaagttgaaggtatcagtccttctttttatgggtgaatgcttttgtgccttaaataggaaattatttcaatccctgaggtcttaaacatattctcctataattttttataaacattttaaagtttaattttcaaatttcagtcattaatcaatctactcagaatttatttatttacttatcttttgagacggagtttcactcttgttgcccaggctggagtgcaatggcgcgatctcggctcacagcaacctccgcctcccaggttcaagtgattctcctgcctcagcctcccaagtagctgggattactggcatgtgccaccacacctggctaattttgtatttttggtagagacggggtttctccatgttgataggctgctctcgaactcctgacctcagatgatctgcccgcctcggcctcccaaagtgctgggattacatgcgtgagccactgtgcctggcccagaatttatttttatacatgatatgagttaggaatctaatttcatatctttctatatggataatcaattgttttgtaccagttttcaaatcatccttttcccatcagtttatggaattatttatcatatattaagtttccacatttttatggggctgttctgaactcttatttttcactggtcagtgtttgtgtgcaagccagaatcacacaagcttatttgctatagcattataataactttttacatctgtagggaaagttctcccctcctattctcctaatagaattcctaatttctatttagcttttgctcctctctctattttagagtcaacttactcagttaattgggggaaaaaaattgagatttgtattggaattgcattgaccctatagatcaatttggggaggagttgacatctttatgatacatatgtgaacatatgaatatgtccctccatgaaaccagtagatacagtcagtcctcacttgacattatcaatacgttcttggaaactgctggctgggtatggaggcttacatctgtaatcccaggacattgggaggctgaagtgagaggatcacttgagcccaggagttcaagaccagcctgggatggggagacctcatctctacaaaaaaattacctggatgtgatggcacccacccatggtcccaactactctggagactgtggcaggaagatctcttgagcccagaaggttgaggcacagtgagtcatgtttgcaccactgcactctagcccaggtgacagagcaataccctgtctcaaaaaaaaaaaaaaaaaaaaaggaaaaggaaataactgcaactttaagtgaaatgacatataatgaaaccaattttaccataggctaatggatataaacaaagttaaattcctatgtcatatttctggccacagaaaacatcatcaaacttctaaataaagacccaacacacttctaatattaaacattgaaaaaagtatgaactatgtgtttaagaaagattaataaaaacaaataagattattggatacacaatttttggtaaatcagggagtgacagaggtcatagtgatggtgggttaaatcaaggaataaatgtttccatagtgaaaattgtgagaagtacctcctactaccatgcagctcaaaaacgagtaatacgtgcggcagatttgtttatcacttttgtgttacatcagtttattgtcatgcatttgtatgattatcacctgccttatgaatttttacttgacaatcatttgtattcactcattttccaacccacttattccattttggagtcatgggtagccagagcctatcctggcagtgcagggcaccaggcaggaaccagccctggacaggatgccatcccatcacagggcacactaacagatacccacctcagaccggggctattacaccaatgaacctaacttgtacatctttggcatgtgggaggaaactggaatacccagagaaaatccacacaggcatagggagaatgtgcaaacacagtggccaggctgggaattttttttcccttatcaattttgtaatgaaatgacattatttgaggacctgctgtatttttattttggttttaagtcctttcaataaattttaaaagtgttctctataaagggtttttacatcttttattagattaattactaagtactttttgttagtatataggtcatatcttttttacaatagtcttctaattatttgttgctcttacagaaaaatgcaactgagtttgcatcttgatcttaaatctagccattttgctagagatcctctcattaattataatactttgtatagagattccttttggttttccttgtggacagctatgtgatctgccaatgacagttttgttttgtcctttctcatcctaatgcctttttattgttatgtttttctatctgggacctccaggaaaatgtggatatcgtgtcttgattgacctaaggaaaggcttctaccatttcaccattaagcctgtgtttgctgcaggattttggtagctagccttgacctggttgaagaagttgtctaagggtcattttgttctctcactcactcaccacttagtggtggatggtgtcgggaagaaacctgtttcccagctaaataaacatggtttaaatattagagctgtgaagtctaaatttttatatgatattttttctatatatacaaagaattgatttttgtatatcaattacctctgaaatcctgaagttcaaataaactaaaaacttcatcattccctattaaattcaggagaaatgaaatgctcaaagaacatatacatgattgtatagttttaaaagccagcagtttctgtgtagttcaatataaaaaatgttattccttttgaaaatattggaaagggaaagtgtcagacttacttactttgggtaatatatcttcttcatatatatatatatatatatatatacacaatctaaattcgaagagagcaatatttctattcatgtaaatgccatacacattttactcatcaaggccttcaaataagtttcacatctgacttttacattaggcctaagccaaatgtattttcatttgttttagttcatttcttctgtttcagttaattagtttatagggcattgggacttcatgtggctgctttgggcatcttttatttttaagaatttatgatttataaaaattatagcatttatagtttcaaaggaatttcatatatattttcttaattgttttaaactttacaaaatgcacgtaaggctaggatttctgttatttttaaattttacagatgagaaaatgaaatgtatttagccaatggctaagccagaaatggaacctcagtcttctaactctaaatggtattataatatgctttaccactacaaatcttattaaattattttagtttaccaagttaatacttttaaagaatacactgtcaaattattgattcttattgtgtgaaaaagccaaattgaacaataagtataaatactcttatctttcaaggtattggaaggcataggtttctacaaaataaaaagtgtatattttttctttttttctcatatctttctaaactaccgatttaaaaacatttctatttctgcatttccattggtccctctcatgtgcttgttgaatttggtaatcccatttgagacagctcctttaacaatgctgtcacagttcagggagccttggcatgacacacgtaacccttctgtgcggtattctctctggcattgcattcttacattacattctctctggcattacattctttcactttccattttgtacttttctctattgctttatttgtatgtaatgttctgaagtccaaataacaaaatgtcatttggaagttatgtgaattattcctaaattacataaatgtgtttgtaaggagttattgaattgtttgtgatggtgatccatgaaataactaagaaaatttatttgattttttatgatttcagccaatgaaaaagtatataaaacagtataacagacacctatttacccatcacacaaatgtcgtagagattgacgttttgtaatatttaggagttttttaagtaaataaaaaattgcagatacagctaaggtcatacgtaattaactgctattcctttttctccatcttcatctcctaacctacatggtaaccattatcctgatgttatttattatccttatgcatggtttttattcttttgtttgacatacatatatatatatatatatatataaactagtagcatataatcatgttttgtgtattttaaaaaaggtacattaatgtctcactgagcttatcttagtattctgcattgtaaataattgttttaacaattgtacaagtagatctatttattttcctcacattagacaattagattatctctatttttgtcagttatgaatacatacaaacaatattacagtgaacagttttatacatgcctttttgagcacttgtatgtttcttgggtagatgcttaaaagaggaattgctgggtcatctagaccaatatacacaatctttaactttgctaggcgtttccatattgctctccatatcttgacagcatactgtgttgaaaagactgtcctttgtctactgtgctgcagtgtcacctttgtcataaatcaaggaactgtatacatgtcaatctgtttctgtgctttccattccactggttagatatgtatgtcattgtgccaaatcacactactgtaattactgtagcattataatactgagtcatccagttcatgaacatggtatattccttcatttaattaggtcttctttaatttctttcaataatgttgtgtagttttctgtgtagagacttgctcattttgttagatttattcctaggtatttgatttcttttgatactatggtaaattgtatcattaacaatgttttattttgaattacaggttgggcattcctaatctgaaaatctaaaatctgaaatgctccaatgagcatttcttttgagcatcatattgttgctcaaaaagctttggatttcagagcattttagattttatttgtaatgcaaatatttcaagataaaaaaaaaattgaaattggaaacacttctgtccccaagcgttttggataagtgatactcaacctgtatttgttgctaaaatataggggaaaagttgatttttgaatactgaagttgtatccaaaattcaatttttatagatttccttggattttctgggagcacaatcatgacatataggaataatgagttttattatttactttctagcccttataccttttatttttatttccctctcctgcccatttgtttcacaagtgaatgttgaattttatcaaatactttctctgtgttattggagataattgtatggtttctttattctgttaatgtggtgaattacattgattggcttttgattattaaaccaactttgtattcctcaaaagctctaaatggtttgtataaccttggattgacttattaatagtttattaagaagttttgcatgtatatttatgggtgaaattggtctgtaatttttcttgtaatgttcttttcaggtttgataagatatccaaatctgaaattatttgggaaaaattcttgttttgttctctggaagaatttttgtaatattcgtgctatttctttcttaaatgtttgcaagaattcagtagggatgttctctgcatttagagtttttcttgtggaagggcttttacaaatgtaataaatataggattgttagattttctatttcttgtgtcgttttgtgatttttaaaaaaggagatagacatattaaaaaagagattaaaaagagattaaagagattaaaaagagatataaaatatttgatcatgccaatatttgattgttttatgacaggcttattttttaatctctgtagaattcattttatttttatcattatttttatcattgttttatgacacgcttattttttactctctgtaaaattcattttatttttatcattagttttatcattctgcttataccaaactactttccaggttcttattgtgttaagctctttctgtcacaagaaacacaggtatactcaagttccttcaagtaatggagatatattaggtgcaatataaagccatatggagccttaagagaaaggaattacacaggaagagcaggatctctagcacagtttggcattagggagactggaaatgtgtggctaattagaatatgatacagctttagggatggaacaggttttctttttatcccccattagtaacatgttataaggctttactttgatacccagttgtttgtgtgaagtttctcacttccttttggcttttgtctatcttttcttcctttcattactaattaccctctttacccctggtctaaataatttttcatcataccttttattttctcataactacttacttatgatccccagtgccttgtggcctggttctgtgattctttttagcctctcttcaagttaccaagtaattgaacctcactggttctcagttaactcccaaaagattatttgattggcctagtttgagaagcttttatgctagctaggcccattggctggttctggctttttttttttttttttgagatggagtctcactctcacccatgctggaatgcagtggtgctgtcttggctcactgcaacctccacctgctggattcaagtgattctcatgtctcagcctcccgagaactggcatcatcacacccagctaatttttgtatagttggggttttgccatgttggccagcctggtcttgaactcctggcctcaagcgatccacctccttggcctcccaaagtgctgagattacaggtgtgagccaccgcgcctggccagcttggctactcttgaccagggagctattgccaaaatgtgggattcacatagcccagagcatggatgccctgggctaactcctctgccaagggctgtagttggacagtttcccttagcaggggtgtgtacctggaaaatactataattgatcagtacagataagtcctagaaaattaagttgttgcaagagttacaattctgcctcgttcacatgctgtggtgaatgctagtaaataattaaatgctggtaaaccaatgtctagaatttgatgttatatcttttagtagtcatctacctataactgaaaaattgctgccaaaaattacatgtgctgccaaccccaaatagggccatgggcaaatagatatgtaatacctgttgttttaagatggacaaatggaaattgatagtctttaaacataagcaatagggagaatatgcacataggcagattaaaaaatgcttaatgagaaagccatagcagttatccacttctggtcttatttcctttttaatacccaggaatagctgtgtgtactgctaagaattcacttttctgcagtatcacacagttcaggttgaagacagaggaccgctttccttttgtgatatttatgctacaaagtaatgttttgcctaatgcatttccacttatgagataaattgtggatattatcaaaaacttttctggtacaataagtgaaattcctttctaattttcaggaggactcagagagagtaatgataattaccggaccaaacatgggtggaaagagctcctacataaaacaagttgcattgattaccatcatggctcagattggctcctatgttcctgcagaagaagcgacaattgggattgtggatggcattttcacaaggtaagtacgttaattcagcttgcatatattcttgaaaataagtcaagcccacattatcgcatgaattttccttttgtgtacatatttagatgctcttaaagcactcaacatttaggagcttaaataaattatttcaaggccgggcacggtggctcacacctgtgatcccagcactttgggagaccaaggcaggaggatcacttgagtctaggagtttgagagcagcctgggcaacatggcaaaaccccatcttgacaaaaaatgaaaaaattagccaggaacctgaggtgggaggatcacctgagcctggggaggttaaggcaacagtgagccgaggtcacaccattgcactccagcctgggcaacaaagtgagaccctgtctcaaagaaaaaaaaaaaaacaaaaacaaaaacagaaaaaaaacccacgttatttttattatgactgttaatactagaaaagacttaagagttaattttgtccaatagcttccaaattatttttaattattgagttattttattttatttattattattattatttgagatggagttttgctctcgtttcctaggccagagtgcaatggcactatctcagctcactgcaacctttgcctccccagttcaagctattctcctgcctcagcctcctgaatagctgggattacaggtgcctgccaccacgcccagctgatttttgtatttttagtagagacagggttttgccatgttggccaggctagtcttgactcctgaccccaagtgagccgcccgccttggcctctccaagtgctgggattataggcgtgagccaccacacccagctgagttcttattttgaagaaaatcttttgtagaaaatcaatatttaagcagataaaaacagatctgctctgtcttctggggtagaaggcttggagacttggctgttaggctctgtagagcacagtctgaaaacttgtccatcctccccattttaggtgcagacctgaaacaaactgcaaaaggcattggaccaagatcattttgttgatatccctttttactctatgaacattacatgcaactgactaagtcttaccctcaatgtgtaaacctaaattttatgccgtgttaggaatatgagtgaaatatcctggcttcactaaggagaattcgtagtttaatctgtttaacaccttctgatttatcagttcttaaagcatcgtgtatatttcttacatgtacatttctaaaaagtaaatacagtctctgtgcatagtcaagctttgtgtatagagtgtcttgagttgttgtccagctacgtatttatataatatttgactgtggaatcacatcagaatatatcacatgctaatattgatattcttgagtagacactaaaatgctttaaagcttcatttttcatctgagaatgaacaaagtaccctgaattctgtttgatgccatgtcaccaaataggtgttattctgatccccatatatgtttaaattaactcaaaataagaaatttaaagagtctttctttagttcttaagacttaattgattttctattttataagaaaaacaaaccaggtattttattttggttacagtattaaggaaagtagcagagatatttagtaaagaaaaaaaaaagagaaaaaagaaaaaaattattggtcaatataaggggatttgcctggaaggaaatcttgttactgagccgaatagcaagaatgtttgtagatacaagtaaaataaaagaagggtttatttttgtcatataaggagaaggctggaggtgggtagctacttctggtgtttcagtggctctgccatttcactggcctttccctcagagttgtaagattgctgctgcagctccaggcatcacattcctattcacatgaggtaaaaaggagaagggactgccatagctcccccacaccctttttttaaaaaatttttttaggacatagtaggtttttaggatcctcccagaaaacttacctttcactgaccagaactgtgtctcatggccatagttgcaaggaaaacagaaaataagaaggtagtttttgtccagcttttaaatagagttaagcacagtaattgggaatacaatcagtggtaatcagaaaatagtttctgtcacagggtgtggaatcagtaataatagtaacagccaacctttatgatatatttacaatattagtgtaatattcttatcaaggtacaggcactgttatgtgcaccttatatagagtactttatgtaagtacattcaatgagtacatgtctaagccttctaaaccatgctgatttcaagaaattggagtatttatccattcattttcatttattcattcatccaacatgtactaagtgaatacctaacatatggcaggcactgagaatacaaaggaaccacagtttttgatttcatgaaagctatgtagtggagaaaatcagcattaaccaaataatcacatacagaaatgtgaaactgcagctatgacaagtcaatgaaggctatatgcaagatgttaggacaggctgtgatcctgatatgatctggtcaggaaggtcaggggaaggcttcccttagcaagtaacttttgagtgcctatctgaaggatgagtgtaagaaggaaggaagtatatttcagagagagcatgtgcaaaagtcctttagcataaaaaacatagacaatgagtgaagggtggtcctccaggagagcaagattctaggtgaagcatagccatgtcattttaggagtttatcctaagagccatggtaaactattgaagaattttaaccagggtttggcatgattatgtctgcattggttacactgtaaagaatgtctggagaaaaaaccaagtagatcagaggaacccaaagagcaggctcttttggtggtcttggtgaaaggatcagtaagtagcttggattaagtttgtagtgctagtttaagtggaaaggagtcatatttgaaatatatttgggaaataaatcaccaggacttggcgatagataggggtatggcagctgagataaatggagttgtcagagatgacattgagtttgtgcatctgaatggtgaatggtgacatttactagaagaggatgttttttcatagattccgacgttatctttgtgtataataagtagaattattctgagacattcaaagggagctatcatatagtaggcagtggatataaagtttagatttcagacagagagatcaaaggtaaagatgtaaatttgttgtgagacatttttgtgtacgtgattgggtgtggatgagatcatcttgacagacagtatggtggagaagattaatgttctgagactgaaccttaaaactgccaagatttcatagttgagtaagaagttaaggttgaaaaccaacaaaggaggtgtagccagagaggcaggagagaaaaacaggacattacagtgtcatgggagcgaggggaaagagtgcttcaagaagaaaagtagtggtcaacagtgctgaaaggtcaggtgagttgaagcctgaaaagtcacctttggtcttagcaaaatagctgtcactaatgaccttagcaggagctgctttcgtggagtggtggggccacactgcagttaaaagagggctaaagagtgagttagaggtcaggaagtagagggggttagtacaggtgatactgcaaaggttggccaggaagaagacaggagagatccagtgagggacttgttttttgtttttaaatggtagacttgaacgtacttcaatgggatatccagtgggatatgttatttccaagaatttattattctaaaaataaataaattaattaattaatcacctttggaggatcctagaatgaatcctaatgatacttaaaatcaaaatatcattagtcacatggaggttgaaaactgaaaaataaagatccaagcaggtatcctatcttttcaaataggtaacggggaagtttctctttatagaaatgttccagccaataaaccaagcaggaatgacaagaattagagtatcaccctttttgcaacccctgatgtaataacagatttaagtaataatcagaaatggctgctaatgtcaccaaagcagagacaaccagacattaggtaaaagtttgtgacaacttatgatgtcttctggccaaaaaaaatcaaactgaatagtcgggcatggtggctcatgcttgtaatcccagcactttgggaggccaaggtgggtggatcacctgaggtcaggagttcaagaccagcctggccaacaatggccaacgtggtgaaacccgtctctactaaaaatataaaaaatagccaggtgtggtggcaagcacctgtaatcccagctacttcagaggctgaggcaggagaattgcttgaactggggaggtggaggttgtagtgagacaagatcacgccactgcactccagcctgggcaacagaggaagactccatctaaaaagaaaatcaaactgaaactgttcagacctctagatctagataccaatttacaagagaaaaagagaatagaggaacatgttaaacaccaccataggggtactgtcagcaaaatctagactgtgggaaactataggacaaatgactggtgtttttttttttttaacaaataaatagcaatgacaaaaaaaaaaaaaaaaaaaaggtgggggagagagggaagagaacctgcatattaaaagagagttaaagaccagtcacccagttccaacatacagatcttaattcaatcctgactcaaacacataaacctttttttttaaagcactagtgaaacatttaaaaatttttgagcactgacagggtatctaatgatactgaagaattacttaaaaaaatgtttaagtgagataaacagtgcaatgcaatggttatgatttaatagaaaaatccttactttagtgatacatgctaaaatgtttacatattaaatgatttgctacccaagatatacatcacaataatcaaggatggatagggaaatttggtaggatagagatgaaatgagattggccatgaattgatcattgtttgagcttgataatggctacattggagttgcattatgcatttttctttattgtacatctttggatttttttataagtttttttgttattgttctgggatttagccatttgagaaagagataagatccctcgtgtaggataggcattgtttcaaactgtgcgtatgaaatcagtgcattgaattgcaattagcattttggggtaatacttcctagatagtgctttgtgttccacatcatggcatatcagggtgcaaccaatgtccagttgacccaaataagctttttttttttaatgcagtagaatggagtagaagaaaaagtatcaaaatcattaatttatagcatgtggcacagaggtggagttatgcaataagaaggccattacatttctgtgtcatcagtaatgacatagaaattataatgttattaggagatgttaacattggcccaataatgagatttaaactctgttgtgctaaaaacatatgtatatataggacaagtcacccagttccccatatatgtgtgtgtgtgtatatatatgtatatatatgtgtgtatatatatgtgtatatatgtatatatgtgtatatatgtgtgtatatatgtatatatgtgtgtgtatatatatgtatatgtgtgtgtgtgtgtgtgtgtatatatatatataattttttttttttttgagacggagtttcgctcctgtcgcccaagctggagtgcaatgacacgatcccaggatcccagctcactgcaacctccgcctcctggattcaagctattttcctgcctcagcctcctgagtagctgggattacaggtgcccaccaccacacccagctaatttttgtatttttagtagagagggggtttcgccatgttggccaggctggtttcaaactcctgacctcaggtgatccgcccgccttgacctcccaaagcactgggattacaggtgtgagccactgcgcccggccaaaaacatatttttattaaaaccttagtgcactgtagttttatgctagacgttagggatacaaacctgaataagataatttacctgtctttaaggccatagggcctgtgtccctgcatattcttactgagtatgccaagaaagcccctgtctttaaggagctcaagtgcagtaagggagatggagaagcaaatctttacaattcggtaagaccatgcaatgctagagaagtgtatgtgtatacgtgtttatttgcttgctcattccttcattcatgtttttcctgtcatcttccagaaaggaatgagacagcttgcagaaaattcaaaatagcttaagtgaataaataaggatgagggcttaaaatggagccatgactgaggcttaaaacatcaatgcccaatactgctgtggataagccataaatctggttcaaaggtttccacaaagctaaatttgttcagttaaatagttcacagtgcccagaaagccaaatgaattaattagttaagaaggcaacttaaaacaaatttttattgtgtttgacagcaatcttttagtaataaaatcagctagaagaatatattgggtagtatcacacagactaggttttattgggtcccattggttacagtttaggaaacaaatgtttgattatattattcttggatcacaggctccactgagacagaaattgtgcttgttctgcacaccttttatcccctattcctagtactaagtagatgtgcagtaaatatttgtttaaaaactgacaataaaaactgtaatataaataagatgtgttgacataactctgtttcttagtccaaatttctggaatctgaaggaaacatccccttgtgattcaaacaccatctaaaatagtatattggagcttaactaagttttgccacaggactcaaaaagtcatcaaatttctatgtaagtttcggtcttataaagaaaacacttaagtttaggtatgtggcaggataaattattaatacacaggaaagagcaaaagttccagtgtcatggagattagtctgtcctgacaacactctgtgtaccagtgcacctttgtgatgctgagtaagaggagatttgcacttcacgaaggtccaggttaagcttagttgctcagtctggactctggtccctaaagtgggaagtctcaggcaaatctgagtatcagaccatgccggcaattcagctctcttcacctgcttctctctctgcaagatgggataatcatgatacttatatttcagggtgttgtcatgtagtttaaataatgcatataaaacaatctagtacctgacatatagtagttccttggtaatattagttacaattttaagtcccatctctatgacactttgaccatttcattccacaatgatctgttcacggtaaactcctaatgccctatttatttggactcagttatttcagtgtcttatttcagtatctatcttagttcataactggttatcctatgccatcatgctatttgttcactatttgagggaaagaactctactccattgtgtattccctgccccactcaggatggcagtaagtacagctactaatataaattaaagtcattcagaaatgaaattattttcacatttatattacattgttttcacttcatcctggaagttatcattagtctgaaacaaacccagagatactgatcccatatttcaaaattgaccacaactttaaagcattaattaattaataaagaattacacgtgccagtttaaaaagaaatatgcagattatagagatttaaatactgaaatatgggacattttcctgtgctctgccatttgagtagctgttagtttatcaaccttcaggtcatgtttatagaagcactctgccacagggcctgtgtccctgcatattcttactgagtatgccaagaaagcccctgattgctttttacatgggccacttatttgtcaaagttgtgcttgcagcaaacaacctggagggataagttaattctccccttaaagaggaagcttgcttcccttgttgtatgcacagcatccatggtacatcaccctcacaggacttgggggctaatgtaaaccaacatgagtaataaagtcctttgtctctgacccagtggccttgtgtcttctgccgttatctgtgaaaccagtggtattagggtaacctgttagcttttaagcagagtaaaatcctagacttcacacagtttttgataggtcaataggattctcagatctcttgctaatattaattacctgcaaaatgtgagtaaaccggctgtgtatgggaaagaataggggctttagatctagaaaactcaagattctgtacaagttctccagcatcctggccatgtgcaagttacttcatccttctagaaccctgagagaagtactgtgccatagtcaagagaatcagacatgttatacttgagcacaaatcttgcttttcccttttaacaactatgtgacctttttcaaattactacttctcagtgtctcagttcttttcctgtaaaatggagttgatactgctaaccctcatatattattgtgggaattaaataaagtacatgaaaatgccagacacattgtaggtacctagtaaattttagttttttttcttccagattctatgccattagtattttagatttaaaagtctgtcttcatatatgtgtgagtatagtgctcacttttctaaacttagcatcggtttttgcacctataaaacaaaaagttcgataataccgacttcacaaggttgatttgagaataagttttgaaaggatgtgaaatcactatgaagtgcttctcttagttgttctcattgaaagaagttgaccaaatctaatctccctgacactttccctcttggagcactgtggccataatagaattgagaatccaggaacctagaggcaccacccacacagaatgggataatggcagtgcctttccttctgttcctcaggaagtggctggcatggaaggtggtctcatggaagatgcacatcctcctccatgctgagacatgcctttatctcatgactcaggaacagccttaaggaactggcccaattgccaatcactgtgtgaaagaacaaccaccaaatttgttgtttcagcatagtaggattcattctcaatttattccatcaaacatactagttttttagctacttcgggatatattttgcagtgacttggtcctggtgggtagtgttatgtggaaagatacgcttgttacaatatgtgaaaaagagccagttacaaagcctggcattcatttcacttttgtatgagtaattgtatgtataaatatatgtggagaaaaccatctagatagaaggcttattccaaaataccatgggggatatggctttatggtcatttttcttttacttatgtaaatttttaaatttctaaaataaatgtgtgaaaaaagtaaaacctcctcaccctcacaaactaccagtattggtcaaaatgagatgttttataggaatctggtgaaatgcttacatggtcactgtctgacaactctttttttctggggcaaatatctctttcctactcagggacgtggaatttggggttttaagctttagaccatcctgggcacttcaatatatcagaccttacttgtccacaaagtttttcccagactataagtaaccctagttcttcttcctttaggagttgatggcattctgtctgggagagaatacaagattcatgtatttaattttcataataaaaacactgctcatatggcactcttaatcttcagtgcacattaaattttttttttccatggagctttaaaaaaaatactgatgcctgaaccctacctccagaaatctttttttgttttgttttgttttgttttgtttttattgatcattcttgggtgtttctcgcagagggggatttggcagggtcataggacaatagtggagggaaggtcagcagataaacaagtgaacaaaggtctctggttttcctaggcagaggaccctgcggccttccgcagtgtttgtgtccctgggtacttgagattagggagtggtaatgactcttaatgagcatgctgccttcaagcatctgtttaacaaagcacatcttgcaccgcccttaatccatttaaccctgagtggacacagcacatgtttcagagagcacagggttgggggcaaggtcatagatcaacagcatcccaaggcagaagaatctttcttagtacagagcaaaatggagtctcctatgtctacttctttctacacagacacagcaacaatctgatttctctgtcttttccccacatttcccccttttctattccacaaaaccgccatcgtcatcatggcccattctcaatgagctgttgggtacacctcccagacggggtggcggccgggcagaggggctcctcacttcccagaggggcggccgggcagaggcgcccctcacctcccggacggggtggcggctgggcggaggcgccccccacctccctcccggacggggcggctggccgggtgggggctgccccccacctccctccaggacgggggctgccccccacctccctcccagacggggcggctggccgggcgggggctgccccccacctccctcccagaaatcttaagttggactggggcatggtctggaagtcacattttaaaagtgtcccagatgatttcaaagtgaagccaagatgtggaagcacttcctcaagccctcgctggagaaatcatgtgttgaattataaaaataataggtgcttattatgaaatgtaacaggtgtactagggtatgaagtgaaacaaaaacaccccattctccccaggtctaccatgtttctttaggtaacatttcacaagtctacaagtatacatcttttcttttctaaaatggtatcatactaagcattactattgtataacttgcttttgtttcctaatatgtgggagacatatttctctatcagtttatacagattagtcgtgctctttttaatgactgcagtgtatctggagtacagatactccttgatttctttaacctctgagagctccgtctgggacagactgccctttagtatatgggacatgttccctatccattccactgtgctcccacatcttcctgttgttaccactggaaaggaatctacatggactacattaaattttatccctaggatataattatatcccattaaattatatccctaggatatagtttaatattacgcccttgtagctttcattgattttttatgaaataattcagacgtataataatcctccatgcaccttctaccctactaaagaaataaaacactacaatacaatcgaacctctaatcctccctaatcccattgccctctaccctatccatagtaactaactggttgtccttgactttggtatccatcccatgcatttctctacatttttactcactgatgttttttgaaacaatgcatggaagtatttggtatgcttttaaactttacacacagtgtatcacactatattcttctgtaagtggctttttcccccctcagtgttatatatttataaaattcatatgggtacatatactttgagttcattaatttttccctaattatgatagtttattttatgaatatattactattccctcatttttcttgatatgatgccaattttttgcaaatataaacagtcatatttgtgacttgtctcatactcaactcctagtgcacacaagggagtttttctcaatctaggagtggagttgttggattgtaaggaacatgtgtctttcatgatctccaaggaggctgtaccagcttagaatcccaccaccagtgtttaaaagtttgttctcatgcttaaaatagattagaataagaaatgttcatttgatgatatttctatatattctccaaaattgctcataagaacattttcatttttattacttaatgtccttcacatgaagtgccatctggtaaattatttttttgttaatgctagggacattttttctctccatgtgcatactgtgcctgtttacaaaaagatttgaagcaatttattggccttttctgacaaactgccaggcttcctgctatcagccagtggctgcttcctctttaattcctttttgtcttggctgccaagacagcaagagctaaactcaaggctcaggtgtggaaacaaatttggcttagttttccccttcgcttcttttatgggagtatttctctagtgtcattcttagaacagctgcatcagaatcttggcggtgctagttaaaaatgctacttactaagccctttcacacatctttttaattggaatctccaaggtggtacacaagaattagcattttaaaagctcatgctaagcttaaatgtaagaatctactgtatggcttgtaatcttagtttcatgtaattgtttcattagaatatgttattgtaaatcacttcaaatgctttttgtactcaatggaaaaaatattaaaatctagcagaatgagatatttgcataagatttagctccaagctgtatctgtaaatagattctattatcaattggccatttagaacactaggtttaaatctgtggattccataaatattcattgagtgcccactatgtgctatacagtgtgcaagaagaagaagtaaatggatgaaacgctataaacagacaggaggttaggaatttttttttttttttttgagatggagttttactcttgttgcccaggctggagtgcagtggcataatcttggctcactgcaacctctacctcctgggttcaagcgattctcctgcctcagcctcccaagtagttgggattacaggcatgtgccaccacgcccagctaatttttgtatttttagtagagacggagtttcaccacattgggcaagctggtctcgaactcctaacctcaggtaatccacctgcctcggcctccagaagtgctaggattacaggtgtgagccaccgcgcccggcctccagaatcttttatctgaatactataacctcacatgaatcttttcctgaataagaagcagatttttttaaaaagtagagttttggcaaacacatacatttgtttctaatggatatatctgtgcattatgatatgtgtactcatcgatgaaatatttctagacccatatttccaaggatcattaacatccttgaatgcatcactgagataagatctgtttattatcttgatgaatataaacttaaatctcatctagccttttagactcagtaattaagttttagaaaagcaatgaattattaagtctcattagaaaacagtttgaaaaaagcaaaacaattggcctcttctctcagcataatttatttctattaaacgttggtgattaagcgttgatgaaaagagatatttactcgatgtggcccatagctaacaattttcatgccatgctacttacacaaactccctcttctgacacccagcttcagggaattctgtgtactcagagtggcacgagtgtgtttttcttgaaagagaattggaagataatagacattcaagtacttagtaacttatttgtttgcccaacttagtgtaattcagaaaatattgagcactgactgtggagtatttgtactctatacaaaatatattctttatggacagaaagaaaacatcttgaatcagtccacaccttctaattagttgtaaataccagtactaaaatccacatgataagtgagcactaaatgagtaagttgttatgattttattggcattaaaaatgtcatcttatcaatatctctgtgctttctttaactgtgtctagcaaacactagttatcttatttcatctttttcatgggaaattattttatgaatttaaggcttgttcctttaattagcttcctcaaagtcacctgaaggtttggtttgatttggttttaaatgcaaatcccaggcaaatcttctgattgaagatcccctggagatagatactgttgtagtaggtatgatgaaggaggcctttagacactatttttttaaaaaagactttaatttttcagagcagttttaggcttacaccaaaactgagaggaaggtatagagagtgtccatctacacttaccactgcccctgcacagcctcccccattttcagcatcccccaccagagtactccctttcttacaattgatgaacctacattggcacatcattaccacccaaagtccatagtttacatgagggctcattgggtaattgataaacaaagtaaatttattacagttctgtagactgggaagtccgaggtcaaggggctacatctggtatgggccttcttactgcctcataaaatggcagaaggcatcacatggcaagggggcttactagagaaaaccaaactggcttttacaacagacccactctagtgaaagtaacccactcctatgataacccattgattcattaccccttaatccattaatccccaaatggattaatccattcataagggcagagccctgatgacccagtcacctcttaaaggccccacttaatactgttacattgggaattcaatttcaatgtgagttttagaggggacaaacattcaaaccacagcattctgcccctggcccccacaaattctatgtccttctcatatacaaatacattcattccatgtttatagccccaaagtctagagtctcatcgaatcagatgtgagtaatgctcaaaggacaattcatcttgaggtaaatttcttacagctgtgagcctgtgaaatgaacgtgttacctacttccaaaataaatggtgggacaggtgtaagacattctcatttcataagggagagataggcaagaagaaaggggtaacaggtcccaaataagtccaacacccaaaggaaaaactaagccttgaggctccagagtaatcttccttggttccatgtcttgcttcctagatacaccagtgtgaggattggatcccagggcctcaggcagccccaccacctaggctttcctgggctctcccaggcttcagttctcacaagtaacagtcaagtgcctgcagctttcccaggctggagctgaatgctggcagttctacagttctgagatctcagcgaggttctgttctctctgctccactagacattaccccacttggggttgtctgtcctggctctggctctgaccccacatttttgcttggcattaatccacgaatggattaattcatttatgagggcagagccctcatcacccaatcacctcttaaatgccccacctcttagtactgttacattggagattaagtttcaacttgaatttcagaagggtcaaaatttgaaccaaagtactgtttatttccttttcctgtcttattgcattaactagtacttccactgcagtgttgaaaaggagtggtaagaggtgacagcttcctattttggctgatcctagttggaaaagcttcaagtttctcaccattaagtatgatgttagctataggtttttttgtgaatattccttatcaagttgaggaagttctcctctattcttaatttactgagagtttttatcatgaatgggtgtcggattttatcaaatgctttctatgcgtctgttgatatgatcatgtgatttttcttctttagccagttgatgtgatggattatgttaactggtgatcaaatgttcacccagtcttgcacacttaggatgagtcctacttagttatggtctgtttttctttttatacattgttggattcattttgctaatattttattgaggatttttgcatctatgttcatgagagatattggcctgtagttttcttataatgcctttgtccggttttggtattaaggtaatgctggccttatagaatgtgtcaggaagtattccctctgcttctattgtctgaaacagattatagagaattggtctaatttcttccttaaatgtttgatagaattcaccagtgaagccatttgtgcctggtgttttctattttagaaggttaatacttattgattcaatttctttaatagatacaggcctattcagattgtccctgtctttttgtgggagttttgacagattgtatctttcaaggaatcagtctgttttatctaggatatgaaatttatggccataacactttacagtattcctttattatctttttaatgcccatgagatctgtggtgatgtctcctcttctatttttaatattagtaatttgtatcctctctctttttttcttagccaagctagaaattattaattttcttgatcttttcaaagaattagcttttggtgttgttgatttttctctattgattttctatttccaatttcactgatttctgctgtaatctcatcatttattgtcttctgcctacttcagatttaatttactttcctgtttctggtttgcccttgaactcttatttttaagaatctctacaagtgactctgatgcacaaatttaggagccattgtttgcattttaatttctaacattttataggaagaaaaacaggatcagagagagattttgttttgcatgaggttataatgtgtgcagtttataaggatgcagcctctggttatattgggttcccctgtattcatcttattgatttatctgattaattttatccatgatgacagattaatcttcctttgacaaccttaattatgtgtagttttcctagctatagttaacattgagtgaaatcatttgctctgttaattatttttctttgcagttcttgggactttcccacaaagtggactactagctatgttagaggatgagttgcccagtcagcacagtgtggattttctttgaaggaaaatacctgtgtccttcgtaagtgtcctacacatgctttatagacagggccagggaacactgtcatgtgagcctgtagaaatttagaatttttctggattgttctcttgattctcatcagtgtttccacggaaattgaaagattgctacagtgggttttgcttgattatatgtgcagtttagtattataacttttataaataaactttaaatactgtagtgtgatcttattgcaatcattagaaggaaggattatatgagagaaacttttttttctattataatacacatgcttctcaagttaaaatgggactatgccctgataaacccatcataagtcagaaacatcataaatcaaaaatgcacttaatactccagtaagctcgttataaaattttaaaataataagtcagggattgtctgtaattttacttatgctaataaatgtttttcatattgctagaagaaggctagttatttctgccttgtcttaacagaatgatacgatataattcttaaatgtatcatttgtgatttttaaaaataacatttgtttttctaattacacaagtaatgcatgttcattatgcaaaattttaaactcaaaattttttaatcacttgtaattccaccacctggagatcattgttgtttaggtagatggctttccaggcttttttaaagtgcacatatgtagtggtaaatcatttgtaatttcattccatttctgagttattgtttatgtttaattaaatacaagacagatttactaattcacgctttttatgccttttaaataccatatggtgcctacatatcttttagtaattggtattctcttacagtctttcctctacttggactttagttttttggggtgtttttcttccttataccatccttcttaaaagttagagtactttgttagttaggagattagctatcttttgtaaaatgtatgtaatatccaaaaaaaaaaaaaacaagctttgacttagacatccattttggacagagttcaaagtttttagcaacctgaagtgaatgggaacatcttcagtttcagaaagcacacaaaataaactaactcttaaaacctctccaggttgggcgtggtggctgactcctgtaatcccagcactttgggaggccgaggcgggtggatcacgaggtcaggagatcgagaccatcctggctaacacggtgaaaccctgtctctactaaaaatacaaaaaaattagccgggtgtggtggcggggcgcctatagtcccagctactcgggaggctgaggcaggagaatggcgtgaacccgggaggcggagcttgcagtgagctgagatcgcgccactgcactccagcctgggcgacaaggcgagactccttctcaaaaaacaaaaaaacaaaaaaacaaaaaaaactctcccatacaaagcacttagaggataaatctatattccacttatatgagatgcctagaataagcacattcatagagacagaaaatatggggaaaggggagagttttccaggatggggaaaggggagagtaaagagttactcttaatggatacagagtttctctttctgtttctgatgaaaaagttctgcaaatggaggcctggcatggtggctcacgccataatcccagcactttaggaggctgaggtgggcagataacctgaggtcaggagttaaagaccaggctggccaacatggtgaaactctgtctctagtaaaaatacaaaacttatacagggtggtggtgcaagcctgcaatcctagctactcaggaggctgtggcaggagaatctcttgaacctgggaggcagaggttgtggtaagctgagattgtcccactgcactccagcctcggtgacagagtaagactccattaaaaaaaaaaaaaaattctgtaaatggaaagtagtgatggctacacaacattgtggatgttaataccactgagctgtgtacctaagaaatgctaaaatggtaaattttattatttttatatatatatatcataatttttaaaagcacttgaagtatgtccaataatactgttgtaataggaataatcattgcctctacttaacaattttaatatttaagctctagttatcattcaatatgaaaagtcctcttttcctaattgcagtatttctcccttatactagcattttccttgcaaaaggcccagagattgtgatttgaagggacagaagcccactccatttgcctgagagacatctagaatattatctcaaaatagtaagatctcataaaaacaaactgtttttcaaatttccatgaaagtgttttttattttagaaactgacccaaaaaagtactaatttcttttttccacaatgctttattaagctttgttgacctatataagggttataggcgaggaggggagtagggggattagaaagattagtcagctgccactcctaaaaatatcagagtgattttttttttccttaatcacataactgtaaccttctgtctactcagggcaaactaactttaagatgaaacctaaagaatggatttttcattttttactacatttgactgtaaatacagacagcttgataataataacatatgctgtggaattccctaaatctctaacatattttaacatcattgtctagtatagtatgtcttataaatgattgttgatttaataaaaactataaactttatttatttttttgtttttttgttttgagatggagtctcgctctgtcgccaggctggagtgcagtggcaccatctcggctcactgcaacctccacctcccgggttcaagtgagtctcctgcctcagcctcctgagtagctgggactacaggagcgtgccaccacacccagctaatttttgtatttttagtagagatggggtttcaccatgttggccaggatggtctcgatcacttgacctcatgatccgcccacgtcagcctcccaaagtgctgggattacaggcgtgagccacctcgcacagccaaactttcttgttaatgtatatcttgtcttgcttctaaaactgattttaggcgtgagccactgcgcccagccatcttaggcactttactgagatatttacaacatagcagaataataagagaagagaatggtatcaaagactctggatcagagagaaaataagaattgaattatgatataaagccaggtataagatgttattcagttgttttctagtaatcaagctagaataaataaactatacatttcttaaaggaaattaacaggaaatacgtttatcaataaacagttcccacaattataaatgcatacttccccagtagccttgatgactggttcatgagccagtatttcttcagtgtgtattcagcattgctacttccattggtactacatccgtaccatcaggtgctatggaaaaatagaattgtaatagaaaatgtgttggctcctaatgcagtggccttcaaactaccctccagggtgtgagtcccacagagccgcctcagaataacaggcctaatagtcctgggttcttaaccagagcaaacatcattcattgtatctaatctgcagagtgaattttcttataaaatattaaatattttatattaaaatatattttaaatatttaaaaagttctacaaatggaaagcagtgatggctacacaaccttgtggatgttaataccactgaactgtgtacctaagaaatgctaaaatggtaaattttatgttatatatatttatcataatttttaaaagcacttgaagtaagtcaaagaatcctcctgtaatagaaataatcattgcctctacttaacaattttaatatttaaactctagttattacattttaaatataattaaaatatatttttagtttaaatacttaataaaaataaatacttaaaatatatataaatataaaataataatacttaaaaataataaagtaaaaatattatttgaacaaaggatttaacagctaaaaagatattttgaaacctctgacctagtactagagtcaagaccattgcctaataaaagtatgtccaagatctcctgaacactggcctgccctccttaagaaagaaaccctataataccatgaggcatgtaggggtgactcaaaaaactccaggccagaaaccagaacacctaataagtatttgtctcttgtctgccacagattagccctgtcaccttgaggaagtggcttgacctctgaaatgtcttatctcatctataaaataggagtataaaatgattactaagaacttgtccagcaccaagactttttcaaaattctttctcttgcctcaaagatggcaaagaatgtgccatcagacaagctcttcccttctgtcaaaagagaagaaccattggagaaagaaatgaccaaattctatgtagagagcttgagcaagaagaaaaaatgtaggggaagggtaaatagctctgtctagagcaattggcttttgttgtttacagcttgtctatgtcagaccatcccgtaggaaaagtttggtaagaacaaagacctttgataaaagatgactgagagactgtctggggtttgatgcaaagatcatcagaggcatctacaaatgagtagtcaccagtgacaaaatctcaaagcgaggcaggctggagaatgggcgatctgttagtcttgccagagaggaaggtattagcaaaggcagattgaataagcggaaggtaaaaaaataaaaagcagcaatagcattttttttttacatatacttcattagcacaggtttggctttaccaatataggaaaggcatttttacactaattaggtcattgtgaaaaagaaaaattggagttattttttaaatgcagtgtttttaactaagaagaaaatatgagaccgggtatggtggctcatgcctgtaatcctagcactttgggagcctgaggtgggtggatgacttgaggtcaggagttcgagaccagcctagccaacagggtgaaaccctgtctctactaaaaatacaaaaactagctgggcatggtggcacattcctatagtcccagctactcgggaggctgaggcacgagaattacttgaaccctggaggtagaggttacagtgagctgagattgcaccaccgtactccagcctgggcaacagagagactgtctcaaaaaaaaaagaaagaaaatattaatactgtggaggttatgtgacagtctttaataacaacaaccagttatattactataataagctttccatgaaaacaccaaaaagtactttttgatatcttattaaaaattaagattctgtcatatttcttagaattatatacattataattttatgttttttagaataaactcagcaatactgtacaaggatatcgtaatctatatggaagcacaaaggaacatataaatttaaatccttttgctccatgatcagtcacttcttttcattttaaactttaattttggacattcacaaaattgttaactcttgagtgatgtggattgagtaagttgtattacaattgtaaaaacaaatgattcatttcaacttgtattgaacatcttatgtgcaagacactctgcttaacacttgaggggactacagagataaatcagtgaggtcagttctatgggaggggaatcagggacagctacacagaagcagcttaaggatgataaggcttccagtccacagaaagagaggggtgaagatgattccagtataatggaaccatgagaacacacagaggaataaaggtgtgtcacatcagctctttgaatatgccacaaaaaaaaaaaaaaaaaaaaaaagctctgaattagttttccctcagtatctgctggggactggtttcaggaccccccagtatgaaaatctgcagatgatcacatccctgatataaagtgggatatttgcatataacctgtgcacatcctcctcgatactttaaatcatctccaggttacttagaatacctagtgtaatgtaaatgctatgtaaagagttcctatactgtattatttttaacatttatattattttgtattgttttttatttttattgaatattttcgatccacagttgattgaatctgcggttgcagatacggagagctgattgtataccctctaaaaggatgaattttatgctatgtcacttatatcttaataaagctattatttttcaaaagtacatgccgtgtgttagagatggcaaggataaattgttgtcatggtgacatgggatcctgtgttgtgcagaaggagaggagactggagagaggtgtaggatcagaccacacagagggtcttgaaaaccatgctaggaattttgaattttattttccaggcattagtaaaacattgtaagtttttaagcataggaatcaaaatgactccattgattttaaaatacggagctaaaagataaattagctgttagtaaaagtgaaggtggagaggaaaaactaggctattggaacagcttcgaccaaagagtgtaaattagtgaaactagtttgcaagaatactagggacaggggtcaggcacggtggctcacgcctattatctcagcactttgggaggctgaggcaggaggatcacttgagctcacaagttcgagaccagcctaggcaatgtggcaaaaccccatctctaccaaaaatacaaaaattagccaggcatggtggtgcacgcctgtggtcccagctactcaggaggctgaggtgggagttcgcttgaacctgggaggttgaggctgcagtgagccaagatcgtaccattgtactccagcctgcgtaacagagccagaccttgtctaaaaaaataaaataaaaatgctggggactggatattgcatcttaaaggggcaaggaaaatgaaagaaaatgctgaattctcattttcatatttatagaacaaagatactgtattatttttctgaactgtgtaaccaactatcacaaatttagcagcttgagcaacacacatttattatatcaacatttctgtggttcatgaccccagacacagcttagctagggttgtgtgaggctgtggttaaggtattggccagggtgggattctcaccttgagtcaggactagagatgcatccactttcagaattacccaggttgctggcagaattcatttccttgaggttgtgagtctgaggtcctcagcttcttgccagctgtaggctggggactgctctcagctcctagaggatgcttgcagatcacatggccctctcaacatgacagtgaacttcttcaaagccagctggggagaaagtctctagcactagttgactggcaaaacatacaacatcatataatcgtgaaattaatatctcatcacctttgccatagtctgatggttcaaagcaagttacaggtcccactcacaataagaggaggaaattatccaagggggtgaacaccagaaagtggagatggttggggtcactatagagcatgtccaccacaggtacttttcagcctcttaaagtacagtagagtgtcctctaaagccgagtgagcagagtgtagactctggcgtcagaccgagccaggtttgaatcctgactccatgactgactatccttttgagcactaaacctcagtctcctcatttgtacatagggataaagatctacgtctcatgatgtggtgtcaggacaaaatgagataatgccggtaaaacacttcagtgagtgcccaagacaggaaaattgctcacatatgttatcacatttgagtctcagctaccatgagaagtaattgaaaagttttccattaaatgatttacctatattaaatcagtttttgctcttgagtaaacttaatctaatggactttttgctatatcattgtgagcatggattaatacattcatgaaaaatcactagacttgagtagaggattttttttttaatcaacctcttctttttacagacaaggaagctacaaccacatagaaaagttatccgacttgcctaagatctcacagtacttagtggctaagccaggactagagtgatggcctatttatgcaagttactgctgtttctaccatgtttagctgtgtgacataaatttttaattacgacatttatacattttttcactcaatcttgtagactagaagctcctttttcaatgagacagctaattttttaatgccaagaaatagatacatagaaaagttcaaggccttagccctaaaataagaatttgcaaacttctagtgacagtactcaatctctctgaatgtctctattgtttaagacgtgatctgatgttttaactttaaattaaactaaattggctgggtgcggtggctcaaacttgtaatcccaacactttgagaggctgaggcaggcggatcacttgaggcgaggagtttgagaccagcatggccaacataccgaaaccccatctctactaaaaatacaaaatattagccaggtgtggtggcgtgcacctatagtcccagctgcttgggaggctgaggcgtgagaatcacttgaaccctggaggtgaaggttacagtgagctgaaattgtgccactgcaatccaacctggacaacagagtgagactctgtctcaataaaataaaataaatttgctacttatatgtgtatgtgtcttcacactgtatatctgggcacgctctatattttttgaaccgattcttaagggtatcccaatgatagtaatgaaaataagcagcatgaaattttatagccatcctagaacaatatttcctgtgtattttaatccactggaattgggaaagaaggattgattatgttgttttcatttaatgtccatttatcaatctccatctttgtgtcagatgtttgctaggtgcttgggggatgagaaagggtcaccacatgaccataatcctcctacccagagataactactctaaacatgttgatagccttctatatatattttttgcacatgtagtttttaatataaaaagtgacacaataaaatactttcaaaaattataattacagaagcagtggctgtcatggtaggaggaaactaaagcaaatcagagggcacaaaactgaaaactaggaggattcccatttcctcccaaccccctgctaccctccccagccctactcactagaggcaaccactgagtggtccctgattttcttctggtagttaacattatattcatataaaatattttaactctggttttagatttattagctttagacagtatctgttaaccttttgctataaaatatgaagaaattttttatcaattcaagcttgagccgttcttcttctcagcttccagtttctaaaactgtttttaccttgaaaaggtctctgacatttattattactggtgtattatctcttgtgctttttcataggctagtttaaaaatggaatgcattattgtgatcacatgttacatgtgtattctctttagagctaaatatatatgtatatcattctaaggtactaaactttgttgtttgacaaacctgacaaaacaagcaatggggaaaggaaaggggaatcttctaggcatcccagtctaaaactcttcatttctatccagcttttttcacttcttccatttcgactgctactcttccttgtatctcatgttattatcttccttgaatattcttttttttttctttgctctgttgcccaggctggagggcagtggcataatctcagctcactgcaaactccgcctcccaggttcaagcaattctcgtgcctcaacctcccgagtagctgggattataggcacttgccaccacacccggctaatttttgggtttttgttgttgttgtttttattatactttaagttctagggtacatgtgcacaacgtacaggtttgttacataggtatacatatgccatgttggtttgctgcacccatcaactcgtcatttacgttaggtatttcacctaatactatccctcccccagccccctacccctaacaggccccggtgtgtgatgttccccgccctgtgccaatgtgttctcattgttcaacacccacctatgagtgagaacatgcagtatttggctgcatagtattccatggtgtatgtgtgccacatttttttttaaattttaagaaatgctctttttttttaatatactttaagttctagggtacatgtgcacaacgtgcaggtttgttacatatgtatacatgtgccatgttggtgtgctgcacccattatcttgtcatttacattaggtatatatcctaatgctatccctccccactccccccaccccacgacagaccccggtgtgtgatgttccccttcctgtgtccaagtgttctcattgttcagttcccacctatgagtgagaacatgcagtgtttgattttctgtccttgcaatagtttgtgagaatgatggtttccagcttcatccatgttcctacaaagtacatgaactcatccttttttatggctgcatagtattccatggtgtatatgtgccatattttcttaatccagtctatcattgatggacatttgggttggttccaagcctttgctattgtgaatagtgccacaatgaacgtacgtgtgcatgtgtctttatagcagcatgatttataatcctttgggtatatacccagtaatgggatggctgggtcaaatggtatctctagttctagatccttgaggaatcgccacactgtcttccacaatggttgaactagtttacactcccaccaacagtgtaaaagcgtttctgtttcttcacatcctctccagcatctgttgtttcctgtcttcttaatgatcattgttctaactggaatgagatggtatgtcattgtggttttgatttgcatttctctggtgaccagtgatgatgagcattttttcatatgtctgttggctgcatgaatgttttcttttgagaagtgtctgttcatatcctttgcccactttttgatggggttgtttgtttttttcttgtaaatttgtttaagttctttgtagattctggatattagccctttgtcagatgggtagattgcaaaatttttctcccattctgtaggttgcctgttcactctgatgacagtttcttttgctatgcagaaactttttagtttaattagatcccatttgtcaattttggcttttgttgccattgcttttggtgttttagtcatgaagtccttgcccatgcctatgtcctgaatggtattgcctaggttttcttctagggtttttatggttttaggtcttacatgtaagtatttaatccatcttgagttaatttttgtataaggtgtaaggaagggatccagtttcagctttctacatatggctagccagttttcccagcaccatttattaagtagggaatcctttccccattgcttgttttgtcaggtttgtcaaagatcagatggttgtagatgtgtgatgttatttctgaggcctctgttctattccattggtctatatatctgttttggtaccagtaccatgctgttttggttactgtagccttgtaataaagtttgaagtcaggtagcatgatgcctccagctttgttctttttgcttaggattgtcttggcaatgcaggctcttttttggttccatatgaagtttaaagtacttttttccaattctgtgaagaaaatcagtggtagcttgatgtgggagatagcactgaatctataaattaccttgggcagtatggccattttcacaatattgattcttcctatccatgagcatggaatgttcttccatttgtttgtgtcctcttttatttcgttgagcagcggtttgtagttctccttgaagaggtctttcacatcccttgtaagttgtattcctaggtattttattctctttgtagtaattgtgaatgggagtacactcatgatttggctatttgtctattattggtgtataggaatgcttgtgatttttgcacattgattttgtatcctgagactttgctgaagttgcttatcagcttaaggagattttgggctgagacgatggggttttctaaatatgcaatcatgtcatctgcaaacagggacaatttgacttcctcttttcctaactgaataccctttatttctttctcttgcctgattgccctagccagaacttcccatactatgttgagtaggaggggtgagagagagcatccttgtcatgtgccggttttcaaaaggaatgcttccagtttttcccattcagtatgatattggctgtgggtttgtcataaatagctcttattattttgagatacattccatcaatatctagtttattgagagtttttagcttgaggggctattgaattttgttgaaggccttttctacatctattgagataatcatgtggtttttgtcattggttctgtttatgtttcggattacacttactgatttgtgtatgttgaagcagccttgcatcccatagatgaagctgacttgatcgtggtggataagctttttgatgtgctgctggatttggtttgccagtattttattgaggattttcgcattgatgttcatcagggatattggtctaaaattctctttttttgttgtgtctctgccaggttttggtatcaggatgaggctggcctcataaaatgagttagggaggattccctctttctctgttgattggaatagtttcagaaggaatggtaccagctcctctttgtacctctggtagaattcggctgtgaatccgtctcgtcctggactttttttggttggtgggctattaattattgcctcaatttcagaacctgttactggtttattcagagtttcaacttcttcctggtttagtcttggcatggagtatatgtcctggaatttatccatttcttctagattttctagtgtatttgcatagaggtgtttataatattctctgatggtagtttgtatttctgtgggatcggtggtaatgtcccctttatcattttttattgcgtctatctgattcttctctcttttgttcgttattagtcttgctagcagtctatcaattttgttgatcttttcaaaaaactagctcctggattcattgactttttgaaggattttttctatctccttcagttctgctctgatcttagttatttcttgccttctgcttgcttttgaatttgtttgctcttgcttctctagttcttttaattgtgatgttaaggtgtcgattttagatctttcctgctttctcttgtgggcatttagtgctataaatttccctctacacactgctttaaatgtgtcccagagattctggtatgttgtgtctttgttctcataggtttcaaagaacacttttatttctgccttcatttcattatgtacccagtagtcattcaggagcaggttgttcagtttccatgtagttgtgcagttttgagtgagtttcttaatcctgagttctaattcgattgtagtatggtctgagagacagtttgttgtgatttctgttcttttatatttgctgtggagtgttttacttccagttatgtggtcaattttagaataattgtgatgtggtgctgagaagaatgtattttctgttgatttggggtgtggagttccgtagatgtcttttaggtccgtttggtccagagctgagttcaggtcctggatatccttgttaaccttctgtctcattgatctgtctaatattgatagtgggatgttaaaatctcccattattattgtgtgggagtcttagtctctttgtaggtgtctaaggacttgctttatgaatctggatgctcctgtattgggtgcatatatatttaggatagttaagtcttcctgttgaattgatccctttaccactgtgtaatgcccttctttgtctcttttgatctttgttgctgtaaagtctgttttatcagagactaggattgcaacccctgctttttttttgctttccatttgtttggtagatctgcctccttccctttattttgagcctatgtgtgtttttgcacgtgagatgggtctcctgaatacagcacactgatgggtgttgactctttctccaatttgccagtctgtgtcttttaattgtggcatttagcccatttacatttaaggttaatattgttatgtgtgaatttgatcctgtcattttgctgttagctggttattttgcctgttaactgatgcagtttcttcatagcgtcaatggtctttacaatttggcatgtttttgcagtggctggtactgattgttcctttccatgtttagtgcttcctttaggagctcttgtaaggcagacctggtggtgacaaaatctctcagcatttggttgtctgtgaaggattttacttctcccccacatatgaagcttagtttggctggatatgagattctgggttgaaaattcttttctttaagagtgttgaatattggcccccactctcttctggcttgtgtggtttctgccaagagatccactgttagtctgatgggcttccctttgtgggtaaccggacctttctctctgactgcccttaacattttttctttcatttcaaccttggtgaatctgacaattatgtgtcttggagttgctcttctcgaggagtatctttgtggtgttctctgtatttcctgaatttgaatgttggcctgccttgctaggttagggaacttctcctagataatatcctgaagagtgttttctaacttagttccattctccccgtcactttccagtacaccaatcaaatgtatatttggtcttttcacatagtcccatatttcatggaggctttgttgatttcttttcactcttttttctctaatcttgtcttctcactttatttcattaatttgatcttcggtcgctgatatcctttcttccacttggtcaaatcggctattgaagattgtgcatgcatcatgaagttctcatgccgtggttttcagctccatcaggtcatttaaggtcttctcgacactgtttattctagttagccattcatctaaccttttttcaaggttttcagcttccatgtgatgggttagaacatgctccttttgcttggagaagtttgttattaccgaccttctgaagcctacttctgtcaactcatcaaactcattctctgcccagttttgttccattgctgctgaggagctgcaatcctttggaggagaagaggcgctctggttttcggaagtttctgcttttctgctgtggtttctccctgtctttgtggttttatctacctttgttctttgatgttggtgacctacaggtggcattttggtgtggatgtcctttttgttgatgttgatgctatttctttctgtttgttaattttccttctaacaggccccttaactgcaggtctgttggggtttgctggaggtccactccagaccctctttgcctgggcatcaccagcagaggctgcagaacagtaaatattgctgcctgatccttcatctggaagtttcatcccagaggggcacccgcctgtttgaggtgtctgtcggtccctactgggaggtgtctcccagtcaggctacacggggttttgggacccgcttgaggaggtagtctgtcccttctcggaggtcgaatgccatgctgagagaaccgctgctgtcttcatagttgtcagacagggacgtttaagtctgcagatgctgtctgctgcctttcattctgctatgccctgcccccagaggtggaatctagagaggcagtaggccttgctgaactgtggtgggctctgcccagtttgagcttccaggccactttgtttacactgtgagctactcaagcctcagcaatggcagatgcccctccccctgtcaagccacaacgtcgcaggttgatctcagactgctgcgctagcagtgagcaaggctccgtgggcgtgagacctggtgagccaggcatgggagggtatctcctggtctgccggttgcaaagaccatgggaaaagtgcagtatttggtcaggagtgtactgtttcttcaggtacagtctctcatggcttccctcggctaggaaaaggaaatcccccgtccccttgcacttcccaggtgaggcaacgccctgccctgtttcagctcaccgtccataggctgcacccactgtccaaccagtcccaatgagataaagcaggtacctcagttggaaatgcagaaatcacatatcttctgcatccatctcggtgggagctacagactggagctgttcctatttagccatcttggaagcgacccttaatttttggatttttttctgagacagattctcgctctcttgcccagtctggagtgcagtggtgcaacctcagctcactgtaacctctgcctcccgggctcaagcgattttcctgccttagcctcctgagtagctgggattacaggcatgcaccactacccttgcataatttctgtatttttagtagatatgtggttttgccatgttggccaggctggtctcaaactcctgacctcaagtgatctgcctgcctcagcctcccagagtgctgagattataggccactgcacctggctgaatattttttttttttttgagcctgtctctgagtacttttttcatgtagggctcttggtggcaaatttttttagttttagaaagcctcaaatagctttatcttcatatttgctttgaaagtttagatgaatataaatatccagattttaaatttaaagaaattgctcccgttatcttccagtattacattcaatgtagataaagtcagtaagagtctgattctcatcccttgcttaatgatgaattttttctttctctgaggcatttagaattttttaatccttattataaaattttcagcagaatgtttagatgtaaatcttttcttactaatcttactcagcatttcatgaaaccttcccatatgaaggtgcatgtcttatttcagcgtaggggcattttcttaagttattttatgtcattacctttgttgtttgtatcttttgcacttcctatttgagcagctttcaactgttaggacatggtctccgtgttttaaatctatttgtttgtactttacatttcttggtctttctcattgctgttctcagagatttctttgaatttatcttccaggtttaaaaacttggtctagggcagggcacagtggctcacgcttgtaatccaagtgctttgggaggctgaggctggtggatcacttgagcccaggtgttgtgaccagcctgggcaacatggtggaaccccatctctactaaagatacaaaaaataaaaaattagccaggcatgcctgtagtcccagcttcccagcaggctgaggtgggaggatcatctgagcacaggaaggttgaggctgcagtgagctgtgttcatgccactgtactgcagcctgggcgacagagttagaacctttctcaaataaacaataataaaataaaagcttggtcctatacagcatcgaattttaatttcacccatacagtaaatttttcagtgatcatatttttaattttcaagatttcttgttctccagttgtttatttcttcatagacttttcttgttttaagtctgtcatattcttaatcttcctgaggataccaaatcgagattttgcttgttttaattctttccagttctattagtccattttcacactgctgataaagacatacccgagactgggcaatttacaaaagaaagaagtttattggacttacagttccacatggctgggaaggcctcacaatcatggcagaaggcaagggagagcaagtcacatcttatgtggatggcagcaggtaaagatattgtgcagggaaatgcgcgtttttaaaactatcagatctcatgagacccattcactgtcatgagaacagcacaggaaagacatgcccccataatccagtcatttcccactgggtccctcccacaacacgtgggaattatgggagctagaagatgagatttgtgtggggacacagagtcaaaccatgttattccacccctggcccctcccaaatctcgtatcttcacattcagaaccaatcatgccttcccaacagtcccctggggtgttaatttatttcagcattaacttaaaagtccacagtccaaagtctcatccaggacaaggcaagtcccttctgcctatgagcctgtaaaatcaaaagctagttagttacttcctaaatacaatgggggtacaggcattgggcaaatacagccattccaaatgggagaaattggccaaaacaaaggggctacaggccctatgcaagtctgaaattcagcggggaagtcaaatcttaaagctccaaaatggtatcttttgactccatgcctcacatccaggtcacactgatgcaagaggtgggttcccatggtcttgggcacctcctcccctgtgctttgcagggtacagcctccctcccagcttctttcacaggctgacattgagtgtctgtggcatttccaggcatatggtgcaagctctaggtggatctaccattctggggtctggaggactgtggccttcttctcacagttccactagatggtgccccagtagggactctgtgtgggggctgtgaccccacatttcccttctgtactgccctagcagaggttctccatgagagctctgccctgtagcaaatttctgcctggacatccagttatttccatacatctctgcaatctaagcggaggttcccaaacctcagttcttgacttttgtgtacctgcaggctcaataccacatggaagctgccaaggcttggggcttgcatcctctgaagccacaacctgagctgtaccttggccccttttagtcatggctagagctgctgggacacagggcaccaagtccctatgctacacacagcgggggtctacaggcctggcccatgaaaccactttttcctccttggcctcccggggtgtgttgggaggggctgccatgaagacctctgacatgcctggagacattttccccattgtcttggggattaacattcagctcctcgtttttaatgcaaatttctgcacctggcttgaatttctcctcagaaaatgggattttcttttctatcacactgtcaggctgcaaattttccaaacttttatactctgtttccattataaaactgagtgcctttaacagcacccaagtcacctcttgaattattttctgcttagaaatttcttctcccagatcatcctctgcctaaatcacctctctctagttcaaagttccacaaatctctagggtggggcaaaatgctgccagtttatttgctaaaacaaagcaagagtcacctttgctccagtttccaacaagttcctcatttccatctgagaccacctcagcctggaccttattgttcatatcactatcagcatttttgtcaaagccattcaacatgtctgtaggaagttccagactttctcacattttcctgtcttctgagccctccaaactgttgcaacctctgtctgtttcccagttccaaagttgcctccactttttcaagtatctttccagcaacaccccactcctggtaccaatttactgtattagtccattttcacactgctgataatgacatacccgaggctgggcagtttacaaaagaaagaggtttactggacttacagctccacatggctggggaggcctcacaatcatggcagaaggcaaggaggagcaagtcacatcttatggggatggcagcaggcaaagacagagattgtgctgggaaactcccgtttttaaaaccatcagatttcatgagactcattcactatcatgagaacagcacaggaaagacctgcccccataattcagtcatctctcaccaggtccctcccacaacatgtgggaattacgggagctacaagaaaagatgtggctggggacacagagccaaatcatatcaccagtgaattgtatttttatccacttcctctatggtacttgttctgttggttttctcagtcttctctttcatactgtcatttttccttatgtgtcctcaaatttttctttaatgtgtttgctactcatatatctgactggaacattactcgagttattataatagcaaggatgaatttccagtagctcaataggtcctttttctagcagactcctccactgaagttaaaaaatttctggtgacctcattttttaacattcactatgttattaatataaccattttccgatgccaaaaattctaacatactaattttattggttgcatagtttttcatcatagtactgtttactctttctcttattattggatatttgattttttccagcttttcattaaataacatcaagaacacatttgtacatgtatttcttcatgtatctctgatggttttcatagtgttaattcctagagtgaaatttataggtcatgaaagatttctaatagacattgctaaattgtcttttggaagattgtaacaagtctctgtctcataaaaataccctttccccgcagcactcttgataatggcagatcatgttctttttaatctctgctaacttagcaatatacatattacaatatatatatagaatgtgaatattttcctgtttgaatttacatatttgggtgttttcatgagtttcttttgtgaattgactctttatgttctttgcctgtttttctgttcaccattttgtttcgctttgtcagactttattttgggaatgttaagtgctcattataattactgtaagttttttctcagtttgtggtttgcctttaacttttttattatgtgtcttttgctaaatatatgttttgatgacatatatgtaaagccacccactcacctgtccagagattaaatttcatctatatagcttggtatgtttatgatttctagttttacattaaacttttaaatccatgtacatttatgttggaatatggcttatatagggacacatctttgttttttctgaaataactaattagctagcatctttttcattgactggtagttcatcctttccctattaatttgaaatctcacctctgtcatatacaaaatgttttttataaatatgtgtgtgtatctgcctagaaataacttgtccaggcacatcttacaattcttgacatttctaacaagaccactctgttactttactgttttagaaagcacttaagtataatgcttaatctactgtattaaaactgtatacaacagccaggcatggtggctcatgcctgtaatctcagcattttgggaggctaaggcaggaggatcatttgaacccaggagttcaacaacagcccaggcaacatagtgagaccttgactctacaaaaaatttaaaaattagcttggtgtggtggcatgcgccagtggtcccagatattcaggagtctgaggtgggcactcgcttgagcctgggaggttgaggctgcagtgagctgttatcactgccactgcactccagcctgggtgacagatcaagagcctgtctcaaaaacaaaaaacaaaacaaaaaactgtatccagtgcttgtgtattatcctaatttctaaaaatcaatgaccccccaaaatatttccctcatcagaatgttctgttatcagccaaagatttctttctgtcagctcacatcctgccacaataaaggcaaacagtggtagacagggtgaaccattgtgattctgaagcattctaagtggtttcagggatatgaaagtttcatcatcctgttttgtggtaggggaaaaggaaatattgttaaagtaaacattgaaatttgaggtaaataccagtattcgaactttgaaaaagtagccagaatgttcctaaggtggcaacatttcagaaattatacaatttctcaatgccgctagttattggaacagttctaaggctctgcccatgtgttgacatcacattccatctcccttgttcttatagggcttcagccacacagctggttaaggtgcaatttgaccatgactttcttaagaaatgaaaggtacattatggtgctgtaggtcaaatgtgaagtatgtgtcctattttgtgaactattgtagcaaaactaaatcaatgaagggattttgctgagaaagtagttaccagcattcacaaagctggctactgggtgaaaaacctgaattctgagttttgcaattaactgcataacactgagtattacctaataatgattcctttgtttttttcagttccttttgcattatataggtgttttcccaaatgtgttctgaaagacattattgctgcaaggtgctctggaagacatttcagggaccatggttaaatcagttaaagaaaagctgtgtactagatccttctctaagaaatgcactggctgggcacggtggctcatgcctgtaatcccagcacttagggaggccaaggcaggcagatcacttgaggtttagagttcaagatcagcctagccaaaatggtgaaaccctgcctctactaaaaatacaaaaaatgttagccaggtgtggtggcatgcacctgtagtcccagttacttgggaggctgaggctatagaatcacttgagcccaggaggcagaggttgtagtgagccgagagcatgccactgcactccagcctgggcaatgggaatgaaaccctgtccaaaaaaaaaaaagcacaatatgtagtctcatactaaaggctttaagaagtcttacagaaaagaaatttaaatcttttggatctatttcttgacatctgtaggaactgtttcataaaatctactttaggaacctgtattagctgctgtccaaggtatcaaacgtctataattctagttccagtaaaaagttgtatataaataacttactttatatgtagtactttaatttgtaatatcagtatggaatcttcttaaggaaacactgaaaaaaacctttaattgtacaagatctttgtacagtatcatggacttttaaacacagaaacacagagaagtattgttttgtcctgtgaataccaaaactttgatttggatttattagtgagaaaaaagcaggatcaaacgtttccctactttttaggagttctgtgcaatacctcaaattctatccagaatgttcctacaaagtacagtatgatgttagacactctttacatccaacatgttttcttttgtttaatttaatttgagctattattggctcaaaatatatagattcttagtgatcttttatatttattgttcataaaataatgttcggcttcctaataagaaagtgaagaggaaaatcaaggtgttttcatcttgcttgtaggatgggtgctgcagacaatatatataaaggacagagtacatttatggaagaactgactgacacagcagaaataatcagaaaagcaacatcacagtccttggttatcttggatgaactaggaagagggacgagcactcatgatggaattgccattgcctatgctacacttgagtatttcatcagagatgtaagtatccggtaaactgtatttaaaaagaaattaatttgtaaattattatttttaaatgacagtcataattgtgccatatttatggggtacaatgtgatgttttgaaacatataaacaatatggagtgattaaattaacctaattaacacattcctcacctcatttaaatatcattttttgtggtgagacatttgaaatttctcttagttattttgaaatatatattattactgctgtagtcataataccgttatgcaatccctgcatacccttttgtacatggatgatacatattatacacattattttcctgatctcagtctccaaatactcaaaattatcttttttataattgactgcagtcctgcaagtgatcattagaatgctacacactgaattcagacagattgaccctaaataatgtttgtagttttttgatatatgttcctttttttgctgactcaacataaatctggttgtacgaaaaaggccttcctggcaatattttcactcagaattatatcttattatccttggtgaaccctaaatcaagaacaggtaccatccatctacagccaaattcctcgagggaaaaacaaggaaatagtgccatttccactttgtgaaatcctttttttcaccaacatcctgaaggatctcactgtgagatctttgatctcatctctttgtgtttctatctgattcagtaacatcattccttcaatacatgtctcctttttttcagggtgcatttctaagcttcagtgtaaaattttgtttgtgtcaaactttctatccctgtcatttccatctaactctctcctttagtttactttctctatcttgttcattttggtctctgcttttcaaatctccccttcatggcacctctccttaggtctttcccttctctggtctttctttctgttttcccccccattttcttgctcctttgtcattgtgtcttccctcattttcatttctttctctcttccttaaatagccaataaaatcatatttttaatatttcttttcaaaaagcaacacaaaaataaaatgtatttttctttaaccttttgttgccattggtgttttggggtttagttttgtttttaaagcttaatttccatttaatttttttccagaagatagtttttcttcagtctttagagactcagctccatgaacaggctttgatggagatcatggggcagcatcctcagatctaaattggagcagagttgtttggtcctctaggcttcatgagaatgattcctgactaccttgctgtgagcggcagaacttgtgcagtaatacagtttcatacactgtttgggaagcacagagacatcaacgacactcaatttggaaatgtccctgacagctgtaccttctactatatttcaaatgacaaacttctaaatagccttgtccttaggtgtgcatccaacacagtttgtgcagcaaataggttgtacctagctatggccctttttggcacaaccgttgttgttgttcctcctcctcctcttctttctcttcctcctcctcctctttttttttttttttttttttttcttttttgaaatgggttcactctgtcactcaggctgcagtgcagtggcatgatcatggctcactgcagcctcgacctacctgggcccaggtgatccttccacttcggcctcccgagtagctgggactacaggcacacaccaaccatacccagctaatttttgtattcttttaggaatggagtttcaccgtgttgctcaggctagtcttgaactttcaggctccagtgatccacctgccttggcttcccaaagttctgggattataggcatgagttaccatgcccagcctcccttcttttctttgttattttggcagtgaagacccaagagtgactcaggttttgtttaaacatttatttagattacataggtaattataacattttgttttttttaaggaattttttgttttgctttaaaaaatttatttgcaaaaagatgtaactcagaaactttaatcattatagaaactacgtaggaaatgatgagttcatgtcctttatagggacatggatgaagctggaaacgatcattctcagcaaactatcgcaaggacaaaaaaccaaacaccgcatgttctcactcataggtgggagttgaacaatgagaacacatgggcacaggaaggggaacatcacaaactggggcctgttgtggggtggggggaggggggagggatagcattaggagatatacctaatgttaaatgacgagttaatgggtgcaacacaccaacatggcacatgtatacaaatgtaactgacctgcacattgtgcacatgtaccctaaaacttaaagtataataataataaaaaaaagaaactacataggaaagcaattgacttttgtacattaaccttggatcctgcaaccttgctgtaatcacttactaattccagtctgtgtgtatgtttgccaattcttttgaatttcctacataggcagtcatgtcagatacaaacagacagtttcacttctttcttccccatctattttttttttcttgtcttattgcagtaactaggactttcagtacagtgttgaaaaagcagtaagaaaggatatcgttgccttgtttctgatcttagtgggaaagctttgagtttctcaccgttaagtatgatgttagctagaggttgtttgtggatattccttaccaaattgaggaagttctcctctattcctagtttactgagagtttttattgaatgggtgttagattttgtcaaatgctttctgtgcatctattgatatggtcatgtgatttttcttctttagcctgttgatgtgatggattacgttaactggtgttcaaatgttgaatgagtcttacacacttgggatgagtcctacttggttatggtctgtttttctttttatacattgttggattcattttgctaatattttattgaggatttttgcatctatgtttatgagagatactggtttatagttttcttataatgtctttggttttagtattaaggtaatgctggcctcatagaatgagttagaaagtatttactccactcctgtcctctgaaaaagactatagagaattggtaaaatatcttccttaaacatttggtggagttcaccagtgaagccatctgggcctatgattttggttttagaaggccattgactcaagttcttcaatagatatagacctattcagaatttctgttttttttcttgtgtgagttttggctcattgtgtcttttaaggaattgtttttcaagaaattttcaccaaggttaccagatttgtggacatagagttggtcatagtattcctttattatccttttatttgtccacggcatccgtagtgttgtccttttcatttctgatattagccatttgtgtcttttctcttttgttcttagttagcttgactagaagcttatcagttttcttttcaaagaaccagcttttggttctattgattattttccccattgctttcttgttttaatttcattgatttctgctctaatttttattatctcttttcttttgcttatttttgctcttctctttctggtgtcctaagatagaagcttagattgtttattttaaattgttctttttttctaatgtgttcagtgctataaattttctttttttattctttcttttctttccattttttcttttttgagacagggtcttgctctgttacccaggctggactgcagtggcatgaacatagcccactgcaacctcgactccctgggctcaagtgatccttctgcctcagcctcccatgtagctgggactacaggcacatgccacaacacccagctaatttcacttttattttttatagagattggggtctcactatgttgcccaggctggtctcgtattcttggactccagtgatcctcttgccttggcctcccaaagtgctgggattacaggtgtgagccaccgctcctggcctataaattttcttctatgcactgcttttggtgcggttccacaaattttgataaggtgtgcttcctgtttttacttagttccaaatattttaaatttctctttatttcttttttgacccatatgttttttaagaatgtgttgtttagtctccatgtatttggggattttccagttacctttttgttatgattcctagtttaattccattgtggtatgagatcaaatattgtatgatttttattatattaaatttgtcaacatgtgttttatggcccaaaatgtggtctttcttggtgaatgttccatgttagcttgagatgaatgtgtattcagctgttggttgaagtatctatagatataaatgatgtctagttgattgatggtgttgttgagttcagctgtgtccttactgattttctgcctgctggatctgtctgtttcagatggaggaattttgatatctctaactatagtagtatgttcatctgtttctctttgtagttctatcagcttttgcctcatgtagtttgacattctcttgttaaatgcatacatgttaaggatattatgtcttcttggacataagacataatatcctttatcattttatcattatccctttatcattatataatatccttctttatccctgacaaatttacttgatctgaagtctgctctgtctcaaattaatatagctactctaacttcctttagaaattaatatagctgcttcagctttctttaatgttaacatgatgtatcttcctccatatatatatatatattttagatagagtctcactctgtcacccaggctggagtgcagtggtacaatctcagctcactgcaacctctgcctcccagattcaagtgattcttgtgcctcagcctcccgagtagctgggattacaagtgtgtgccaccacgcctggctaatttttgtattctttttaaattaaagatggggtttcaccatgttggccaggctggtcttgaactcctggcctcaagtgatccatctgcctcggcctcccaaagcgctgggattgcaagtgtgagccacctcacctagcccctccatatatttttaatatgtagttatttttatatttaaggtgagtttcttgtagacaacatacagttaggtcttattttttgatccactctgataatctgtcttttaactggtgcatttagatcatcagcattcaaagtgattattgatagagttggattaatatttaccattttttacttttttctatttgttgttcttgttcattgttcctacatgtgtcttccactgtttttctgtcttatgtggttttaactgagtattttatattatttcattttctctctttttttttttttttgttttttgttttttggtttcttggggtgttttttgaggtgggatcttactgtgttgcctaggctggcctcaaactcccgggctgaagtgaccttcccacctcagcctcccaggtagctgggagtacaggtgcatggcactgtgcccagctattttctctcctttcttagcgtatcagttatatttcttgttttactttttctagtggttgtcctggagtttgcaatatacgtttgcaactaatccaagtctactttcaaataacactatattgctttatgagtaatgcacgtattttttaataacaaaataatcctgattactttcttctatcctttgcaccatcactgtcatttatttcacttatacttaagtgtacataagcatatatatatatataaacatacataatcgcatacactgttgctattattattgtgaacaaaatgttatgctagatccactaaaaataagaaaaataaaagtttttcgccttcactggttccttcttcaatgctgcacttttctttatgtagatacaagtttctgacccctgtcattttccttccttctaaagaactttccttaaacatttcaggatagatctgctggctacaaatcctcaatttttgtttgtctgagaatgtctttatttctccttcagttttgaaggattattttgcaaggtacagaattctaggttggagaggtttgttgtttttttttttttttcctctcaaaactttagatattttactccactcttttcttgcttttgtggtttctgagaagtcagatgtaatttttatctttgagcttgtgtggataaggtgtttcttccctctggcttacttcagtattttttttttctttatctttggttttctgtagtttgaatatgatttgtctaggtgtggttttggggacatttatcccgtttggtgttccctaagcttcccagatctgtggttttgtgtctgacattactttggggaaattctcagtcattattgttttaagtatttcttctgtttctttctctctttattttctctctggtattctcattagctgcatgttatatcttttgtagttgtctcaaactttttggatattctgaggtttttttctagtctttttctgtttgcatttccattttggagatttctattaagatgtcctcaagctcagagattcttccctcagctgtgtccagtctaccagtaagctcatcaaacacattcttcatttccatcacagtgtttttgatctctcgtttccttttggttttttcttagaatatgcatctctgtgcttacattgcccatctgttattgcatgctgtctgtgttaaccatagagcccttagcatactaatcagttgcttccaattcccagtctgataattccaacattcctgccatagctatgtctggttctgatgcttgctctgtctcttcatatttgtgggtttttacttttagtatgtcttgcgactttttcttgacagctggctatgatgtattgggtaaaaggaactgctgtaagttaggttttagtaatgtgctggtaagggtctaggggaggagtcctatgattaagtctcagtcttacctccctcccacccctcaggtgggataggaaggctagagtgggctggagttgggtatttcctttctctcatatggaaggctagaggagactggagttgagtctttcccttcccccaggtaggtgaggctttgataaaaccccagcaggttaggctccacttaagtagtttcttctgagggcagaccttgttaagaacagagtgccctggtgcatttcaaaatagttctttctttcttccccttgcctgaagcataaggggaatttactccagtgtttattgtgagaaccaagtggaactcctgggagtaaaactcacaaaagtgtgcccccttcccccatgactcggttcccctgcactttttgactctcagacttgttgacactgagcctccagcaattgatcagttccagttccagttttcctaccctgatactggttccttcagaggtttctgcctccatttcagctcaggaaagttgtgattctttgtatctgcttgtctgtctctaacttgggggacagtggtttgcctgtgacttcatttttcttacagatctaaagagttgatttttcagttggttctactttttccttgtgatggagaggtaacctccaaccttcttatatgctaaactggaaaccagaaacttccctgacctttttatggatgaaaatctttattttcatggttccttctgatctctggatagggaagagagatcagaaaggagcaataagggaggtcatgtgttgctgctgcaggccgagaacagccttgaggagcacagtgtcggatcccagacccttaggtcttccggctaaaagtgcctatcagcttggagaaggagcaccatggagataggtggtcctaagatccctcggggcagattttaagcacagctttttaaagaaatcctgccttaatacgtttatttgttattgttatcagaaagaaggcacacattcagacttttaataaggtgaatggcaggtgaatcaaaactggagttctttgatttaattacctccttctgccaatatttaggctaagattggtgttaactttcctccagatagaggtttccagaatatataaaatatgccttaaaataatgcttattaaagaatccatgagactgggtgcagtggctgatgcctgtaatcccagcactttgggaggccaaagcaggaggaccccttgagcccaggttcaagaccagcctgggtaacatagtgagacccctctctacaaaaaataaaaacaaaaaattagccaggcatagtggtgcacacctgtagtcctagctacttgggaagttgaggtgggaggatcccttgagcccaggagtttgaggttatagtaaactatgattgtgccattgcaatctagcctggatgatagattgagaccctgtctctaaaaaaaaaaaatttgttaattcatactgacactaacaaaaataaactttaaaatggtggaggtgagtggggaaaagtgaaacctctgctttacagaataccaacgaataaatgtaggaagaattttttaatcaacatttaataacgactataataataactgattcagacagcaatgatcaatagattataaaacctttggatgaaagattgttggagaaaaggatattcatatatctcaaagtgtcatgccacaggttatttattaattacaaagggaaaaggtatagtgaagaaatctagtgggtaccctcttcaaccagataatcaaatttggcatccccagttatgtaaaactgatatcacgtcccacctgatgtgatgcactgggaaggacccatcacctacatatacatggaatattcctggtatcgacgaaaagagtcaaactctgtaaaatatttgaagagatttattctgagtcaaatatgagtgaccatggcccgtgacacagccctcaggaggtcctgagaacatgcgcccaaggtggtcagggtacagtttggttttatatattttagggaggcatgagacataaatcaaatacatttaagaaatacattggtttggccgggtgcagtggctcacacctgtaatcccagcactctgggaggccaaggtgggtggatcacgaggtcaggagattgtgaccatcctggctaacacggtgaaaccccgtctctactaaaaaatagaaaaaattagccaggcgtggtggcgggcacctgtagtcccagctactcaggaggctaaggtaggagaatggcgtaaacccgggaggcggagcttgcagtgagccaagatcgtgccactgggcaacagagtgacactccgtctcaaaaaaaaaaaaaagaaaagaaatacattggtttggttcagaaaggtgggacaactccaagcaggggcttccaggctacaggtaaatttaaacattttctggttgacaattggttgagtttatgtgaagacctgggattaatggaaaggaatgttcaggttaagataaaggattgtgggaccaagttttattgtgcagaggaatctctcagcagacttcacagagagagaagaggttgtaaaatgtttcttatcagacctaaaagggtgcctggctcttagttgattatctcgtggatctggaaaggaaggaaaacaaagggtgaaggggatactctatagaatgtggatttttctcacaagagactttgcagggcaatttaaggcgtggcaaggaaatatactccttggggttaaatattttttccttgtctcataatgttgtgccggagtcatattgaaaagcaagtcacaatatacagggtcaaataaaacccatctgatgagaatccatgatatgtagggcatgactccctggaccccttaggtaggaatttgggtaagataaaaaaatcagagtttagtcctcactggcaatgatgtttggaggaaatagcaaagtccaaattgaaagacattatgcaaaacagcataagtgccccctccacccacactctattcctgtacgaaaggatacttgatacttcaaaaatgtccatgtcataaaagacaaaaaaggaaagagacaaaaagaaacattgttgggagaattagggagatttaggaactgtatatgttatataataataatatatttattgagtgtaataattgtattctagttatataggaggatgttttgttcttagaagatagaatcttaaatctttagtgatgaagtgtcatgatgtctgcaactaattctcagatggttcaggaaaaaatgtctgtgtctgtggaggaggaagaagaagggaaatatggtaaaatattaacaattgattatctaggtaaacagtatataataattggtcgttgtacttttcttgtgacttttaggaagatttaaaatttttcaaaagaaagtggaagacagattttaattacaataaaatttaaaaatgaaataacatttattctgtcttattgctttaggtgaaatccttaaccctgtttgtcacccattatccgccagtttgtgaactagaaaaaaattactcacaccaggtggggaattaccacatgggattcttggtcagtgaggatgaaagcaaactggatccaggtatgaaatattcctgcagttggtacaaatattggttttcatgtttgataactcaaagtttgttggaacatgaacttactgcttattaataatgaaagctgtgaatgtgagctataaataacatttgtcaggattcatttttgctaagctttaggtcaagtagaatttagatttatccttgctatctctgagtccttctctggtcttccttgtctcatttgtcgtggcaacccttttctctttttttacaggaatagggtgtgggtggagggggcacttaggttttcctcttagtgccttgtactcttacatgattcatctcagtacagatgacagtcacctgcagagtataattagtcatcttttaaaaacgcccaatattttccccaaaatatcatttaacttactaagggccatatactgtactggacataggtttttattttaatattataaggaaactgaatctcagacaggtaaagtggtttgaccatgtcaaccacttagatgggggctaaaatgagcctagaattcacttcttctgcttctgggttctcttctgttcccctctgctagagctgctatggaggaaatctacaatatttttcctagtctttccagttactggtgtcacagaaatgagacattttatgaaaaagaacaccgttagccaatagcaatacatttaagtgccataagtaatacagtagactttagcatttttttttctgttcagtagtaattgttttaagccaccagcctgtagtcctgtggtggtttgcgcaattggtatgctgcaatggaaaatccatcatgcaagataccccagagtccagattttattttggaaaagtaatagggatggacctgaaaaagaaatcaggcagctggcccaaataaaacaaagcactgggcctaagataaatgtaatgttaggcagttcctgcttttcaccaccatgcaatcttgaaaaacacatcataaattctcttatggaagtagttttgtatctattaatctgcatccaggttgacaagaggagacttaagctaaaacccttgggacaaagagaatagagttcaccaacagggaagaagaggagtcagtgccgctaatacgcatttgatgtgaactgaaaactaacccagagcattgtacctttcccttaaatgttctgtgcattttattttattgattttaatttttgtgttttgttgagatggggtgtcactgtcatccaggctggagtgcagtggcacgatcatagctcactgcagacacaacctcccaggcccaggtgatcctcccatgtcagcctccccggtagctgggactacaggtgcacaccaccatgcctggctgatttttgtatgttctgtagagacaggctctcactatgttgcccaggctggtctcaaactgttgaattcaagtgatcctcctgccttggcctcccaaagtgctgggattacagggatgagctaccttgcctagctgattttaatttttatcaatgaacataatttttaaaattcaatggtgctaaaaggctcctgctgacaagcttccatcccttcagttcacgtccttccccatcctagtcccaaggcaactactttcaacacttcccctttctgttgtatttctaagtaatatccgtattttcatgtctcttgcttcatcaagttgacacattattgatggacctctcattgtgttaattgagaatcttcaattttcccttcctctgtccttccagtatagtcatttcacatgtattgtatgtcattcatacttgttgttttcattattattgccatgctaaatattgcttactgatgagccaagtttggagacaagtacatttctttcttttacaacgttttctattttctcaaaaataagaattgactgtcctcattttttccattttgttttgttttgtttttgagtctatagctgaatcttcctgtaccctcagatagcttcgtaaaatgcctctctagatgtttttccacacaactgaacctactggttcccatttgtccactggggcccttcctcctggagccctttgtcctcctgctcatctgaactggctgctgtctgggcctgcggcacagctgtcatcctaagcctgccttgctggcatcctaggagttcccttacccctcttctaagcatgtgattgcaaggaacaaaacactcggtctcacactggctcagacaaaaggatgcagtatatataatcccatgttccatgacttccagaggaagagtgggcttcagctcctcctttttgtaattcccaggctctgtcttcctgcctggccagctttattatcaggctagtgacaatgactgcagctcttcctggcatcatgtccagaatgtccaaaggaagaagagacaagcatttcctgttcactctttcttagaacaagggaactttttctcagatgccttccagtatctcatgattgcctcattgcattttcagaattgagtaacaggctccttcttaaaccactccttagcagaggatggcaggggtgactttgatgggcctagatgaatcaggatcaacttctggagctggctttgaagacccagtcccctgagttaaatgattagggagttaattccttataaaatcaaggttttcttaggggtggaataaatgttgaattaggctactactaatatcaactaaaggaggtaaaagttttgagatttttcatgaatgaaaatgtttcacatgcttgttggccatgtatatgttgtcttttgaaaagtatctgttcatgtcctttgcctattttttaatgggtttggttttttcttataaatgtaagttccttatagatggtggatattagacctttgtcagatgcatagtttgcaaacattttctcccattctgtacgttgcctgtttaccctgttcatagtttcttttgctgtgcaaaagctttatagtttaattaggtcccctgtgtcagtttttgcttctgttgcaattgcttttggcctcttagtcatgaaatctttgcccgttcctatgtacagaatgataaaagcaaaacatcactgaccattagagaaatgcaaatcaaaaccacagtgagataccttctcacaccagtcagaataggtattattaaaaagtcaaaaaataacaggtgctggtgaggttgtggagaaaaaggaatgcttatatgctgggtgagagtgtaaattagttcaactgttgtgtaaggcagtgtggtgattcctcaaagacctgaagacagaattaccattcaacccagcaatcctgttactgggtatatacccagagaaatataaattgttgtgtcataaagacgcatgcacacgtatgttcattgcagcactattcacagtagcaagacatggaatctacctaaatgcttatcaacggtagactggttaaagaaaatgtggtacaaatacactgtggaatactatccagccataaaaaacaataagatcatgtcctttgccggaatatggatgaagctggaggccattttccttagcaaactaatgcaggaacagaaaaccaagtgttgcatgtttcacttataagtgggagttaaatgatgagaacacatggagacatagcggggaacaacatacactggggcctactagatgggggagggtgggaggagggagaggatcaggaagaataactaatggatacaaggcttaatacctgggcgattaaataatcagtacagcaaacctccgtgacacaagtttacctctatagcaaacctgcacatgtacccctgaacttaaaagtttaaaaaaaaaaacaacaactctatagcttccatgttcgaatttatagttcagccaggattagaattttagattgaaaaccatttcactcagaattttgaagcagtgctccactgcctgctgccttccaatattgttcctggctatatctgtgcttcatccattacctcttccccaacttctcctcttctgtatgaggtagaggccattgcgtaggtcatcagtaaaatgccccacaggtcttttggatggcttctataatactctatttcctatgatgtgataggtaaaacaatggacaaacagttaagaaacctgtgttttagtctattccaatctgtatgatcttgaacaagtcacctaacttcactcacccctaaatttttatgaatctgttctaaaagcaacttcagaaattatttgtcagtacacatctctttaataactgcttagagaagtttggcttaaatataaatcttgctatgtttccccataataagcagaaacatgaattattacttccactgactcaaagcagtgccaggtaaacattttaataatgtccatttaagaaatggccatagcttgtaagtagttacatcctcatcaagaacttttgctgtgagcctgtaaagaaatagagtttttctcataaaacaagttttattctctcccatgtggctttttctgactccatatttccatcctaccagcacccccaacccctctcgcacacagaggttaaaggagtacataattacagaaagagatcccccaggcgattatagaagagtggttgcgttctttaccttgaagatatgagaactaccataatttaaagtggagaccagcatataatgatacactcagcaactgtttgtatgttaacaaggtattcagagcagtgaaatattttatgtaagttagctatattttgtagctatattatacattatatatataattatataagaacattgttacaactatctcttgtgcactctttatatatgtatacatatatacatatatatacatatatacatatatatatacatatatacatatatatacacacacacacacacacacactatataaaaaaattaaaagtcattaataggctgggcatggtggctcacgcctgtaatctcagcactttgggaggccaaagtgggcagatcacctgaggtcgggagttcaagaccagcctgaccaacatggagaaaccctgtctctactaaaaatacaaaaagtagccgggcatggtggtgcatacctgtaatcccagctactcaggaggctgaggcaggagaatcacttaaacccgggaggtggaggttgtggtaagtcgagatcatgccattgtactccagcttgggcaacaagagcgaaactccgtctcaaaaaaaaaaaaaaaaaaaattcattaacaaatttttggatagggggattttgtggcatttatcaggctcccagaaaatactgatggctggatggatggatagatggacagacagacagatgaatgaatcttgtttagaaaggtcagcatgggatctagattatattggagagctggagacagggagatcagttaggactaacacagttgaagtgataaactatttttctgtcttaaagttaagaaatggctttttttgattgcctattgcctttcacttcactcttagtcttgtgaactttgaagagttacaaaaaattatccaggtttgcaggcactggcttctagctgcatcttccctaatctgttcccacctacttccgcacctgtgtttctcaactttcatttgggggcaaaaggtactgtcagtgccttgcaacggaagtttaggtctgtgtttctgagtgagttggcattctttccacctcccacttcagcacccacccttggaaagctcttatctgtctgctgccgaattcttagaggagggccaggaaaaatccattgtcctttttctctgtcatgttcagtctttggctttttaaattttcactgataaaagaagaaaagcatacacatctatcaaatgaaataatgattgagaaaaagcttttaataaactcataagtatactgggattgtagaaatctttgtaactcttgtccaccttggacatttctgcagcacagtgcacattttgcagcacaattatattgaatttcataataaaagttacataatatcctgagctgctttagcttaaactacatgcagtggtttatgataattattgtacttcattatatcccagttcttttaaagttttaagttcatgtgtatgtatatatatgacaggctgggtcctctaggaggcagattctgagatttgcattcaggaggttcattcggagtgctgggctgtgttatggtcaaaaggcttcagccagccctgcagagaactctgaggctagagtggtccttcagagttacctcaacttggggtgagggggatagacctctatacctttattagttatctctattagtttggggtaatttgcaaacagtgtgcaacagattaccccccaaaacatagcggcttagaacaacaaacatttattacctcataatttctgtgagtcaggagtccaggtgcaacttagctgaacacctctaaggctgaaaactgtagccctgtaagagaccctctagttcggttcctcacagggctacagtcagtcactaatcagggcagcagccatgtcaaggcttcccagcccacacatggctcttgccaagcctcccaatatctgcttccaagcccactcatgtggctgttggcatgccttaggctctcaccaactgttggtgggagacatcagtttctttccatgtgagcatctccacagacagcccacaacatggcggctggcttccctcagagcaggcaggcaacaaaatgagagtacccaagtcagaagccacaacctttctgtaacctaatctctgaagtgacatctcatcacttttgccgtattctgtttgttagaagtgagtcactggttaggaatgatacagagagggaatgacacaagcacgtgaacaccagcaggcagaggtctttggtggccatcttagaggctgcctacaacaaccagtcactggctgtaggctgccccaaagcgggatgtggtcttgggtgaagcccctcccttcagctgcaacaatttccaaagaaggcaaacagtcgagggttgcaggccagcaatctttctgacagctgagggaataaactctttagtcctaagtgggatctgggtggtactgaacagaatccggtatgtatagctcttagttaacctgaatatttaataaaccagaccatcttaatcctgttatttaaactggccaacatgtaatattttcttttctgtttttaagggagaaattataggcctggtatggtggttcatgcctgtaatcccagcactttgggaggccaaggtgggtggaccacttgtgcccagaagttcgagagcagcctgggcaacatggccaaaaccccatctctacaaaaaaaaaattagctaggtgtggtagtatgcacctgtagtttcagctactcgggaggctgagatgggataatcaccttgaacctggaagattgagactgccagtgagctgagattgcgccactgcactccagcatggatgacagagtcagaccctgtctcagaaacataaaaaggagaaattatattgtatcaaccacgtactaagatcattctcatcctggcgcagtggctcacgcctgtaatcccaacactttgagaggccaaggagggaggattgtttaaagccaggagttcgagaccagcctgagcaacatagcaagacctgatctctacaaaaaatattaaaaaattagctgagtgtggtggcatgaacctgtagtcctagctacttaggaggctaggcaggaggattgcttgagcccaggagtttgatgttacagtaaggtatgattgtgccactgcactccagcctaggtaatagaacaagaccctatctctaaaaaagtaaataaataaaaacattctctttttaatatagacgttcagttcaaatttgcaatgaatcattgttaaaaactattttaagtgaactaaaagatagatcctatatgcacacagcagtttcaaaacagtatttacccttttctagacatatcaaattgataaatggatctaacaggcaagtaggaacagtgatttcagattgtacgatttaataaagttatgagaacttacatgtcctttttaatcctctaatttatttcagctttcaggcacagttttgatctcctttctttatttcacaggcgcagcagaacaagtccctgattttgtcaccttcctttaccaaataactagaggaattgcagcaaggagttatggattaaatgtggctaaactagcagatgttcctggagaaattttgaagaaagcagctcacaagtcaaaagagctggaaggattaataaatacgaaaaggtcagagtgattatgctgcattttttcatttgtaatgaaaccttctaagttgtccaagaaagagaggagcgtcctaaaaatgaacatcaggtctacttttaagcacctcttcaaatattctgaaccatttaattatgatgaagtgaaaacagctcttgcaaagctcaggtgaattcagtccatcttcattagatcattattaagttgctaaattggtttttcggtcatttttataaagaattaagttaactccttaatatgtgccacattcattactttaaagattcagtatgccaaaggttactgaagatattgagaacctacagaagatttcttttattcatagattttattcagatatgcaacgattacatccagaaattctatcagagcattaatgaaaataatagtattacataacaggcaatcacagtcagtatccacatgtcacttattttgtagattgtgacaaatttttcattctaaacaggctgctgtcactttaaatgcttatgggaatactttccacctttacgcttgctatccagctagtatgtagtcagtacataaattaatcttaatgtaaacctgagatacactttgaaagaaagatattcctagaaaaatatcatattagtaaattatacccttttgtttcccaaatataaaattctaaaacaacataagctccccatccacctactgccccacccctgccgtacttggggagcctggtgtgctgggtacattagtaccctggttgataatcatatgaccatgatgaacagattgttgatcgaatagaaaatcttggctggctactggtggtccctgtgttatactccaataatattctttaatatttggttataattctgggaattattaccaaatttcaatattgaaatagtaatgcctatcatactagctaaagaaacagttgctaacttgtttaccaaagtacagtagtgcagttaacttctctttctctacctccttctcctgtgcttccgccttgcactcctccacttcggtatactgtagttcaccaagtccagagtgctggactctacaaatggcacacagcctcctctagtgacactcttttctggctcatttccaaattgcaatgccaaaacagaagcaaagtggcataatcagtttcagcctatttctgttacaagccagattaatataaaatttttcctgagggaaaagtatctatgagaatttaaaaataaacttagccctcttcctctgcaaagtccagagacaaattaaactctttagttgccatattattattgttctttttctctgaaaaaaacctagaataaaactttactacaaaggatatatatacaagatagtaataaaatatgtcaatttctaaatttgctgtagaaatatatgcaagatagcaataaaatatggcaatttctatattttcatatattcttgtttctgctatatagcctataaagcaagagcaaaaaaactctcagattactcataaatattttaactcttccaactagtaagtgacattttgaactctatgaagttatcttgacaagatgagagaattattagaagacattgcattgggatggaatctgatcatttatcaagatactgtatttgttattttaccttttttctaaaagtgcttatcacatcaattcctttggccagatcaaagaaatcaaactgcatcttgggccttactgtggatttgttataatagttgctatttgttggatggttactgtgtgtagaaaccattctgagcagtcatttgcagcagcctacacactgtgccagctactcttctcatcactttacatacattatctcatttcatccttatggcagccttatcctcatggtatagttggggaaagtgagaccagcaaggacaggacactgacccagagtcacacagctacttgatggtggagcagtaattggaactcaggtactctagctccataccctaaatagtcaattgggttgctattctgcagaaaaaaaaaaaaagtaagtctgtgttatgctggcgttttactctttaattagcttcattgttttcggttggtgttacttttcatcctgggaacacttcataggagtttcttttctccaggtacaaataagcacacaccaccagcctctagcagagtttgaaggaggaggaggtcaggttctcccctctggggctggcaggggtaaggattttaggagaaggcacaaaggtaatagtggcaattggtaacctgggtcccttgattatagtagcagctctgaaagctcctttcactggaagggtgacactgacacagcttcctaactatagagcctgcccggtattcaagtgttatagacttttcatagcttctgatgagacgtattgtctcccagcaatttcatttattaaataagtagtatttgatttttccccagaaagagactcaagtattttgcaaagttatggacgatgcataatgcacaagacctgcagaagtggacagaggagttcaacatggaagaaacacagacttctcttcttcattaaaatgaagactacatttgtgaacaaaaaatggagaattaaaaataccaactgtacaaaataactctccagtaacagcctatctttgtgtgacatgtgagcataaaattatgaccatggtatattcctattggaaacagagaggtttttctgaagacagtctttttcaagtttctgtcttcctaacttttctacgtataaacactcttgaatagacttccactttgtaattagaaaattttatggacagtaagtccagtaaagccttaagtggcagaatataattcccaagcttttggagggtgatataaaaatttacttgatatttttatttgtttcagttcagataattggcaactgggtgaatctggcaggaatctatccattgaactaaaataattttattatgcaaccagtttatccaccaagaacataagaattttttataagtagaaagaattggccaggcatggtggctcatgcctgtaatcccagcactttgggaggccaaggtaggcagatcacctgaggtcaggagttcaagaccagcctggccaacatggcaaaaccccatctttactaaaaatataaagtacatctctactaaaaatacgaaaaaattagctgggcatggtggcgcacacctgtagtcccagctactccggaggctgaggcaggagaatctcttgaacctgggaggcggaggttgcaatgagccgagatcacgtcactgcactccagcttgggcaacagagcaagactccatctcaaaaaaaaaaaaagaaaaaagaaaagaaatagaattatcaagcttttaaaaactagagcacagaaggaataaggtcatgaaatttaaaaggttaaatattgtcataggattaagcagtttaaagattgttggatgaaattatttgtcattcattcaagtaataaatatttaatgaatacttgctata

SEQ ID NO: 58 - DNA, 23872 bp, Homo Sapiens
ggcgaggcgcctgttgattggccactggggcccgggttcctccggcggagcgcgcctccccccagatttcccgccagcaggagccgcgcggtagatgcggtgcttttaggagctccgtccgacagaacggttgggccttgccggctgtcggtatgtcgcgacagagcaccctgtacagcttcttccccaagtctccggcgctgagtgatgccaacaaggcctcggccagggcctcacgcgaaggcggccgtgccgccgctgcccccggggcctctccttccccaggcggggatgcggcctggagcgaggctgggcctgggcccaggcccttggcgcgctccgcgtcaccgcccaaggcgaagaacctcaacggagggctgcggagatcggtagcgcctgctgcccccaccaggtagcggggtgggggtggggtcgaaggcgggggcatagcggcggggcgcttggaacccggcgaggggaggctcgcacagggggttgggggggtgcacggcctggccctgggctcggaggaggcggggccgcagagttggcttgaatgagtgcaggggtcgagtctggagcatttgggggtgtagcttgtaaacagggtcggaggagagaggctgtgcaggaagagggctgcaggggagacgcggagagttcgggccttttggagggaggagacgcgtcccgccaggtgggggtgctgggctaaggaaggggcgacgcgcgcagctccgggtggggagggggcctgggaggtgggagcactgggggtggggcgagaaggggaaggcgcccggcccacttggtgggcggggcggggggcggggtggcgggaaggaggaatgcctgcgggaggccgaacggggagagtccggtggtgtggggtgcgaaaggaggttcctcggccggcgcggagatagtgagttggggctccagtagtcgatcgaggtagacacttagaggtagttaagagccgcggtcgccgagacgccttggggacggtgggccttcggcctaggtgaggggccgccgagggggtgggccacgagctgcgagcgcgggggggtgtgtcaccatggggaccgcggggcctaattgggcggggcggggccgtggggagccgaagtgctgggatccggctgggtccttcggtaggtaggctgcacgtgcaccgagacgaagatagaatattttgacgtatgtggaaattcgtgtcgagtggaaaatattttattttatgaaatagtgtaatttttatggggcaccactgggcttttagaggccttaatcgggcgctggacaaagatgtgtggacgtgagtgactccggggaagcctgtcgggagttgtcctcactttatgggcagttaagtgcttttttttttttttcctttttgagagagagtttcgctcaagtccaggctggagtgcaatggcgcgatctcagctcaccgcaatctccgcgtcccggcttcaagcgattccccagcttcagcctcccgagtagtcgggattacaggaatgcgcccccacaccccgccaattttgtatttttagtagagacggggtttctccatgttggtcaggctagtctcggaattcccgacctcaggtgatccacccgcctcggcctcaaagtgctgggattacaggcgctagccaccgcgcccggtctgtttagggctttttatccgggcagctggcgacattttgaaaagcttgcttttgctgtttgccagatacatatatatgtattttgagacagagtcttgctcttttgtccaggctagagtgcagtggcgcgttcttggctcaccacaacctctgtctctggatcaagagattatcctgcctcagcctcccaagtagctgggactacaggtgcgccccaccacgcctggctaatttttgtatttttagtagagacgggtttcactatgttggccaggctggtatcgaactcctgacctcttgatcggcccgcattggcctaccaaagtgctgggattacaggcatgaaccaccgagcccggccgtttgtcagatactaaacacaaagtttaatggtcgctatttgaacaaacgaagaaataaaggctcagaaaaaataactcattcaagataagagccagttcgtgttttttgtttggttttgttttgaaatggagtctcgctctgtcgcccaggctggagtgctgtggcgctttctcggctcactgcaacctctgcccgccgggttcaagtgattctcctgcctcagcttcccgagtagctgggattacgggtgtgcccaccgcggtccggctgatttttcaccatggagtttcaccatgttggccaggctggtcttgaaactgctgacctcaagtggtccacccacttcagcctcccaaagtgctgggattacaggtgtgagccaccgtgcccggccgctagttagtggttttgagtaatggatttcaaatccatttaaatccagtttaaagtgtcctaaaggaattctgagatttttctaagtgtaattatagtgttacccttgtttaagcgaccctttcccgcagtttaaatatatatagttgtgcattagtagaatatgcttgtggggaacagagccagcatccgcaataacaaactcctggttagaaaagcatgacgtattgtttacttgagcatgaattgattgttgaatccaaaccaaacgggtgtatttattgtaaggatgtactttacattcatattgaatagcgtatgttatttgtttcttgaggttgagtttaagagacttgtaaaaataaaacgtatacatttcacctcccgttatggagaggattccagggtattcaagaaagatgggcatttgatactaggtttctaaagaaactgcagtgtctagatcactctgccgagcacagcattaggcattatggatcctggatacaaccatgaacaggacaaagcaaagaggcaattgtagactccaagtggaaaggggacggagaggatgcgggtcaggctaggctctcagctctgtaaaccgaaaccagaaggacaaataagcttagacagattatagtgagagtgggaagctggttcaggaagaggaaggtctgcaaattgtgggtaggatgaaaggaggaggagggagcattggagaagttaagcagagatccaatcatgaacagtctgatgagctacagagacattcggacttactccatgaatcatttaagccttaaaacatgttgagcgtattttttttttttttgagacggaatttcactcttgttgcccaagctggagtgcagtggtgtggtctcagctcactgcaacctccgcctcctgggttccagcgattctcctgcctcatcctctcaagtacctggtattacaggtgcctgccaccacgcccagctaatttttgtgtttatagtagagacgggtttcaccatgttggtcaggccagtcgtgaactcctgacctcaggtgatccacccacctcagcctcccaaagtgttgggattacaggcgtgaaccaccgcacctggccgtgagccaccgtgtctgtccgagcatcttttaatgtttgtcatttagatttcttcttgtgctgaagtgtttgtcttttgctgtttcttttttttttcctagttctttgtcatttgtgtgtgatataaatgtcttctttcacaatgagttctttcatttagtttatggctttgttgttgttgttgaataatagaggtctcactttgttgcccaggctggtgttgaactcttgctctcaagcgatcctcccacttcagcctcccaacctgttgggattacaagtgtgagccaccacacccagccttatggcatctttcgatgaacaaattattgattataatgtggaatttgtccttttattttctctgtggttagtgtttctataggttttatttaagaaatccacagggaggctgggtgcagtggctcatgcctgtaaacccaacactttgggaggccaaggcaggccaacatggctagaccctgtctctccaaaaaataagaaaattagccaggcatggtggcgtgtgcctgtagtcccagcttcttgggagactgagatgggaggatcgcttgagtccaggaggttgaggctgcagtaagccaagagatcatgccatgcactccagcctgggtggcagagtcagaccctgtctgccaaaaaataaaataaaagttggtgaaaatgttgattatatattttaggaacaactagtaattgacatcaaaattatgggctaaagagaaagcaaaaataatgtgattttaaaccagaattcaaaagatctgtttagcgtatgtttagacaaagccattacttattatatcaaagttttaacatttattttgtgagctgtcagcttttcctcttaacatttttccccaccgtcttaaaaaaccccaagaataccggacatttaagactcacttaaagctttaaaagcacttgcaaaatcctaaaatcataatttaaggtgtttttggagggcaggagcaatggtggcaggcagtgttttgctttgttgcccaggctgaagtacagtggcagatctcggttcactgcaccctcgacctattcggctcaagtgatcctcccacctcagctttctgagtagctgggaccccaagtgcacaccaccccatgcctggctaatttttaaatttttttgtagaaacaaggtctcactgtgtagcccagatggtctcgaattcctgggctcttaagagatcctcccaaagtgctgggatcataggtgtgagccaccacacctggcctattttggcattcttgaaaaccgcaggattaccacggataaaattttaaaattacctttaaagaattcaggtttacacacaaaaaaaatttggtttgttagcagtgagtgaagaaaaattttgagaaatgtttaaaatttttagttttgttacacaatacattttactacctgtttaattatcttttttgactcagaaaccagtttcctgggtccaggatgtttagtggtactctttttcttcaagctttttagcattggaggaactgcatattagtaaaatttttagtcttagcattttatagcttactgctatttcttttctttcattctttctttcttttttttttttttttttttttttttgagatggagtctcgccctgtcacccaggctggagtgcagtggcacgatctcggcttactgcaacctctgccttccaggttcaaatgattctcctgcttcagcctcccgagtagctgggattacagatgcccgccaccatgcccagctaatttttatttttttagtagagatggggtttcaccatgttggccaggccagtctcgaactcctgacctcgtgatcaacccgccttggcctttcaaagtgctgggattacaggcgtgagccaccgtgcccagcctttttctttttctttttctttttttttttttttttgagacggagtcttgctctgttacccaggctggagtgtagtggcatgatctgggctcactgcaacctccacctcccgggttcaagggagtctcctgcttcagcctcccgagtagctgggattacaggcgcctgccaccatgcccagctaatttttgtatttttttagtagagatggggtttcgccatgttggccaggctggtcttgaactcctgacctcaggtgatctgcctgcctcgtcctcccaaaatgctgggattataggagtgagccactgcgcccggcccagcatactgctatttctttctttctttcttcttccttttttttttttttgtttttttttttttttttttttttttgtgagacggagtctgtcgtccaggctggaatgcagtggcgttttcttggctcactgcaacctctgctgcccgggttcaagtgattctcctgcttcaggctcccaagtagctgggattataggcctctgccactgcacttggctaatttttgtatttttggtagagacggggtttcaccatcttggccaggctggtcttgaactcctgacctcgtgatccacctgccttggcctcccaaagtgctgggattacagacctgagccaccgcacccggcccatactgctatttcttaacagcagagaaattatgtgtcagattctgtaagtgtaatggtatataaaggataaaatgatgttgaaaaacaaaattttttgtttaaatgcttatgtttctaatattttatttcagaaaggaatttatttcaaaactgataatggttggatccagcttttcacacaaacttttttttcctagtgaggatgcacatttatcctgtaaacaaatggaagacattatttttttaattgcttgcttagaaatgaaataattcttttctaatgatcttttaaagcatgagacctcatacatcatttaaaacaatttatactgtattttacacatgacaaagttctaaggtaacagcccttttctaagactaaagttacagtcctccctttgtatctgagggggattggttgcaggacccccctgtgaatacccaaatccttggatgtccaagtcccttatgagatgtagtatttgcatataacctatacacatcttcccctgtactttatctctagattacgtacaatacctaatagaatgtaaatgctttgaaattagttgttcagctgtattttaaattttgtattttttttcctttttttttgagacagagtcttgctctgttgcccaggctggagtacagtacagtgatcacagctcactgcacctttaacctcccaggctcaagctgtcctgcctcggcctccccaagtgttgggattacaggtgtgagccatcatacctggtcactgttttttattggttttaaatttttgatttaaaatttttaatctaggttggttgaatctggactggaacccaaggatatgtttgttgagcatactgtatttactttggaatacaactagaatgcttaacttgtatgttaaaaatactttatttggccaggcgcggtggctcacgcctgtaatcccagcactttgagaggccaaggcgggtgaatcatttgaggtcaggagtttaagacgagcctggccaacatggcaaaaccctgactctacaaaaaaaaggtaaaaataagccaggtgtgatggcgtgtgcctgtagtcttggctattcaggaggctgagacacaagaatcgcttgaaccggggaggcacgttacgccctcagttgttgacttgagtttttccgtagtttgtagggggagggtaatagagtattaggtagcttttggaatacataggagtgtaactggaaaaagattccaagcaagtctaatgaattagataatttacctaattagtaaattatgtaatcagtatgctttataataatattgtgagttagatcctgtttctgatatgtacataccatattgtataggtgctactaatttggagagcatatacagtgagtccatgcctttttcctgccatcagcattataccaaaattctgccatggtttttaaactttgattctgagaaagtttctcaccctaataacataactatatttgtgtttgtcttcatagttaaatatgcattatgatatcagcttgcatacattttttaaatgacttgaatatctgactttaaaaattattctagaatttctgtgcttcaatattaatgccagaagacttggaattgtttatttgtaggtaactgcctttaaggaaacttgaccaaatattaactaagttatgtatttccttttggcaacagttgtgacttctcaccaggagatttggtttgggccaagatggagggttacccctggtggccttgtctggtttacaaccacccctttgatggaacattcatccgcgagaaagggaaatcagtccgtgttcatgtacagttttttgatgacagcccaacaaggggctgggttagcaaaaggcttttaaagccatatacaggtaagagtcactactgccatgtgtgtgtgtttgtgtgtgtgtgtgtgtgtgtgagagaaacagacagacaggcagacttttttctatatgatgaaattaagtgtattttaccccagtaaattgcaaggggtggcagttgtgaaagcttctggcatgggaaagggatgtaacatggtctttagctggtttgttttgtggaatggaatttttatttctgtcctttgagtgacttacagcaatattatacccttaataagggtaaactaaactgtccccccatcttgaagggtccaagagaaagttaatgtcatcaggatacatagcctatagatagcgacattctctagggaaagatggagatgcgcactacctggccttcaaactactcactaatgaacacatctgagttgagtttcacaccaaactcctggaaccataactttcttttcccagatctagtcttgtttatcacagacatcaacagcctggcatgtttagcctcacttgggctaggtgcaccccatcgtctcttgtacaagttctctttctttcttttttttttttttttttctggagacagagtctcactctgttgcctaggctggagtgcagtggcgcaatctcggcccactgcaacctccgtctcctgggttcaagagtttcctacctcagcctcccgagtagcttgggattataggcacacgccacgttgcctggctatatatatatattttttttttgagacggagttttgctcttttggcccaggctggagtgcaatggcgcaatctcagctcactgcaaccgccacctcccgggttcaggtgattctccttcctcagcctctaaagtagctgggattacaggtgcacaccaccaagcccagctaattttttatttctagtagagatggggtttcaccatgttggccaagctggtcttgaactgctgacctccagtaatccacccacctccccctaccaaagtgctgggattataggcgtgagccactgtgcccagccgcccagctaatttttgtatttttagtagagacggggtttcaccatgttggccaggctggtctccaacttctgacctcaggtgatctgcccatttcggcctcccaagagtctccagtctagtacgttgtcgtactcggtgttgtaaaatccaaacaagggtcagtttcccaggtaactgggaaattcccagaatcacactctttcgtcatagtgctcatcctacaaaaaaggattgggggcattttgtctaaaattaaatgtaaatggtgatctgacatacaggtggaaagagaattgggaagttttgttctctcttctaccaacttgccacataatcttggccaagcaaagtaacttgttttttcttttaatctttttaaaagaaatagagacacagttttgccatgttgcccaagctggtctcaaactcctgcctgagctcaagcagtctgcccacttcggcctcccaaagtgctgagactacaggcataagccaccatgcccctgggctcggccaactttttcgttttcttttcaagagatgggggtctcactctgtcacccagcctggagtatagtgttgggatcatagctcactggagccttgaactcctgggctcaagtgattcccccctgttttagcctcctcagtaaccgggactagaggtgtctgccaccacacctggctaatttttatatagttttttttttttttttttttttttaaagagatgacggtcttgctatgttgcccccagggtggtcttgaattcttggcctccagtgatccttctgcatcaggctcccaagtagttgggtgatctggctaaagtaacttattttctgatactgtttacttatatttagaatgaatctcattggggttgcactggggccgggcatggtggctcacacctgtaatcccagcgctttggaaggccaaggcaggtggatcacctgaggtcaggagttccagactagcctggcaaacatggtgaaatcccgtctctactaaaaatacaaaaattagctgggcatggtggcacatgcctgtaatcccagctacttgggaggctgaggcaagagaatcgcttgaatctaggaggcggaggttgcagtgagtcaagatcatgccaccgcactccaacctgggtgacagagcgagactgtctcaaaaaaaaaaaaaaaaaaaaaaaaaaaaaggctgggcacggtggctcgcgcctgtaatcccaacactttgggaggcccaggcgggtggatcacgaggtcaggcgttcgagaccagcctgaccaagatggtgaaacactgtctctactaaaaatacaaaaataagctgaaatcccagctactcgtgaagctgaggcagagaattgcttaaacctggtaggcggaggttgcagtgagccgagatcgcgccactgcactccagcctggggaacggagtgagacttcatctcaaaaataaataaataaataaataaataaaataaaataataaataaagtaaaaagatctctcattgaaccagatgatatatgaagtctcttttaggaccaatttcgagatttaaaaaatttggcagaattactttttttttttgcagcggagtccagctttatcacccaggctggagtggaatggcacaatctcagctcactgcaacctctgcctcctgggttcaagcgattctcctgcctctgcctcccaagtagctgtgattataggcgcccaccaccaggcccagctgatttttgtatttttcagtagagttgaggtttcaccacgttgtccaggctggtctcaaactcctgaccttaagtgatccgtccaccttggcctcccaaagtgctgggattaggtgtgagccactgggctggcccagaatgatttttaaaaagagatcagtaaggccaggcagtggtggctcacgcctgtaatcccagcactttgggagactaaggtaggtggatcacctgaggtcaggagttgcagacaagcctggccaacatggtgaaaccctgtctctactaaaaatacaaaaattagccaggcatggtgacacatgcctgtaatctcagctactcaggagggtgaggcagaattgcttgaacccgggagtcagtttcttttttctttttttgagatggagacccactttgtcacccaggctggagtgcaatggtgcagtcttggctcactgcaatctctgtctccggggttcaagtgatcctcctgcctcagtctccttagtagctgagactacaggtgtgcaccaccacacctggctaatttttgtatttttaggagagatggatgtcaccatgttggccaggctgatctttaaactcgtgacctgaagtgatccacccgccttggcctcccaaaatgctgggattacaggtgtgagccaccacgcccagccctaaagttgtattttgatggaacgaactgttttgagaaataaattttaacgcgttgagtctgaactgggctgccctttcaaaatgtgaaggccccttaaagtagcacattggttggttattcttttatttatttagatatatctgatctagttgtctttgggacaaactcatatttaatatcatagctgcatgtaactgacagtgtagtctttgtcttcctgaagtgtttgtttgttttttgagatggagtcttgctctgtcgcccaggctgaagtgcagtggtgcgatcttggctcactgcaacctctgcctcccgggttcaagtgattctccttcctcagcctcccgagtagctaggactacaggcatgtgccaccacacccagctaatttttgtatttttagtagagatggggtttcaccatattggtcaggttggtcttgaactcctgacctcgtgatctgcctgcttctgcctcccagagtgctgggattacaggtgcgagccattgtgcccagctagtaagtttttaagaaagattctcaaacctcttttaaatcgtctgcctcacttgaagaggtatgccctacctgtttagggctgtagacccaggtcattagaagacagactaagtagtcctgggtgaacccatagggcaccttcaaggaggtaaaattggtgattttagtttcaccagtagtttttccctgaatatttattccttttgtgctttattgatctatctatatcaataaaaagtaatggggcataacaaattatacttgtcattcttgttcattagggcaaatgttgtaggttgagtcaagtgtccagccaacaagttattttatgtgtgtgtgtgtgtgtgtgtgtgtgtatacatatatacatttttttttttttttttcatcgagacagggtcttgcactgtcgcccaggctggagtgaagtggtgcaatctcggctcactgcaacctctgcctcccaggtttaagtgatcttcccacctcagcctcccaagtagctgggactacaggcgcacaccaccacccttggctaatttttgtattttttttttggtagagatggggtttcaccacattgcccaggctggtcttgaattcctgacctcaagtagtccgcccacctaagcctcccaaaatgctgggattacaggcgtgagccaccacacctggcatatatatattttaagatagagatggggtttgctatgttgcccaggctggtcttgaactgctgggattacaggcgtgagcctctgcacccggcccttattgtttataaatacatttctttctaggttcaaaatcaaaggaagcccagaagggaggtcatttttacagtgcaaagcctgaaatactgagagcaatgcaacgtgcagatgaagccttaaataaagacaagattaagaggcttgaattggcagtttgtgatgagccctcagagccagaagaggaagaagagatggaggtgggacacggcaagcattcagttgttatttatgttagggtgatgggggaagaaagggggagggtgtattaacaagataccttgttttatatatgtgtgtgtatatgtattattttattatacatacatgcatacttctgtagttccctggactgtaggataagttaggttacttagaatctcaacagctagcatcgtttttacttaggttttcaagcctactggcagggtaagcaagaggtagtaccattttggtaagaagtagagagctagggacagtaaagatggagtaatatatatatgagggtatagtcaggccctagaaattaattatccagttttatgctttttataaaaaaactgagatggggtcttgctatgttgcccaggctggtctcaaactcctgagttcaagggatctgcccacctgggcctcccaaagtgttgggattacaggcatgagccacagcacccagccccagctttatgcttttaattctaaaactttttttgttgtattttgcattcataagaatagatgttaaataaaccttgaaatacaaccttggctcaaacgttaatggtcatggataaagtgaattaaaacttgttaggggccaggtgtggtggttaatgcctataatcccagcactttaggaagctgaggcagttggatgtcctgaggacaggagttcaagaccagcctggccaacacagtgaaaccctgtttctataaaaaatacaaaaattagctgggcgtggtggcacacacctgtagtcccaaccacttgggaggctgaggcatgagaattgcttgaacttgggaggcagagggacttgggaggcagagggtgtagtgagccaagatcgcaccactgcattccagccagggtgacagagcaagaagactgtcaacaacaacaaaaaatgttatagaagtgaaaaaaattgattaatttagaacaagcttgtccagtctgtggcccaggatggcgtttaaatcagcccaacacaaatttgtaaactttcttaaaacattttgtgatttgttgttgttgtttagctcatcagctatcattagcattagtgtattttatgtgtggcctaagacaattcttccagtgtggcccagggaagctgaaagatcattatcctctgatctatcatattaatgagctgcatcctaaaagacattcatctataactaagctcagtttcatgttttgttcctttttcaatagataagatagggaatgagcaagttaataaagtgggtattttaattttaaggttgaaactaaggatcataacattatcagaggtctagaactggatggcagctacagagatcatttagcctaatactggtttaacaaataatccgggagatccgtgatatgtgaatgtgctaggcctgagatgagacagccaattgtggaagagcaaacactagaaccagtataagttgcttactgctttcttatgctattaatgagcatatcgcctcctgatatttatgatatatggtcatgccaacagctttgtcataaatagaactcccatggcagcaatcacttaatcttgtagttagaggtggggtctcaccatgttgccgagctggccttgaacttctgggctcagcgattttctccacaggcacctgctactgtgctcggtgcagcactttgtgtttttgaacataacctcaagatgttattgtcttcatagtaaaacaaaagatgaggcttagaactggatcactttgcctgtctcttcttacctcctcccagttcaaaatgcttgcatctcttaatagctagcattcccttggattttgcacatgagctcaaactcaagcctcagcacaatcttttttatagttttagtcttttagccagagtcgacttaccccccatacccactctgcttccttcataatgctgctttccctgggcagagaatccttgcccttcttgtattatgtcactttgtggggttggtgtctgctacacttacagcaagtccagagattttttttccaccacgtttgcaggagaactattggcatggaaaatgacaattgttttaatgtcaagtgaaactgaagttgatgttcattgagaggtttctaatttctagaggtgggttctttttttggcatatgaagttgcagcatattaagagaatttacagtagtacagatggggttatcccatccacaacttatgatggggttacataaactaaaaacgtgtttaatacacctaccccaccgaatattgtagcttgggcgtagcctaacctatctcagacgtgctcagaacacttaaatgttagcctaaagttgggcaagatcatctaacacaaagcctattttataataaggaattgcctatctcatgtaattcatcgaatactgtactaaaaatgaaaaacagtggctgcacgggtaccattataaagtcaaaaaatcataagttgaactgtcttacattatggttttccaaattttgatttgtttttaaatactctttccttgcctggcaggtaggcacaacttacgtaacagataagagtgaagaagataatgaaattgagagtgaagaggaagtacagcctaagacacaaggatctaggcgaagtagccgccaaataaaaaaacgaagggtcatatcagattctgagagtgacattggtggctctgatgtggaatttaagccagacactaaggaggaaggaagcagtgatgaaataagcagtggagtgggggatagtgagagtgaaggcctgaacagccctgtcaaagttgctcgaaagcggaagagaatggtgactggaaatggctctcttaaaaggaaaagctctaggaaggaaacgccctcagccaccaaacaagcaactagcatttcatcagaaaccaagaatactttgagagctttctctgcccctcaaaattctgaatcccaagcccacgttagtggaggtggtgatgacagtagtcgccctactgtttggtatcatgaaactttagaatggcttaaggaggaaaagagaagagatgagcacaggaggaggcctgatcaccccgattttgatgcatctacactctatgtgcctgaggatttcctcaattcttgtactcctgggatgaggaagtggtggcagattaagtctcagaactttgatcttgtcatctgttacaaggtggggaaattttatgagctgtaccacatggatgctcttattggagtcagtgaactggggctggtattcatgaaaggcaactgggcccattctggctttcctgaaattgcatttggccgttattcagattccctggtgcagaagggctataaagtagcacgagtggaacagactgagactccagaaatgatggaggcacgatgtagaaagatggcacatatatccaagtatgatagagtggtgaggagggagatctgtaggatcattaccaagggtacacagacttacagtgtgctggaaggtgatccctctgagaactacagtaagtatcttcttagcctcaaagaaaaagaggaagattcttctggccatactcgtgcatatggtgtgtgctttgttgatacttcactgggaaagtttttcataggtcagttttcagatgatcgccattgttcgagatttaggactctagtggcacactatcccccagtacaagttttatttgaaaaaggaaatctctcaaaggaaactaaaacaattctaaagagttcattgtcctgttctcttcaggaaggtctgatacccggctcccagttttgggatgcatccaaaactttgagaactctccttgaggaagaatattttagggaaaagctaagtgatggcattggggtgatgttaccccaggtgcttaaaggtatgacttcagagtctgattccattgggttgacaccaggagagaaaagtgaattggccctctctgctctaggtggttgtgtcttctacctcaaaaaatgccttattgatcaggagcttttatcaatggctaattttgaagaatatattcccttggattctgacacagtcagcactacaagatctggtgctatcttcaccaaagcctatcaacgaatggtgctagatgcagtgacattaaacaacttggagatttttctgaatggaacaaatggttctactgaaggaaccctactagagagggttgatacttgccatactccttttggtaagcggctcctaaagcaatggctttgtgccccactctgtaaccattatgctattaatgatcgtctagatgccatagaagacctcatggttgtgcctgacaaaatctccgaagttgtagagcttctaaagaagcttccagatcttgagaggctactcagtaaaattcataatgttgggtctcccctgaagagtcagaaccacccagacagcagggctataatgtatgaagaaactacatacagcaagaagaagattattgattttctttctgctctggaaggattcaaagtaatgtgtaaaattatagggatcatggaagaagttgctgatggttttaagtctaaaatccttaagcaggtcatctctctgcagacaaaaaatcctgaaggtcgttttcctgatttgactgtagaattgaaccgatgggatacagcctttgaccatgaaaaggctcgaaagactggacttattactcccaaagcaggctttgactctgattatgaccaagctcttgctgacataagagaaaatgaacagagcctcctggaatacctagagaaacagcgcaacagaattggctgtaggaccatagtctattgggggattggtaggaaccgttaccagctggaaattcctgagaatttcaccactcgcaatttgccagaagaatacgagttgaaatctaccaagaagggctgtaaacgatactggaccaaaactattgaaaagaagttggctaatctcataaatgctgaagaacggagggatgtatcattgaaggactgcatgcggcgactgttctataactttgataaaaattacaaggactggcagtctgctgtagagtgtatcgcagtgttgggtaagactttgaacaagcttgttctcaggctttgataagtagtgctgtttgccagctgtatattatccctaaaaataagtaataaggtatatatggtacatattttgacatgcatatacatatttgcatcctgactaggctgcccacagcaatttaagttacttgaaactcgcttttatcttagtagccctttggcctttcttcagtttttttttttttttttttttttttgagacatggtcttgctctgttgcccaggctagaatatggtgacacaaccatggctactgcagcctcgacctcccaggcttaagtgatctttccacctcagcctcccaagtagctgagattacagatatgcaccaccatgcatggctaatatttaaatgtttgtagagagatggggtctcactgtgttgccaggactggtcttgaactcctgggctcaagtgatcctcctgcctcggcttcccaaagtgctgaggttacaggcatgacccattgcgcctggccctttcttcagtctttaataatcgaacaaaaggtttttgtttttagacagtgtcttgctctgttacccaggacagacctctcgtgtcagcctcttaggtagctaggatttacaggtaagcaccggcgtgccctgctttatttttttggtgggggaagggggaagggagttgaagcttccctatgttgcccaggctggtcttgaactcctggcctcaagtgatcctccagtctcccaaaagtgctgggattacaggcatgagccaccgctcccggcccaaaagatttttaaatgtgttatacttcatgagacaggctttattttagatcgaattttatttatcaataaaaagttgagctttttattatttggtgaatactgtttcaaggtgctttgttacactatctgttgatccaacatttaaaaattgttttattacaacctttgcatttcagtgaatccatctgcatacaattttaaaagaatcattccttttttctgtagccaaattgtcaaagattctttcctacaattgatttttcaaagccctgagttaggaatttacaatttggcaaccatctcaacttcataagcaattttgttctttaaatgtcacggccaacattacctggaaccattgctgttttatagtttaggtttatgttgtatattttttttaattttttagagacggggtcttgctgttttcagactggagtacaatgggatgactagctcactgcagcctcaaactgctgggttcaagtgattctccttcctcagcctcctgagtagctgggactacaggtggtcaccatcacacctggctaatttttgtatttttggtagagacagggtttttcccgtgttggccaggctgttcttgaattcctgacctcaaagcgatctgcccgccttgatctccgaaagagctgggattacacgcatgagccactgcgcccagccctgttttttttttttttttttttttaaataatggtagtttacttgaatttgtaacacagtaacacaaaactattttgatctgaacgcaagtatctaatggaacagaataatatacttccttttagtgtgctgcatttggttactgggtaatttaaaattcttcctcagcacaggtgttcaaaaaccagtcttcagagattgttttcatatcagtgtgccaactttggcacattctgctaagtaagaggcttaagtgtagcatgtttctgctgttttgtgtttgttttgttttgttttttgagacagagtctctctgtcgcccaggctggagtgcattggtgcgatcttggctcattgcaacctctgcctcccaggttcaagtgattctcctgcctcagcctcctgcgtagctgggattacaggcatatgccacgtgtattaggcactgctaatttctgtatttttagtagagacgaggtttcaccatgttggtcaggctggtcctgaactgctgacctcgtgaactctgcccgcctaggcctcctgaagtgctgggattacaggcgtgagccaccgtgcctggcctctgctctatcttttagctttcccttggcacttctatggtccagatgttagagggtaagtattttgatgggggagatcgttggactgtaattgaaagttatgtcttataatgaaatgtgttatataaagaagacctataaaacacttaggctgataaaacccccaaacgatgaagcctcacttttaccctctcttttaacagatgttttactgtgcctggctaactatagtcgagggggtgatggtcctatgtgtcgcccagtaattctgttgccggaagataccccccccttcttagagcttaaaggatcacgccatccttgcattacgaagactttttttggagatgattttattcctaatgacattctaataggctgtgaggaagaggagcaggaaaatggcaaagcctattgtgtgcttgttactggaccaaatatggggggcaagtctacgcttatgagacaggtaactgattcttaaagttttgttatcagaaagtcatttgtgacattaggaataacatacttaggtgatcattttccaaacacagttacataaaagtcagccagtgacttaataggaagcaaagggaaattactccctgtgttataaaattgagaattatatttagctgaaacatcgatgcttaatgttaaggggaatatatgttaaaaaggggaaggaggtcagtcattcaggtcatgaggccctttgacttgaattcatttcctcagaaggtaggtatattcatagtgaacaaaaatacaaaggctgtatgaaaagatgaaaatgttacaggtttatccttaaattagactcatttgcagaaatgcaaatgaggtaagaaagcaaatatagttcatgacctctagcaactgttgaaaactgctctttagggatgacatgctggcccttttttttttgttgttgccaaggctgaagtgcagtggcaccatcacagctcactgcagcctcgaactcccaggttcaacccttcctcctgcctcagcctccccagtagctgggactacagatgtacaccatcatgcctagctcatttttaaaaaaattttttatggcattgtatttatcttctctttataaccaggggttgaccagccacagaacttgtaaagttttttatatttttaaaaggttgtaagaaatagtagtagttggctggtccccgctgctctcctgcattatagtatacttctgttcacctagtttgctagagagaggcagtatagtgtgtatagtgatttccaaactttttctttaaatcagaatcacctgaaagaatgtgacaacgtgtaaaaaaaaaaaaaaaggtgcagagattccatcctgacatggattcacttgattggaattgattctaggcatctcagtagttttaaagagctcctaggtgattctattctggccagcgttgagaatcactagggtagtgggttggtaagcaggctctgatgttttaaaggccaggtgaggccctatgcctcttgtctctcttagcctcaactttctccatgttagcaaatggatttcagaacagaaccaacgtacatgtgattgtgaaagttgttttagagtgcctagctcttacgtaagggttcataagaaagacaaaagtttatgaaactgttactaccagtcataaaagaccttttcctccctcattcacaggctggcttattagctgtaatggcccagatgggttgttacgtccctgctgaagtgtgcaggctcacaccaattgatagagtgtttactagacttggtgcctcagacagaataatgtcaggtgagttttttgtttcccacttaagttctcattcagtcatttagatgtgataaaagatatttgcttcttgtatatgagccttttaaatctaatatttgatttttctggtgttactttaaaaacatcactttttaagaactgcatagtctctctctcttttttttttttttgagatggagtttccctcttgttgcccaagctggagtgcaatggcacgatcttggctcactgcaacctctgcttccaggttcaagtgattctcctgcctcagcctctcgagtagctgggattacaggcgcatgccatcacgcccagctaattttttgtatttttagtagaagcggggtttcaccatgttaggctggtctcttaactcctgacctcaggtgatctgcttgcctcggcctcccaaagtgctgggattacaggcgtgagccaccgtgcccggccaataattgcatagtctcttaatgagatttaatcttttataccaatatgtgtagctcatgatagctatataacctagaagatgaatttatgtaatatgatttgcaaaatgagtattcatttgtgatttttttttttttaaggtgaaagtacattttttgttgaattaagtgaaactgccagcatactcatgcatgcaacagcacattctctggtgcttgtggatgaattaggtaagacattaaacttctcatttgaagactatctatcttaaaaacatttgtacaaataactatttttatagaagattatctgaagtacatttaaacaatatgaatgtttttagagcacgcactcaccattgtggcacagaccgatagttggagataaaaggtgatattgtgaaaggtttttgattacccattaattattaggccttacactgtttagttgtaataaaacatttgttatactacggggatgagaacactaataggaggactcaggaagtttatgaccttgagcgatactgtattttctttaaaagaaacctcactccccatgggctgctaagcagactcgtgtagctaaacaaggcctatttatagaatgcttttagacgtggatgtactaaccgatgttgcttttctgtcctagcatttttgttttaattccttttttgttttaattcctttgagttacttccttatgcatattttactttaacaggaagaggtactgcaacatttgatgggacggcaatagcaaatgcagttgttaaagaacttgctgagactataaaatgtcgtacattattttcaactcactaccattcattagtagaagattattctcaaaatgttgctgtgcgcctaggacatatggtatgtgcaaattgtttttttccacaaattcggttttttgagagggcacttctcttgctagcacatgtatcgctaatatttttctttcttaaggcatgcatggtagaaaatgaatgtgaagaccccagccaggagactattacgttcctctataaattcattaagggagcttgtcctaaaagctatggctttaatgcagcaaggcttgctaatctcccagaggaagttattcaaaagggacatagaaaagcaagagaatttgagaagatgaatcagtcactacgattatttcggtaactaactaactataatggaattataactaactgaccttaagtttcaaagaaacagtaaaaggggaagggatgatgcactatgaaaaaacaaaaaaacttttttttttttttttttaattttaagggaagtttgcctggctagtgaaaggtcaactgtagatgctgaagctgtccataaattgctgactttgattaaggaattatagactgactacattggaagctttgagttgacttctgacaaaggtggtaaattcagacaacattatgatctaataaactttattttttaaaaatga

SEQ ID NO: 59 - DNA, 38182 bp, Homo Sapiens
tttagtggttcgaagcaacacaaatttattaccctacagtatgtaaattagtcccacagtgctggttccttccagaggctgagggagagaatgcgttttcttgccttttccagcttttccagaagcggtccccaacctttttggcaccagagaccggtttcgcggaacacaatttttccatggattggggtcggggagggatggtttcaggacgattcaagtgcattgcatttattgtgcactttatttctactattattacattgtaacatataattaaataattctacaactcaccatcacagagactcagtgggagccctgagcttgttttcctgcaactagacagccccatctgggggtgacgggagacagtgacagatcatcaggcatcagattctcataaggagcgtgcaacctacatccctcgtgtgtgcagttcacaatagggctcgtgctgctatgagaatctaatgcccaccgctgatgtgacaggaggcggagctcgggtggtaacgccagcgacggggagtggctataaatacagatgaagcttcgctggcttgccggcccctaacctgctgtgcaccccacttcctaataggccatggaccactactggtctgtgtccggagtgttggaatccctgttctagagactgcttgcaatccttgactagtggtacctccttccatctccaaaaccagcaagacagcctctctctggccagcagggaaaggtctccacctttgaaggactcacccaatggactgggcccacccagacaatccaggataatctctctgttgcaagatccttaactcagccaggcatgatggctcacacctgtaatcccagcactttgggaggccgaggcggtcggatcacctgaggtcaggagttcgagaccagcctggtcaacatggtgaaaccctgtctctactaaaaatacaaaaattagccagtatggttctggacacctgtaatcccagctactcgggaggctgaggtgggagaatcacttgaacctgggaggcagaggctgcagtgagctgagatcatgctattgaactccagcctgggcaacaagagcgaaacttcatctcaaagaaaaaaaaaaaaaagatccttcactcaatcacacctgccgagtcccttctgccacgtgaggcagcgtggtcacaggttctggggattaggacacagctgtcttgggggctgttatcctgccacagctcccaatctggagagttcataagtgggatcctgcagaccacgccagcacagtgccagacacgatggcacagtgactactgtactgcctcctccatctgagggattctaaagcaggaaggggagccgcccacagtctggagaaggggtgggggcagcagggggagccacatctgtcatctctgggcccccaagagggcatctttacttccattttcagccaagttcaaacaggacaaggttccatgaaaactatttgaaaagacagacagggattcttatattcccagaaccattcaaggccagtaactggaatgttctacagttcacatcctgaggaaaccaaatcacagcatcaaattatgggaaatcaaactctttttgttcccctgcgaggacagcattttgcgaccttggccgcacagaggaatgtttcaaatagtgacccctgtcccatccagtcattttcttccagccgggcagagaatcccccgtgtttaaaaatttaatgtgaatcagggctgagaatcactaactgaaaaggaccctacttttaaatttatgaaattaaacaaagatgaatttaattatcattaagggttgaaagttatagactaaactatgtccagccagagcagaggcctgagtaacttccaaagtggtttggtttttttttttttgttttgttttgttttgttttttgagacacagtcttgttctatctcacccaggctggagcgcagtggcgcaatctcggttcactgcaacctccgtctcccgggttcaagcgattctcctgcctcagcctcctgggtagcggggattacaggcatgcgccagcacacctggctaattttgtatttttagtagaggcagggtttctccatgttggtcaggctggtctcgaacttctgatctcaggtgatccgccggcctcggcctcccaaagtgctgcgatcacaggcatgagccaccatgcccagcccaagtgttcttatttttataaaatgtgttcttgcctggacacacacacacgagcgcatgcaaacatagagaaaaaaaatttgcaagcaatgctccatctggtttgaaaaggttctcaagatcacttttaaatgggtgtgatgtgtattttttttaagtagcaggttcattttaaaacaaaaaaggttagtgaagactctgtctttcaaaacataaaaatctgcgataaaaccaattattccatacagtgactacggtcagttctgagaaatgacacccaggttggcgatgtgtctcatggttggccttccatggggacagttccaggggtggtccatctcccccatgtgggtgatcagtttcttcatctcgcttgtgttaagagcagtcccaatcatcacctgagtgtgagacacaatggttcaacgttttagtagttttttgacgtcagaatggcagctcttcagaagcattcttctctaaaataaggctggacaagattacagctcaaaaactaccttccctgaaaaaccttcccccagagaagcctaggttctagatctcagccctccacccttctgtgaaatcaggctccttgtggctccttcaaggtggcaccgcctccactccagacgccgaccacacctgtctcagcagccaccctgccctctcaccctggcaggtgcagcagcctcccagcaggcctccctgccccactgcgacccctccgagccgctctccactcagcagccagtgattacttttaaagggctgtcaggttattcattccacttcacagctctccccctcacctgaataaaagcccccgtctgtcccctgacttggccctcgctgggctgtgcctgcacccccacctccaagcacgaatgcctcccttcctcaccccagctgcactgctactcccttcctcttgcacaggcccatcacgcaaacacctgccttgggactgtggcactcccgggaccctctcccccaatgggtgcaggcgtcactccccctctgtcgagctccgacctgctgcccatagcactccagccctggccctgctgcctccctgccatgggtcctctgacaggaaggagaggacacaagcctgaagcccaatgtcaccttctttcttcctgcagcaccctgagggctcgccatgtgccaagcacagtcagaaggctggggtgacagcaggttggagaaggacagacaatcaacaagtcaacagagaaccaagacaggtggcaccaggcgaggcggcctgctcaggtgtggggatggggtgaagggtgacggtggcaaacccaggtagagaggagagtagggagaaagggtgtaaggcagggaggagactgaggcgagcgtggaactggaaggcagctacatggctggaagctacatggtggggagatggggctggaagggtgggcagggctcaaagcaggagcctcctgggcaggcagtgacaacaccggagatggacgggtaggccagggcgagagggaaggagcagcctgtggttccccgggccactgagtcacactaaactcaggacatcaaaactgcccggctatgagctcagctccacgctctcactcacagactccaagactggaagatccatattatgtcttttattttggtgaggtcaggggtggtggagagactctgtctcccaggctggaatgcaatggtgcgatctcagctcactgcaactccgcctcccagattcaagcaattctcccgcttcagcctcccgagtagctgggattacaggcgcccaccaccatgcccagctaattttcgtacttttagtagggatggggtttcaccatgttggccaagctggtctcaaattcctgacctcaggtgatcaacccacctccgccttccaaagtgctgggattacaggtgtgagccaccacgcccagcccctattaggtctttatccaagaaacactgtggctagaagtcagactctgggccctcttctaattaaactctgcccttgagtcatttcatctaatctcatggctgtaaattacacctgaagctcacacagcaggctccatcccacccactccccacgtggcccccagctgctgctctcctcagcggccgcagccaccgcaccccttccagtctgttctctctccagcagctgcaatcacgggactccttcccgtctgttctctccagtggctcgtgccacacacagcacagacccccagggtctaggtatgaccggcaacactctacgtggctgtcctctggacgccgctctgctcactcccttcccctctccagggacacaatcagcctctggcttcagtcttgctacttccttcgcttggaaagttcttacccaagagggctccattctaccttttttttttttttttttgagacaaggtcttactctgtcacccaggctggagtgcagttgcgtgatgttggctcattgtaacctcgacctccctggctcaagtgatcctcccacctcagcctcctgagtagctgtgactacaggcacatgccaccacacctggctaatcttttaattttttgtacacatggggtctgcctgtgttgcccaggctggtctcttaactcctggcctcaagcaatcctcctgccttggcctcccaaaatgctgggattacacgtgtgagccaccatgcctggcttccatcccaccttttagatggcagctgagatgccacctgcccagatgccattccctgaccaccatctcacctggtcaccatgtttttctcttgtcatttcctgccccaaaacgctgttttaggccaggtgcggtggctcacgcctgtaatcccagcactttgggagaccaaggcgggcagatcatgaggtcaggagatcaacaccagcctgaccaacatggtgaaaccccatctctattaaaaatataaaaattagccaggtgtggtgggtgcctgtagtcccagctacttgggaggctgaggcaggagaatcgcttgaacctgggaggcggaggttgcagtgagctgagatcacatcactgcactccagcctagtaacagagcgagactccgtctcaaaaacagacaaagaaaaatgctgtttgaatctcttgactgtgcttactggcatctaatgcgtgtcatttatttgtggtgatgcctatttctccccactgtctgctccacaggggcaggggctgcagccgccttgttacctctgtgtcccgagcacctggagcagggcgggccccacatcaggggctcaaggagcacctgctgaataaataaaggaatggcgtcctggcccttcccagtggccagctgatacacagtcacttttcttggacatcaggctaatccccactgcaggcagaaccactgctgccaccttcccacaccaaccgaagcagcggcagtgacgccacgtgcaatgacaaccacggcaccccgtgaagcacctgctgcctcgatgactctgcagaatcgtgtccaatgtcgccgagtcctggcagcagcaaatctttatctcccaatgttgttatgacccataaggtccatagacgaacaaggtacctcaaacgctaactgcgttggagtcaaccaaagctcggagatagaatactggccgggccaggcacagtggctcatgcctgtaattccagcactttgggaggctgagacaaggggcaaaaggagaccatgtttctacaaaaaatttaaaaattagctgggcatggtggtgcatgcctgtggtcacaactacttgggagacagagagaggaggatcgcttcagcctggtacgtcaaggctgcagtgagctgtgattgtgccactgcactccagcctgggggacagagggagaatctgtctaaaaaaaaaaaaaagaagaattctgggttttttttgtttttttgagacggagtctcgctctgtcgcccaggttggagtgcagtggtatgaacttggctcactgcaagttccgccttctgggttcacgccattctcctgcctcagcctcccgagtagctgggactataggcgcccgacaccacgcccggctaatttttttgtatttttagtagagacgggctttcaccatgttagccaggatggtctcgatctcctgaactcgtgatccgcccgcctcagcttcccaaagtgctgggattagaggcttgagccaccatgcccggccaagaatactgcttaacagaggtaacaaaagagcaataattatgagttcaaggtcacagagaacgcagacgacacagatgctcagctacgacgctgcacgtagctctctgtgtaaaatgacccctggcaatcacaaaggcgtttacaaccttgaccaaatcaggagctgggctgagaccttcctcgactgcaagcttgagcagctgagctgacagccaggctttctttacttaccgacttccggcaggctctggaggcaaacatctgcttgactcgggaaggccggcacatgaccccagggctgtcgctcagcatgaagatcagttcatcgacgtcctggggtccgaaggtccagtttttactagttggcaaggaaatcagtttagccctttcagtgactggagctaaaagaatacaattttgagaaaaatccatgacttgacaaacacgtttcacttgaaagctacttaggatgaacatctgaggccgggcgtggtggctcacgcctgtaatccctgcactttgggaggctgaggccagcggatcatgaggtcaggagatacagaccatcctggctaacatggtgaaaccccgtctctactaaaaaatagaaaaaattagctgggtgtggtggcaggcacctgtagtcccagctactcgggaggctgaggcaggagaatggtgtgaacctgggaggcggagcttgcagtgagccgagatcggcaccactgcgctccagcctgggcgacagagcaagactccatctcagaaaaaaaaaaagtgaacacctgaaagagaggaaactcacaaaatgctttttggaggaactttttaatcttttataaaattaaaaaaaactggtctatatgacctgaaagattattcccagctctaaaaagacaagaatctatagttctgatttttttttttttttgagacagagtttcactcttgttgcccaggctggagtgcagtgacgtgatctcggctcactgcaacctccacctcccgggttcaagcgattctcccacctcagcctcctgagtagctgggattacaggcacccgccaccacgcccggctactttttgtattttcagtagagatggggtttcaccatgttagccaggctggtctcaaactcctgacctcaggcgatctgcccgccttggcctcccagagtgctgggattacagacgtgagccaccacacccagccgctatagttctaattaataacttaccattttcatcgataacaaaatcaaagccattctttctaaatatttccagattttctatcagaacagcttcattaacagcagttaagttgagagtctgaggtctgaaaaacacaaaaatgattcaaaccatatcctgaagtcaaacatttagctttacagcagaaatgaaatgaaaacaacaatactgtattttgaattcatgtcaaaataacaacacaaataacaacactactcagctaagtgtcacaaaacttcctgagaagttccttttaattttctctttcttaaagttctttttagaagttaaagtagctacaggccaggtgcggtggctcacgcctgtaatctcagcactttaggagcccgaggcaggcagatctcttgaggccaggagtttgagaccggcctggtcaacacagcgaaacactctctctactaaaaatataaaaattaggccaggcatggtggcgcacgcctgtagtcccagctacttgggaggcttaggcatgagattcgtttgaacccaggagggaggcagaggttgtagtgagagccaagatcacgccactgtactccagcctgggcgacacaacaagactctgtctcaaaaaaaaaaaaaaaaaaaaaacacccataaaaacaaaaattagctggaagtggtggctcatgcctgtaatcccagctactcgggaggctgaggcactagaattgcttgaacccaggaggtggaggttgcagtgagccaagatcacaccactgcactccagcctgggcaacagggcaagactctgtctcaaaaaaaaaaaaaaagttcaagtagctacaaaagtagtttgctttttcctcagcctgccacgccaatgactcccactttttctgaatcctttccttaaggataacagtatcacaaaaatgctatttttcctccttctaatacagaatttgaaacactgggttaggtcattgccagcatttgtaaacagaatgaacagacagcttttattttgctatcctgttccttcctctgcctgtattatatctccatccctctctcctcctggatttactgtttgtttttttttaacctttcgttatttttttcaaagatagagacagggtctcactatgttgcccaggctgctctcaaactcctgggctcaagcgatccttccacttcagcctcccaaagtgctgggattacgagtgtgagccactgcatctggtcctgagtgctggataagacaaacactgctcaaggcaggagacagctggtgagcaaacacaggcttggtcctggagccaacagattaccggggaagaaagacgttgagcaaatactcaggcaagtcgattatgatgagaaacgacaggaaggtcaggaagaaaaagcagccagtgtcatagagagacttcaccctggggtcaggaagtgacctttgagctgagtccggggataagagagttaatcaggtaacgggggagaagtgggtgcagggtgcaggacaagtattctagacagggacaacaatctgtgccaagccccaggatggaccgctgatgtttgcagagccacacataaagatatccttcattctgcttagtggccacatagggattcatcaggcctgccaagggaaaaagaaagacagccagagaggcttgagtacagggaacaaggggaagacgaacgggaaaagctacagaggtcaacagggccaccctacacaggggctggcagggcagggtggaactgggtctttatcctttaatcttgaagtgtggtccatctgggaccctaagtggtctgtgattacctgggccaacttgaaatgtcacagatgagaggttatctttgccgaatggctaaaaaatacaagacctcagccgggcatggtggctcacacctgtaatcccagcactttgggaggctgaggttggtggatcacctgaggtcaggagttcaagaccagcctgacaaacatggcaaaactccctatctattaaaaatccaaaaattagccaggtgtggtggcgggtgcctgtaatcccagctactcgggaggctgaggcaggagaatcacttgaacccgagaggcagaggttgcagtaagccgagatcacatcactgcactccagtatgggcgaaagagtgaaactctgtctcaaaaacacaaaaacaaaaaacctctattaagaggaacagggaagggatataaagtagcttactaaatgtctattattaccattgcctcctactgagaataaaaacaattcacgcattccacaggagagtactcagcaaactacacaggagagtactcagcaaactacacaggagagtactcagtaaactacacaggagagtactcagcaaactacacaggttcagtggtacatttctccatgtgggatctacttgttgggatctgagtttacttcactacgtggtttaatttcccacacgaaaatccatgacctcttcttctaactttgctgaagacaagactttggttttacatgatactatcacacctgacctttgtgaagtagtcagggtaaaacattccagtttggccgaggagagagaaataccaaattctgcagtgactatcttaaaataatttttaaattttattttattttatttattaatttatttgtgagacagagtctcactgtctcactctgtcacccaggctggagagctgtgcagtggcacgatcatggcagcctcaatctcctgggctcaaacgatcctcccacctcagcctcccgaatagctgggaccacaggcacacaccatcaagtctgactaattttttacatttgttgtagagacaaggtttcaccatgatgcccaggctggtctcaaactcctaagctcgagggatctgcctgcctcagcctcccaaagctctgggattacaggcgtgtgcccctgcatccaacctgcagtgactatctgacttctgattactctactgtcaatcaacactggcgcacaggctgtctgtctttctgaacacacacattccatacactatgcatactaatactccatactatcaattgccctcatcagaaggatcttctggctaaccagtgatcaacatttttaatagcgaaaaatacctgatacttagagaacatgttaaccacgtgaactggggcaggttactcaacctctctgcatgtgcctcagttttatcgcttgtggaatggtgatggtaacagtaacaaccccataggtttttgaggattaaaggaactaatacacatacattatttcaacagtgcctggcagattctaggcactgaataaatggtaactatcactattatgtaaaaagtataaaaatctgctatatgaatacttatggaaaaatacatatatacatatagacacacatataaactattaggtctctttttttttttgagatagaatctcgctctgtcacccaggctggagtgcagtggtgcgatctcggctcactgcaacctctgtctcccaggttcaagcgattctcctacctcagtctcctgagtagctggaattacaggcgtgcactgccatgcccagctaattttttgtatttttattttttatcattattattattttttgagacggagtttcactcttgttgcccaggctggagtgcgatggcacgaactcggctcgctgcaaactccgcctcccgggttcaagcgattctcctgcctcagcctcccaagtagctgggactacaggcgcccgccaccacgcctggctaattttgtatttttagtagagacaggtctcaccatgttggtcaggctggtctcgaactcccgacctgaagtgatctgcccacctcggcctcccaaagtgccgggattataggcgtgagccaccgtgcctggcctttttgtatttttagtagaggcggggtttcaccacgttggccaggctggtctccaactcctgacctcaggtgatctgcctgcctcggcctcccaaagtgctgggattacaggtgtgaggcaccgcgcctggccaactagatattttttattttttacacccctccttcctagatctcttcttttttaaagtagatacaaggtcttgctgtgttgtccgggctggtctcaaactcctggcctcttgtgatcctcctgccttggcctctattagatcttcaatttgagggggagtctgggaatgaacactaaacacactcacgctatgagcctctgcccctggagcacggtgtgctgctgcagcatctcgaagttatacttctcgtccgtggcatgctggtccactatgaagatatcctcattcagtttggttattataaatcccaggttaaactgaccaatgatttccatttctgcaaacatcgttttactgcaggtagaaaatgttaattatcagacattttacaagattatttttctgattatgttatagaacactgtaataaaaaaaaagtcaaacaatacaaaaacaaaataaagtccctagccatcccgctttctttttttttgaaacagagtctcgttctgtcacccaggctacagtgcaatggcacaatcttggctcactgcaacctccacctcccgggttcgagtgattcttctgcctcagcctcctgagtagctgggattacaggtgcgccaccatgcccagctaatttttgtatttttagtagagacagagttccaccatgttggtcaggctggtctcgaactcctgacctcatgatctgcccgccttggcctcccaaagtgctgggattacaggcgtgagccactgcgttcggcttaaccatcccactttctaaagataacattaattattcattcatccaactctccggagaagacatcagttgctactattaacgatttaaatggaatatatccttctagacccttgtctccatatataattttttttaattttaaaaaacaaaaatggaatcttaattctccattctgtcatcacttaatgcatctgaaacaagttttcagacctgtacacatagatctacttcattattttttctttttttttttcttttaagacggagtctcactctctgttgcccaggctggactgcagtggcgtgaccgtggctcactgcaacctgcgcctcccaggttcgagcgattctcctgcctcagcctcccgagtagctgggactacaggcatgcaccgccaagcccggctaatttttttatttttagtagagacaaggtttcaccatgttggctaggctggtcttgaactcccgacctcaagtgatccacctgcctcggcctcccaaagtgctgggattacaggcgtgagccaccgcacctggcctacttcattctttttaatggccacataggaattcattgcatggatgtaccataatttgtctgacaaatcccctactaaaggacatttcagttgtttccaatttcaatagcgcactcaaagctgcaacaaatacttctgtgcataaacctactcatctgtgggtgcatttccgtgagacagacgctagagggagaactacatatgtacttcttgacgggaaatctgtgaaaagtcacactcccaccaatggtgtgtaagagcacctttctgccaatgctggatatcaatccttctcatctttgccaggcccaccactgggtcctttgcgggtggcttcaacatctaatgtcattaaatactaacttagtcaatctggacaaaagacagacaccaccgctaaccttcacacgagaaattgacactgtcattctcagtcccacacaattaaatccggtgaaaatggattttccgcagtatcagcgcggtgatgacaagaaatggctctgttaaagcagccatggacgttttctggttctcacctggtggcctgagctgaggatgaaagcagctgtaatgtaatcccagcactttgggaagacaaggtgggcagatcatttgaggttgggagttcaagaccagcctggccaacatggtgaaaccccatctctactaaaaataaaaaaattagccaggcatggtggtggacacctgtactcccagctacttgggaaacgaaggcagaagaatcgtttgaacccgggaggcagagcttgcagtgagctgagatcgtgccagtgcactccagcctgggcgaaagagtgagactcttgtctcaaaaaaaaaacaaaggagctgatattgttgtttctttctataagtgctccaggaagacccggtcccatgccaccatgctcgtcaccatcacaatcaaccacaggggacagtttggtgaactgtgagacctccacatggcatggattactgagcccacatttcctatggtgaggggctccacacagagctcaaatccaagtcataaccaaaccagtccccaaatcctatctttgagggtctgtttcctggtaccaattccagatcaggcagagtgcaatcaatcaagagacaaaaaccacaccagtgattttaacagggacttttttttttaagacagggtcttgctctgtcacccaggctggagtgcaatggcatgatcatagctcactgcagcctcaaactcctgggctcaagtgagcctcctgcctcagccccctgagtacctgggactacaggcgtacagcaatgtacttagctaattttttttttttttttttttttttagagatggggcctcattatattgcccaggctggtctcaaactcctagcctcaagtgattctcctgcctcagcctcccaaagtgctggaattacaaggtgtgcaccaccatgttaggcctgaggaggaaaaatgtataataaggcattacacaaactagtaaaaggtggttaactactatgctaagaaatacaggaatggaaaatgctactatcctagggaagagggagagtcctcagaaaaggaactctttttttcttttttctttttcttttttttttttttgagatggagttcgctcttgttgcccaggctggagtgcaatggtgcaatctcggctcaccacaacctccacctcccgggttcaagcaattctcctgcctcagcctcccaagtagctgggattacaggcatgcaccaccatatcccactaattttgcatttttagtagagaaaaggtttctccatgttggtcagcctggtctcgaactcccaacctcaggtgatccacccacctcagcctcccaaagtgctgggattacaggcatgagccaccatgcccagcagaaaaggaactcttgtaagaggctcctacccactcaggctgagtttcagacctccttggagcaggagtggccgcagcctgctggatggagagaagctgccagagtgagtgatgacacaggaactcctgccgcacaggagggaaggaaaagaacatcccagaagcatcccagatgccagcacaaataccacctcccctggcgccgatcccaggctctcccaggaattgtctgaatatgccctggttcccagtacatagataatctgctcaaaagctggtgctggcctaaaagacccaagtcttccatgtgtttggagtctgtgtcctgccacagagaacaggatctggccaggcgcagatgccggaattacaactgcgcactaccgcgcccagccaattttattgtagagacgaggtctccctatgttgtccaggctggtcttgaactcctgggctcaagtgatcctccctccttggcttggcctcccaaagtactgggattacaggtgtgagccaccacacctagcctcaaaatactcttaagaaaaaactttacctggccgggtgtggtggctcacacctgtaatcccagcactttgggaggccaaggtggctggatcacctgaagtcaggagttcgagaccagcccagccaacatggtgaaaccctgtttccaccaaaaatataaaaattagccaggcatggtggcgtgcacctgtaatcccagctactcaggaggctgaggcaggagaaacgcttgaacccgggaggtggaggctgcagtgagccaagatcatgccactgcattccagcctgcgcaacagagcaagactctgtctcaaaaaaataaaaaataaaaataaaaattttagataaaaagagaaaaagtaaaaaattaaaactttaccttatctcttttcttagttcatcttcggctgcttgattttctccaggacaaatctttgccctaaacttcctgtaattctgttccccttcactttgctgtgcttcatgatgtaactgctttattcgtttagctaaagaactcatagaaaagtccaggggcacaactttcttattaattttcacagctacatcaacctgagaggctgacatgtcctgagtatttactaacttttgacaaatgtcagaactggaaagaatttcttcttttttaaaacgctttgtgtttggggttgcgagattagttggctgaggcaaaactcgaaatttacatccggtatcttcctggtttgaatggcagtccacatctgaaaaagagtcgtcagttttaggcgctttctcctgagagtccacatgttcctgcgagcccctgtcccctggggagctggccgcatactcgctgctgcagtgactgcccgtgtctgggatgctgaacccctcagaatccacggaagtgctgccgtgccccgagtccttctccacctccgctctgtccgtagggtcactgggtccgtgactggaactcactgcctctttctgaggtctcaggacgcctttgtcagagatggcacctgaagtgctagaagacagcataccccttttctgtcctagagggctccttcttggttctggagtctttgggctgtgaggcttgttctctgttgtgtgacgaagagaaaaggcctctcgcagtctggaaatggacacgtcttttttttcttctccagtccttaatgaaggggattgatcctgcttttctaccatgggcttttccaaatccgctgcatgcatttttattaagttacctaagcaaacgtggacggagaagagggtcagggactatcctgaaatggtgagaggacgtgcttatgtgaacagatacttcacaaaagaggagatccacatgctaattacacagatgaacacagttcaatgttcaaaataaaactataatatgggccaggtgtggtggcttacgcctgttatcccagcactttaggaggccaaggcagggggatcacatgaggctaggagttcaggactggtctggacaacatggtaaaaccctgtttctactaaaaatacaaaaattagccgggtgtggtggcatatctgtcatcccagctacttgggaggctgaggcacgagaatccctttagcccgggaggcagaggttgcagtgagccaagatgccaccactgctctccagcctgggtgacagagcaacactctgtctcaaaaaaaaaaaaaaaaaaaaaaaaaaccacaacacaatgcaatatggccatatactcaccagaatggtaaaattaaaaaaacaacaaatgctcacaaagatcaggatcaagaggaatgcctgaatacctctggtaggaatgaacctggtacagctgctttgaaaagttctctgggaatacctcctaaatctgaatgtatgcacacctgcaacccagcatagctactcctatcagaagtgcctattggccggcacagtggctcacgcctgtaatcctagccctttgaggtcaggagttcaagaccagcctgaccaacatggtgaaacctcatctctactaaaaatacaaaaaaaaaattagcagggcatagtggaatgcacttataatcccagctactagggagaatgagaatgaggcaggagaatcacttgaacctggaaggcagggttgcagcgagccaagatcactccactgcactccagcctgggcgacagagtgagactccctctcaaaaaaaagaaagaagtgcctatctatgctcgtcaaaaagacgtggatgaggatgttcatgacagcattcttcattatagccccaaactggaaacaattcaaatattcacaaatgatgatatctgactataatggaacactgtatagcgaacgaataaatgaattttgccacatgacttgggtgaatctcacaaacaaaataatgagagaaagaaacaaatcacagaaaaggacagactgaataacttcaaattaaaaacagattaaactataccgttttgggttttttttgtttgtttgtctgtttttttgagacggagtctcgctttgtcacccaggctggagtgcagtggcacaatcttggctcactgcaagcccctcctcccgggttcacgccattctcctgagtcagcctcctgagtagctgggactacaggcgcccgccaccacgcccggctaattttttgtatttttagtagagacagagtttcaccgtgttagatagtctcgatctcctgacctcgtgagccgcccgccttggcctcccaaagtactgggattacaagcatgagccgctgcgcctggcctaaattctactgttagaagtcaggaaatcccagcattttcagaggccaaggctagaggactgcttgagctcaagagtttgagaccagcctgggcatcatggagaaaccccatctctaatgacaatacaaacattagccaggtgtggtggtgggcgcctgtaatcccagctactcaggaggctgaggcaggagaatctcttgaacgtgggaggcttcaaggttgcagtgagctgagatcgcatcattgcactccagcctgggtgacaagagcgaaactccatctcaaaaaaacagacatgacaagggagttaaaaatgcagtcactgcagacttcttctaatcatatatcttatatgacttcatccgtttacagtttacaaaaaactagaggtacttggaggcagctacttgggaggctgaggcaggaagatggcctgagcccaggagtgtgatgctgcagtgagctacaatggcaccactgcagtccagcctgggtgacagagcaagtccctgtctcaaaaaagaattaaaaatgataaaataatataagagactttgttttcatgtcaaaaaaaagtttacttggaaaaaataaggaaacacattagctaaaagctttagaagctgtttgtacactgtatttttcttaccttcaacatccagcagtggctgctgactgacatttagcttgttgacatcactatcaaacattcctatcaaagaggtctttaaaactgccaacaaaagcttttcctcttgtagcaaaatttgccttttatctggagtaacattgatatcaacgcattctaaggcaaaaaagaaaacatatttattatgtttaaattcacttttattttatttattaattattattttcagacagcgtctcactctgtcgcctaggctggagtgcagtggcgcgatctcagctcactgcaacctccgcctcctgggttcaagtgattctccctgcctcagcctccgaagtagctaggattacaggcaagtgccaccacactggctaatttttgtatttttagtagagatggggtttcaccgtgttggccaggctggtctcgaactcacaacctcaagtgatccacccgccttggcctcccaaagttctgggattacaggcgtgagccaccgcgcccagccaaattcacttttaacaatagaaatttccccatctattatttcattcacttgtatttatcacaagtgctattaaaaacattacagtgtccaggttaagattcataagttatgaaatcagctttttcaaataaatgagcaaaagacaatttttgaatagacaaaatacggaagggcttaattaggtaaattgttaaaggaaaagcaaataaacacataaaaataattttaaatatgcaaactaaaataagatattttaatcccctactgaatttagcttaacaattataatacctagtacattataggtaggtgtgtaaattggtacatctagaacacaatacagaaaaagccttaaaatgatcatattcactgacccagtaattctactcccggcaatttatattcagaataattaaagatgtaggctgagtgcagtggctcacaccctgtaatcccagcactttgggaggctgagacgaacagataagttaaggtcaggagttcaagaccagcctggccaacatggcgaaaccccgtctctactaaaaacacaaaaaattagtcaggcatggtggcaggtgcctgtaatccgtgctactcaggaggctgaggcgggagaatcgcttgaactcaggaatcggaggttacagtgagctgatattacaccactgcactccagcttgggagacagagcaagactctgtctcaaaaaatatctaataataaagatgcagataatgatttaattataaggaaagtatttataatttccaaaaactaaaaacaatttaattttgaaaaatttaaaaattaaaataccaaactataaccatgcattggaatataattcacctattaaaaccacatttctgatcaatttctaataacatggaaaagaaaacattcacatctaaggataaagagcagtatacaaaattattttctcatcccaaagaatatgggagtaggggagagagagagaaagagagagaggacagaagatattttttaaggtatgtacatatgtgtttctaagtatctagaaaaaatactcaattacaataaaccaaaattttaacaatcagaaaaaaaaatctatatgaaatgaattatttatgaaattaggaagaacatttcatctactttctcccttggttgacattaaaaaaaattacattttcctaacaatataattaacatagtctcaagtagaaagcgggaactctgtttaaaaaaaaaaaaaattatagggccaggcacggtggctcatgcctgtaatcccagcactttgggaggccaagacgggcagatcacgaggtcaggagatcgagaccatcctggctaacacggtgaaaccctgtctctactaaaaatacaaaaaattagccaggtgtggtggcacgcacctgtagtcccagctacttgggaggctgagtcaggagaatcgcttgaacccgggaggcagaggttgcagtgagccgagatcacgccaccacactccagcctgggtgacagagcaagaccccgtctcaaaaaaaaacaaaaacaaaaaacttacatgaccataaattgttatctcattccagtcatagcagagctgtagaatttcattttattctttgaggcattagtcactagttgtactgaaatgccaatggaacttacctgaatcaacagaaatgttaagaacaacaaatggatactggtgtcgattatacatgtggtagacctcattcacgagtctgcagacctgcacaaaatacaaggagtagaaaagaataaatgacaaatgttcccagccccccgcattctaacaacattctattctaaccaaccagcatgttcttagaaggggatacttttttgttttttttttttttgagtcaaggtctcgccttgtcacagcctggagtgcagtggagcaatcatggctcactgcagcctcaacctcccaggctcaagtgatcctcctgtgtcagcctgacatgtaacttggattacaggcaggatttttttttctttttttttttcaacggagtctcgctcttgttacccagactggagtgtaatggcacgatcttggctcactgcaacctctgcctccggggctcaagtgattatcctgactcagcctccagagtagctgggattacaggcacacgccaccatgaccagataatttttgtgtttttagtagagatggggtttcaccatgttggccaggctggtctcgaactcctgacctcagttgatccgcccgcctcaacctcccaaagtgctgggattataggcgtaagccactacacctggcctaaggatacatttttttaacagctttactgagatatgactaacatggaataaactacacatatttaaagtgtgcaatttcataagttttgacatatacacaaacacctgtgaaactatccccacaatcaagataatgaatatatccatcaccaaaagtttcctcacaatctcaaagtgatatttctctaatcatagattcctaaaactgaatatttttccaacttaaagttgctctatgagaaattctagtgaaatgcaagtgcagcttaaatgttcataaaacatattcaatgtacatagaaaagtatctatgacattaaaatgtcattagaaataaaccaaaatatcacattattaatagttataattaataattatgaatccatcacactataggttaaaaaatttagaagttcaaccacatctggcagattacaagcaaactctaaagcatcattgaaaaacaggggctgggagcggtggctcacgcctgtaatcccagcactttgggaggtcaaggcaggtggattgcctgagctcaggagttcttgactagcctgggcaacacagtgaaaccccatctctactcaaatacaaaaaattagccaggcatggcagcatgtgcctataatcccagctacttgagaggctgaggcaggagaattgcttgaacctgggagggagagcttgcagtgagccaagatcacgtcactgcactctagcctgggcgacagagctagactccgtctcaaaaaaaaaaaaaaaaaaaagaaagaaagaaaaaaaaacaaaatattactgaggtacaatgtgttgctaagatacaaactcaaaaaacccatgtcatcatatcaagatgatcaatttaaatctgaggcagaagtaatctgagcccttattttcctaggaaaatagaaagaagagaaaatatagaaatctatagaaaatatagaaaccatgggccgggcgcggtggctcatgcctgtaatcccagcactttgggagacagaggcgggtggatcacgaggtcaggagttcgagaccagcctggccaatgtggtgaaaccccgtatctactaaaaatacaaaaattagccgggtgtggtgatgcgtgcctgtagtcctagctactagagaggctggggcaggagaatggcgtgaacctgggaggcggtgcttgcagtgagcagagatcatgccactgcactccagcctgggggtgacagagcgagactctgtctcaaaaaaaaaaaaaaaaaaaaaaaaaggaaatatagaaaccatgtaatcagtctatactgaaaggtgacatagaatgttataaaatgtttagtttcttcaaatagttttagtttttacaataataaatatactggtaatatgtgtttatatatttatgtatctatacacacaacacatataatgtatatatgcagatacaaacacactcacgtatatgcaatttaaaaaactatacagaggccaggcgcggtggttcacgcctgtaatcccagcacttcgggaggccaaggcaggcagatcacgaggtcaggatttcaagaccatcctggccacatggtgaaattccgtctctactaaagacacaaaaacttagccgggcgtggtggcgcgcgcctgtaatcccagctacttgggaggctgaggcaggagaatcgcttgaactcgggaggtggaggttgcagtgagccaaaatcgcaccattgcactccagactggccaacagggcgagactccatctcaaaaaaaaacccaaaaaacaacaacaaaaaaaactgtacacagatagatgcgctccttaacttatgatagggttatgtcctgataaacccataagttaaaaatattgtatctgctgggcgcggtggctcacacctgtaattccagcactttgggaggccgaggtgggcggatcacgaggtcaggagatcaaaaccatcctggctaacaaggtgaaaccccgtctctactaaaaatacaaaaaaaaattaaccaggcgtggtggcaggcacctgtagtcccagctactcgggaggctgaggcaggagaatggcgtgaacctgggaggcggagcttgcagtgagccgagaccacgccactgcactccagcctgggtgacaaacaagactccgtctcagaaaaaaaaaaagaaagaaaagaaaatactgtatgtcaaaaatgcctttgtgataacctaacctactgaatgtcccatctcagccttgcctcagaatacttacatagtctataggcaaaataacctattttataataaaatgttgaatatcttctgtaatttattgaatactataccgaaaaacaatggttcaataggtacttgaagtatggtatctactgcaaaaaataacttctgcaacaaggtaaagtagtagaaaaaaatatatatatatttttttgaaacacagtctcgctctgtcacccaggctggagtgcagtggcataatctcggcttactgcaagctccatctcccaggttcaagtgatcctcctgcctcagcctcccatgtagctgggattacaggcgtggaacaccatgcctggttattttttgtattttagtagagacggggttttgtcatgttggccaggctggtctcgaactcctggcctcaggcaatccacccgcctcggcctcccaaagtgctgggattacaggcatgagccactgcgcccggacagaaaagtcttcagttgaaacatctgaagctgggggccatctgcggtagacttctgtaaatgcacaaaataagataatgttaaagccatgtttctcaaagtcccgagctccacgtaaactgcctattatcagaaaaaagttatcaattaaaagtcaaaggcataaagaacaaactaacacaaaaaaattttaaatacctttgctgggtcacaaggccgccggttgataaagaaaaactgtctgtctgttgaactccttccaactccatgcgtgcattgtgaaatgaaacctgagatgctattcaacattaatatggtaagggcaggattccagagtgaaagggattagaaatacgatcacatggcacattcttaaagtgaaatgaaaacaaaacaccaggtgacatgctgataaggatcactattgcagttcacgggtatctgtgctccaaatcttgatgagtcatcaaagaaccaaaccttctggaatattctaaagctcctacagtcaaccaatgcaccacaggtgatgcagtgcgtccaaaactgatgtgttgcagctctccttacccttcctgataaatcctcagcctctgtaagtgggtctcgcttcaaatgcattctcagaacctccgtgctgccacccctggtttgtcaatgaagtctaaccacttgtgctcagaattttgcccacattccctcccctttcaaaacctcccgggtaggacgcttatatctcatgtcttggtaaagcgcttgcttcacatgagacccaccccagggataccggcatttccagaagaacaccaccttcacataaagacataaagctccatgtttaccatttcaggcataagccaaaagcaagtggaggaagagtaagaaatatagatctcaaggcaacaaacaaacaaacaaaaagaaatacagatcttaggctgggtgtggtggctcatgcctgtaattccagagccttgagaggccaaggtgggtggatcacctgaggtcaggagttcaagaccagcctgggcaacatggcgaaaccccgtctccactaaaaatacaaaaaatcagccgggcatggtggtgaacacctgtagtcccagcttctcggaaggctgaggcaggagtatcgcttgaacctgggaggcagaggttgcagggaggcagaggttgcagtgagccaagatcacggcactgcactgcagcctaggcaacaaagcaagactccatctcaaagctaaaaaaaaaaaaaatatatatatatatatatatatacacacagatagatagatatctttacaggaccaatcctatttatggaagtgtctattttcttatacgaaaagtaatgacactgaactgccttcatcagatgccaggaaagtcaaaatcatttaaaatgataaaataatttacaagttagtctaactaaacagagccttaaagaagacctgctcaacagaaaaccacctgaaatataccacttactcaaaacatggtttgaattaagcaactgactcctttgtataaatcatctttcttagccacagcattgctcacagttttataaaggacataaaaaactattatccctagccaggcgtggtggctcatgcctgtaatcccagcactttgggacaccaaggtgggcggatcatctgaggtcaggagttcgagaccagcctggccaacatggtgaaaccccgtctctactaaaaatacaaaattagccgggtgtggtggcacgtgcctgtaatcccagctactcaggaggctgaggcaggagaattgcttgaactcaggaggtagaggttgcagtgagccaagatagcaccattgcactccagcctgggcaacaaagcaagactccgtctcaagaaaaaaaaaaaaagacacgaaactattagccttagaatcactatctttaaaaaaaaagctctcaggataaaatgttcaattgtagttctcttgccagcaatctacttactaaaaaagattatgcagagcatcggaacagctcaaaccgtactcttcacacacggagtcactagggggcagctgaacaaaaggaatgaggctttgcaactgaaaaaaaaaaaaaaaaattcacagttacttcctaataaagacagagtggacttaatctgttttctttcttagtcaagctattgacattacaagcgcaaaaaaaattaaaagaatcttttgttttgttttgttttttgagacagggtctccctctattgcccaggctggagtacaatggctcaatcatacctcactgcaatgtcaaactcgtgggttcaagcaatcctcctgcgtcagcctgtcgagtgagtagctgggactacaggtgcacaccaccacacctggctaattttttaatttttttgtagagatgggatcttgccgtgttatccaagctggtcttaaattcctgggctcaagcgattctcccacctcaaaattgttggccgggtggttcaaacacataatcccaacagtttcctctcccagagtgctgggattacatgtgtgagccgtgggaacaacaattttgattttatgatataagaaagatgaaacaagtacctacttattcagaacccacacattgcccacaataacttatatttttttcagagagagagtgaaaagacgcagtatacgagtgtctctggaagaataaaatgaaacacattcagctctcaaacatcaatttttgtgataggtactttgtttttttttttttttttttcctgggatggtgtcttgctctctcgcccaggctgcagtgcagtggtgcaatctcagctcactgcaacctccatctcccgggttccagcgactctcctgcctcagcctcctgagtagctgggattacaggtgcctgccaccacgaacagataatttttgtatttttagtagagatggggtttcaccatattgatcaggctggtctcaaactcctgacctcgtgatccgcccacctcagcctcccaaagtgctgggattacagacgtgagccactgcgccgggccttgtgataggcactttaaaaatcaattcttaatctgggcgcagtggctcacgtctgtaatcccagcactttgggaggccgaggcaggcggatcactagaggtcaggagttcgaggccagtctggccaacaagatgaaaccccatctctactaaaaatacaaaaaattagctgggcctggtggcatgtgcctgtaatcccagctactcaggaggctaaggtaggagaattgcttcaacgcgggaggcagaggttgcagtgagccaagatggcgccactgcactccaacctgggcaacagagcaagactccagctcaaaaaaaaaaaaaaccggccgggcttggtggctcacacctgtaatcccagcactttgggaggccgaggctggtggatcacgaggtcaggaattcgagaccagcctggccaacacggtgaaaccccgtctctactaaagatacaaaaaattagcctggcgtagtggagcatgcttgtaatcccactactcgggaggctgaggcaggagaattgcttgaatctgggaggcggaggttgcagtgagccaagacaacaccactgcactccagcctgggcagcagtgcgagactccctctcaaaaaaaaaaaaaaaatcaattctaagattttattctccattctactggaagggacaatggaaacccgctataatcactagagcaataagaggcgttgaagtaaccggccatcactacctgcttctgcccaaacacagagccgatattttcctttatgctggggcttccacctgtgcataccacaggctgtcgttttccttgtccaagctgattggtgcaacttacacggatgcctgctgaaatgatacagtatgcatgtaagacctggaccattttggcatactcctgtttaaaaaacacaaacacaatattctacattactttaatattataggaattacacagctcaagttacaacatccaacgcaaggttctcacatcatcgcacaaatcaagggaagcactgttgacagaatgatctgtaaagaggtgtcttcctatattctacagaaaggaacgcagagcttttggctcctggtcacagtcctctcacttcccaatgtgccatgcatcctggtaaaacaactaaaaagtacagcctgtaatcccagctactcaggaggctgagggcaggaggatcacttgagaccaggagttcaagaccagcctgggcaacacagcaagaccctgtctctacaaaaaatttaaaaaaaaaattagccgggcgtcatggcatgtgcctgtagtcacagctactgaggaggctgaggtgggaggatcgcttgagcctaggagttcaaggctgcagtgagccatgattgcaccactgcactccagcctcggtgacagagtgaggccctatctctaaaaatgaaaattaaaaaactgaaacgtacattgtgtttgattttataatctctccttttgaaatgtatcttcgtataatagaaacactggcacaagcattttggtatgcaaagagatacacaaaaatgttcactgaaacaatctctatgaacaaacagaaacaacctaagcaagcatcattgaggagttgattaattatggtatagccatagcgcagcagaatgacaacaaataaggcagtgtgcaccgactaaaaaagacaatcacaatatgctaagtaaaaagtcagttatagggccaggcatgatggttcacacctgtaatcccagcactttgggaggctgaggcgggaggatcacttgagcccacgagttcgagacctgcctgggcaacacagaaggacccatctctacaaaaaaaacaaaaattagccgggcatggtagcacgggcctggagtcccagctacttgggaggctgaagtgggaagattcattgagcctgggagatcatggctgcggtaagctgagattgtgccactacatcccagcctaggtgagagagcaagaccctgtctcaattaaaaaaaaaaaaaaaaaaaaaatacaactttcaaccacatacaattctgtattacttgcatgttgtacattctatattacttgctttcattatattaacttatgaatttatcttgaaaattattccaacagttataaacacatgaaattaaaagcagcctgaaaagatatacaaactgtaaataacagttatctctgacaaatagaagttctacattcctgtattctgctaaggcactaatttttttaccataagatacaaaaaaagagtaagttttctctactttagaaaatttaaatttgtgaaaaaatgtaataaagttaaaattagcagccaagtgcagtggctcacacctgtaatcccagcactttgggaggctgaggcaggtggatcacttgaggtcaggggtgcaagaccaggctagccaacatggtgaaactccatctctactaaaaatacaaaaattagctgggcgtggtggcgcacacctataatcccagctactcgagaggctgaggcaggagaatcacttgaacccaggaggtggaggttgcagtgagccgagatcgcaccactgcactccagcctgggcgacagagtgagaagactccatctaaaaaaaaagaaagttaaaattagcaccaaatgctttacaagtaaaaaaagtttttagctgcatatgtttaagtaactttttagattatgaaaaacacacatacaaaatgggaaggcacaaagaagacagcaaaaactgcatgagatctcacatccaaggataactgctgagaacatgaaagtgccgagtcttccagcctttatactatacacatttaggcttgttgttttgttttcacaaaattgtaatcaaataatacagacagttctataatctgctttttaaacacaacgactatataacatttagctattttcatttgcattcaaattcataagggttctaatagctcatttctcagaaaaccaagagaaatattcttttttttttttttttgagatggggtctggctctgtgcccaggctggagtgcaatagcttgatctcggctcaccgcaacctctgcctcccggattccagcgattctcctgcctcagcctcccaaggagctgggactacaggcacatgccaccatgcccagctaatttttgtatttttagtagagatggggtttcaccagtttggccaggatggctttgatctcttgacctcgtgatccacccgcctcagcctcccaaagtgctgggattacaggtgtgagccactgtgcctggccgagaaatattcttattaaaatataagtacataaggccaggcatggtggctcaggcctgtaatcccagcactttgagaggccaaggtgggcagatcacctgaggtcaggaattcgagaccagcctggccagcctggacaacatggtgaaaccccgtctctactaaaaatacaaaaattagccagctgtggtggtacacgcctgtaattgcagctactcagaaggctgaggcaggagaatcgcttgaactcaggaggtggaggttgcagtgaaccaagatcgcgccaccgcactccagccagggcgccaaagagaaactccatctcaaaaaaagataaaaataaaaaataaaaaatatatatatatgtatatatatttttccagacaggatcttattctgtctcccagtcttaagtgcagtggcgcaatcatagctcactgcagcctcaagttcctgggctcaagtgatcctcccacttcagcctcccaagtagctggaactacaggtacatgtcaccatgcccagtaaatttttttttaaaatttttcatagagacagggtctcactgtgttgcccagtcctaataaacactatgtgatgaaaagaaaaaagtaaatcatcctaaagttaagtctttaatgttaaatctttaatgagaaatgcaaataaagcatttctcaataatttatgggaagagaatcaactgaagaataaacatctttagtaaatcttttgctcatgtgcattaaccaatactcttgaaaaccaggattaatttactgtaccttcttaatattcctttgaaattccttatggcgcacaggtagtgtggaaaataactgctgcacgctgactgtggtccctctggggcgggggtagggggttttctggataattttcccattgtgatcaaacatcagtcgagttccaaccttcgccgatgcgtggcaggtagaaatggtgacatcgctgtgagagaataccaggcatggtgtgttcagtgagagacccatgatgttgggcactgactactcttttcttcacttgcttttctctcaaaattttcttaaaaagctgacgatccctctgagataatcaagatctaaatggttgaggagtcatcataaaatctaaggtttggcatctaaaagacagtgagacagagagcactaaacatgctttgctttgataaaagctttgatttcgtttttcaggttgaactgcaaaaccataaatgatcttaagatttatttattcacaaacacagatttgttttgttattactcttcgaacaaattttttttaaagaatctaacaaatattataattaaaatgtatatgtagggcagagcgtggtggctcatgcctgttatcccagcactttgggaggccaaggcaggcagatcacttgaggccaggagtttgagaccagcctaggcaacatggtgaaatcccatctctactaaaaatacaaaaattagccaggagtggtggtgcatgcctatagtaccagctcctcaggaggctcaggcacgagaatcacttgaacctggaaggcagagattgcagtgagccgagactgtgccactgcactccagcctgggtgacaaagagagactctgtctaaaaaaaaaaaaagatatatatatatatatataattatttataaaaatttcatatctgtgctataattaaatagtgctttggtgaaatgtttccctaaaaattgataatgaaaaccaatggtaactatcatttattatctacatgttaggttaaaattgagaattactgttttaataagggtaaccatctttttaacaatactatttgcttcatttcattcatttattgctcacatttcagaagtactatgacttagattggcagcgagacaaaacagaattcagaagctagaagttgagatgttgagatagaaaactgaaaataataatgattccaattaattttcagagaggtttctctaaggggtcaagtgagtggataaaaatattgtatcacctcagtgcacaaagtgagctcagagcttccccccgaaagccaaaagtttcaacctgagttaggtcggcaaactcttgaatcttagatgtgtgatgtttcagagctgaaagagagtgtaaagtaaggactaagatatctcaagtgctataacaacaaaatatacatgatatctagtaactggctttaaaaaactgtttttgcatttcccaagacagtgttactcaaaattctgagacatgtgacccaattattttataataggattagaaaaagtcaacttacttaagccttcgaagttttcttcttctaccccacatccattgtctgaaacttcaataagatccactccatagtccttaagctttagatctagaaagtttaaaatatttacatatttattaaaaacggacccatgctatcagtttttatattgacattatttataacatatgcaaatttaagagtcataactatacctttagttaaacatactagtgtcattttgtatatttcattgttataaagtcctttctggctatttactagcccagactaaatagtttagctttttctttctttcctctttttttttccctaggctagtgaagtgaagcagttggagtggagaaggaacaaaaaaaatctgtaactggtggtgatcaattagctgtaaaccgcgttgcactttgaccatccttttcttttgaaagaaataattttaacatacccaataaagagaacggggaccgggtgcagtggttcatgcctgtaattccagcactttgggaggccaaagcgagcagatcacctgaggtcaggagttcgagaccagcctgaccaacatggagaaaccctgtctctactaaaaatacaaaattagccaggcttggtggcgcatgcctgtcatcccagctactcaggaagctgaggcaggagaatcacttgaacccaggaggtggaggttgcagtgagccgagatcgtgccattgcactatagcctgggcaacaagagcaaaactctatctcaaaaaaaaaaaaaaaaagagaatgggttctggaatcagacttcctggatcctattttatcagctttataatctcaaaaaaaggaaatttcctatcccctaatttcctcatttgtaaaatagagaataataagttctatctcataaagttattctgcagattaataattctttggttttttttattttattattcttttcttttcttttgagatggagttttgctcgtcacccaggctggagtgcagtggtacgatcttggctcactgcagcctccacctcccaggttcaagcaattctcctccttcagcgtcctgaggagctgagattacagccatgcaccaccacatctggctaatttttgtatttttagtagagacagggtttcatcatgttggttaggctggtctagaactcctgacctcaaatgatcagcccccctcagcctcccaaagtgctggtattacagatgtgagccactactccagccctattttgttttatgtttttgagatggaatcttgctctgtccccaggctggcatgcagtggcacgatctcggcttactgcaacctccgtctctcggcttcaagcaattctcgtgcctcagtgtcccaagtagctgggattacaggcttctgccaccaggtccagctaatttttgtatttttagtagagacagagtttcaccactttggacaggctggtctcgaactcctgacctcaggtatccacccgccttggcctcccaaagtgctgggattacaggcgtgagccactatgcctggcctactttatttttcaatagagacaaggtctcaccatgttggccaggttggtcttgaactcttggcctcaagcaattcccccacctcggcctctcaaagggctaggattataggcgtgagacaccacgcccagctgttctgcaaattaaatatttctgtgcaattcttagcataacacctgcctggcacaccgtaagaacacaataaaagctgttattattattactacctagctaagtactaggcacataataggtgctaacttcaacttaaaaataataatttattactacatcaacacttgatagtcttatttcaataacaaatgtttcttaactacaacaacattcacagatcatttcttgtggcttaaaactctcccaaacttaccaatattagtggcaccagcatccagactgttttctactaactcctttaccgcagtgcttagactcagtaccacctgcccagagcaaatctgatggactgacttccgatcaataggtttgatggccttagcaggttctgtactagagaaatcagttacaagaaacaaatcaagtattcagctatatattttcatcctgattttaactgtgggaaatgactcaacactgtaaataatttatgggtctaatctattcatttattatattagcaaatacatttattatatccagaaatagaaacactgttttacaatccttaaacatgtacccaaaatacttctggatagatacttcaaattcaacagatccttactatctaattatactaagatccacatggagaaaacatacattgtatctctcaaattaccaaaatctttggcaacaatggtgtcttctttcttgaaaagtgaaagcatggctggctgtggtggctcatgcctgtaatcccagcactttgggaagcagagatgggtggataacttgaggtcaggagttcgacaccagcctggccaacacggtgaaaccccgtctttactaaaaatacaaaaaattagccaggcatggtggtgggcacctgtaatcctagctactcaggaggctgaggcaggagaatcgcttaaatccaggaggcggaggttgcagtgagctgagattgcggcattgcactccagcctgggcaacgagcaaaaaaaaaaatgaaagtaacataatttcccaacataattagaaaaaccaacagtatgctgggaaatacacaatgtttaagtcaaaatcatctcagaaattgggtaccagttatataactattccttatacacagttgcctttgataccccactccaaactgaagctgccagctgctgtcttagcaaagaccctcaaagctcttgctgtactagctttaagagttttataaaggttttatctccccttattccctgctccaatacatcctccactctatcaccagagctatttttgaaatcacaaatctggtcaaataatttttctgcttaaaaatttactagtgccccacttcctactatatgaaagttaaaatttagtcatcattggggccaaaactaccttcttttcagaatctctctaatcctttcccttcatcaagtcccctacattattattattattattattattattgttattattgttattatttgagacagagtctcaccccgttgcctatgctagagggcaatggcatgagctcagctcactgcaacctccgcctcccaggttcaagcgattctcctatctcagcctcccaagtagctgggattacaggcgcccaccatcacacccagctaatttttgtgtttttagaagagatagggtttcaccatgttggccaggctggtctcgaactcctgacctcaggtgatccgcctgcctcggcctcccaaagtgctaggattacaggggaccgcaaccagccatcccctatattgtagcacagtgaacaactgtcctgaacatcacaagctctttgagacactacagtgtataagcaggtctctgtctaaaccgctctcctcttcctcctctgcccaaacaatgtctgctcaaagaatgtatcccgtgtgttcattaacttagcaatttccagcaaacagtttaattgataacttgttaagagaaggcaggaaacctccatgaaagagaaatcactgggtatttcctacagcatttaacacatcgtaggcctttaataaacccttctgaaataaacaaacctctttactcttcattccaccttgctaagaatctcacctaagtctgtctaccatgtgaaactgcagatgacctcacagaaaatggaaagaagtatctctaaaaataagtttatttggcagcacactataggctacaggtccacttctgatttttttttttttttttttttgagaccgagtcttgctgcgttgcccaggccggactgcagtggcacgatctcagctcactgcaacctccgcctcctgggttccagcgattctcctgcctcagcctccaaagtagctaggattacaggctcccgccatcatgcccagttaatttttgtatttttagtagaaacggatttcaccatgttggccaggctggtcatgaactcctgacttcatgatccacccgccttggcctcccaaagtgctgggattataggcgtgagtcaccgctctcggcccacttcagatatttattttgaggagggagcgcatttagacacagaccccaaatttatttaaatgtctcaatacatttaaatgtagttacctaaatatatctaatatatttaaatgcagagagcaaatttgcgtttacaaatctgacatggaatgcaaatgtgctagccaagattcggtgtagcttaccagccagaaatcacacatcctaacaggtagaaacgtattgcatttttaaaaactgcgcagctatgcaaataaggatgtgtctggacgctctaccgtccccaaaataaccttaattttttaaaaaggccaggcacggtgcatcatgcctttaattccagcactttgaggggccaaggcgggcggattgcttgagctcaggcgttcgagaccagcctgggcaacgcagcgaaatccccgtctctacaaaaaaaaattaaaaataaaatactataaaaataaaaataaaaggggagagagaacaggtagaaaggaaatgcattcagtctatggggatttcacgctcccgcttcaagtccacggccctgtgatgggatgtgggcaaggcctgtctgggacaggccgaacccaactcctcacagggccgaatcctttgcccgcagcccaggaccccgaaggagcttgcctcggcctcaaggcgcacccaaggggcacgagatcgctgcaacactgaggtcgccactccggggcctccagggggctgcctcgccacgcgcctcggccatgttccccccatttccagggaggttggaatgccgtgggtctcaaagagggcgcgcgagaggggacaccggaagactgcgagccccgctcacctcgagctctcagctcgctccatggatgcaacacccgatccgcctcggggactgggaaagttccctccagggctcccacaggcgctccgcctcctgaactcccattggct

SEQ ID NO: 60 - DNA, 116368 bp, Homo Sapiens
agtgcgtcggcgcgcagttctcccgcccgtttcagcggcgcagcttctgtagttgggctactggaggggtcgctcagaaacctcatacttctcgggtcagggaaggtttgggaggatgctgaggcctgagatctcatcaacctcgccttctgccccggcggtttccccgtcgtcgggagaaacccgctcacctcagggtccccgctacaatttcggactccaggagactccacagagccgcccttcggtccaggtggtctctgcatccacctgtcctggcacgtcaggagctgcgggcgaccggagcagcagcagcagcagccttccctgccccgcgccaaactcccggccagctcaaggcaaggagtgattgggtggaggagtctccttgaggctagaggccggcagttcatggaggctcgggggcacgtgggtggtggttaccacagtgaagttgtgatttggttggggcgtgagatctgagtgccctgggaatttggtgagtctgggtgattagaagccttgacttttcaaattggttctattgcaagaccttgactgtggatggctcagttctgagaaaggctgaagtatcccatataacgtccctcacagtgtctgacaaatgacagtttgtgcgtgagtttgctgatagaagttgtgagctgatctttggctgctgaatttaattctccaaatcctgctaaggtgggataaaatagattaaattgaacatttcatctaattcagggaaaataatatgtttagtattaaaagagtgggctgggcggtggctgacgcctgtaatcccagcactttgggaaaccagggtgggcggatcacttgaggccgggagttccacaccagcctggccaacatggtgaacctcccacccccatcccctatctctactaaaagtacaaaaattatctgggtgtggtggcacgtgactgtggtcccagctactcaggaggttgaggtgggaggatggcgagtccgggaggtcgaggctgccgtgagctgagattgcgccactgcatttcagcctgggtgacacagtgagaccctgactcaaaacaaacaaacaaaaaagatgcatgtccttcaaatcatttattattttgttagtctctattcatgacaaagcatcaccatttttcacacacgattgcaacacaatggtaaagtaacaaataccaaatccaatggtcatttttcagttcatctcatgtgacctttctgctgtatttaatgttcttaatttctttatttttagaaacagagtctcgctatgctgcccatgctggtctcaaactcctggtctcaagtgctcctgcctcggtctgcccaagcattgggattacaggcatgagccactgctgcctggcctatgtttaatgttcttgactggtcttctcttaaactcttttaatttggcttccttgattccacttgcccctgtttttctgctacctcccagagaattgctgtgcccacctttgttcccaaattatgggcatgtcattaaagctttttttcctaggccacttctacctagatgtgactatctccacagctcagatctcatctacactccagacttacttcagactgtcttctgaagtttttattgatggactaatggatacctcaggctgactatatgattaattaaattcctctctgcactttttttttttttttgagacagagtcttgctctgttgcccaggctggagtgcagtggcatggtcatgactcactgcagcctcaaattcctgggctcaagcgatcctcccacctcagcctcccgagtagctgggaccaaggcatgtgcccctacagatggctaatttaaaaaatttttttgtagagacagtgttttcctacgttgcccagcctggtctcgaacttctaggctcaagcgatcctcctacctcagcctcccaaaatgctgggattacaggtgtgagccactgcacctagccctcaaactcttaagtgttcttccatccttgtagcttacttactgtaccaccagagttatgtggaaaatgatcttatcatgtcccttgccacttaaatcagtagacctgtatctgcaggtaaaagatcaaactctctagaaggatagccaaagcaattgggatcggtttctaatctttacagatttatccctcatcatttaatatttaccctgctttctaacaaaactgagctacttgcaattcctttaaagcaacatgaatgttcacattgtcagtctaatccctctcttcatcagatgcttggtcacccacttatttatcagtaatgataacattcactaatttatatgcacctactttgttctggcttcttactaggcagacggtatctttgatcctcacaataattttgcagagtagattttttttttgttcctgttttacagatagaaccaaggcccaaataggcgaacaaaggttcaaattatgttagcagctggggataataatctgtgctctcaatgaacttaaggttcagtagagaagacagacttaaaaatcaacaaatacacatttaagaaataactgtatttgaggtatttataatttttgaggtaggtataattaaagtatggggacaaaagtgggaaaagacatttcacagagtaagtgcaccttgaactggtcttcaagaataagtaggaagaagaatgccagccaaagggaaacagctggagcgcattcttgagaaaaacacgtgcaaaggcacagaagaatcatgtaaaactgctaataattttgcttggctagagcaggagagtgatctaggtagataaacttgaatgtagatatagttgtgagaattagatctgggagacaaatttaacccagagaccccccatattcaacaccaggtctctggttttggtgactggatagatggtagtagtattttctgattctgggaattttgtaggcaaagcaaattttagagggaagatgatgagctctgttatggacatgctgagtgtgaaaagcctgtgggatatccatatatttatattaagataattgaatataggaaactagagctaagaagagagaaacttgagggaaatatggatttgaaagttaccagtatgttgggaccacagcagagaatatgaagactatatagcaaaatagaggtcaaggaagtaggaggagaattaagacaagtgaatgagtttcaagaaagggtatatagtctaaaagtagtctgagaacaagaaacagccctctccatctccagtttccgcatctccagtttctggcaaccactctcttccttagctccctaaagcctagaaatgctaatggagcacattttatgctggttctacacacgtctttatgatagcacccctacaccctgtccacacctttgtaaatattctctttatcaaattatcccagtttgagtatatcattgattcctgctggaacccatataatgaagttatattttaccctatggtgagtatggggagacacataggaattgtaagaaagagagatactgatcagatttgcttttcagaaagattattggtgatgattcgaagaatagattagagaggtgtaatactggaagcaaggagaagaagaagtaggaaacttgcacaaggaccaaagaagatacaggcttaaaatgggctgggaggagtagagagggatttaaattttagtgatgttaaaaaaaaagaattctagcactcagtcactgagtgttagggttgatgaaggaagaattgagaatgtctcctaagcttatgacttgagtgacaagggacaagctggtacaattaaccatactggtaataaagaattaattttgagggaaagatagagttcacttttggacatttagaatgctgggaagatacctaaaggtttatgcccaagagatagatatagtgacctggagctacattgtctgatagaatattctgtgataatagaaacgtttcatacttatgctgtccgatgtggtaactagtagccgtatgtggcttttgagcatttgaaaatgttgctagtgtgactgaggaacagaatttaaattgtatttaattttgatttagttaaatactcacatatgctgctttattgaacaatgcaggtatagagctgagaacggtttttgcacttttgaaggattaaagaatcaagaatattttgtgatattaaaattatatgaaatttagaattcaatatgtagaaataaagccatttttaattgaaacatagccattctcatttatttatgtattatctatgactgcttttctatgatagtgtcagagctgagtaattgtgacagtgattatatggcccacaaaagcctaaaatatttgccatctggtcctttatttaaaagtttatgggctgggcatgatggctcatgcctataatcccagcactttgggaggctgaggtgggcagatcacctgaggccaggagttcatgaccagtctggccaacatgacaaaaccctgtctctattaaaaatacaaaaaaaaaatagccaggtgtggtgggcatgcctataatgccagctgcttgggaggctgaggcaggaggattgcttgaacctgggaggcagaggctgcagtgagctgagattgcgccattgcactctagcctgggcaacaagagtgaaactccatctcaaaaaaaaaaaaaaaaagtttatgctgaggcatggtggcttatgcttgtaatctcagtgctttgggaggctgaagtgggaggattgcttgaggccaggtgtttgagatcagcctgggcaatgtagcaagaccctgtctctataaaaaaaaaattagctgtgtgtggtgaggtgcacctatagtccatagttactcaagaggctgaagcaggaggttacttgagcccatgagcttgaggctgcagtgagctgtgatcacactactgcactccagtctgggcgacaaagagagaccttgtctttataagacagtaaaatagactgggcatggtggctcccgattataatcccagcattttgggaggctgagatgggaagatcacttgagcccaggagtttgagaccagcctgggcaacatggcaaaaccccatctctacaaaaatacaaaaaattagcctggcatggtggcatgagcctatagtcccagctactcgggagggtgaggtaggaggattgcttgagcccaggagttcaaggctgcatttagccaagatcacaccactgaattccagcctaagctacagaacgagagtctcacatacagacaaaaaggaaaaattaaaagtttagcaacccctggtttacagtttaaggagtcgttacagctatatacgaaggcttgagagttgtcagaaaatagatgttaatagaaacaaagaggagagatgagatgcctggagatgcataatgttgatttgtgagggaaagcttaaaagtatgaagccctggaggccaacagttaagaagcagaggaaaaaggagatggcaaaggaaactaaaagtggtttaaagagaattcaagatagagagttgtggaaatcaaagagaataggtgaacagagcccaaacattttaaaatttttttagaacttctatgtgccaagaggctatgctaggttgtttatgtacattatttaaaaattttatgacaatcctgtaaaataggtaatagcttacatcagtagataagtacctaaataaggaactgaagccaattgagtctaaaatgccatttgcataggggagagaaattcaatgaagaaattaacagaagaaggttaaaagaggtctaataattattatacaaatgaaacatatgtcttagtctgtattctgttgcttttaaaagaatacttgaaactgggtgattatcaagaaagaaaacatatttcttggaagtctggaggctgggaagtccaaggtcaaaggaggcacatttagtgagggtctttgtgctggtggagtctctgtagagtcctgtagtggtacagggcatcacatggagagggagctgagcatggtagctcaggtctctcatcctcttcttataaaaccaccagtcctactctcgtgataacccattaacctattaaatcatgaatggattaattcattcatgaaggcagagccctcatgccccatcacctcttaaaggccccacctctgtcctgccacacttcactggggattaaatttcaatgtaagtttcagaggggacagatattcataccttagcaacacatctggtatatttgaagattaaagggtaatttatgattttagccagagtagttgcagtgaacttgtagaggcaaaagctatattagcatatttttgtatatttatcaataatgtcattaattttgttataatctgtttattttcaaaaatcattttcacatgaaattttatagaaagtgaacatagtggttgggtgcggtgactcaggcctctaatcccagcactttgggaggccgaggcaggcagatcatgaggtcaggaattcgagaccagcccagccaacatggtgaaaccccatctctactaaaaatacaaaaattcaccaggcgtggtggcgggtgcctgtaatcccagctactcgggaggctgaggcaggaggatcacttgaacttgggaggtggacgttgcagtgagccgagatcatgccactacgctccagcctgggcgacaagagcaagactctgtctcaaaaaagaaaaaaagaaaaaaaaggaaagtgaacatggtataaattataatgactaatacatcattgcataattcaaatctttaagaattgactgttaatttttcaaatttaggttcatactttggaaacaaaagagcttatgcagaaaacacagttgcatcaaattttacttttggtgcaagctcatcttctgcacgagatactaattatcctcaaacacttaaaactccattgtctactggaaatcctcagagatcaggttataagagctggacaccacaagtgggatattcaggtaaaataagtggaagattaacctagatgatgttttgaaacttaaaagttttataaattataaattagggttattaagttcatttgaatttatctataactgatatgaatgaaaaataaatacattagtttacctctatccataatttgagtctagattaataaggcaacatagtttctgaaattgtttgttaataaatgtaagtctacattattttaaccattctgacaaaaaaacacacaagaaagagaaacctctcccttttatacatgatggcatttaaatctaaaagttgaccctgatattactagtgagtggtttttttatacttaaattttaatttttatctaaatctatgagattttcttgaagagtagatagataaaataggttttcatgtataacagttttctaaggtatatacaacagaatttcttggttacagggtaagttatgtaaatgcatatatttataagataatgacaaattattttttaaagtagttctaccaaagtataaatggtagttaagtttatattagatctacagaagtcagttttagctctgtagtagaatatgaccttcctttttttttttttttttttttaattttttgagacagaatctcactgtgtcgcccaggctggaatgcagtggtgtgatctcgactcactgcaatgtctgctttccgggttcaagtgattcttctgcctcagcctcctgagtagctgggactacaggtgcttgctaccacgcccggctaatttttgtatttttagtagagatggggtttcaccatactggccaggctggtctcgaactcctgacctcatgatccacccaccttggctcccaaagtgctgggattacaggcatgagccactgtgcctggctgacctttttatttacttttatttttatttttatttgtttgagatggagccttgctctgtcgcccaggctggaatgcagtggcacaacttggctcactgtaacctctgcctcctggattcaagcaattttcctgcctcagcctcccgagtagctgagattacaggcatgcaccaccacgcctggctaattttgtatttttagtagagacagggttttaccatattggccaggctggtcttgaactcctaacctcatgatccgcccaccttggcctcctaaagtgctgggattacaggtgtgagccaccgcacccagccctgacctgtttatttttaagtagaaaataaataccaagttccagtggaaattcaatagacatataaaagacatctctaaggttctaaaaatacatttatgctgttatctctctgttgtaaataacataataatgagcatcctaatacataaagcttttttctgagtctcttattatttccttaaaacacacccttagaagtcaaattactgaaacatagggaaattaccttttttattttttttaattaccattttttgtttttttttttttttggtttttgagacgaagccttgttctattgcccaggctggagtgcagtggcaccatctcggctcattgcaacatccacttcctgggttcaagtgattctcctgcctcggcctcccgagtagctgggattacaggcatgcatcaccatgctcagccaattttttttttttagtagagatggggtttcgccatgttggccaggctggtctcgaactcctggccacaagtgatcctcccaccttagcctcacaaagtgctaggattacagttatgagccactgcgcctggccaaaattaccagtttttaagaatctcagatatattgccaagtttcttttgagaactggactaatttttaattccatcaatagtgtataaggtaagccaatcttactctatcctcatcattactaacttctaaaatttattatgattattggctaatttagtaatcatcatcatcatcataagattattattaaattagccaataatcattatcataataaattgtattggttaatttattggttattatggtatgctcttattaacaatgtgtaagagtccacttcaacatttgatattgttagactcaatattttccaacctaacagttgtaaaatactacctgagttttttattttctgagtttgcattttcctgattactagtgagattatctttttctgtacttttgggctatatatctttaataatggtctgtgaaattaatgttcatgtcttttactcatttttctttaggcttatttttctggatttgtagcaatactttatatattctgagtaataaatattttgatgacttttctgtttggttttttttttttttttttttttttttttttgagaaggagtctcgctctgtagcccaggctagagtgcagtggcgcgatcccggctcactgcaagctccgcctcccgggttcacgccattctcctgcctcagcctctcgagtagctgggaccacaggcacctgccaccacgcctggctaattttttgtatttttagtagacatggggtttcaccgtgttagccaggatggtctcgatttcctggccttgtgatccgcccacctcggcctcccaaagtgctgggattacaggcatgagccaccgcgcccggccttttctgttagtttctatgtttctagttcttttttaactctgatgggtcattatgtctagctgtgtgccaatatcacaccatctttagctttataataagtcttgatattttgtaggacagccttgccacctgtaccctccacaagccaccttactcttctttagaggagtcttgattcttcttggccctttgctcttccatgtaaattttgggccaatttttcaagctccaccaaaaaacatattgaggttttgattgaaattatagttgtactgaaccaatagatcctttagggagaattgaaataagaggctaactgatatctacagattgcattattttgtcctcttgattaagaatttcctagttttttttaaaaaaagaaatgattattatcaatgtttatatcttttctttatttaaaaatttacagcttcatcctcatctgcgatttctgcacactccccatcagttattgtagctgttgtagaagggagaggacttgccagaggtgaaataggaatggcaagtattgatttaaaaaacccccaaattatactatcccagtttgcagacaacacaacatatgcaaaggtaagtattaataattctagaaaatggttgctctgttaggcagtatctagagtttaaagtcagtgccttcccaatttgtttactttttggtagaataaaggttattcattattatgtcaatgtaaatactctgaattaaaataaaactgtgttatatctgatttttattttttaaatatattttgtccaaaaagagtgtgttttactgttatttaaataagctattgttagtattagtttctaaaattaacatcttcaaattaataatttctggatttattccaaaggtaatatatgtgataatgtggtactgatcataatccttaaagacacaatcccaaatgccataatcccgatgttcaaatcttgaaagatcaaaatccttaatgttgaaatcctgaaagcttaattctagggaagggattaatgcgtttttggttgtacacaagatagttgcatcatgttagatgcatcatattaggcaatactactaccttattattttatttggaaattaggtatggtttaaggagatgcataggggtgccaaattggcaagggatagacttgtggatttaagtataggtgacaacttgactgtattaaaaaaatacctagtaaagcattatttgggctgtgtctgtgaggttgcttccagaggagatgagtgggtgagtctgagtggactaggcggtgaaaatctgcccttagtgttggtgggcaccttgcagttgaccagggcccagagagagcaaatacagaaattgcatttgtctctctctaagagctgggacagactcttctgctgctgccttggacatcagaaatttgactccacagaagttcgttatcacaacattgactgtgtgtaagcattgtgcatatacattaaaatgttgaaatttttttgataaatgaagacatgtcctttttgtacatcatttatttgtgaaagataaaatttatttcttgaaatcttagctcttcaggcaactgtgtatgtggtgacccatagaagtttttgatctatctcatcaaaagacttaggttgtccctggtggtatttcagatgaccatatttatgaagcttggtgcagacaattaccaaccatagtgatatgcatttatacattttgctttttgactaatttctaatttttgactaatttttttgtgaatacaatttgtctgctcataactgttattatacctgtgtgactgtcattagtacacttaagtgttcatgcttgcaaaaaagttattattgcctattttattgtgtaaagtggcctatgaagtgtactgttctgtttttatatgtttctcaaataaatccccttttaaaaatgcaaatcaatgtcttaaaattgtttttgaagttatttcttccagaactgtgtttttgggattttggtcttttggtattggggttctggggatttttagactttaaggattttgctcttttgggattttgacattcaggattatggcatttgagattgtgtctttcaggattatggcccaaacccatgataatgctaactccagagagttatttctactgaactgtatttgaattttattttttcagaggtaaagaaaactagtatcttagatcagtcagaatttagcctcttaatttcttgccttcacttcttattttgccttcattttatatcactcatcattcatttgggccactcgcctattgtcatgggaatttgcatgatctatcaggtagagatagtttactcctaatttctatgttatttaactcaattattattttattttatttttaaaaggtcttgctcttttgcctaggctgaagtgcagtagcatgatcgtgactcactgcagcctcccacctcagcctcttgagtagcagggaccacaggcatgcaccaccacatagagctgatttttaaattttttttgtatagatggggtcttgctctgttacccaagctagtctcaaattccttagactcgagtgatcctgccccctcagaagttgaattgcccctcgggttcccaaagtgctagaattataggcatgagccatcgagcctagttaattattattttgaagatgtgatctagtgttttatttcaagtgtttcattattttttaattctcttcctttagtccctctttatggtcctccagtgtgtagacttccctttcctaataattaattttttattatacctaacaaccttaatgatactagtattgcatactaacttcatctgtaggtattttatacatttttacaatttcaaaagagtaggaaaaaagtttttaaaaaaaaggaatgttagacaaattgagaatttctgtgtttggaatagttctaagaaatacaccttattttatgaaaagctaagccataaggcagatgtttctcatctgtgtttatgtacttttcaacagttaatctgtaccagtgtggccatactgattgtattgccatagttaccctttttttttttttttttttttgagacaatgtctcactttgttgcccaggttgccaggttggagtgcagtggcacaatcttgactcactgcgacctctgccttccgggttcaagcaattctcctgcctcagcctgcctcagcctcccaagtagctgggattacatgtgcacaccaccaagcctggctaatttttgtatttttagtagagacagggtttcaccatgttggccaagctggttgtgaactcctgacctcaagtgatgcagtcgccttggcctcccaaagtgctgagattacaggcgtgagccacctcccctggcccatagttacccttattggatgtatttacatttttcacagagtatttggataaaatactaagtataagaatttatttaaaaacaattttattttgggaatatatatttgataagttcaaattaatttttgaacttaaggctgttagaaactattgtgagtaaaatatagcctattttatgacagtattttatgttagtagttatataggagatatatgttcaatatactaccattagaaatatatatacatatatattttattgttattggtggtggtggtgtttgtttgtctgtttttgagacagattttccctctgccacctagactggcgtgcaaaggtgcctggtgtgatctcagctcactgcaacctttgccccctgggctcaaactattctcatgcctcagcctcctgagtagctgggattacaggcatgcaccaccatgctcgggtaatttttgtattttttttttttttttttttttagtagagacagggtttcaccatgttggccaggtgggtctcgaactcctggcctcaagtgatctgcccacctcagcctcccaaagtgctgggattacaggtgtgaacccacctggctagaaacatattttaattgaaatatatcattaggacagttataattttgtgtatctatgaattaattttaaatacttatctcagaaaaatatgaaacttttatttcctaagctttatttaagaaattgtttattcaaatgatttcaggtgatcactaaacttaaaattttatcacctttggaaataataatgtcaaatactgcttgtgctgtggggaattccaccaagttgttcactctgatcacagaaaatttcaaggtaagtgatgtttactgtttgtaacattcaagatctaatcacttatttatttatttgttatttattatttatttatttttttgagacagagtttcactctgtcacccaggctggagtgaaagggcgtgatctcggcttactgcaacctccagctcccgagttcgagtgattctcctgcctcagcctcccaagtagctgggactacaggcgtgtgttaccacacccagctaatttttgtatttttagtagaaatggggtttcaccatgttggccaggctagtttcaaactcctgacctcaagtgatcgatctgccttggcctcccaaagtgctgggattacaggcatgagtgagtcactgtgcccggccctaatcactttatttaaaatttacttaataatatcattataaagaacaataattttagtaactttatatttagtgtcctaaagtagtcactaaatacaaatcctaatctaagggactgttaatacagataataaaaatgatagggaatttacttatttgatttggcaccctgatctactttaaacaaaagaaaacatgttttaggtaataaggaagtttctcagatatacaaggggcagacccatagagaaagcataagtttcccttacatgtattttcctggaaactacttattgtgctgtcagactggttgaaattgaagttcttaggggatagcagctatcagcaagtacctttttctatagggaatttaatttgtattacagaattgtttcagcttcccctgataacatgtactgccttccagttagcctgctactctagtgtctatctgtaggactgtagtgggtaagcactgtggaaccttatccaacaagaatgggggctgtggctccaaaccaagtagacagcattgcagttggaataattccttaggaatgcaaattattttcagaatatactatattttgttatgtttttagacttatcttttactttaacacatttggaaccaagctgaggtttggagtccaatgagttcctttcctgttcctaatatattcagcatctgcagtcatataagatttgtcatggtgctcttggatttcctgtatagatgagctgcctttgactcattgccagagatagtccctattctaaatctattgtctctattagacgaatcactttatctgttctttttcatttataactttatacttcttttcattatgcctatttatccatacctttccaactttcatgttttgttgttgttgttgttgttgtgattaggccttataattcttttggttataaataagagaaatctaatgtaaactaccttatgcaaaaaaggaaatgtattggcttatgtaactgggaagtcaatggttgaatagatcctgttcctactgtcaaaggtaaacaaagccaaacactagctaaatattttaatcagtaatatgctgttgcaacagagaaaagagtccagtgtggactgaattgaacttcggtttatactgggcattttaatgggagactaagggaataaggaggagtaagcacaagctcagtagagtcagggaagtgaaaaattattataacaaaaagtaagaccaggtgcggtggctcatgcctgtaatcccagcactttcagaggccgaggagggtggatcacaaggtcaggagatcgagaccatcctggctaacatggtgaaaccccatctctactaaaaatacaaaaaaattagccaggcctggtggcacgcgcctgtagtcccagctactcgggaagctgaggcaggagaatcgcttgaacctgggaggcagaggttgcagcgagccgagattgtgccattgcactgcagcctgggcaacagagcaagactccatctcaaaagaacaacaacaaaaaatctgggtttgctaactggcacttaccaaagttaggctcctattctcccacagaggataggagacagggaccctatttttaggtgttaagtggaataaacagtaaattttttttggcagcctgagttttcttaggctggcactttatgagaggctaaggtcatcctagggatgtggctttgagcagttagaaacaatgttagtgtttcgttcaagtctttataggccagttggaggcttagttgagaagaaggcttatagtagcccaggtagagtttggtcaaagagagcatctttatcactactctcattccccatatcatcctttttctactgcagatagtttacttctatgagatttaagaagatgattgctaatggctcaaggctgatgtcatctcagcttagctaacccagagggaaaataatttctttattccagtgtccatgtatgaattccagggaaggatgctgactgattccgctttgttcagtttctcacacgttagagtaatcactatttctgggggtagatacactataattgactaatccttttgctgtgagacacagaatactatgatagctaggccttccagaatcacatggaatgggggataagtcctccaaaggcaaaaacaacataatttcagtgcatttgaatagtaaggcagtatagcatagtgcttaagaatagagaagtcagattgtcccggtttcagatcttgactctacgtgacctactgcaagacacttaacttcttggagcttcagtttttttcatcagtaaattagggacaataggagataccaacctcctagaaaattgatattttatatagggtaatcagagatggcctcattgataaggttacatttgggcaaagttctgaatggagtgagggagcaagccatggaggtatttgaggtaaaagtattctaagcagagggaaaattcgatatttttattatcattattactattatgactacacttaccataagaagaccttcattagccaggtgtagtgacatgtgcctgtagtcccaggtacttgggaggccagggtgggaggatcacttgagcccagtagttcaaatctagcttgggcaacatagtgagacccctctcttaagaaaaaaaaacagacctgcattaaatcaaaagcaatatgaagtataaggaaaatggacttcaaagaaatctaaatttgagtctcagctttggcacagatcaactgtataatatcagaaaagttacttgacttttcagaattttatttatatgaaaaccggagttaataagatatgtccctacttggtcatgatattttttcattcttaacagcgcttacatagtctattgatataatattaccttttcttaaccatcagttttattcaaaggaggtaaaccttttacttaacaacttgatgctttttaaaagttccattatcaaccgggtgctgatgtctcacactggtaattccagcactttgggaggccaatgtgggagaatcacttgagcccaggagtttgacaccagcctgggcagcatagtgagaacttatctctgctcaaaaaaaaaaaaaaaaaaaaaaaattagccagatgtaatggtgtgtgcctgtagtcccagctactcaggaggatgaagcaagcagattgcttgtaccctggagttcaaatttgtagtgagctatgatcatgccgctgtattccagcctgggcaacagagtgagaccctgtctcaaaaagattataattttctctttgttctaaataaattcaattcactttatgtaaatagtatatcatagataggtagaattggtgttttcatcttttcacctggggcattataagaatctaccctttctcaattatgatagactatggaaagatgaatataaaactgtgaaaggttatttctatacaaaagattactaaaaggcatagattttagtacaatctatacaaaagattactaaaaggcaaaagattactaaaaggcaaagattactaaaggcaataaaaaataaactgtcatgtttattttttattattgtatctaacatattccattaaatctcataagagtaaggtctaataagagatacaaactactataattcacttagcaagaataatcattctttttatagaaataactaagaaaagttcttatttaaatgttgaaatttttatacaatatttaagccacttacctagcatgtgtttaagaaagcagttttgggcaagcgcatggcacttcaaactttattttgaaattaaaacttcttttcagaatgttaatttcactactatccaaaggaaatacttcaatgaaacaaaaggattagagtacattgaacagttatgcatagcagaattcagcactgtcctaatggaggttcagtccaagtaagttatatatttatttatttttttactagcccacagctaccaatatcatatcaagtaagttataacttaaggaaagtaaataaatctccagtgtgagttccacaagggcagggacttttgtctgttttgttctctgctgcattcctaccacctggaaaattacctggttcataatacatagtaattattgaaatagtgaaatagttgactaaaatttatacacaaggcatatattgctaacttaatttatatagaatttctccaaattagtcataagctattgacctaatggttgctactcactttactttggagtgaaaagctcaagtagctacagtaaactggaaatgtgagggcataggagtaaaacacaggtaaagctgtgttcctgtttctttctgtctttactcctaacagattcagcatgagacagagaatggtatttttggaacacatatttcctagaacatacgaaatagatactttctttgagtcaggttggattacctgtttactcagttaataacaatcattattctcactgagatcataacatacttctctgtacattgagatctgattctaccgttaaagtaccggatttttccaggctgggcacagtgactcatgcctgaaatcccagcacttcgggaggccaaggagtttgagaccagcctcagcaacatggcaaaaccccatctctaccaaaaatacaaaaattacctgggtgtggtggtgcatgactgtcatcctagctacttgggaggctgaggcaggagtattgcttgagcctgggaggtggaggttgcagtgagccgagatcacaccactgtaccccagcctggttgacagagctagaccctgtctcaaaataaataaataaataaagtatcagactttcctaacattatttgaatacttagaatggtacatcaaaaattgatgcaaattacctttgattgaatgttacctcctaacacaggatttatcggaatttaaagtcccttaagtgtcagacttgaacttgaaattaatacttgaaattatttattttcattcatttttatgatttagaggttatttacctagttttcaaaaatatgaaatacctggtgtaccttttccttttgagtttaagcaatgctatgcaaatatttataatttttcttaaggggaaatagataattttttatattaaagacttatagtgatgtattattggtcatcttttaggtattactgccttgcagctgttgcagctttgttaaaatatgttgaatttattcaaaattcagtttatgcaccaaaatcactgaagatttgtttccagggtagtgaacagacagccatgatagattcatcatcagcccaaaaccttgaattgttaattaataatcaagactataggtaagatcatccattttatttgtataaaatatatcggtatatatatatttttctattaatggtaactttaaagttctttttttcttttttaaattttgagatggagttttgctcttgttgcccaggctggagtgcagtggtgcgatctcagctcactgcaacctctgccttccaggttcaagcaattcttctgtctcagcctcccaagtagttgggactacaggcatgtgccaccatgcctagctaatttttctatttttaatagagacagggtttcaccatattggccaggctggtctcaaattctggatctcaaattatccacctgcctcagcctcccaaagtgctgggattacagccgtgagctactgctctcagcctaaacttctttgaattatttgatggagaattttatttaagaggtaggttcttgctattttgtccaggctggtctcaaactcctgggctcaaatgattgtcctgcctcagcctccaagtagctgaaactatgggcacaaactgccatgcccagctaatggtggagaaatattaagtaagcatgttttaaatcattgtactgtttttgctgaactggtcagatgtttcaccaaaatcaagttttaaaaagatatttgtactaaataacaaaaaacaacccagttcagaactgggtaaaggaacttaatagacattttcacaaagaaggtaaacaaatggccagtaagtaccagaaaagatgctcaactttactagtcattagggaactacaaatcaaaaccgcagttagataccacttcacatccattaggttataggttaaaattactctgtctttgactttctatgatatcctatgttatcatggcatagaaagtcaatgaccaagcctggtagttattacaaagtgttttatattcagttttaccttgtcatgtttcacactttatcattgtcaaacattgtttgacttcctgctatatattagggatacagatacttaaatgatagaatatctgatctccaggagttagtattatagttgaaaggaacaattgaaaagtcttttcacagacttaaatgaaagaatcctcaggttaaaagatggatattctacgtactgaactatctgaatagctccaatgcttccataggcttgctgcctgttcagtgcagtattacatccattgatttctataacaaatgggaggtttatgtgtgccccttacctccttttagaaataagttctcaaaaaaaaaaaatgtacatgtgatgggagacaccccccctccccctagccagttgatatgagtagttccctacaaattagtttaaatgggtatgacagaaatctggtagaatgatgactaaatcttaaaagtcattcttgtttcctctcctttcacacctcagatttgatccatcagaaaatcctcttgatctagccttcagagtatataccagttctggatcacttgtcaccatttccaaggctactaccctaacccaaacctctatcatctttagcatagactactataatagcctcctagcttttctttctgccctcttcttaccttcctatagtttattctcaacatattaatagtagtcatactgtgatatccttttaatccagaaatcagatcttgtaactcttctgctgaaaaccttccagtggctctccttacatttacaatagaatccagactctttggcctataaggacttctatgtcctggcctctatcaacttcttcattcatctctctctattcttacccccacttgcaaagctccactaaccttgatcttcttttttgttctggagccagacttcctgggcttaaattgctgctatgctacttacttggaaatcttggacaagttacctaatttccttgttcttaagttacttctgttgtaaaatgatgtggccaataatagtgcctatctcataacatggttattagaattaaacaagttaatacttttaaaatgcttagaacaattgtgggtacatactaagtatcattttatgttagctgtcctcattattgttgtcatgattcccatcccatcgtcatctttgcattgctgccttcttttttaatcattcagttctcaactctactatcaaattcatagggaagtctttcttaatcaacctaactaaagcaaccaccctggtccttctctgtatattccgttttttttgtttgtttgttttttgttttgagatggagtctcactctgttgaccaggctggagtgcagtggtgcaatcttggctcactgcaagctctgcctccagggttcacgccattctcctgcctcagcctcccaagtagctgggactacaggcacccaccaccatgcccagctaattttttttttgtatttttagtagggacggggtctcactgtgttagccaggacggtctcgatctcctgacctcatgatccacccgcctcggcctcctaaagtgctgggattacgggtgtaagccaccgtgcccggcctgtttttgttttttttagctgtttctgtacctaaaattattttcttgatatgattatgtgtttattgtttttattgtttatttcccctcgctctttgtcttgtcttcagtcacggccagtaaactgacaaaagttattgtcaatggctaagtgcggtggctcatgcctgtaatcccagcaccctgggcaggccaacgtgggtggatcacttgaggccaggagtttgagaccagcctggtcgccatggtgaaaccctgtctttaccaaaaatacaaaatttagccagcatagtggcacacctgtaatcccagctactcaggaggctgaggcatgagaatcacttgaaccctggaggcagaggtagcagtgagcctagatagtgctgctgtactccagcctgcgcaacagagcaagactctgtctaaataaataaataaataaaaagttattggcaatcgccattaggctgtaaggtctgtgaagacaggaatcatgtccgtcttatatgcccagtgtttagcatagagttttgaataccataagggctcaaaaagtatttgttaaatattaaaatgaatcagattttttacatgtattatatgaagttgtctaataaatagtccaactaaatgaatttttttgtttctttgtttttgtttgttttagacagagtctcactttgtagcccaggctggagtgcagtggcgcaatctcggctcactgcaacctccgcctcccgggttcaagtgattcttatggctcagcctcctgagaagctgggattacaggtgcctgccactatacctggctaatttttgtatttttttttcagtagagatggggtttcaccatgttggccaggctggtcttgaactcctaacctcaagtgatccacctgcctctgcctcccaaagtgctgggaatacaggcatgcgccaccttgactgaccagcattctttagaatagctcatttctttataaatcacctaggaattatgaaattgtcttgtacttgtcatcagaacaagatcattatagtaaatatttattttaacaatataaaagcccctccacccttaaggatatattattaatatcttgctattatggatggaataaatagactagaaaactttatattagtgtgaatattgtaactgatctataaaagaagtcataaagtgcaaggagattctattcatccttgttaaagtgtagttcattgaccaatagcatatatgggagcttgttcaaaatatatcctcataaaatgagttagggaggattccctctttttctgttgattggaatagtttcagaaggaatggtaccagctcctccttgtatctctggtagaatttggctgtgaatccatctggtcctggacattttttggttggtaagctattaattattgcctcaatttcagagcctgttattggtctattcagagattcaacttcttcctggtttagtcttgggagggtgtatgtctccaggaatttatccatttcttctagattttctagtttatttgcatagaggtgtttatagtattctctgatggtagtttgtatttctgtgggatcagtggtgatatcccctttatcattttttattgcatctatttgattcttctctcttttcttctttattagtcttgctagtggtctatcaattttgtttatcttttcaaaaaaccagctcctggattcacaacaaagatcaaaagagacaaagaaggccattacataatggtaaagggatcaattcaacaagaagagctaactatcctaaatatatatgcacccaatacaggagcacccagattcataaagcaagtacttagagacctacaaagagacttagactcccacacaataataatgggagactttaacaccccactgtcaacattagacagatcaacgagacagaaagttaacaaggatatccaggaactgaactcagctctgcaccaagcggacgtaatagacatctacagaactctccaccccaaatcaacagaatatacattcttttcagcaccacaccacacctattccaaaattgaccacatagctggaagtaaagcactcctcagcaaatgtaaaagaacagaaattataacaaactgtctctcagaccacagtgcaatcaaactggaactcaggattaagaaactcactcaaaaccgctcaactacatagaaactgaacaacctgctcctgaatgactactgggtacataacgaaatgaaggcagaaataaagatgttctttgaaaccaacgagaacaaagacacaacataccagaatctctgggacacattcaaagcagtgtgtagagggaaatttatagcactaaatgcccacaagagaaagcaggaaagatctaaaattgacaccctaacatcacaattaaaagaactagagaagcaagagcaaacacattcaaaagctagcggaatgcaaaaaataactaagatcagagcagaaatgaaggaaatagagacacaaaaatcccttcaaaaaatcaaaatatatctaaaaactttttttgcgacaagatctcactctgtctccacactggaatacagtggtgcaagtatggttcactgcagccttgacctcctgggctcaagcaatcctcccatctcagcctcctgactaactgggactaaaggcctgtgccaccctgtccagttaatttttagttttttgtagactcggggtctcactatgttgtccatgctggtcttgaactcccgagttcaagtattcctcctgccttggcctcccagagtgttgttgagattataggtgtgagcaaccgtgcgtggcccaaaatgtagaacctcatgctttttattagacctactgaattagaaatttatgtaattgtatgcacagtaaagtttaagaatcattgctggccaggcgcggtggctcacgcctgtaatcccagcactttgggaggccaaggcaggcggatcacaaggtcaggagatggagaccatcctggctaacaaggtgaaaccccgtctctactaaaaatacaaaaatacaaaaaattagctgggcgtggtggcgggcgcctgtagtcccagctactcaggaagctgaggcaggagaatggcgtgaaccttggaggcggagcttacagtgagccgagatcgcgccactgtactccatactgggagagagagcgagactctgtttcaaaaaaaaaaaaaaaaaagaatcattgctgtagattataggattatttaattacaaagtgaaatgaaattttcttgcgtttttctttgtattcttactgacatttcttgtgttttgaaaggaataatcacactctctttggtgttctaaattatactaagactcctggagggagtagacgacttcgttctaatatattagagcctctagttgatattgaaaccattaacatgagattagattgtgttcaagaactacttcaagatgaggaactattttttggacttcaatcaggtaaatcaatattatttaatattataaatacaaattattgaaaaatacagttggcttagttatttttccatgtttctgaaagacaagtagtgaaggtgttaattcttgtattcttttatggaaaatattttcctgaaattttctactgagtcctgtagtaaataatttcaggggtacattatgtaatgtattttgatttcctgtatgcttttcttttccatttttttctgtttttttttgttgttgtttttgttgttgttgttcatagatactttacattctttttctccatggtaatcctcaaagatgggaagatttgttcagactacgtaattatcaacggataggatatattagtttcctaggctgctctaaaaactagtacctactccatggtttaaaacaacagaaagtttttgtcttacagttctggaagctagaaacttaaaataaggtgtcagaaaagccatgctccctctgaaacctataggggagaatcctttgcccctttctagcttttggtggtcgctgtcagtccatgatgggccttggctcacaggtttgtcattgcaatctctgcttctattgtcatatggttttctccctgcgtgtcttcacattgtcgtcttataaagacactagtcgtattgtattaagacctaccttaataacctcacattagcttgattacatttgcaaagatgcaatttccaaataaggtcacactaacagatacccggagttaagacttcacagtatcatttgggggtcacaattcaacccataacatgggataagaaaattgcccttgcctcagggtctgtttctggagaactcaccctaacacagtcaccaacaggcatattgctaattttttttttctttactttaaattctggaatacatgtgctgaaatgtgctgaacatgcaggtttgtcacataggtatacatgtgccatggtagtttgctgcacctatcaacccatcatctaggttttaagccttgcatgcattggggatttgtcctaatgctctccctcccctttccctccacccactgacaggccccagtgtgtgatgttcccctccctgtgcccatgtgttctcattgttcaactcccacttatgagtgaaaacatgcagtgtttggttttctgttcctgcattagtttgctgaggatgacggttcccagcttcatccatgtccctgcagaggtcatgaactcattctttttaatggctgcatagtattccatggtgtatatgtgccacattttctttatccagtctatcattgatgggcatttgggttggttccaagcctttgctattgtaaatagtgctgcagtaaacatacatgtgcatgtgtctttatagtagaaagatttataatttttttggtatatactcagtaatgggattgctgggtcaaatgatatttctggttctagatccttgaggaatcgccacactgtcttccacaatggttgaactaatttagactcccaccgacagtgtaaagtgttcctatttctccacatcctctccagcatctgttgtttccttactttttaatgatcgacattctaactggcttgagctggtatctcattgtggttttgatttgcatttctctaatgaccagtgatgatgagctttttttcatatgtttgatggccgcacaaatgtcttcttttgagaagtgtctgttcatatcctctgcccactttttgatggggttgtttttttcttgtaaatgtttttaagttccttgtggattctggattttagagctttgtcagatgggtagattgtaaaaattttctcccattctgtaggttgccttttcactctgatgatagtttcttttgctgagcagaagcgctttagtttaattgatcccacttgtcaattttggcttttgttgccattgcttttggtgttgtagtcatgaagtctttgcctatgcctatatcctgaatggtattgcctaggttttcttctagggtttgtatggttttaggtcttacatttaagtctttaatccatcttgagttaatttttgtataaggtgtaaggaagggatccagtttcagctttctgcatatgtctagccagttttcctagcaccgtttattaaacagggaatcctttccccattgcttgcttttgttaggtttgtcaaacatatgtggtgttatttctcaggtctctgttctgttccattggtctatatatctgttttggtaccagtaccataccgttttagttactgtagccttgtagtagtttgaagtcaggtagcataataccttcagctttgtttttttttttttttgcttaggattgttttggctatatgatctcttttttcattccatatgaaatttaaagtatttttttttctagttctgtgaagaaagtcaatggtagctaaatgggaataacattgaatctataaattactttgggcagtatggccattttcacaatattgattcctcctatctgtgagcatggaatgtttttccatttgtttgtgtcctctcttatttccttgagttctttttgtagttctcattgaagaggtccttcacttcccttgtaagttgtattcctaggtgttttattttcttcgtagcggttgtgaatgggagttcactcatgatttggctctctgcttgtctattattggtgtataggaatgcttgtgatttttgcacattaattttgtgtcctgagattttgctgaagttgtttatcagtttaaggagtttttgggctgagacgatggggttttctaaatatataatcatgtcatctgcaaacagagacaatttgactttctctcttcctatatgaataccctttatttctttctcttgcctgattgccctggccagaacttccaatactatgttgaataggagtggtgagaaaggacatccttgtcttgtgccggttttcaaagggaatgcttccagtttttgcccattcaatatgatattggctgtgggtttgtcataaatagctcttactattttgagatatgttccatcaatacctagtttattgacagttttttagtatgaagggtgttgaattttatcgaaggccttttctgcatgtattgagataatcatgtggtttttgtcattggttctgtttatgtgacagattacatttagtgatttgcatatgttgaactagccttccatcccagggataaagccaacttgattgtggtggataagctttttgatgtgctgctggattcggtttgccagtattttactgaggattttcacatcaatgttcatcagggatattggcctgaaattttctttttttgttgtgtctgtaccaggttttggaatcaggatgatactgccctcataaaatgagttagagaggagtccctcttattctattgtttgaaatagtttcaaaaggaatggtaccagctcctccttgtacctctggtagaattcggctgtgaatccatctggtcctgagctttttttggttggtgggctattaattactccctcaatttcagaacttgttattggtctagtcacagattcaacttcttcctggtttagtcttgggagggtgtatgtgtccaggaatttatccatttcttctagattttctagtttatttgtgtagaggtgtttatagtattctctgatgttagtttgtatttctgtgggatcagtggtgatatcccctttatcatttcttattgtgtctatttgattcttctcccttttcttctttattagtctgcatagtggtctattttgttaatcttttcaaaaaaccagctccccggttcatggagttttcgaagggtttttcatgtctctgtctccttcagttctgctctgatcttagttatttcttgtcttcttctagcttttgaatttgtttgctcttgcttctctaattcttttaattgtgatgttagggtgtcgatttgagatcttttccactctctgatgtgggcatttagtgctataaatttccctcttaaccctggtttagctgtgtcccagagattctggtacattgtctctttgttttcattggtttcaaagtacttctttgtttctgacttaattttgttatttacccagtagtcattcaggaggaggttgtttactttccatgcagttgtgcagttttgagtgagtttcttaatcctgagttctaatttgattgcactgtggtctgagagactgttatgaattccattctgttccatttgctgaagagtgttttacttacaattatgtggtcgattttagaataagtgctatgtggtgctgagaagaatgtatattctgttgatttggggtagagagttctatagatgtctattaggtccacttggttcagagctgggttcaagtcttgaatatccttgttaattttctgtctcattattgtcagattcgccaaggttgaaacaaaaggaaaaaatgttaagggaagccagagagaaaggtcaggttatttacaaagggaagcccatgagactaacagcggatctctgtgcagaaaccctacaagcaagaagagagtgggggccaatattcaatattcttaaagaaaagaatttttaacccagaatttcatccagccaaacttaatttcataagtgaaggagaaataaaatcctttacagacaagcaaatgctgagggattttgtcaccatcaggcctgccttgcaagaactcctgaaggaagcattaaatatggaaaggaaaaaccagtaccagccactgtaaaaatacaccataatataaacaccaacaacacagtgaagaaactgcatcaactaatgtgcaaaataaccagctagcatcatgatgataggatcaaattcacacataacaatattaaccttaaatgtaaatgggctaaatgccccaattaaaagacacagactgacaaattggataatgagtcaagacccatcagtgtgctgtattcaggagacccatctcacatgcaaagacacacataggctcaaaataaagggatggaggaatatttaccaagaaaatggaaagcaaaaaaaaaaaaaaagtaaagtaaaaagcagagattgcaatcctagtctctgataaaatggactttaaaccaacaaagatcaaaagagacaaagaagggcattatataatggtaaagggatcaatacaacaagaagagctaactatcctaaatatacatgcacccaatacaggagcacccagattcataaaagaagttcttagagacctacaaggagacttagacccccacacaataatagtgggagactttaatacccactgtccatattgttaaatttaatgggcacattagttcccttatttgaataagaaaattgccctgggcaaagtacatcaacagatgcttctcaaaagaaagacatacaagtgaccaataaacatatgaaaaaatgctcaatgtcactaatcctcagaaaagtacaaatcaaaaccacaatgagatgccatctcacaccagttggaatagctattattaaaaagtcaaaaaataacagatgttggcaagtctgcagagagaaggaaatgctcatacattgttcttaggattgtaaattagttcagcctctgtggaaagcagtttggagatttctcagagaactaaaaatagaattaccattcaacccagcaatcccattactggatatatacccaaacataaataaattgttctcccaaaaagacacctgcactcacatgtttattgcaacattattcacggcagcaaagacatggaatgaacccaggtgcccatcaacagtggactgggtgaagaaaatttggtacatatacaccttggaatactatgctgttataaaaagaatgaaatcatgttctttttggcagcatggatgtagctggaggccattattctaagtgaatgaacgcagaaacagaaaaccaaatactgcatgttcttacttatatgtgggagctaaacattgggtacacatggggatataaagatgggaacaatagctattggggactccaaaaggggagaggaatggggcaagggttcaaaactattgggtactatgtttactatctgagtgctggattcaatcaaagcccaaacttcagcatcaaacaatgtatctatgcaacaaacctgcacatgtaccctgtaaatccaaaataattttttttaaaaaggaaaagagaggaggttccaagatggccaaataggaacagctccagtctgcagctcccagcatgagcaacacagaagacgggtgatttctgcatttccaactgaggtgctgggttcatctcactggggcttgtcagacagtgggtacagcccatggagcagggcaggacattgcctcacctgggaagcacaagggttcagagaattccctttcccagcaaagggaagccatgacagacagtacctggaaaattgggacactcccaccctaatactgcgcttttccaatggccttagcaaacagcacaccaggagattatatcccgcacctggcttggagggtcccacgtccatggagcctcgctcactgctagcacagcagtctgagatcgaactgcaaggtggcagcgaggctgggggatgggcatctggctttgctgaggcttgagtaggtaaacaaagcggccaggaagctcaaactgggtggagcccaccgcagctcaaggaggcctgccttgcctctgtagactccacctctaggggcagggcatagctgaacaaaaggcagcagaaacttctgcagacttaaacatccctgtctgacagctttgaagagactggtggttctcccagcatggagtttgagatctgagaatggacagactgcctccccaagtggggccatgacccccaagtagcctaactgggaggcatctcccagtaggggccgactgacacctcatacagctggatgcccctctgagacaaagcttccagaggaagaatcaggcagcaacatctgccgttctgcaatatttgctgttccgcagcctctgctggtgatacccaggcaaacagggtctggataggacctccagcaaacaccaacagacctgcagctgagggtcctgactgatagaaggaaaactaacaaacagaaaggacatccacaccaaaacaccatctgtacaccaccatcatcaaagaccaaaggtagacaaagccacaaagatggggagaaaccagagcagaaaagctgaaaattctaaaaatcagagcaccttttctcctccaaaggaacgcagctccttgccagcaacggaacaaagctggaaggagaatgacattgatgagagaataaggcttcagacgatcggtaatagcagacttctccaagctaaaggaggatggtcgaacccataacaaagaagctaaaaactttgaaaaaagatgagacatatggctaactagaacaaacattgtagagaagtccttaagtgacctgatggagctgaaaaccgtggcacgagaacttcttgatgcgtgcacaagcttcagtagctgatttgatcaagtggaagaaaggctatcagtgattgaagatcaaatgaatgaaatgaagcaaaaagacaagtttagagaaaaaagggtaaaaaaaaccgaacaaagcctacaagaaatgtggcactatgtgaaaaaaccaaatctacatctcattggtgtacctaaaagtgacggggagaatggaaccaagttggaaaacactcttcaggatattatccaggagaacttccccagcctagcaaggcaggccaacaattcaaattcaggaaatacagagaacgccgcaaagatactcctcaagaagagcaattccaagacacataattgtcagattcaccaaagttgaaatgaaggaaaaaatgttaagggcaaccagagagaaaggtcaggttacccacaaagggaagcccatcagactaacagcggatctcccagcagaaactctacaagccagaagagagtggaggccaatattcaacattcttaaagaaaagaattttcaacccagaatttcatatccagccaaactaagcttcataagtgaaggagaaataaaatcctttaagacaaacaaatgctgagagattctgtcaccaccaggcctgccttacaagagctcctgaagaaagcactaaacatggaaaggaacaaccagtaccagccactgcaaaaacatgccaaattgcaaagaccatcaatgctagaaagaaacttcaccaactgacgagcaaaatcaccagctaacatcataatgacaggatcaaattcacacgtaaccatattaaccttaaatgtaaatgggctaaatgctccaattaaaagacacagactggcaagttggataaagagtcaagacccatcaatgtgctgtattcaggagacccatctcacttgcagagacacacataggctcacaataaagggatggaggaaggtgtaccaagcaaatggaaaacaaaaaaagcaggggttgcaatcctagtctctgataaaacagattttaaaccaacaaagatcaaaagagacaaagaaggccattacataatggtaaaggggtcaattcaacaaggagagctaactctcctaaatatatatgcacccaaaacaggagcacccagattcataaagcaagtgcttagagacctacaaagagacttagactcccacacaataatagtcggagactttaataccccactgtcaacattagacagatcgagacacaaacttaacaaggatatccaggaattgaactcagctctgcaccaagtggacctaacagacatctacagaactctccaccccaaagcagcagaatatacattttctcagcaccacatcacacttattccaaaattggccacatagttggaagtacagcactcctcagcaaatgtaaaagaacacaaattataacaaactgtctctcagaccacagtgcaatcaaactagaactgaggattaagaaacacactcaaaaccgttaaactacatggaaactgaacaacctgctcctgaatgactactgggtacataatgaaatgaaggcagaaataaagatgttctttgaaaccaatgagaacaaagacaaaacataccagaatctctggcacacatttaaagcagtgtgtagagggaagtttatagcactaaatgcccacaagagaaagcaggaaagatctaaaattgacaccctaacatcacaattaaaagaactagagaagcaggagcaaacccattcaaaagctagcagaagataagaaataactaagatcagagcagaactgaaggacatagagacacaaaaaacccttcaaaaaatcaatgaatcaaggagctggttttttgaaaagatcaacaaaattgatagaccactagcaagattaataaagaagaaaagagagaagaatcaaatagatgcaataaaaaatgataaagtggatattaccaccaattccacaggaatgcaaactaccagcagagaatactataaacacctctatgcaaataaactagaaaatctagaagaaatggataaattcccggagacatacaccctcccaagactaaaccaggaagaagttgaatctctgaatagaccaataacaggctctgaaattaaggcaataaataatagcctaccaaccaaaaaagtccaggaccatatggattcacagccgaattctaccagagttacaaggaggagctggtaccattccctctgaaattattctgatcaatagaaaaagagggaatcctccctaactcattttatgaggctggcaacatcctgataccaaagcctggcagagacacaataaaaaaagagaattttagaccaatatccctgatgaacatcgatgcaaaaatcctcaataaagtactggcaaaccgaatccagcagctcatcaaaaagcttatccaccacgatcaaggcggctttctccctgggatgcaagggtggttcaacatactttgaagcaatatacgtaatccatcacataaacagaaccaaaggcaaaaactcatgattatctcaatagaggcagaaaaggccttcagcaaaattccacagcccttcatgctaaaaactctcaataaactagatattgatggaacgtatctcaaaataataatagctatttatgacacacccacagccaatatcatactgaatgggcaaaaactggaagcattcccttgaaacctggcacaagacagggatgccctctctcaccactcctattcaacatagtgttggcagttctggtcagggcaagcaggcaaaagaaagaaataaagggtattcaattaggaaaagaggaagtcaaattgtccctgtttgcagatgtcatgattgtttacttagaaaaacccatcgtctcagcccaaaatctccttaagctgataagcaacttcagcaaagtctctggacacaaaatcaatgtgcaaaaatcacaagcactcctaaacaccaataacagacatacagagagccaactcatgagtgaactcccattcacagttgcttcaaagagaataaaatacctaggaatccaacttataagggatgtgaaggatgtcttccagtagaactacaaaccactgctcaacgaaataaaagaggacacaaacaaatggaagcacattccatgctcatggataggaagaatcaatattgtgaaaattgccatactgcccaaggtattttatatattcagtgccatccccttcaagctacgaatgactttcttcacagaattggaaaaaactactttaaagttcacatggaaccaaaaaagagctcgcattaactggacaatcctaaaccaaaagaacaaagatggaggcatcacgctacatgacttcaaactacactacaagcctacagtaaccaaaacagcatggcactggtaccaaaacatatatagaccaatggaacagagtagagccctcagaaataataccacacatctacaaccatctaatctttgacaaacctgacaaaaacaagaaatgaggaaaggattccctatttaataaatggtgctgggaaaactggctagccatacgtagaaacctgaaactggatcccttccttacaccttatacaaaaattaattcaacatggattaaagacgcaaatgttagacctaaaaccttaagaaccctagaagaaaacctaagcaataccattcaggtcataggcatgggcaaggacttcatgactaaaacaccaaaagcaatggcaacaaaagccaaaactgacaaataggatctaattaaactaaagagattctgcacagcaaaagaaactatcatcagagtgaacaggcaacctacagaatgggagaaaattttacaatctacccatctgacaaagcgctaatatccagaatctacaaagaacttaaacaaatgtacaagaaaaaatcaaccccatcaaaaagtgggcaaaggatatgaacagacacttcgcaaaagaagacatttatgcatccaacagacacatgaaaaagtactccttatcactggccatcagagaaatgcaaatcaaaaccacaatgagataccatctcacatcagttagaatggcaatcattaaaaagtcaggaaataacaagtgctggagaggatgtggagaaataagaatgcttttacactgttggtgggactgtaaactagttcaaccattgtggaagacagtgtggtgattcctcaaggatctagaactagaaataccatttgaccgagccatcccattactgggcatatacccaaaggattgtaaatcatgctgctataaagacacatgcacacatatgtttattgtggcactattcacagtagcaaagacttggaactaacccaggtgtccaacaatgatagactggattaagaaaatgtagcgcatatacaccatggactactatgcagccataacaaaggatgagttcatgtcctttgtaggtacatggatgaagctggaaaccatcattcagagcaaactatcacaaggacagaaaaccaaacaccgcatgttctcactcataggtgggaagtgaacaatgagaacacttggacacgggataaggaaccacacaccagggtctgtcgtggggtcaggggatgggggagggatagcattaggagatatttgtaaatgaggagttaacgggtgcagcacaccaacatggcacatgtatacatatgtaacaaacctgcacgttgtgcacatgtaccctagaacttaaagtataataataataacaaatgaagtgaaaaataaaaaggaaaagaaagttgcctttgcaacctggctgtttgtccactggcatggtggtgcagttttattcttaaatctgtagttggaaggatagtttatatgtactactctttgtccagtatttggttgctttcagcttggtctgtcttccatacctccacttgcctgactaccctagcttgtgttctggtagtctaaatgaaagtggtgcattcaaatctagaaggcatttactacctgagtaggttttcttcagtccaattccaaatacctttaattagcgtaattccttcaaaattctggtattatattgactgtgactctgcctgtccaatgttgtccagtatattcttttttaaatatgtatattcctgtgtatttagtattgggaaaggcagaaagaggccatttttaactatccttttcttgttaatagcaacatcttgttggtctacctatacctgccatttagtgtaatacgtaagtgccaagaatatgaaaagtcatttaatcatgttacattggtcaagctccaaccattgatacctttttaaactttctgctaccaaatatgcatttatacttatctacttttcactccctttgtttaagccagaagtggtattctctagctaattcctccatctgttccctggatcccatccttgcacttatctcctgtatcttcattatttttctctccatggccttcttctaagaggatttaaacttcctcatgtctctcctatctttgtaaaaactctccctggacttcatcttttctagctaccactatatcacttctctattcacagccaaacctgttgaaaaacaaatttcctatgctcactatcttctcttcatcactatgtctcaatgtgctgcaatcttatttctgtgcccagtactgtgctgagactgctcttgtcaaggtcactggagcagatcttgttggttctctgtacagattgtcttggatcccttttacctttcggagttcaccttttgctggtctgcgtgcctagtggcccacacctggactctttttctatgcctaccttcaggctgttagagcgctttgttcttaaacacagagtacccaaaatgcctggtagcccttaaatgactgtatggtgtgaagatatgaaagcctagctctttcacattgatttggcaaaaacctgaatataacttaaactccagaatttctttgcaagattagttgaagttaccttccacacaactttgcctgaaatcacactgttggttggcttggtttcccttctctgtccttttctcactgctctactggtttcttctggaagcagattctttttctctttttctttctttttcttttttttttttttgagacaaggtctcattctgttgcctaggctggagtgtggtggtgcgatttcagctcactgcaacctctacctcctgggttcaagcaatcctcgcacctcagcctcccaagtagctgatactataggcctctgccaccatacttagctaatttttatgtttttggtagacacgggatttcactatgttgcccaggcttggaagcacattcttaataaattactggcacataaatccttgcctcagtgtctgtttctggagaacccaacctaacacagtcaacaacaggcatattgttaaatgtaatggacacgttagttctcttatttgaataagagaaatgtccacaatttatttgatactgctgaatatctgtcattattgaattactgcctttctttgtttctgtgattacacaacctcctgatcttcttcctctgtctttgtggtttccttctgagtcttttaaatatacttctcttcctttgcttatttcctaaatgctatggctcttcaaagatatgttctgggttgtccttttatcctgaatttccttattgtatgacttacccagtttcatggttttatgactattattcacatattcatgacttccaaatttacatctcatgcctaaatatctctccagaactttggactcaaatatcttattgccttctgagcatttgctgtgatctacatgttgtgcttctccaaaattcatatgttgaagtcctcaccttcaaggtgatagtattaggacgtggggcctttagggggtggttacacaagggtagccagagacctcatgaatgggatcagtgcccttataagagaagctcaagggagactccttgccccttctaccatgtgaagatacagcgagaaggtaccatctatgagtcagaaagtgggctcttaccggacactgaatctgcccagcagaaaataaatttctcttgtttataagccactcagcttgtggtaattttttatagcagcttgaatggaataagagcatttgttaggtgttcctcaatcacctgaaacttaatgtacccaaattgtgcccttttttttttttttttttttgagacggagtcttgctgtcacctaccctggagtgcaatggtgcaatctcagctcactacaacctctgcctcccaggttcaagtgattctcttgcctcagcctcccgagtagctgagaatataggcacccaccaccacacccgactaatttttgtatttttagtagagatgggattttctccatgttggccaggctggtctcaaactcctgacctcaggtgatccaccagcctcggcctcccaatgtgctgggattacaggcgtgaaccactgtgcccggccgccatcttcttttctaaatcagttcttcctggtttcagtgaatagctccacatccaccctctttatgcaagctagatacatgaaagtcattcttaactcttaccttccttccaatcagtcatcaaatctgccatgtctccttgctatatacctcttggatgtatctgcttcttctatccccatggctgccactccagcccaggataccttaattctctcatctcatttcttataagagcctcctatttggtcacccttctccaaccttgctgtttctagccttttctctacattgttgcctgagtgatcttttgaaaacataaatctgagactatcactctgtattcatttcttaatgttgatataaaacatcaccacaaatttaggggcttaaaacaacacgaatgtattatctcacagttctggaggtctgaaatcagtttcactgggctaaaatcagtatgtcagcaggtctacatttttccaaaggctctggagggggagtccatttccttgctctttctactttctagaggccgcctacatttcttggctcttagcccttcctctatctttaaagccagaagtagatcattttcccttcctctgacttctgcttttgtacttatatcttctctctctgacactgatcctcctgccaccctcttgtaaggactcttaagattacactggggccaagagacaatccaggataatctctccatctcaagacccttaatttaatcccaactagaaacttccttttatcagttaacatattcacaaattccagaaattaggaagcagatctctttgggggtctgggggagggtggtggttaccatactcatctgcataaaatccttcaatcttttctctttagattctcttctcacaacttttagattaaaatgcaaacttttctatatagctgttttcctgtaatctcccacagcatctcttgatactcttcactctccattttctcttctagtctaaatgaacttctttaagttacttaaacatatctgctgtcattttctggctttggaacgctgtaatttttgcctagaatacctcttcctccttccctgcaaccccttctcccaggcttctctagctaactgcagttcatcttttatcattccagtttagatgtgacttttgctacaggcctttctaattccgcaagtcagtgttaggcatctttaatacatgtttcctgtagtatcttgttatgatgacacttatttttctttttgtaaatgcatgttttgtttgataattcttatataaggctaggacataacagtttaacatatttgttaaactattgatttgttgttgaatctgttgaaattgtattctgttattcccaagacaatactgtttgtatgataaaattttgatgataaacttggatttttttaaactttaattttgatatattttaagtttttaaattccttatgactgaaaatttcaaagtgatatctataaataaacatttctctgttttctatatctttttcttttcttttttttgagacagagtttcactctgtcacccaggctggagtgcagtggcacaatcttggctcactgcaacctctgcctcctgggttcaagcaattctccagcctcagcctcccaagtagctgggattacaggcgcccaccaccatgcctggctaatttttgtatttttaatagagatggcgtttcaccatgttggccaggctggtctcaaactcctgacctcaagtgatccacctgccttgacctcccaaagtgttgggattacaggtatatgccatgttttctatgtcttaatggtttgtaatttatcttaacacacaataaagtagagcagcagggcatagggcagagtgggagggtaatttttacagtttattaaaatataagaatctcatgtctaaaacaccaaaagcaatggcaacaaaagccaaaattgacaaatgggatctaattaaactaaagagcttctgcacagcaaaagaaactaccatcagagtgaacaggcaacctacaaaatgggagaaaatttttgcaacctactcatctgacaaagggctaatatccagaatctacaatgaactccaacaaatttacaagaaaaaaacaaacaaccccatcaaaaagtgggtgaaggacatgaacagacacttctcaaaagaagacatttatgcagccaaaaaacacatgaaaaaatgctcaccatcactggccatcagagaaatgcaaatcaaaaccacaatgagataccatctcacaccagttagaatggcaatcattaaaaagtcaggaaacaacaggtgctggagaggatgtggagaaacaggaacacttttacactgttggtgggactgtaaactagttcaacccttgcagaagtcaatgtggcgattcctcagggatctagaactagaaataccatttgacccagccatcccattactgggtatatacccaaaggactataaatcatgctgctataaagacacatgcacacgtatgtttattgcggcactattcacaatagcaaagacttggaaccaacccaaatgtccaacaatgatagactggattaagaaaatgtggcacatatacaccacggaatactgtgcagccataaaaaatgatgagttcatgtcctttgtagggacatggatgaaattggaaatcatcattctcagtaaactatcacaagaacaaaaaaccaaacactgcatattctcactcataggtgggaattgaacaatgagaacacatggacacaggaaggggaacatcacactctggggattgttgtggggtgggggaggggggagggatagctttaggagatatacctaatgctaaatgatgagttaatgggtgcagcacaccagcatggtacatgtatacatatgtaactaacctgcacattgtgcacatgtaccctaaaacttaaagtataataataataaaataaaaaataaaataaaataaaatataagaatctaaaccttttaaaaaaaacccattacctcctttattataggcattctataagtgttagggataaaaagatgaggaacattaagctatatctgtcctcaaggacctcacatccatgttcgggcaacagaactctaattaaataattttgatgcaatgtgatacatgcaataacaattgagtagttcatgggaacacagagaagggagttgggataaagacagaatccagatgggatttgcaggaataatatttcagctttgtcttaaaagaaggagtaggattttagcaacaggagaatcctagcagtgatattcgagatgaagggaacatgcctgtgcaaggtatgttgatgtccatagcagtaatgcagatgttttttggatatagtggttaggataaggatctggtatgcacgccattggctatgatcttgaccagtcatttccttccctccctccctccctccctcccgctttctcttctttttttttgttctctctctctttctttcacagggtctcactctgtcacccagactatagtgcagtggcactatcatatcttactataacaaacctctgggttcaagtgatccttttgctgcagcctcttgagaagctatgtctacaggcctgcaccaccatgcctggctaatttttacattttttgtagagccagggtcttgctctgttgcccaggctgaacttgaactcctgacttcaagcaatcctctcatctcaacctcccaaagtgctgggattgcaggcacaagtcactgtgcctggctgtacttaggttgatataaaagagcttgctgtatttaaggattggccagtagttatttatgacttaaagccttggggaatggcaggaaatgaggattgagactagactatgaagggcctttttataatgctaaggagtttaatttttttccttcaggcaatatggagctgacattctgaacctagagagtactgatcaaatcctattttagaaacattctggttgtagtgatagatttggggaaaggaagaaggaggagtctggaaagagaaagagcaatataaatgagggctaaagggagtctgactaatagaatcacatgtaaaatgtcataatagtattgtgccatattgcacataatgaagaatataaccgcaatatattcagcctattctaattttttaaactattggcgaaaagagccaaactctgtaaaatatttgaagagatttattttgagccaaatatgagtgaccatggcccatgaacacagccctcaggaggtcctgagaacatgtgcccaagatagtcggagtacagcttggttttgtatattttagggaggcatgagacatcaatcaaatacatttaagaagtacaatggtttggttcagaaaggcaggacaactcaaagcaggcggtgggacttccagactgtaggtaaatttaaacattttctagttgacaattggttgagtttatctgaagacctgggaatgttcaggttaagataaaggattatggggaccaagttttattgtgtagaggaatctctcagatagcagacttcagagagatagcaggttgtaaaatgtttctcactggacctgaaaggatgcctggctcttagttgattatcttctggatctggaaagaaaggaaggaaaactgtgggcagcaagccacccaggccccaaggaaagagaccgaggacaggagctgttccagtatagtaaaatataaaacaagaatagttataccagatatagatcttagatatgattatatatgaatatcattaatcattagtttgtagcaattactctttattccaatattataataatcctcactccataatcataccctaggaaaaaccaggccatacagagataggagctgaggagacacagtgagaagtgaccagaagacaagagtgcgagccttctgttatgcccggacagggccaccagagggctccttggtctagtggtaatgccagcgtctgggaggacgcccgttgccaggcggaccttggtctagcggtagcataagtgtcaagggaaaacacccgctacttagcagaccgggaaagggagtctccctttccccaggggagtttagagaagactctactcctccacctcttgtggagggcctgacattagtcaggctcgtccacagttatccggaggcctaacagtctcactgtgatgctgtgcttcagtggtcacactcctagtctgccttcgtgttccatcctgtacacctggctctgccttctagatagcagtaataaattagtgaaagtactaaaagtctctgatatgcagaaataatggcataagctgtccttctctttgtctcctctctctctctgcctcggctgccaggcagggaagggccacctgtccagtggacacgtgacccacgtgaccttacctatcattggagatgactcacactctttaccctgccccttttgctttgtatccaataaataacagcgcagccagacattcggggccactaccggtctccgtgcattggtcatagtggtcccctggcccagctgccttttcttttatctctttgtcttgtgtctttatttctacactctctcgttgctgcacacggggagaaactcacccaccctgtggggctggaccctacagaaaacgaaggggtaaggggattctctatagaatgtgaattattcccacaagagactttgcagggcaatttcaaggcatggcaaggacatatattttggggttaaatattgtattccttgtttcataatgttatgccagagtcagattgaaaagcaaatcacaatatgcagggtcaaataaaacccatctcatgagaatctatggtttgtagggcataactccctagaccccttaggtaggaatttgggccagatacaaaatcagagcttaggcctcaaaacagttttaacataatgaattaccatagaaacagaaaattagaaaggggacagttctagaggtaggcaaactgaaaactatcaaaagacacctgacagtttgaacaggtagcaggtaaaataaacattttcttattttgtgggtttctttttttttttgagatggagtttcacccttgctgcccaggctggaatgcaatggagtgatctcggctcactgtaacctccgcctcccgggttcaagcgattctcctgcctcagcctcccgagtagcggggattacaggcatgcaccaccatgcctggctaattttgtagttttagtagagatggggtttctccatgttggtctggctggtctcgaactcctgacctcaggtgatccacctgcctcggcctcccaaagtgctgggattacaggcgtaagccaccacgcccggctcttattttgtgttttaagggataacagcatgacaccactttgagagtgttaataagtctacacaaaaacttttaatgttatatattactatgataataaccatgagtcattaagaaatagttatcattgttcactgtatttcaagtatggggaaataagtacattttaaaacaatctctatgttaaatggttaaagtttattacttatttatatttatttttattaatttttttgagacagagtctgactctgttgcccaggctggagtgcagtggcacaatcttggctcactgcaacttctatctccctggctcaagccatcctcccacctcagcctcctgagtagctgggactacaggtgggcaccatcccacatggctgattgttgtattttttgtagagacagggtctcactgtgttgccaaggctggtctcaaactcctaagctcaagtgatctcctgccttggcctcccaaagtgctgggattataggtgtaagccaccacacctgggctgaaatggttaaaagttttttaaaaaaatacctggggatatttaaaagggatagtttacaattttctataaatttatttttgtagaacactgtaagctggaaaataaattgagaagaataaaataagtttttgagtggtggtacatgcaagacactttacacattgccatagtctatttgtgttgcagtaataaaatacctgagactaggtaatttataaagaacagtgatttatttcttacagttctgaaggctgggatctgcaaggttaagggacctgtatctggtgagggccttcttgatgcatcatcccacgccaaaaggcagaaggacaagagagcacacatacaagagagagaggaaggggagcaaactcatccttttatccagaatttacttccagaacaagtaacccacttctgtgataatggcattaatccattcatgagggcagagccctcttcacctaatcaccctttaaaggtcccacctctcaacaaggttgcactgagattaagtttctaatgcatgaactttggggacacattcaaaccatagcactctgctcctggctccctcaaattcatgtccttctcacatgcaaaatacattcatttcatcccaataggcctaaagtcttaacttgtttcaacacttactcaaaagtccagaatctcatctgaatcagatatgtgagactcaaggcatgattcctcctgaggcaaattccccaccagctatgagcctatgaaattaaaaaagttatctacatccaaaatgttgggacaggcataggataaacattcccattacaaaagggagaaataggcaataagaaaggagtaacaggcccaaggaaatcagttcaaacctcacaaggaaaacaacagtaagtcttaagaagaagaatcttctttgactccatatcccacatcaggggcacagtggggaagaagtagggctctcaaggcctcaggcagcgtcagggcttagtccactcagcagctctcatggtttgcagtctcatgcccatggctttctcagattggagttacatgcttgtgccccctatagttctgtggtctcagggtggggaggtagggggtgattacccactcccatggctttactaggcattgccctagtggggactctgtgaatgatggcctctatcctatggctccaccaggcatagtgggggctttctgtggtaggttctctgtggtggctctgccccatgataagtctctgcctgggccccaggctgtcctcaacatcctttgaaatttaggcagaagccaccatggcttcatacctattgtattctgtgtgcctgcagaattagcaccatgtggacactgccaagatacacagcttataccttctggagcagtgggttgagctgcagctgggctcacctgagctacagttgtggtggctgagaggtgctatgccagaattaaggaagcagagttccaaggtgctgcagggcagcaaatgctgaggtctcacaagcaccttgctggaaaccttgccctcaaggtcctagcttccctagatctctgaaatgtttttggggtcattctcattgttttcatgaatagaacctggcttctttctatactaatatttttagcaatcacttgaccacacccttagtattctcccccaaacatacattttatgtggccaggctaagagttttcataatttgtttattctgcttctttttaaattataaatgtcatctttaaagtatttctcccttctctcattttactgtaagtgactgaaagaagctatgcaacatcttgaatgctttactgcctaggtagctcttctgccagatatcctagttcattcctcttaagttctgccttccacaatatcctaggacatggatacagttctgccaagttcttttcaactgtaacaaggatggcctttactccagtttccaagattttgtttttcagttccacctgagtcctcatcagaatggcctttactttccatatttctaccaatgttctgatcatgaccacttaagtagtctttacaacattccagactttccttacatttctttcctttttctgagccttcactagaattgcccttaatgttcttctgttcatggcaatctgggctttttctaacctgctcctccaaattcttccaacctctacccattcctattacccaattcctaacctgcttccacattttcaggtatttgttatagcaacaaccccagtcttggtaccaattttctatcttagtttgttttgtgctgctataacagaatatctgagactgagtaatttataaaggacagagatttatttcttacagttctggaggtggggaagatcaaagtcaagtggctcacatctggtgagggccttcctgctgcatcataacatggtggaagggcaagagagcatgcatgcatatgagaggaagggagctgaactcatccttttatcaagaacccactctcatgataatagcactaattcactcacagaggcagagccctcatgacctaaccatctcttaaagatcctacctctcaagacagttgcattggggatcaagtttccaacacatgaacgttggggatcatattcaaaccgtagcacaagtattacctcacttaattctcacaacacacctgggaggtagatgttatcagcatttaaaagatgagaacagctattgtttagagaagttaggtaactcttgggaagttatgtggttagtggttgaactatacttttaaactaaggatcttttaaatatcatgaagaaaagtagagatcaaaaagatgagaagaaaattatgatagacaatatcaaaaccagagaagtagagtttcaagaatgagggtaagtcgtgttgctataatagaatacctgaggctgggtaatttacgaagaaacgagtttatttgggtcacaattccagtgactggaaagtccaagagtatggcattggcatctactcagcctctggtcagggctttcatgatgcatcataacatggaggatggtcaaggaggaaatagacatatgctaagagcaaaatgaggggcatcctcactttctaacaacctgttcttgtgtgggaactagtccctttctgtgtaaactaatccagttttattaaggggttaactcactcatcacggtaggaatggcactaagctgcccatgagagtggagcctctgtgacccaaatgttttccactagactccacctattaaatgttttatctcccaacatcgccacactaggaattaaggtttcaacatgagttttggtggggacaggcaaatcatagcagaagggatggttagcagcattaaattttgaggtgagattgagtaatcaaaattaacaaaagagcattagaatttagttatattcattttacatgtaagatagttaaagaagacaaaaagtaatatttgtaggtagaactgttctattttattctttgaggataatattttacatagtcaatattttgaactgtaccataaagtttaaatactcacatttgtttgtttgtttcagttatatcaagatttcttgatacagagcagcttctttctgttttagtccaaattccaaagcaagacacggtatgtttttgtatacattttgtattatattattatacattatttgatggaacttgtcttaatgtaatgtaacaattggaaaatatcaaaatgttttgggaaagtccttcattattgatatctggagtattttatgccactgtagaggaaacttttttcctaatgtattatcctgtatgttatagtgaaatttaaaatttcagcccggcatggtggctcatgcctataatcccaacactttgggaggtcaaggcagttcaagacaagcctgggcaagaaagtgagaccccatctctacaaaggatcaaaaaattagctgggcatgctgttgcatgcttgtagtcccagctcctggggaggctgaggtgggaggataacttaagccttgggaggtcaaggctgcagtgagctgtgttcgcatcactgcactccagcctgggtaacatagtgaggccttgtcacaaaaaaaaattgctttttagatagttgaggaattggcctattttcactgatcaaatattaaggagttatatataattttcaaaagacttagactataataatatttgcctaataactaactaactaaaatatattagagctaaagattcttcttaaaagtgatcattatgtgaagtttgattagtcttcaaatattattattattatttttgagatggagtctcactctgtcaccaaggctggagtgcagtggtgcgattttggctcactgcaacctctgtctctcaggttcaagtgattctcttgcctcagcctcccaagtagctgggattacaggcatgcactaccatgcctggctaatttttgtatttttagtagagatggggtttcaccatgttggccaggctgatctcgaactcctgacctcaagtgatctgcccacctcggcctcccaaagtactgggattgcaggtgtgagccaccatgcttggccaagtctttaaatattcttaacctttaagaatgaaacaacacattttctggatatttttccaatttaaatagtgcttatgggtatattctgcaaagaaagtaataatagctttcattcttccatttaagatgaactgaagaatatttactataatgaaatacaggtatatttttgcccatatgcataaaaagaaaagtcttgcacatcaataaaatttaatttacaatttgatgacatttgtaaatccattgaaagctaatctatatttgggaagcctttttgtattataaagaaaatactcttaaggttcatttataataaaatcatcactagattgaaaagctttagctgttgggcaggcacagaactgagtttccttaaataattgaagctgcttatacttcaatgtatacaaatgggaagtaacctaaaacaactgatgtttggaattaaattagcagccctcataaaataagtttggaagtagcccttcctctttaattttctggtagagtttacatagaactggtattatttcttccttacatatttggtagaatttacaaatgaagccattaaagcctggaatttttttggtaggaaggtttttaactataaattccacttattaaataggcatagtgctcttcaggttatctgtttcttcttgaacaagctttggtaccttgtgtcttttaaagaatttttcatttcacccaacttttcaatgtatcagcataaactatctcataatatcctccttatatctgtaaaattggcagtgatacactctctcattcctgatactgataattttaatatgttctctgtttttcttaatcagcctggctagatattatcaattttattggtattctcaaggagccaactttctatttcattggtttctcttttttgctcctgttctttatttcactgatttctggttttatcactcttctgcttactctgtgcctactgttcttttttgaggttgtaaaggaggaagctgaggtcattgatttgagaacttttttccttctaatataagcattttagtactataaatttctctctgagtaatgctttagctgtattccacaattttagatatgttgtgatttctttttctttcaaaaaggtcaaaacactttctaatttctttttaaacattctttgatgtatgggtttttagaggtatgttattttatttccagtatttggggactttccaaatatctttttgttattggtttctaatttaattcccaatgatcagagaccatgtattatataatatagatccttttagctttattgactttttttatggcccaaaatagagttaatcttggtaaatgttccatgtgaacttgaaaacaatgtgtattttgctgttgttggttggagcgttccataaatgtcactttgttcaagttgtgtggtagtgttcttcaaatctcctatatccttatggtgttttacgtttttttgttttgttttgttttgtttttctatttgttctatcagttattaagaaaggagtgtcaaaatctccaaatgtaattgtggatttgtctatttttcctttcagttttatcagtttttatctaatgtatttggaatctttgttattagattcataaacatttaagattgctatatcctctataaattgagcctgttgtcattatgaaatgatgcttttttatccctagtagtattttttgctatgaaatctactgcatctaatattaatatagccactccagctttcttttggttagtgttgccatggcatatctttaccatccttttgcttttaacttatttttgtctttatatttaaagaaggttttttgtaggtgacatatagttaagtcttaactttttgcatacaatcagagaataccttacttttaattgaggtatttattacatttacacttaataagattattgatatgtttttatttaaatctgccatcgttttttttttcatttttctcatctgtttgctcccttgtttctttttttctgccttcttttgtatttttttatgattccatctcatttcctttgttggcttattagatataactcattgccttcattagcttaattattgacttagggtttatagactacatctttagctgaattcagtccatttttgtttattttttattttattttttgggacagagtcttgctctgtcacccaggctggagtgcagtggcgccatctcggctcactgccacctctgtctcccggcttcaagtgattcttgtgcctcagcctccctagtagctgggactacaggcatgccaccatgccatgctaactttggtatttttagtacagatggggttttgccatgttggccaggctggtctcaaactcctaacctcaagcgatccacctgcctaggccttccaaaatgttgggattataggtgtgaaccatcggacacagcctcagaccactttaaataatattataatactttacatatgatataagagccttgcactagtataccatcatttccctcttccctaccattatgctattattgtaacatgtttaacttctacatatatttcacaattcatttttaaaaataagacagctttattgagatgtaattacatagattacaattcacacattcaaagcctacaatttaattgtctttaatgcattcacagagttgtacaaccatcaccacagtcaattttagaacattttaatcattcccagaagcaatcctgcaaccactagcaataacttcccattccttctaacccccgtttccccagccttagacaaccagtaatctattgtctgtctctacagatttgcctatcctggacattttatataaatggaacattttagtatgtacaggtagtcttttgtgactggatttttaacttagcataacgttttcaagtttcatgttgtagcatttatcaatactttattctttgtattgacaaataatattccattgtatggatataacacatttggtttatcagtttatcagttgatggctatttaggttgttttcacttttgactattatgaataatgctatgaatatttgtgtgcaggtttttctagggacatacatttttcatttgtcttgatatatacctaggaatggaattgctgggtcatgtgataactctatgtttaataatttgaggaactgctggattgttttgcaaagtgactttatcattttaggtatccaccagcagtgtttgagggttctgatttctccacatccttgtcaagacttgttattatcttaatttttgattctggtgagcctgtcgggtgtctcatggttttggtatacatttccatgatgactgacaatgtcgagcatctttttacatgcttattggccatttgtatcttccttggagaaatatttattaatattatttgcccattttaaattgggttgtttgtatttttattactgagttgtgagagttctttatatattttggataccaatcccttattggatatatgatttgcagatattttctcccattctgtgggttgtcttttcactttcttgattatatgcatgttaatccccgatcaaaaaaatgaatacttaactctcttttcttccttatctcccataaacatggatacttacatccttgcttttcatcacccagtatgattataacagttttagttagatcaaaattattatgaaaattattacgttatacagagctgagcctgcgtgactttttgtgggcttttccccagaaattagtaactatttttctttgtttgtttgtttgtttgtttgtttgagacagagtttcactctgtcacccaggctggaatgcagtggtgtaatctcggctcactgcaacctccacctcccaggttcaagtgattctcctacttcagcctcccaagtagctgggattacaggcacccgccaccatgcccagctaatttttgtatttttagtagaaacggggtttcaccatgttggtcaggatggcctcaaactcctgacctcaagtgatctgcctgcctcagcctcccaaagtactggggttacaggcgtgaaccaccacacctggcctgattttttttattgttagattcaggttacataacattggcagaaataccacagaagtgatgatgcgttcttctcattgcatcttcttatatggcacacaattttgatttgtctcattatgatgataagtttgtatacttggttgagatggtgtaaaattgctgcacaattatgattcccccatttaattaataagtattttgtggggaggtagcttgaaaccatgtaaatattttgctcttctttcaatttatccaactttcaatttatgtatgtatgtatttaatccatatggactgatgattttatattcaattggttatagtctattactgtcaatatttattttgattctcacattgtctcagatttgacatgtgcaagcctcttctaatttgcttctatgctctttggaaatgcatccacaattctttgagaactttatcattttctgcctcaagaaaatgagccaggcttatcttgtactttccttggtagcctttgaatcaactatttctcccaggagtcctggttcattttagtaaggaatggtattagaaatcaagatttgagcaccaggtgtacttattgctattggggtatcaccattctaaaaccctctcatggctagggcataagtgtgtgtgtgtatatatatatatatgcataaatatatagatattgacctctatatttatttctgtatttatctatacaatagaaaatcatacgttcataccaatacttccaatttcaatttacagtcacagggttcatactagttttctctctttccatattagtaactctcttctctgtcaatgaaaaacctgatgagaaatcctattatccaatgagaagtcttcattattcttaatatattaatatatttgatatattcaggaggaataccaatctcctactactgctgctccctcccccatgcagataccatcttcactctgcctatgctgtagtactccctgctgaactgtcttcctatgctgaaatccttctcacctctctcaggctcaagctgcccttctacgcagaggaggctttcttcagcctacttgggatccaaaacctgtgtcagggtttccctcttctcttgcatgaataacctcctgttgttcatattcaggctcatatacccttgctaggtagaccttcagtttaaatggcttccttgtcctcctgtgctataccacccgtccgtcctctccctgctctggctttgccacccccacaccaacgatgctctcttcttcctatttgggccctaacaactgatactacatcacattgttcatattaaaatgatttttcagtatatatggagggttcttcactttatttttgaatatgttgctagcctaacctttttttctttgcatttgtttaacagtgttgttggaatcagtaaatgttttaggattttcagagacttaaacatgaataatcaatataaataaaaacaaagtaccacagttaatgtttatgatattttgccagatgtcactgctttggatgatatttttgaatgaaaaatatcttaaatacttaacagtttttacttatgaatagcatattttacatagaaaaatgcaatgcagtttaatagaacaggaaatggccactttatatagataattagtatttgtattagtttttttttttctttcttttttgagacagagtctcactctgttatctaagctggagtgcagtggtgtgatcatagtttactttagccttgacctccctggcttgtgcaatcttcctacctcagccgcctgagtagccaagaccacaggcatgcgctaccacacccaactaatttttaagttttttgtagagatggggaattgtctttttgcccaggcttgtcttgaactcctgggctcaagcaatcctcctatcttggcctcctgaagtgctgagtttatgggtgtgagtcactgtgcctggcctgtattagttttctaaggctgtgtaacaaaacactatgaattgcacatcctaaaataatagaaatttattgtcttacagatttagaggctaataatctgaaatcaaggtgttttagggccatgctctctctgcgaaacctgtaggggaatcctttcttgcctcttcctagcttttggtgatttgtttacaattattgccatttcttggcttgaatcttcataacgccaatctgtgtttcctcgtcaaatggtggtgtccctgtgtttccacgtgttcacaacgccaatctgtgtttcctcttcaaatggtggtgtccctgtgtttccatgtgttcacatggctgtctttgtatgacatcaatattattggactaggggcctaccccactccagtattacatcattgtaacaattactaacctctggaatgaccctatttccaaataagatcacattttgaggtactgagggttagaacttcaacagaatttttttggagggaacacaattcaacctttaacagtgtataagtgaaggctatgtttctattttactataggaaagaattaatcatcagattatacctgacagcaatctctttattgtcaatttatgtaacatatagtattatgcaatcacacagtttcatacagtgtcactagttataggaattagtaatatacatctttttgcactagacaatttctggttaaattaggaaaaaaatatcactttgaccaactagttttctgagaaatatctgtgaatagcttgcctgcttctatactcagtttgactatcagattttagaaaagtcttctggtctaggtttaaggtaattcagtaagctaagaatctggaacctttttttctgttcagaaaaaaaaattataattagcgccataaggttttaaagggtcaatgttacttcccatccttttttctttctttctttctttttttatgtatattttaggttctgggttacatgtgcagaacgtgcagttttgttacataggtatacacgtgccatggtggtttgctgcacctatcaacccatcacctacattaggtatttttcctaatgttatcgctcccctagccctccacccccgacaggccccggtgtgtggtgttcccctccctgtgtccgtgtgttctcgttgttcaactcccacttatgagtgagaacatgcggtgtttggttttctaatcttgtgatagtttgctgagaataatggtttccagcttcatccatgtccctgcaaagcacatgaactcatccttttttatggctgcacagtattccatggtgtatatgtgccacaatttcttaatccagtctatcactgatggacatgtgagttggttccaagtctttgctattgtgaatagtgctgcaataaacatacatgtacatgtgtctttatcgtagaatgatttataatcttttgggtatatgcccagtaatgggattgctgggtcaaatggtatttccagttctagatccttgaggaatcatcacactgtcttccacaatggttgaactaatttacactcccaccaacagtgtaaaagggatcctatttctccacatcctctccagcatctgttgtttcctgactttttaatgatcgccattctaactggcatgtgatggtatctagttgtggttttgatttgcatttctctaatgaccagggatgataagcattttttcatatgtctgttggctgcataaatgtcttcttttgagaattgtctgttcatatcctttgcccattttttgatggggttgtttgcttttttcttgtaaatttctttaagttatttctagattctggatgttagccttttgtcggatggatagattgcaaaaattttctcccattctgtaagttgcctattcactctgatgatagtttctttcactgtgcagaagctctttagtttaattaggtcccacttgtcaattttggcttttgttgccattgcttttggtgttttagacatgaagtctttgcccatgcctatgtcctgatggtattgcccaggttttcttctagggtttttatggttttaggtctaacatttaagtatttgatccatcttgagtttatttttgtataaggtgtaacgaaggggtctagtttcagttttctgcatatggctaaccagttttcccagcaccatttattaaatagggaatcttttccccattgcttgtatgtctcaggtttgtcaaagatcagatggtcgtacatgtgtggtgttatttctgaggcctccgttctgttccgttggtctatatatctgttttggtaccagtaccatgctgttttggttactgtagccttgtagtacagcttgaagtcaggtaccgtgatgctttgtttaatcttggctatgcgggcccttttttggttccatatgaactttaaaataatttttccaattctgtgaagaaagtcagtggtagcttgatggggatggccttgaatctataaattactttgggcagtatggcttttttcacgatattgattcttcttatccatgagcatggaatatttttccatttgtttgtgtcctgtcttatttctttgagcagtggtttgtagctctccttgaagaggtccttcacatcccttgtaagttggattcctaggtattttattctcttagtagcaatagtgaatgggagttcactcatgatttggctctctgtttatctgttattggtgtataggcatgcttgtgattttgcacattgattttgtgtccagagaatttgctgaagttgcttatcagcttaagaagattttgagctgagacaatggggttttctaaatatacaatcatgtcatctgcaaacagagacaatttgacttcctctcttcctattcaaataccctttatttctttctcttgcctgattgccctggccagaacttccaatactatgttgaataggagtggtgagaaagggcatccttgtcttgtgccagttttcaaagggaatgcttccagtttttgcccattcagtatgatattggctgtagatttgtcattaatagctcttattatgttgagatacattccattgatacccactttattgagagtttttagcatgaaatgctgttgaattttctgaaggccttttctgcatctattcagataatcatgtggtttttgtcgttggttctgtttttgtgatggattatgtttattgattttgtgtatgttgaaccagactcgcatcccagggatgaagccgacttgattgtggtggataagctttttgatgtgctgctggattcggtttgccagtattttattgcggattctcacattgatgttcatcagggatgttagcctaaaattctctttttttcttgtgtctctgccaggatttggtatcaggatgatgctggcctcataaaatgagttaaagagaattccctctttttctattgatcggaatatttcagaaggaatggtcccagctcctctttgtacctctggtagaatttggctatgaatccatctggtcctggacttttttggttgctaggctattaattattgcctcaatttcagaacctgttattggtctattcagagatttaccttcttcctggtttagtcttagaaaggtgtatgtgtccaggaatttatccatttcttctagattttctagtttatttgcatagaggtgtttatagtattctctatggtagtttgaatttctgtgggatcgatggtgatatccactttatcattttttattgcgtctatttgattcttctctcttttattctttattagtcttgctattgggctatctcttttgttgatcttttaaaaaaccagctcctggattcattcattttttgaagggttttttgtgtctctatttcctttagttctgctctgattttagttatttcttatcttctgctacttttgaatttgtttgctcttgactgtctagttcttttaattgtgatgttagggtttcaattttagatcttccctgctttctcctgtgggcatttagtggtataaatttccctctacacactgctttaaatgtgtcccagagattctggtacgttgtgtctttgttctcactggtttcgaagaacatctttatttctcccttcattttgttatttactgagtagtcattcaggagcaggttgttcagtttccatgtagttgtgtggttttgagtgagtctcttaatcctgacttctaatttattgcactgtggtctgagaggcagtttgttgtgatttctattcttatacatttgctgaggagtgttttacttccaattatgtggttgattttagaattagtgtgatatggtgctgagaagaatgtatattctgtttatttggggtggagagttctgtagatttctattaggtccacttggttcagagttgagttgaagtcctggatatccttgttaattttctgtctcattgatctgtctaatattgacagtggtgtgttaacgtctcccattattactgtgcaggagtctaagtctctttgtagatctctaagaacttgctttatgaatctgggtgctcctgtattgggtgtgtatatatttaggacagttagctcttcttgttgaattgatccctttaccaatatgtaatggccttctttgtccttttttatctttgttggtttcaagtctgctttatcagagactaggattgcaacccctgcttttttttttgctttccatttgcttagtagatcttcctccatccctttattttgagccttgtgtgtctttgcatgtgtgatgggtctcctgaatacagcatgctgatgggtcttcactgtttatccaacttgccagtatgtgtcttttaattggagcatttatcccatttacatttaaggttaatattgttatatctgaatttgatcctgtcatcatgatgctagctggtcatttctcccattaatttatgcagtttttccatagcattgatggtctttacaatttggcatgtgtttgcagtggttggtactggttattcctatccatgtttagtgcttcctgcaggagctcttgtaaggcaggcctggtggtgacaaaaatctctcagcatttgcttctcgctaaaggattttatttctccttcacttatgaatcttagtttggctggatatgaaattatgggttgaaaattcttttctttaagaatgttgaatattggcccccactgtcttctggcttgtagggtttctgccgagagatccgctgttagtctgatgggcttccctttgtgggtaacctgacctttctctggctgcccttaacattttttccttcatttcaaccttggtgaatctgccaattatgtgtcttggggttgctcttcttgaggagtatctttgtgatgttctctgtatttcttgaatttgaatgttggcctgtcttgctaggttggggaagttctcctggataatatcctgaagagtgttttctaacttggggccattctcccagtcactttcaggtacaccaatcaaatgtagatttggtcttttcacctagtcccatatttcttggaggctttgtttgtttcttttcactcttttttctctaatcttgtcttctctctttatttcattaatctgatcttcagtcactgatatcctttcttcacttgatcgaatcagctattgaaacttgtgtatgcttcaggaagttctcatattgtgcttttcaactccatcaggacatttaagctcttctctacatggttattctagttagccattcatctaacctttttttcaaggtttttagcttccttttgatgggttagaacctgctcctttagcttggagaagtttgttattaccgaccttctgaagcctacttctgtcaagtcgtcaaactcattctgcatccagttttgttcccttgctggtgaggagttgtgttcctttggaggagaaaaggtgttctggtttttggtattttcagcctttctgctctggcttctccccatcttcatggttttatctacctttgtcctttgatgttggtaacctacggatggggttttgtgtggatgtcctttttgttgattttgatgccactcctttctgtttgttagttttctttctaacagacaggccactcagctgcaggtctgttggagtttgctggaagtccactccagaccctgtttgcctggatatcaccagcagaggctgcagaacagcaaatattgctgcctgatccttcctctggaagcttcgtcccagaggggcaaccgcctgtatgcggtgtctgttggcccctactgggaggtgtctccaagtcaggctacacagggatcagggacccacttgaggaggcagtctctctgttattggggctcaaacaccatgctgggagaaccactgctctcttcagagctgttatgcagggacgtttaagtctggagaagctgcctgctgcctttttttcagatatgccctgcccccagaggtggaatctagagaggcagtaggccttgctgagctgcagtgggctccacctagctcgagcttccctgccactttgtttacactgtgtgtatagaaccacctactcaagcctcagcaatggcggacgcccctccccctgccaagctcccacatcccaggttgatctcagactgctgagctaccagggaggaggtctctgtgggcgtggaacctgctgagccaggcacggaaggggatctcctggtctgccagttgtgaagaccgtgggaaaagtgcagtatttgggcaagagtgctcctccaggtacagtcactcacaacttcccttggctaggaaagagaaatccccccaccccttgtgctttccgggtgaggtgatgccctgccctgtttcggctcaccctccgtgggctgtacccactgtccaagcagtcccagtgagatgaatcaggtacctcagttggaaatgcagtaatcacccatcttctgcgtcaatctcgctggaagctgtagactggagctcttcctatttggccatcttggaagcgtggtccacttcccatcctttaaactaaggaaaactttagttttgggagaatcagtcagaattgtaaatctttttctcaccattgtgtttctgtcctttgtggaggctttttgttaagactgtacagatcagatttagtaacctttagggaaacttaagcaatatatttaactttatgcatgattcatggccttcattatttcttataatgtttctcagttatcatttttttaaccatctgaaaatttgttttgaagggctcttttctcatttaatataagcacaaatctcttaattgaatacagtatttactaagttcagacttgtgctggttaaactgaatgatttgctaaaacttgtgaatgaactaaatgctttcagaaaattttcagtaagaaattgtttgcctaagatgagttcttattctttctttttaagaatattgattcctagaaaatgcatgtttctgaccataagtgttcactaaaaataaagcttaaatttcttatcttaacacaattttctttctgtacagtatctataaccatagcacttaatgtattgcactaagaatatttgtgttttccactacaaatgcttaaaatactttccccaacatttgaaaaatttatattaaagatatttttctaatttttatcatgagttttttgcatcattttgaataactttttttcaaatgatttcagactgccatatagagtatctgaagtatatgattccttctttgatttattctatgattcattttagtaagtattatgataagtgctaaaatataataagaattacagctctgatccaaaagaatttatactccaatgttatatttgggtaaaaataaaataagcaattacagcatagtattatctagaactgcaagggatctgagattctaccctagttgcaaactaactagttagcctgccatagtttcatagatgctgacagaaggcacaagacgcttgggtcaaagagaaatataaacatgctattatcgcttcattaaaaaaatataaaatggctttttttgcttgtttttacttccccctctacttttcttctgtttctctgtaaagcaatattttttggaaggattatctgtaactgatgtatctaattatgcttcttttctctccaaacccattccaaacaaatcttcgcctcaccactccactgggaggattatctgtaatttgtgtatctaattatgctccttttctcaaagccaccaattatttccatattgctatatccagtggttaatggcagtgctcatcatgcttgacctagcagcaaaatttgactcagatgaacacactcatttctcattttcttcttttgccttctgtaagagtattcttttctttctaccttcctgtttattattatttttagccttttcttaaagtaatgagaaataatatacaatacagaaaactgtacaaaataaaaatgtaatgttacattgatttatcacaaagtgaacattcatgtaacaaccactcacgtaaagaaatagttatcaccaatacctcaaaaattccccttcttctccttcccatccattattttctacctgtctccaaaaagaaacgacttttagtaatcatttccttttctttgtaatttagtttgacttgatctattaaaaactttatatataaagggattattcaatgcatattttttgtgcctgacttcttcaagtcaacattttatttgtgagatttaaccatgttgtttcattcagctttagctcatttattttcactgctatatgatattccactgtatattaatatgccattatttatccatttcataattgctgaacttttgagttgctgacagtttttgcaatcagaaataatactgctaaacaatcttgtacccatctcttaatgtaattgtacatatgtttttatttggtatatagttaggagtggaattgctgggtcatgtggtatgcatatattcaactttggtagataatgccaaaatgtttttcaaaatgatttatccatttatcctcccatcagcatatgagaactccagtttttcttccccaaacctgatattactggttttaaaattttagccgtagcattttaataaacgtggttttaatttgtgttttcctattaatgaggttgaacatcctttcatatgtatattgaccatttgaatatcttcttttgtgaaagtcttgcttgagattcttactcatttttctatttggtttatctgcttttgtgatttgtatagcttcttttcacatattagatataagcccttttttggttatgtgtgttacaaacatttcttcccattttgtagtttaatttgcactgaacattgtgggatagatgctgttggtatgctacccacattgccttggtattcacttttgtgcaggaagacttcttgcttgaagcagctgagactctgctttctgaagaatttctctggccataagagaggctggagggtattagggaattgatgccctggcaacagctcttaaccaacactgaataggagttgatgaataaataccccattttccttacctctggagatagcttctgaaacttactctattccatctctcagatgtctccatctgagagatggagacaaattggttacttgatcattaatgtctcctgtacaggtatcctttccttctctgtcttacttccccactcccttgcttgtttttgctggaattactttttaaaataaattatttgctctcaaattctagtttctcagagttggcttttggagaacctatcttgagttagtaatatcttttgataaatagaaattcataatttaaatggatctagtttatcagttttttttcccttcatagttagtgtttgctctgtcctgcataagaagtctttacctactctaatatcttgattgtacccatggaattttaattttaatttatgaagatgattgaatgataacatggagacactaatgctattgtttattacgtatagttcccaagaggagagggcatgtcaggcaggaccacctggggaagtactagggttggtcgagaggcagaaggagcaaggagaaacatgggcaaaaatgccaggaagttgctaggtagggaagtcacctgttgggcaggaagtaaaacacagatgttgaagtttgtgattggagagtttgtaatatgattttcacatgcctgcaaaagccagactgcaagggagatgtaaacaactttagctattagtttcaccgtgtgattaatggatgccaaatcatcaattacaaaatctataaaagttaattagaacacacaaggccatgaagatattcttctttattaattccagatattttattgttttaccttttatacttagatatacaatccatctggaattaatttttgtgtgtaggttgagggaagggccatgtttcttttcttcccatatggattcataattctactggtactatttacggaaaagactctcctttccccactgttccgcagtcaacctttgtcataaatcgagtgcccatatatatgtttaggtctatttctagactctttattctgttccattggactctgtttttacgtcaataccatcatttcttaattactgtaattttattagaagttgacattcattcattagttagtctttccatcttcttcttcttcagtggtgtgttagctatttttggaattatccccctgcccttttttgagacagggtttcactttgtcacccaggctggtgtgatcactgcttactgcaggctcaacctcctgggctcaagtgatcctcccacctcagcctctatgtagctggaccacagacatgtgccaccacacccagctaatttcttaactttttttttgtagaggcagagttttgccatgttgcccaggctggtctcaaactcttgagctcaagtgatcctcctacctcagactcccaaaatgctgggattaccgacataagccattgcacctagcatgaattattcttctttagtgatagtgatgatagttgttttctgtttagtgaattttatttatttttaatcttccagttagtttcagagatccattgtaagagaacatgacataacccatttggggctaacaacatttattatggcattttttctaaattgatgcatatggtcacagaacagtccaggtattgtgcagtggggctatagaccacggtacctcaaaaagaaacatctggctaggcatggtggctcatgcctgtaatcccagaactttgggaggccgagatggctggatcatctgaggtcaggagttcgagaccagcctagccaacatggtgaaaccccatctctattaaaaaaaaaaaagaaacatcttcatatcaagtacattatgtcataattgtagtcctaaaactctacttcatctgtcagtattggtaaattagtccaggcacaggatcattcctcattcctccaggtttggtaacactgcccaattctagagtgcaatttaatttatataaaatttattaataaaatttggaatgttgatattgctttattttggcaaactataattcctagtggaattatgaaaagttttacttgaacaaacaggaaccaatgagggaaatcagtgttgttctataactatctgggaggtttggattcagccttttaaaatatcatctatctacaaatactctttgtgcctttttcagttaatcttagtctcttggtgctgctcaggattggactgcatctccttttgctattcagtttaaattgaacccaagagattgaaatagaaatgaaaattggatacaaagagatgaactcttctcatttccagacttttgggaaaccggtgtgctaggttaattatggtgggtcaataattttgtatcattctttaggcttgcattgcggctaggctgatatataaaaatatatgggatatggaaagagtaagaatgttcaagaggaaaacccattgttctattaaatatttatggtgtccatccaaatttgggtttttatcttaacaggtcaatgctgctgaatcaaagataacaaatttaatatacttaaaacataccttggaacttgtggatcctttaaaggtaatttatgtgtgtgtatcgtacaaaacatgtccagcattattttttaactttttgttggaaaaaaatttcaaactcggaaaattgcaagaataacatggcgaatttcccatattttttttctttgtacatactttacatacacatacacattgttagccttattatgcttactgaaccatttaagaataaattgcagcacctaagtactaaggtactaagtacttaggagactaaagtctcccaacaaaaagatgttctcttatataatcataatattattatcaaattcagaataattaatactgatgcaatactattttataatatgtatcccatactcaaatttttaaaattgttctaataatgttctttatagcatttttttcctgatatagggtccaatccaggatcatatcttatatttaatgtcatgttttttaaaactcctttgaagtggagaagtttctcagcctttgttcatgatactgacattttgaagcataagggtcaactttttaagtagaatttcctcaatttatgtgattgctttctcctgattaaattcatctgtgcatatttggccttaatactctatgatgtatcctttttagtgcatcacatcaagaggcacataatgccatttcctcattcttggtgatattaactgatcaatttcttcaccataaattcagattttcttttgtaattaataagttattaatctatggagagttattttgagaatgtgtaaataacccaatcctcatcaaacttccacccattgattgtagaattaattgatggctcttacctgaagtaattattactctgatggttacaagatgattattttctcattaacttttaaatactacactgtgtaaaacttgtttttattgaagtgataaagggaactgcttttgaaaaagaaataatgaaaaatatggaataactttgttatagagattattctaataaatattaacatggtttggctgtgtctccacccaaatctcaccttaaattgtaagaatccccacatttcaagggcggggactggtggagataattgaatcatgggggtggtttctcccatactgttcttttggtagtgaataagtctcacaaggtctgatggttttataaagcagagttcccctgcacatgttcttcttgcctaccggcatgtaagatgtaactttgctcctgatttaccttctgccatgattgtgaggcctccccagccatgtggaactgtgagtcaattaaacctttttcctttataaatttcccagtcttgggtatgtctttattagcagctgagaacagactgatacagtaaattttaccagtagagtggggtgctgctgtaaaggtacctgaaaatatggaagtaactttggaactgggtaacaggcagaggctggaacagttcggagggctcagaagacaggaagttgtaggaaagtctgaaacttcctagagacttgctgaatggctttgaccaaaatgctgatagttatagggatagtaaggtccaggctgaggtggtctcagatggagatgagggatttttgggaactggaataaaggtcactcttgctatgcaaagagactggcagcattttcccctgccctggagatctgtggaactttgaacttgagagagagggtatccagggggaagaaattcctaagcagtgaagcattcaagaggaagcagagtataaaagtttggaaaatttgcagcctgaggatacagtagaaaagaaaatcccattttctggggagaaattcaaaccagctgaagaaattcgcataagtaacaaggaggcaaaagttaataatcaccaagacaatggggaaaatgtctccaggtcatgtcagagacctttatggcagccccttccattacaggcccagagatctaggaggaaaaaatggttttctggccccgcttgctctgtgcagcctagggacttggtgctctgcgtcgcagttgctccagctatggctaaaagtggccaacacacagctcgggccatggcttcagagggtgcaggcctcaagccttggcagcctccatgtggtgttgagcctgcaggtgcacagaagtcaagaatagtttgggagcctccacctagatttcagaggatgtacggaaatgcctggatgtccaggcagaagtcttcttcagggacgggaccctcatggagagcctctgttaggacagtgcagaaggaaaatgggcaaaagcccccacacagagtccccacttgggcattgcctagtggatctgtgagaagagggccactgtcctccagactccagaatggtagatccaccgacagattgcaccatgcacctggaaaagccacagacactcaacaccagccttaaaagcagctgcagggttcagggggctgtaccctgcaaaggcacaagggtggagctgctcaaggctatgggagttcacttcttgcatcagtgtgacctgtatgtgagacatggagtcgaaggagatcattttggagcttttaggtttgactgtcccactggattttggacttgcgtggggcctgtagcccctccattttggccattttctcccatttggaatgggtgtatttacccaatgcctgtaccccaattgtatctaggaagtaactaacttgctttccagttttataggctcataggcagaagggacttgccttgtctcagatgagatttggactgtggacttttgagttaatgctgaaatgagttaagactttgggagactctttggaaggaatgattggttttgaaatgtgaagacatgagatttggcaggggctaggggcagaattatatggtttggctgtttccctacccaaaactcaccttgagttgtaataatccccacatgtcaaaggcagggccaggtggaggtaattgaatcatagggcagtttcccccatgttctcctggtagtgaataagtctcacgagatctgatggttgtttaaaggggagttcccctgcacatgttcttcttgcctgctgccatgtaaaacatgactttgctccttattcaccttctgccatgattgtgaggcctccccagccatgtggaattgtgagtcaattaaacctttttcctttataaattacccagtcttgggtatgtctttcttagcagcatgagaaaggactaatacaaatatgtatagttaaagtaatgtggcaaaagacttcaaaaatgttttcacctttcttgtaatgaaataaatggaataaatcaccagaaaaatattgagagatttcatgaaacacaaattttaaactttggtatgtcaaaagcaaagtaaaaggcaaaggtaggaaaaatttataacaaatgacagtttattagtctgttttcatactgctataaagaactaccaaagactgggaaattcataaaggaaacagatttaattgactcacagttcagtatggctgggtaggcctcaggaaatgtacaatcatggcagaaggagaaggggaaacaaggcacctttgttacaaggcagcaggaaagagaaggaatgcaggaggaactatcacacacttataaaacgatcagatctgatgagaactcactcaccatcatgagaacagcatgagggaaactgcccacattattcaattacctccatctggtctctccctggaaaagtgaggattatgggaattctagggattataatttatgatgagatttgggtggggagacaaaccctaactgtatcagacagacaaaatactaatttctgtcatcataaaactcatgtaatttcataggaaaatattgaaatgccaatggaaatatggaaaatgacccaaagaaggaaatcaaggtgattaataaatggtaccaaaaatgttaacctcatcattaatcaaagcaataccaattaaaaccatagttcttatctgtcaaagaagcagacattttcatttatcttaaaggatgtaactcatttctaattagagatctatgagacagacaacttattaaacagctggtaaaaatacagatttcacatactttacaaggaattgtgctggaaatgtttgcaacatctattttttgatcctgtaacactacttctagagatttgtctgaaagaacttttcagaaacattggccaatatttatgtccaacaatggtcattacagtattatttatttatatcagtgagaaattataagtagagtagaactgcagtaattacaggaagagactatttgctttccatagactggaatattatgaattattaaacatttttgccttgaaaagttttttatatgtatgatatagtatcagttgagcatccctaacccaaaagttaaaaattttagatgctccagattctgaaactttttaagtaccaatgtgatgtcacaagtggaaaattttacatcttgaccttatgtaatgtgttgcagtcaaaatgcaggtagtcaacacagtttattcagcatcctaaagggaaaaaagaccctcccagctatcttcatctgtaatatatctttcctgtgcattcccagattcttctatgcaaacattcccacaaagggtaacacaatgacacagctacaggtcagatgtgccaatggcaagtttccatgatgctccacatagggccaagactgatgtgcattactgtttttttgcttattgcctgctttgtctagtggttaagataacaaaaacaaaaaacaaaacaaagaaaatgtcagaaaggcctgcagtaacagtgataagaaaaagaggaatcacttacgtttatatgtaacacagaaagtcaagctattggagaaactggataatggtgtaagtgtcaaaggtcttaaagaagcctgtgctgttagaatgactgccagatatgacctaaagaaacaaacggataaactgttgcagttctatgctgaaagtgatgaacagaagctaatgaaaaatagaaaaacactgcataacattttaaaaaaaagaaagaaagaatggatccatctgccttgcagtgaacacatgccacttaatggtatactgatcatgaaacaagtgaagatgttatcacaatgaaatgaaaattgaagggaactgtcaatattcaacaggctggttgcagaaatttaagaagaaaataacattaaatttttaaagatttatagtgattgagcatctgctgatcatgaagcattggagaaattcattgatgagtttgccaaggtcattgctgatgaaaatctgatgccagaacaaatcgataatgctgattaaacatcattgttttgacattattgcctcagaaagacactgactacagctgatgaagcagcccctgtgggaattaaggatgccaaggacagaaaacaactatgctgggctgtgctagtgcagcagacacacgtaagtgtaaacgtgctgtgataggtaaaaccttgtgtctttgctgttttcaaggagtgaatttcttaccagtttattattatgctaacaaagaggcctgaatcaccagggacattttttttccaattggtctcacaaacattttacaccagcagctcatgctcactgcagggaatctggattggatgatgattgaaatattttgttattccttgacatctcttctgttaatcctccagctgcaattttcatcaaaaataatgtttatgccatatattttcacctaaatgtgacttcattaattcagccatgtgactgtgacaagagtatccttagatcaatgaagagtaaatacaaaaacactttttaaaaattttttaatttttattttagttttgggggtacatgtgcatgtttgttatgtgggtaaacttgtgtcttggaggttatgttgtacagattatttcaccaccgagttactaagcctagtacccaatagttattttttctcctcctcttcctcctcccaacctccaccctcaagcaaacgccagtatctgttgttcctgtctttgtgtccatgagttctcatcgtttaactcccacttttaagtgaaaacatggggtatttgattttccgttcctgtgttaatttgctaaggataatggcctccagctccatccatgtccctgcaaaagacatgatcttgtttttatatatatatatataactgcatagtattccatgatgtatataaaccacattttctttatccaatctgtcactcacgggtatttggttgattccatgtctttgctatattgtgaacagtgctgcagtgaacattcgtgtgcatttgtctttatggtaaaatgatttatattcctctgcatatatacccagcaatgggattgttgggtcgaatggtatctctgttttcagctctttgaggaattgccacactgctttccacaatggttgagctaatttacattcatacaccaacagtgtataaatgttcttctttctctacaagctcaccagcatccgttgttttttgactttttaataatagccattctgactggtgtgagatggtatctcattgtggctttgattcacatttctctaatgatcagtgatattgagcttttttttcatatgtttgttgtccacatgtatgtctttagaaaagtgtctgttttgcttactttttaatgaagttgttttattcttgtaaatttaaaaacactttcttgaacagcgtgctagcatcagtgaacagaagcatagatgtggaagtttttttagagttgcagtcttgctctgtgcccaggctggagtacagtggcacgatcattgcacaccgcacccttgaacttctaggctcaagtaatcctccaacctttcctgagtagctgggagtacaggcatatgtcactatgcccagataattttttaaaattttatagacaggggtctcgctatgttacgcaggctggtcttgaactcctgggctcaagcaatccacctgcctcatcctcctgagtcactgggattacaggtgtgagtcaccacacctgacaatggaaggtttttgaaaggagtttagtatgaagaatgccatatatgctgttgccagtgcttggaacatagttactaaagacgtggttgtgcatgcctggcacaacttctggcctgtgatgctgttcaatgatgatgataaaacaaggtggtgactttgtaggattccatatgtcaagtgagaaaaaattatgtctgacatcctaaaatatgcaaaatgcatactttcagagtctgtcagtaagctggaagaactgggtgttaaagtttgtatttatttatttattatttgagatggggtctcactctgtcacccaggctggagtgcagtggtgcaatctcagctcactgcaacgtttgcctcccaggctcaagccatcctcccacctcagcctcctgagtagctgggaccacaggcacgcaccaccatgcccagctaattgtttgtctttttgatagagacggggtttcgccatgttggccacactggtatcgaactcctgagctcaagcaatttgtccgccttagcccctcgaagtggtgggattacaggtgtgagccatggcgccaggccaattgacatttttaacatcaataatgaggccccagctgttcattaatcaatggatgatgaaatagacaaaatggttctgattcaaggtgatcatgacagtaatgacgatgaagatgatgttgtaacactgcagaaaaaacgcctacagatatggtaaaaatgtgtgatgggcttattgaagatctacagtttttgttaagcaaaataaaattcctatttttactgtataagaatggagcagcacacattcataacagaacaagaaatcatgtcaattataaaatcaaagagaaatttctatgacaaaaaccattattaatgaagcagatgactctagaggaaacatttctaaaagcgggccagcaaaatgcctccgtatccttagaatacccacttcctggtcccttaactgtttctgatgtttcatctcacttagaaaaataaaatacagcttacagtaacctcttaatcaaaatatagcattataggtggatactggaaattattagttgttgctgtcatttaagagctgatgcaggtactctgggggtgctaccgtgctgttagcctgaacacattttttcactatattaatggtatgtcaggttttttttttactgttaagtacttatgggtaaataagtgttaaaaaatgattgcttattggtagcatataaattcagagttgggaatgatagtgatgccaaacaatcacaaattgtccacctaagtgcctgaaatagtgacacctttgctttctggtgtttccatgtacatagacttctatgtgcaaaattatttaaagtgttgtataaaattacctcaggctatgtgtataaggtgtacatgaaacataaatgaatttcatgtttagactcaggtttaatctccaggatatctcattatgtacatatgcaaatattccaaaatctgaaaaaaatccagaatctggaacttctgatcccaagcattttgggtaagaaatactcaacctggattaagtcggggttggggaaggagcacacaatgatataaaattatttattttagatactgacaggaaatataatatttagaatgtttatctttggacaatagtagatttaatttttttctttcaattttggtgaattttttagtttttatctgtctgtgcatattattttctgttcataagcaaaaaaagttatcaccattgcttcatatcaaatttaaaaaaggagataatggccaggctaaatatgctttctcttcttcttttctgtttatttagttagtgaccccctcatagttttcattaagcaaaataaaatccctatttttactatataagaattgagaaattgctctatttatgaatatacaaagcacttttttggtctaatgtatatctaacctaaattttggaattatatgtagagtactctaaatgtacaacagtagttgtttaagtacctatatatgtaagttgtcgggtgttaacaattagtagagaggcaagaaaaataaaatttataataagcagtggatggcactaattagccatgtactctttatttggaaaaagggaaagatacagtctatcctcagctagatagctacaaatatattttatgagtatataaatgaggaaatgaagaaagcacttggtaaactataaagtattaaacaactgtaaaatgatatgtttgaatgatcttgtaattgattatccttaacttttttattttattctttaatagattgctatgaagaactgtaacacacctttattaagagcttactatggttccttggaagacaagaggtctttgtcactcaaccgttaataaaaaataagattattctcttcttcctgatcataactgattttaaagactctaattgtattctatggaacaattacttgagttttggttaacagaatctttaacctattcatcaaaattctaattgtacatttcacattataagtagaataaatagggtaacaacacattgattatttgtgttaaaggacaattagaatagcatgaaaacttgaaatccaagcacaattttaatatttccttttaaagccattctccatggaaagacttgcaaataataaaaatatatttctttattttgttaaatcatgaagggtctaatgtaacaaaaaatagtagatataaatattgaatacaatctaaatgctgtttaattttaacagtattaaattattagcagtagttgtggactgaagaactactggttcaatccagaccttggttctgaactgaaaagatttgtgatacttaagaactattattctattaattgaagatttatcccgtgtgaggccacacattgaagttaataataaaactggcttaattacaaataaaatatagaatggaatgaaggaaaagttgaggaaaatatgtgttaccagatttctggtttgcataatcactgaactttaccactggtaattgtgaggttcctgttacgctgtctacatatgtgtttagtgtctcttgcctctaccgaaggcagggatcatatgttattcttctctgaatctcttcacctagcacagtgcttgatacatggtgtacattgatgtttattgagtgaatgagcatgaagccacaatttttatgacagttctttagagatgtattttgtacccacaggcacatcagtatatgtaatttgtgagctctattagcagatgtagaattgtttttggggtcctgatgctgttttagactagtcctgactgatgaaacagtttaaatatgaaatagtcacagctctaacttaagtaaatttaaatatttgttgcttaattagttatttcaaaataactttcaacaaaaatttgctatcatcaattgtgattcaaattataaattaaaataactctttgacttattgcctataatgtttttcttttggccttaatattaggtttggaatcatacttgaaaagattaaaacagtaattaatgatgatgcaagatacatgaaaggatgcctaaacatgaggactcagaagtgctatgcagtgaggtctaacataaatgaatttcttgacatagcaagaagaacatacacagagattgtagatgacatagcaggtaatttctttatttgataatgttttttgtagggataaaacagccttttcaggacatgctgtccttttttgctgctgatgactagccatacatattttaaatttatttttcgttaccaaaacataaggttagcatgtagtgccatttaaggaaacagcatatgtggcagccttcatactaaactccttttgaaaaccttccattgccaagtgcaatagctcatgcctataatcccagcactttgggaggccaaggagggctgatagcttgagtccaggagtttgaggctagccttggcaacatagctagtcttttgtagagacaagacgttgtctctacaaaaactgagaaaatttgccaggcatggtgatgtatgcctgtagtcccagctactccggaggctgaggtaggaggatcacttggatcacttgagcccaggaggtcgagactgcagtaagttatgattgtgccactgtgctcagcctgggcgacagagtgagatctgtcttgaaaaaaaaaaaaaattattagagtttgaaagagcaacaagacctcctatttatgtataaaataagaatttaaaaaccatgtgactctttaaaacagagtgatttttctcattaaaatttattcattttgttttgtttttgtttttcttgtttctggtcaccaggaatgatatcacaacttggagaaaaatatagtctacctttaaggacaagttttagctctgctcgaggatttttcatccagatgactacagattgtatagccctacctagtgatcaacttccttcagaatttattaaggttcattttagagtggttaggaaattagtgtttctgattttatagaattacatctacatatttttgggacttcttgagttttgcaagccaaatttctgaatgttctgtatcttctcctattcctacccacccacctaactaatgtactaatctaagagtgatttagatgcttttgcagaaataccaaactcagtgttttccacagttctgggagcttggtgtaagaaaaaaaggaaaatgaagaaagaacatccaaaagctgtttatgataaaagaaattaggaaaataccacaccatttgcctgttaaaggtttaaaaagtcctgaagtaaataaatctacttaacttttaaaaatctaatatttccaaacctttgtaccacaggaataatttttcctatatagctcctttacaatataccagtttgggaaagtctaacccactctaatctttgttctatctgcttagggggtactttttgataagaacaaaccatttagctttcaggcttttagagcttgagtacgattagagattgagttgaggttcagatataggacaagggctgcgacaggggtcagagatggagtgaggatcactgatgtccatcatgcgtgttacttggtaataagatgtagtgtttttaacattttaagacctatcagagtagtcatcccagatgaactaggtcaaaatatcctgctttttaaaaatgaatgtatgggttaaaaaatttggctttatcctttgaagtgatctacctcttacatttcacaaatattatttagaactttctttgtgataccatatctcaaagagtaaaatgattaacctaaatacccatatttctgttgtttaaaatcttacatttcatagtagtgtgcatttatcttgacatttgttttttaatctccaagcagatttctaaagtgaaaaattcttacagctttacatcagcagatttaattaaaatgaatgaaagatgccaagaatctttgagagaaatctatcacatgacttatatgtaagagcatttgaagtatttgaatattgaattaaattggtttaatttgagaaactgttacaattgtattagtttaatttttatctaattacagacaattgtagaattatgcatgttagcaaaggaagtctgtctttgtgattagaatcactgagcctcacagaagcttcggggaagatctaattgcaaacaaatacttttataattgatatttctgtaatgtgcattctaccatgatgtagaacttggcacatcaggggcttacctgggcttcgttcagtttattattttcctatggtctgtaagtcctcagcttcttataccttgatattaataattcaatagcaatatcacaatagtgtcagttcttttgctggtcatgaaatagtagcaatacagccagaaagaagaagtagaagatttagaacacttattaggctgaagtaataaagagaaaggttgggctttcaagacaatttcaaggcatgtaccaccaacattttaatatatagtaagttttgggtacatatttatctttgcaagagaaaaactttttgcactatatcacagtataactctgccttataaaaacttaaataattatattattcagatattgtgtctgtgtgcatgtgtgtgagtgagagaacaagaacgagagagaaagaaaaaatggatgagagagaaaatgcatatagtttttgtgttgaacttaacatttgcaaattcacaaagtgattagcaaatgggatctttccaagtataatgagggcttgatttgacctatatcaaatattcttaataataaaaacttattttattaatatcatataaaagcagttatttcaaaaatgttatgttaatacacaagaagatagattctttgccactaagtagctgtgatcttgagcaaaaacttcaatttcctcatctctaaaatgagacagatgaacaataggctttatctatagtgtataactcagatgtgaatattattttacttcaggcaatgaatttaatattattttacgattacaatgtatgtcccttttgaaaaaacattattacatgtcttaccaaacgtgttttcaggatagtgtgcaaactgcttagtgagatttatgaacatattcattgcttatataaactatctgacactgtgtcaatgctggatatgctactgtcatttgctcatgcctgcactctttctgactatggtaagttgctttctttggaataaacatattgcatagttaaatttgtattcgattcaaacaatttgatataatagttatgacatttaaaatttttaacttgaaatagagtctcttgcctctggtcctagactaagacacaaaataaagaaagtgagattacccttaaaattttttttgaagtaaaaattattctctcagaaattggcaaaccaaaaagaaaaaattgcaagaaactaaagattccccaaataagaaagactgtaagagctgtctccttggtaaaaatgacagtgatctaaatttataaagttcaaatctgaatacttattagaagcagcgtgataaacgttaatagagagaaatgcatctccagagtgagcattttaatccactagctctttagatgtgaacataccaaaattaggaattatgtaatttatttttatatcccaagtctataaaaaggccatgaatataaatgttaagtaattttctcatgttaaatgaatacttcgagttagtgctttgacatttcttatctaacttaccagtaataaccatactccagtatgcaaatttactggactagtatgtgataattatggttgaataattgtagacttcattacattaaaaacattgaaatttctaatgtaaatcagcagtaaaatttctaaaatgttatgttaatttacttttatgggatgtatcttaagattttttcatatttcttatggaaatattaactttttctattggtattttataggccaaaacttttcaaacttttatatctcctttgcatcaaaactctactttaggggtcagatattccaatggtagttttgtttttaaactattaagagatttagtcttgcttcattttagtttgagaaggatcattctgaaactccatatctataaataatgaatttttgaaaatacttaaaattttttttctaacctcacttttatgatgaatgttttcaagtttatgcattttagataaaggtatggaacattttggttttcacatatgctttcaccctcttcctcctccccccacttcaggtggtatccatagagacctgatccttatttatttctatagattagcagattatttgtgttgatcttctctattctcattctctgaaatttccttttatacaaaatttctccatgggcttagaaagaattatttttatatttgattttattctataatcatacctcaacttatgagctaggtgtttgaaaccagcctgggcaacatagctagacctcatttctaaaaaaaaaaaaaaaaaaaaaaaaaatcggtgagaagtggtggcaggtgcctgtactcccagcttcttgaaaggctgaggcaggcaggaggatggcttgagcccaggagtttgaggctgcaataagctatgattttgccaccgtattccagcctgggtgatagaccaagaccctgtctctaataaatacataaataaatgctaagcgtaccaaatttgaaataatattaaagtagggaagtagtgtttaaggtagagtaagtaaatatgcaactctgtattaccagtaaccaactatgatttttaaagtacaatcaatgagtacttggttcttttttatttttatttttatttttttttgagacagagactcactttgtcagccaggctggagtgcagtggcacaatctcagctcactgcagtcttcacctcccaggctcaagagatcctcctatctcaaccccacaagtagctgggactacaggcatgagccattacacctggctaattttttttttttttttgtagagatagggtttgaccatgttgcctaggctggtcttgaactcctgagctcaagcaatcaagcaatctgccctcctccgcctcccaaatgctgggattaccagcatgagccatcacgcctggtctgcttggttctttttaatctacaaaaagctgaaaattttataaactattttggagctcaggacagtggtaaagaactaaattctagagttctctagaagtgaataaaagttgtgatagtgattagagtgtgtccattataatttagaagaatttgggtggggatttgggataatatagtaccttaatgttattattccaaattgaccagtgtgaaaatcactaagatatagacaatacatacacactacaaaatctttagacacaaatatattaatctttaaaaaccattctattttttttcttaagttcgaccagaatttactgatactttagcaatcaaacagggatggcatcctattcttgaaaaaatatctgcggaaaaacctattgccaacaatacctatgttacagaagggagtaattttttgatcataactggaccaaacatgagtggaaaatccacatatttaaaacagattgctctttgtcagattatggcccagattggtaagttatggctttatttataatgaccagttttacactcttttcagaatgctttgtgcctaatttttttagggccatgtgcctaattaacccaagaacagtttggagcagattctgttacctaaaagtataacagtgtgtctgttgtgtaaactataactttactatttgatatttattaagctccatccaatttcaattgcattgcactaaaatttttttgggatactacagaattgggaacattcttactataactattaaagttgcatcaaatattactaaattgaatcatgcaattatttctggttcaaaaacaaagtttgttgtgagaaaaagtgaaatgagtaggttaagctgttgcctttaataatccatgtgagttttttccaaaattattaaatataatattgagcagagaaacatttcccttaacttgaggggtaccaataacttggccatagcagttgatatattatacatacacatgtgcatacatgcatctaaatggctgtcactgacccaacattgttacctatttcttaatatggaggcccagcttaactcctaattctgaaaactgggtttccttgagaactatatgaatcagagatgagatacttggccaaaatgaagtggttcttaagcagggttggttttgatcccttacctcccaactcccagaatttggcaatatctggaaaaatttttggttgtcacagctgaggggagtgtagagtccaggaatgctgttaaacatcctacaatgcacagaacagctcttcctctccacgctcccctgctttcctcaccccaccatacacacacacataagaaagatttattgagcccaagatactagtagtgtcatgggtgagaaaccttggtctaatgtaatgaattgtaaggagaacaaagcaataataatattggtgatacagtataaattcacccttagtactgggacaatcagagacaaatgagttaatgaagagtaaatattttattgattttgtaggtttattggaattaaaaggacattttagctaatttccttcgccttataagaatactgtctgattcatgtaagacataatacttcgatttgaattagctatgaggagctaatatatatgtatatatgtatatgtatgtatgtatatatatgtgtatatatatgtgtgtgtgtatgtgtgtatatatatatatgtgtgtgtgtgtgtgtgtgtgtgtgtgtgtatatatatatatataccagccaggaggcttctgtaataatctagataagaaaggttgagaaactttttgatggaggttaagagagcagagaaaatacaaacatataccacttaataatatacgctatgtgtatatatatagggtatatatataccttctatatataatataaatatatatattatatacattatatatataaaatatgtatataataccgtatatatactacgtagtatatatagactcacactgggggtgtgtgtgtgtgtgtgtgtgtgtatatatatatatataaaggtatgtaacattttggttttcacatatactttcacccttttcctccacctcccacctcagttggtatcctgagtgtgtatatacatatatatatatatatgtatatatacacacacacacacaaacactgggtacatatatatatacatataaccttcacatttatttcacatttatataatgaaggtaatatatatgtatatgtaaagtattatatgtattatatgtatatgtattatatattacatatgtattatatataatatatattatatattattatatattatatattatatattattatttatataatgtattatatattatatagtatatatagtatatataatgtattatatattatatagtatatatagtatatataatgtattatatatagtatatataatgtattatatagtatatatactatataatgtattacatattatgtatagtatatgtaatgtattatatattatatagtatatgtaatgtattatatgtattatatagtatatattatatatgatgtattatttagtatatataatatatatgatgtattatataacatatataatatatatgatgtattatatagcatgtatagtatatatgatgtattatatagcatgtatagtatatatgatgtattatatatagcatgtatagtatatatgatgtattatatatagcatgtatagtatatatgatgtattatatatagcatgtatagtatatatgatgtattatatatagcatgtatagtatatatgatgtattatatatagcatgtatagtatatatgatgtattatatatagcatgtatagtatatatgatgtattatatatagcatgtatagtatatatgatgtattatatatagcatgtatagtatatatgatgtattatatatagcatgtatagtatatatgatgtattatatatagcatgtatagtatatatgatgtattatatattatatatggtatatatgatgtattatatattatatatggtatatatgatgtattatatattatatatggtatatatgatgtattatatattatatataatatatatgatgtattatatattatatataatatatatgatgtattatatatgatgtattatatataatatatatgatgtattatatatattattatctattatatacgatgtattatatgcaagttattatgtataatatataatgtattatatattatataatgtataatatataaatatataaatatataattatgtataaatatagaaatatatacattatacattatatacattataatgtataatatataaatatattatatataaatgtatacattatatataaatatattatatacattatatataaaatatgtatatagttattataccttatatatactaaacagtatatatatatactcacactggtacatatatatatatattatatatatatatatattaccttcacatttatttcacatttattctcctagaaactccataagaaagttgtatttgaaatctaagttctgctctctgagggcaggacccatgtctgtttatttaccctaacacatagaagggcttcaataaataggtattgaatttctataaaatgaggaaagtcaggctcaaagacttgcccaagatcacccagtataaatcctttaccttagtcttccccacttgccccattatgccgtttgactctgtgtctccacccaaatctcaccttgaattgtaatcccacgtgtcaagggagggacctggtcggaggtgattagatcatggggggcggtttccccaatgttgttcttgtgatagtgaattctcacaagatctgatggtttaaaagtgtttggcagttcccaccttgctctctccctctcctgctcgcatatgaggacggtccttgctttctatttgccttccgtcatgattgtaagtttcctgaagcctccccagccatgcagaattgtgagttaattaaacctcttttgtttataaattactcagtctcagggattttatagcagggtgaagcagcagactaatacaccccagtagctaatattgagtgttcactatgcccatcactgctgtatataccttgcatgataatacgcatttcacgtttatctgcctggaaactggaagtgttatctggttaacactcataaaaatatgataaagattattaactccatgttatagatgagtaagtcaaagtattgagaaggaatttgtccaagattatatagtttgtaagaggcagcacaaggattcaaacccatgcagcctgacaaataatctttgccctaaattagcaaattgtccccacccttctccagaatcttaagaaggtagcaggtcattcctgttttcttggaaatggacagtttgtttatgtttttgtttttgtttttagccagaaagttctgattcaaattctggctctatcacttcattatttattttcagcaaacatttatcatgagattatgtgtcagaagccactctaggttcataattcatccttttaggaaaacaagcaaaaaaatagagtagaatgggggagatacatctttctagtttttataatttattgggttattttgaaaattaggaagagtggatataaaatatctagtatgtcgaatggtataggtgccgttattataattactactgttatgattattacttttattttcattaatattaatctgacttttggtttcttttcttgctactccttattcctcagagttaagccctattctttaccctttttttgtttttaatcttggagtaatctggctttggtttttttgctgctattatttcaccattttacctatacagaattctgtatatgtggtacgtttccctttcaactatttgtatattttatcttcttataatgttagaatgcattttagattttattctatattgagactggtgcattaatcagattgatttgttttcaaaaaacgaatattttagatgagttagcacaataacttcttgggcagaaacagtcttgtgggtgaaaattcaccttttttttctttttattaaatgttttgcttttattttgcttctgaatgtttctccatgtttgtaatcacagatatttctttatatctttttataatgattttattaacttcagctttataggcattttcttcagattttcatatttctttttttaatttattttatttttgacataataattgcacgcatttaagagatacatagtgatgtttgaatacataccatgtataatgattagatcagtgtaactggcatattatattcataagctttataagcattcccttcatattttaatattttgaatgttatcattcaagtaagttatttaaaatttttattgtgtttataactgtctgtttgttatgtacttgaacatttactgccttatttgaacttctggataactttgtacagtaggtagggcaactttttttttttttttttttgagacggagtctcattctgtcgcccaggctggaatgcagtggcgcgatctcggctcactgcaggctccgcctcccgggttcacgccattctcctgcctcagcctcccgagtagttgggaccacagtttccccgcaacacgcccggctaggactgggaaagtttaagtgctgtctaagcttttataataagggatagaactggggtcatgtcttctaatgccatatctagtgttctttctaccatataatccttgtaaataatctgagaagtacaaaatgttattagtaattatattttataaacacatttcagtttatcttgaccttatattttacaggatcatatgttccagcagaatattcttcctttagaattgctaaacagatttttacaagaattagtactgatgatgatatcgaaacaaattcatcaacatttatgaaagaaatgaaagaggtacccaaacaaaacttttcttatgttaaaaacattaaattctctcactaatggccagttatcacataaaatatttttatactaaaatatgcagatgttgcttatacccttttctaagagccagagggcagtcaaagacagcctcctaatttctgttttatgtggaaatggaagacaatgtttaagtgaaaatataattttaagagaaagagctagcattattaagtaataaaagtgtgcctaaatgtttttataggaaatacgtaaaagacttcagaaaatgataactggttcagtaccattttgcatagtatttattgttcttcataggcttgattttaaaacaaaagattactgtgttagaagggtttcaaaaatcatcctcttctttgttctcatagaattttcactccctgtaccaaagtatcacctatttctgattgagcaaacgtcaagtaggctttagaactgaaggaattaagtgtaactcttgggatatctgtattatgaatttaggatcactgtttagttggaaaattttcttcaagtagataggtggtgactaaagttatcatttgtcccatgatttatataattatttattgtgtattgaatatctataatagatcgtagcaatatattaggcacttaaggtatatttttaaatggtcctagcactcaaaaagcttagtctcatagaaaggtaaaatgtccatcaaagttactattgtgtcataatataataaagataaaattctatttttgagaaagaggttaataatcttcagtggaaaagagcacttctgtcaatttaagtcttagtctccattggtcatggatttaaatttatttgttaaaccaagaatcaagacttaggtattttttcttaaatttttctttacttcatctttacagggtatagagtaatacttaaataaatttgagagatggttttggatactttatagcagtaattgattagtcatttgtggagaagaaaatgaccatctttgtgcttagtttaaacatttaatttattgcattttttcactgtatctaaagcatcaatattttagataatggttatttactctgttgtctcatatacatatgcatatgtctatttatgtacacatcagctattctactggaattattagtcatgagatttttagaaaagaaaactattattttctgctcagcaggatgtctctaagaatacatttcagatgaacttataaagagactgggtttctcctcattttttcctgtgatattgacagctgtttggttacaatgaataaatattaaaattatatatttcagatagcatatattctacataatgctaatgacaaatcgctcatattaattgatgaacttggcagaggtactaatacggaagaaggtattggcatttgttatgctgtttgtgaatatctactgagcttaaaggtattcttttattttaagtatattgattttgagtccttctttatgtatccttttattattattgaattttatggacacccacaaatagcttttaaaacaatttagatagtaaacacatatcatcgcatttatatttttgttccttcatttccaatgaaagtgggaatcattagtttgataaccatgatatagataaggaaaagatgaaatcaagaaattcaaataatgcaaaattagtcagttggctttaatttcatcaaattcagtagcaaaatatgaaggtctttcagtaattgcctccatgtgcaatgatgttgactatgatgttacaacaggaaggaaagcactaggcaactcaggtaactttacagaaaatctattttacctacctaagtaaattttattcctttaaagaaagtagtttttcacaaatcaactatgtaaaacattgatttttgctctattaaattaatttataaaatatctttttaaatggtcactcacaatatatacagatatgaacaaaactgaaataaaaatactttttcttatttaagataccttaaaatgtccctaagatgaagttatttaccttaaatgaaagtccataatgatttatttatttttattatatttatttattttttgagacagggtctcactctgttgcccatgctggagtgcagtggcgcaatcttggctcactgcaacttccacctttcaggctccagcaatcctcctgccgcagcctcctgagtagctgggactgcaggcatgcaccatcatgcttagctaatttttgtatttttagctgtgacggggtttcaccatgttacccaggctggtcttgaactcctgggctcaagtgatccactcacttcagcctcccaaagtgctgtgattgcaggctgagccgtcatgcccagctcgtaatgatttattatatagaatgagaaaaatctattttatgcttaaaagtatgtgataaatcaaaagtaatggtaataaataatattagtctttgtaattttgaatgtgtcagtttcaatttctcatataaataaagtgcatatattacttaagattaaaagctaattagtgcctctgatggttaattttacatgtcagtttgactgggccacagagtgcccagacatttggtcaaacattgttctggatatgtctgtgagggtgtttctggatgagattagaattggtaaactgagtaaagcagattgccctacctaatgtgggtgggtcccactcaataaatgcaagcctgaatagaacaaaaagccttccaatgagtaagaggaaactcctccttcctggctgccttcagtatggaagatctgttctttactaccttcagactcaaactgaaacattggctttttctgggtctggaacctgccagctttggactggagttgtaccattggctctcctggacctatagctagcccattttagaccttggtacttgttagccttcataaatcacatgagccagtttcttatgatgaatctcttcacacgcacacacatacacactctctctctctctctctttctctctctcactctcactcctgccccaccccctctctattggtcctctttctctggagaaccctaatacaaatcttggttctggtatgatctgacaatagtggtaagtaaaatatcactatcgtatactcttaatcaactgcttgtaagcagcagagatccaggtgattttatatatgatacttccaaacatttttggcaaactaatgaatataatgaaattggctggttgctcctagtgtcactagacaaagttgggaaagcaaaggatgaactcaaggattcaaattgccagctcgggcccccacccaagggacttccagtcactgcccatcacatacttggtgagggcctgcctgtcactaccaggaagaaccaggcatcacatgtgtccctagatcacagcaggggggctgtaagaagggcagggtttcttaacctgggatccatggatccctgggctgcatgaatctgaaaacttgagttcagaagcctcaacttagatgggaaaaaagcctctttatggtcactaacttctactcgaaattgagccttttcttccaggtgaatgcaggcaaacaagcacaccagggttagcaggaactgtgttttccctagctagaaaccacaggtgttttccaattctgtgacagtggctgtagacaccaggaaatgtgcatcacttcctcactgcttccaaaagcaggacttaattagccttgctgctatttaatgcattatttaatgtgttaacttagaagcatgtgtgttactttttaactaaaacattttaaataacaaaaaagcaccaaattgccagctcattgctgcataaatgacttgaaagcacctaaatgtgccctgaaggaaatccttatctcctatagtcacagggttgagattgctgaaaatcaaacccagaatctcatcctatgccagaattacaacacaagttgaactcccagctttatagggtatctcctgttaaagtgagggcattagttgggaaggaatgggagactaccagttggaataggaatgtgtagggagacactgatgaacctggggacatttaggccctaaattctgatgagttgtctttgccagtagaagagaccacttcaccgcatctgaggggattaacctagcattacctgaggaaactgtaatggcatcccagccaatgctgagtctcctcaagtcgcacttccaccacatttctttgcctctagacctataactagatctctaaaggtgaggtacaaaatgtgactataaggagatacattgcactctgaaagaactacttgaattttctactttatacagacagaaatccatggaacatgcatgggaatgtattctaagggtgtgggataagggtggaaggaacataaagttggattaggctgaagtttttgatatgggcttactaagccaggtgtgcatttaatgttgcaactcaaagagttagaaagcgatctaacagtttgattgactggctgaaaaacagaccaaaagttggcccaccatgaatgagttgccttggtttaatgcagggattcaaagcttagggaggttggaatgttagagtgggtttgtcatttaagatcacttacccatcctggaagagtccaaatgacataccttttaccatgactatgagaaataaatttgtgagaggagccctggcagccttgaagagctctgttgtcactcttctatataggacagacattacggcccaccataaggcctttactgcaggcactgaattgggaaacccaaatgcaataggaataattggatcccagggtggtaggggccaagttgtggcactcagccaccaaggacaaggtggaaaagttactgtaatgggaagcagagttaaagcagcaatcagaataatctgacttacatagacctatggctttggataggagggctactaaattctgacttgatctgaataagcataaaagttctaggttgaggttttatgcatgagatcagcaacaggagcctgcagtcaccaagactgacctggctatagccattactgcatgcccagtctgtcggcagcagagacgaacattgagtcccctttatggtaccattccctggtagcagattgattacattgtaccacctccattatattcatattggaacagacacttattctggacatcagtttgccttctgtatgtgtaatgtttctgccaaaactaacatccatggacttaaagaatatcttatctgccattatggtattccacacagcatttcttctgatcaaggaacttacttcacagcaaatgcagtgctgcaaagggcctgtgctcatggaattcactgttttgactgtgtttaccaaccatcttgaagtagttggcttgatagactggtggactagtcttttaaggactcaattacaacaccagctaagtggcaatacctttcaggactagggaaaggttttccagaaggctgtatatgctttgaatcagcttccaatatatgatgctgtttctcccattgccaggattcatgggtccagcaatcaagaagtggaaatggaagtggcatcactcaccattacccctagtaactcaagggcaaaatatctgcttccagtttctataaccttgctctgctgacatagaggtcttaattccaaaaggagtatgcttccaccaagagacatagtgataactttttgacctggaagttgagactcctgcccagccactttggctgtcttatgcctctgaatcaacaggcaaagaagggaggtattgtgttggctgaagtgattgatcctgattagcaaagggaaattggactactactccacaatgcaataaagaaagaatatgtctgcaatacagaagattccttagggtatctccgttctgtcatgctctgtgttaaaggtctgtggaaaactacaacccaacccaggcaggactatgaatggccaagacctttcaggaatgaagatttggttcaccccactagttaaagagctctgactagctagggcttgctgaagccaaaggaaatacagaataggtagtaaaaggaaaaggtagttgtaattaccaactacaactctcttaccagttacagaaataaggactgtctgtaattgtcatgattatttccacctcatttggtatgatttttttggtgtgtatatatatacatatattaaacaaatattttatttcttcttattctcttataatgtaacataagatgtgttgacttcacgtcatattatttaagtattgccaatttcacattatagtatttaagttatgagatatcaagaagaatgaacatcactcagtgacgttacctccttttctggaaaaggggttagtgctttctcagttgtgctgaagacagttgtatcatattagagggaagtatgacctaattattgtcttcatttgtagattaagtgtggtataaggagatgcctatggatgccaagtttacaaggggtggatttgtgttgaatagttttatgtgtcaacttggcaaggtcatggggtgcccagacatttggtcaaacattctgggtttatctgtaagggcatttctggatgagattagtagactgaatgaagcatattgccttccctagggtggatgggtcccatccaataaattgaaagcctgaatagaagaaaaaggctgatccttctaagaataagagagaacttactgccttcaatctgaaatactgaaagactaaattgccttcagactcaaactgaaacattggctctttctaagtctacagcttgcaggcatttggactggagttattccatcaactctcttgggtctccagcttgctgactgtagatttttgatcttgccagcctccataattgcatgagccaattccatataataaatctctttacacacatacaacacacacacacacacacacacacacacacacacacacacacacacaccctattggtctctttctctggagaaccccatctaatacagtatctgttttcttttttttaatttttttttgagatggagttttactctttttgcccaggctggagtgcagtggcatgatctcagctcactgcaacttccacctcacaggttcaagcatacagtatctgtttccaaagtattctacaatagtttaaaatagtgtttttagtattactttacaatattattttctagtataaataatttaataaaaatgtaatattgctacttattttaaatttaattattattttctaacacagtatccttagtgcctagcacaattcttgcaacagatagggtctgaataattatttgctaaattgaattaacctgaaatagagtctacaaagttcctctaatagattggtttggcatataacttttaaggacattattgttattgaatatagtctctaccttttaaatagcttactgtgttctaaatatttcctgtagctttataaatttggttttgttttatactccttttgatttgttgagtaggtatttaagaattttcatttttctgtcatatacaaaattattccttcccttgcttttcactttccatagttgatagccattttgccaatcaattatttttactgtcttaatatttaaatttccactgaacacctacctaatttgtcactcataatgtcttaaaacgtaactggttattcagatctctatctgccttagtaaattctgggctggaaatcttgtgctggctgtaagtcacttgaaccactttcatcaaaatcacctaaagtacttacagaaaatgccatttcctggggcgccacattagaactattggttgacaatttttcaggggatatgtaccaagaatttgcatgtttaacaggctctctaagggattactaatgtttgagagccattatcttaatcagtgttctcaatctttctttttcctctaccagtacctaacccaaacacaatgaagtctaaaaactaaaaacttttggaatttgacatacctaagacaatctcttgattccactgccaaaacctacttacaactagggaggctacttttatagttaagttttttaaaaattgaggaaaatattattttttttgcatgtgagttaccttcctaataaatgattacttcaattcatagctttgtttctggtaaacttcatcttttcaatatcttcagatatattttttaggattttattttcagttttgttctctttcccataatgtggcatacacgtctgtgcacaaacataataaacatatcttcttcatttaatataaaatctcaaaacattttaaaatggattgataatgttagcctccaaattattagttttattcctacatctctgccaagctacttagaaaattaaactaaaattttatgttcacatagttaaaatagaattttctagttaatttttaaagtactaatattcattgtctgttatatattccaggcatttacactgtttgctacacatttcctggaactatgccatattgatgccctgtatcctaatgtagaaaacatgcattttgaagttcaacatgtaaagaatacctcaagaaataaagaagcaattttgtatacctacaaactttctaagggactcacagaagagaaaaattatggtactgcatatagaaattatacctatacattcaaatactatatattctcctaagacaaactttcatctcttctttacttggctgttaatctaaggaaattttctcattcttttgagtgcttatattctcttagattgtattttctatgtcaagctcattgtatctatatctagatatagatatataaatctttttaaatttttataagccagtaactatgtaaaaatacagtgacaactgaaaaccctagaagtattagtttccttagaaaatgtaatttatcttatatttgcaagttatataatgaattgaaaattatatattttctacacaatctttcagtagcagggtccttcctctgtttttcttcaggttctgggtacttgaaaattaaatctaaaatcttaaatcttaaaagagaatgtattaccaaaccatattttttttttttttttgagacaaagtctcactctgtcgcccaggctggaatgcagtggcactatctctgctcactgcaacctccacctcccaagctcaagtgattcttctgcctcagcctcccgagtagctgggactacaggcgtgcaccaccatgcccagctagatattcttcaacttgattagatactttctatttaaatcattaagtctcacagattcagagaattttcaattggtctgtacatacaagtttcaaaaattattttagctatggatatgaccctttgagggaaaaaaaccatctttgttttgctatttgaaatgggaaatcaactggattacttatttatatcagatgtttaaaatttatgagcctcaatttcatgatctatgacatgggaataattttttatatatgtagagttgcaaagattcaattaattatcaaatgtgagctgtgtggcacactgcttagcaattactaacgtctcaataaattttgatgttgcttctatttctaaagcaataaatacagtaagctattggtgtacagtagaaagccatatggcatttatacaataaaattaagctctaaaaacatgagaattataattgatcctttgaatttgcatatagattactcaccaactgttacatcttctgagaaattcctgtctcattgatttaggtgggtgaatgtttagctgtagtgttatccctgtgactagctattatcttcccctgcaaaactcatatgccttttgaccttctgttaaccaactatatttgcaaatggaatttcaatattattattttctaactatctcttttgttcctgatatctcagagctatattgagaggtaactgatattctaatttgccctatgtgtcttggataagtaattaaatctaataattggcaagttgtcatccagaattttagaaagcttaattctgagaattattgagtagttcagaagtgcctctagaagggaagtttaaatctgtgactaaaagattaatactagttaaaagaagcataaaaatgccagcagtaacaatattgaagccaaatttaaaacaaataattctaggattaaaagctgcagaggtgtcatcacttccaccatcaattgtcttggatgccaaggaaatcacaactcaaattacgagacaaattttggtaagaaactttgttcttatttgttcttcaaattaaaaaaaatacttttagtgtagatttttattatgacctttgatctaaatatataataattaatataataattaaaatatttaaaattaaaacctaatttctaaacaaagaaaattaattttacttcttaaaactcttttggtttggtctattataatcctcgcagcaaatcagctaacaagctaggagataaaaattaaacagtttagtttataaaataattattgctatactaactttatgatgaggaaataaatctattttaagtggacattaaaaatgaaaatcactatgcacaatatttgtataattatatattttttatagttttcaaagcttttctactcatcatatgtaagcctcataactcttcatgaagtaattaggtctttatagtaaaagattaaaaaaggattacttctactcttaattttacaggttcacagaggttaagtgatttgttaggaagcagtaggttcaacactaaactcacatctgttgactcaaaatttggaaaattttggttgctttatataagtgtttttggttttggggttttgtttgtttgtttgtttgtttaagatggagttttgctcttgtcatccaggctggagtgcaatggcatgatctcggctcactgcaacctccgcctcctgggtttaagcgattctcctgtctcagtctcctgagtagctgggattacaagcgcccaccaccacacccggctaatttttttttgtatttttcgtagaggtgggggtttcgccatgttggccaggttggtctcgaactcctgacctcaggtgatccaccaacctcgggctcccaaagtgctgggattacaggtgtgagcaaccgctcccagctgctttacagtgttttaaaaatgcaatgtgttcagtaaactgacctaggtgcagtgtgatattttcttcaataacaattttctgtgtccctcactctttcttaacctgtcttccatttttaattcctctctcctttaagttcctctactgtctctgtgacttcacttgcctaattatctatttgaatctcttagtcagaaattttaactgttctgtactctgaagaagctcttattacctaactctttagagttcatcttaccacatttcaattatggaccacctctctactagccttctagtaggctttgattctcctaatgaagtttgaaaaatattcgaaacaagctatttttatccactgcaaattcatatattctgattttagttgaatattttactggataattgtgatttttttctttttttaattgataatagttgtacatattttggggctacatgtgatattttgatacttgcatgcaatgtgtaatgatcaaatcagggtagttgggatagccatcaccccaaacatttatctttacttcatgttgaaaacattgcaattcttatcttctagctattttgaactatacgacacatattaactatagtcaccctactgaactatcgtacactagactatttcttcaatctaactgtatttttgtacgcattaaccaacctgtattcatctccttcctcctccaaacccttcctaacctctagtaaccatcaatgagctcttcacctccatgagatcaactcttttagctcaggcatatgagtgagaacatgtggtatttgtctttctgtgcctggtttatttcatttagcatagtgattctttatccatgttgctacaaatgcaaggatttcatttctttcttttttggctgaataatattccattgtgtatatttaccacattttctttatccattcatctgttaatggacacttaggttgatccatatcttggctattgtgaatagtgctgcaataaacgtgggaatatagacatctctttgatatacttattttctttcttttggatagatgcccagcagtaggactgctggatcatatgatagtgctatttttagtcttttgagaaccctccatgctatttttcatagtggcaatactaatttacattcccatcaacagtgtatgtgcattcccctttctctatcctcaccagcatttgttaattgtctgtcttttggataaaagctatcttaactaggtgagatgatatctcattgtggttttgatatatatttccttaatgactggtgatgttgaacattttttcatatacctgttggctatatgtttgttttgttttttaatcttttatttcacttatgttgttccctctgctaagaatttaattcctcttcctccatctacctcatccatataatttttatttaacatttttacctagctcagatgtgaacttccccaagaaacttccctgaatttttttccagtggagcaatgtactcatttcttgttcttaaaggccccttttcacaacaactatgatgtagttgcaataatatatccacattgcctattttttgtttatttttattttactttattttagattgagggggtacatgtgcttgcttgttacataggtatattgcatactgctgtgagttgggctcctagtgtacccaatagccagatagtgaacattgtaaccaataggtaatttttaacccttgccacctcctaccttcccccttttgtccccagtgacagttatttccatctttatgtccatgtgtacccattgtttagctctcacttataagtgagaacatgcagtatttggttttctatttctgagttagttcatttaggataatggcctccaactccatctatgttgtgtaaaggacatgatttcattcttgtttatggctattagtattccatggttttctttatgcagtcaactattggtgggtgtttaggttggttctatgactttgctattgtgaatagtgctgtgatgaactaggtacaggtgttatatatgtgtatgtatatatatatatatatatatatatatatatatatatatatatatatatatatatatatatagttcttttagttctttgagaaatctccgtaaggttgaactaatttacattcccaccacctgttggctatttgtatgtcttcttttgagaaacatctattcagatgttttgccaatgttttaattgggtttatttggtgggatttttttgctattgagttgagttacttagatgttttggttattatttctttgttattattttgcttaatttggttgtcagaaggagagcttgaaaatatttcctccccttctgtaggctgtctcttcactttgttaatttttttttttgctatgcagaagctttttaacataatgtaattatataagtgtatttttgcttttattgcctgcacatttgaggttttacccaaaaagtctttgcccacattaatatcctaaagcatttcccaatgttttcttcaagtagtttcatagtttcaggtcttacatttaagtctttaattcattttgattagatttttatatatggtaagaaatatgagtctggcttcattcttctatatatagttatctatttttcccagcactatttattgaagagactgtcttcttggtatcttgttgaaaatgagttggctgtaaatgcttggacttatttctgggttctctgttctgttcaattttttgatgtgtctgtatttatgccaggactctgttgttttggttactatggctttgtagtatattttaaagtcagatagcatgatgtttctaggtttgttctttttgttcagggttgctttgactatttgaagtattttgtggttccatataaattttaggatttttttccacttctgtgaagaatgtctgttattttgatagggattgtattgaatctatagattacattgaatagtattgacattttagcagtatttattcttccaatcaatgaacacatttatagcaatatttattcttccagtccataaatgggatttcttcttgtatttttttcagtttgttcactattgacgtatacaaatgtcactgatttttatatttttggtggagtctttagggttttctaagtataatatgtcatctgtaaaaaggatattttgacttcttcctttccagtttggatgccttttgtttctttctcttgcttaattgctctggctaggacatccagtactatgttgaataaaagtggtgaaagtgggtgtccctgttttgttccagaagttagaggaaagactttccatttttactcccatagtattatttagttgtgggtttgtaatgtatgtcctttattgttttgaggtgtgttccttctacacccagtttgttgagacgttttgtcataaaggaatgttgaattttgtcaaatactttttcggcatctattgaaaagatcacatggtttttgtccttgattctgttaatatgacatatcatatttattgatttgcatatgttttatcattctggcatccctgggatgaattccgtgtaatcatggtgaatgatcttttcagtgtgttgttgtatttggtttgctagtatttggttgggttcttaatttatgtttaacaggaatattggcctgtagttttctttatttgttgtttcatagtctggttttgatatcagggtaatactagcctcatagaatgagtttggaagtgttccctcctctgtaattaattgaaataatttgattagacttgctattcattcttctttaaaaatatctggtataatgcagcagtgaagtcatcaggtactggcttttcttctttttctttttctttcttttttttttgacaggatcttgttctgttgcctggactggagtgtggtggtgcaatcccagcccactgcttacttgacctcctagctcaagtaatcctcttacctcagcctcccaaatagctgagaccacaggtacacaccaccacatctggctaatttttatttatttactgttttgcagagatgggggtctccctatactgtggggttttctttgaagggagattttttattattacttcaatctcattattcattataggtctattcttgttttctatttcttcatgcttcaatcttggtaagttgtatgtctccagaaatttctttctttcttttaagttttccaatttgttggcatatagttgtttacaatagtctctaatgatcctttgtatttctgtggtatcaattgttatgtctcctttttcatttctgattttatttgggtcttctctctttttagttggtctagtaaagatttgtttgtcttttgtatttattttagtttcaacttcatttatttctgctttgatctctattatttcttttcttctaccaattttaggtttggcttgttgtttttgctttcctagctttgagaagtaccacgttaggttgttgttgtttttttttaaatgtttctacttttttgttgtaggtgtttattgctataaacgtttctcttagcaatatgttgctgtatgtcatagattttagtatgtcatgtatttttttcaagaatttttaaatttttctttttaatgtcgttattgacccattgattgttcaggggcatgttgtttattttccatgtatttatatatatagtttccaaaagttcattctgttattgatttctagttttattccattgtggaataaaatatacttcatagggtttcgacatttttgaatttattgacacttgttttgtggcctaatgtattgtttatcctggagactgtttcatgtgatgatgagaagaatttgtattctgcagcagttggatgaaatgttctgcaaatgtcagtgaggtccaggcagtctagagtgtagtttaacttcagtgtttaattgttgattttctgtttggatgatctggccattactgagaatggaatgttgaagacccctactagtattgtattgcagtctatatttctctttatatctatgaatttttgctttacatatttggatggtccactgttgggtgaatatatatttataattgttatgtcctcttgctgaattgacccctttattattatagaataacattctttgtctctttttacagtctttgacttgaagtctatcttatctgatataaacatagctactcctgctcttttttggtttttatttatctggaatatcttcttccatccctttacttttagtctagtatgactttgtaggtgaagtgagtttctagttagcatcatacagttagatcttattttatttcttttattttttttgaggcagagttttgctctgtcacccaggctggagtacagtggcttgatctcagttcactgcaacctccacctcccaggttcaagcgattcttctgcctcagcctcccaagtagctgggattacaggcacccgcctgtacacccagctaatttttgtatttctaatagagacagggtttcaccatgttgtccatgctggtcttgaactcctgtttttttaagtcttgtttttttaatccatttagacactcttatgtcttttaattggagaatttaggacatttacattcaatactattactgataaagacttactgctaccattttgttacttgttatctggttgttttgtaagtgctctctttcttcctttttgattaagtaattttttctggtagtatgttttaattcattgctttatatttttaatatatataatatatatacaatattatatatattatatataatatatacatattatatattatatatatataatatataatatgtatatattatatataatatatataatatataatatattatatattatataaatttaaatatatatattttaatttatgattttcatgaggcttataaaatattttatagctataacactttattttaaacagataactacttagttttgaccatagagagaagaaagtaacaaacaatggaaaaactgaaacactccgtactttaacttcattcccctgacattttgattttttcttgtctcaatttacaccttcttatattgtctatttctttaaaggtgtctgtagttactattttcataaacgtgtctttttttttttcttttttttttgagattgagtctcactctcttgcccaggctgcagtgcagtggcgcgatcttggctcactgcaagctctgcctcctgggttcgcaccattctcctgcctcagcctcctgagtagctgggactacaggcgcccaccaccacgcccagctaataaatgtgtcttatagtctttatgttagagatatgagtagattacacatcacatttatagtattagagtattctgaatttatgtacttacatttaaacttcaagtttgtttgtttgtttgtcttttgcatgttagcattctttcctttcagatttaagagctccctttaacatttcttataatatgggtctagtaatgatgcatttcctcagcttttgtttgtctagaaaagactttttctctccttcatgtttgaaggaaagttttgctaggtatagtattctcagtttgcagtttttttcccttcagcactttgaatctgttattccactccctcctgatctatatggtttttgttgagaagtctgttgccagatgaattggagctgctttatatgttatttgcttcttttctcttgctgcttttaggattctctttgtccttgacctttgagagtttgattattatatcatttggcttgtcttatttgggatgaatatatttggtgttctgtgacctcttgtacctagatattaacatatttctctaggtttagtaggttttccattttattcctttaaataggcattctactctttgctctttctcaattctctcttgaacaccagtgaatcttagatttgctcttccacggtgtatctctctctctctctctctctctctatacatatatatatatatatatatatatatatatgtataaaatctttcaggctgtctttattcctttcattctgtttttttttccctctgactatatcttggcttactgcaacctccgcttcttggattcaagtatttcttgtgcctcagctacccaagtagctggaattacaggcatgtgccaccgtgcctgtctaatttttttagtgagacggggtttcaccatgttggccaggctggtctctaactcctaggctgaagtgatctgcctgcctcagtctcccagagtgctggtattataggcatgagccactgtgcctggctaatctcactgattctttcttctgcttgatctatttcttttttggagagcctctgtagtttttttaagttcaacaaatgtatttctcagttccagggtttcaaatctgtttgccatttgatttttaaaaactttcatctgtttttttttttttttgagacagagtctggctctgtcacccaggctggagtgcagtggtgtgatctcagctcactgcaacctctgcctcctgggttcaagaaattctgctgcctcagcctcctgtgtagctgggattacaggtgtgcaccaccatgcctggctaatttttgtatttttagtagaaatggagtttcactgtgttggccatgctggtctcaaactcctgacctcaaatgatctgcccaccttggccttccaaagtattgggattacaggcgtgagccaatgtgcccggccaaactttaatctctttattaaatttctctgataaatttatcagttgctttttctgtgctgttttagagttcatgaattttcttaaaactgctattttgaattcttgatcttagagctcacgtatcaccatctcaccacgatgttgatcaccagctccttgctttgttcatttggggagatcatagtttcctgtttgctcttgttccttgtggatatatatctatgtttttgcaatgaaggatcagtttatcttcagtgtctcgcttgttggactttctaggttgtatgtttgcttagaagttctttgcaattgtctgtgattccccttaatcctagattgctgcctcattttcagcactagatggcaccttaagcccagaatttcctcagctctggcaaatgtttgcagtactacacatctcagatggtagggttcttagaggggatacctcagctgtgtggaaaggctggctaggggtttatacccagatgacctgtggcatctgcttcctctagcatggtgctgctgtacatccacactgatttggtgtctccttcgactgaaatgaggagtagttttacaggctggagtttctaattccactcccctttttgtctctagctgccctcaggcggttttctccctccaggcactagtggtgcttcctgtgggtttaggcaggaatgatttttctgcaagggaacccaggatggtggggaagctggctatccacctcaatctcactttttccagagtagaacaaatgagattgggaggaattttctgtgcatgatgcctggcagattggggcacggacattgcagatagagaactttctttctttttatagtctgctcagagtttttcacttctctgtctcccaactatcatttcagcctcagatttggcttctaaaatgttgctggtgttaatctgtgctccagatatttgcttttggttctctgtggggagagcaaaggcagactgcttctactctgccattttgttgatatccagaattgtatttttttttttttagtatatactttaagttctgggatacacgtgcagaacgtgcaggtttgttacataggtttacatgtgccatggtggtttgctgcacccatcaacccgtcatctaggttttaagtcccgcatgcattagatatttgtcctaatgctatccctccctttgcctcccaccccctccccccgctgacaggccatggtatgtgatgagaattgtatttttttctttttatttattatttagcttcttttacgataactcttttgaaacagtttcactcttcctgtactctcaatcacttcactttctacagataatctgcctcctactttttaacaaatttgaggtcatcttgatgagttcttgaacctcccctccttcaaaattttgttttgaatatttctgtttttcttccatctctcttccatcttatctcagaggaagagactgactttcagacagaaggttaactattctaccttttaaaaaaatctccactaagttattattacttctcagttccctttattctcttttgcatctttaatattttcgtcacaggcttttcctttttctaagagtatgcttagatttctcccctaaaattctgcctgtttactctacttttcaaactattatttcattttctttttactgcaaacttatcaaaagtaacccatgcttgcttctttcatttctcatgtttaaactgagtcttattgtcatcactctccccaaagttttctcttaaataccaactaattataaaatcctttgtccttcttttcacttctgatcttccatgatctctctatggcacttgacactacccttgttttctcttttcttaattctgccctctcttggctatgtggaattattctctcctggatattttcattctcctacctgtttgattatttcttctgtcccttcttcactagtactttttcttttctttttttttcttttttttgaaacaaggtctcactgtgttgcccagcctggtttttaacaaattcctgggctcaagcattccacccgcctcttcctcccaaagtgctgggattacaggcatgaaccaccgcacccagccatcatcattactttttcttattccacttactaaatataaaagtttctaagatttttgcccttgtttcttttctttctaaaatctgcacttggtgatctcatcttttctcacagcgtccatcatcatttctgttcaactctgaatctatatatttttctccatatttctcctacatatcttaatctatgtttaaaagccaaagttaaatttatcatcttctaaaaaaaactcttatctcttcacctttaagtctcccagtgactcaccaaagtcatatatggatcattcctcttaatcacctgtcattaggactatgcagtaagttctctctctctctcaatctatttatatacacttctaccagattgtctcctaatgcatagtttttattatgtagtttgcctactcagaaacttttaatgatttattacaaagtaaagttgaactcctttgtctagtgtaaaaagtcctctgtaattctcaaaatatattttagaattacctgcattagaattgcctgagatacagggtaccatactagattgtcaaggatcttctgtggctcagggatttgccttcttaaccagtttttacgtgattgtaaagcttattggcttctgcttcatgattttcctttgttttctacacctcccttacataatatcactcggtttcacgtaatctacatttctgcaatttcaatcttgtaaattaaattacttgtcattactacattgaattacttgccatttcatcatattgacctgattgtgtaccatgctttcaaatgtacctgctctaactgtttcctctgtggaataccccctcttctaggctgttttatctatcaggattaatttcaatactccatcctattcaagcttttcttggcctgagctggaagtgagtttcccttcctctgagtattttatggctgttttatgggacttttcttaattattataatcagttgcttacaacaagccttttgtttttttaaccattaagactgtaagctccttgagttctgttatcatgtgaggtttacatttttgtatcccccatagatatataaacgtaagcttagaggcctggaacatagatgatagtagatattcaataactttcttaaaataatagactaattggtaattgatctgtgtaccaaatagatagatgggtgaatatatggtaatcttattctacctcataaaatcttactcatttttcctatagtgaaaagtaaaaaaaaatctggagttgcttgctattatgagttgaagggattatatttcagggaaactcactaagactttccataaaaagttaagattaaaaatgctgatttctctatctagttcaggcaaagaggtgaaataagaattttctaggtatatttgcagtcctgaagttctattcaagaccaagcatctaaaggacttctacattcctgttttacatattatttcttgggtatcccgaagtttagtttattaaaaattaaggcatgattttaaatagctattcatattatttatttttaaaatgtaatttacccctcaggcagtattttctcttaggctccagcagtttctatatatgtactctctttaggggcaagcaattttctgatgacccattctgtgtaccagtttatctgttggggaattaaagtaggagatagcagagtagtactctttggcatcatttaaaagtatattaccacatagcaatgaacaatgctgttttcccatacctttttaatgggaaagtgtttgtagagtctatctctggtggattttctattacttttcggtattatgttgagaaatctgacctatttagcataatttttttcattgaaaagtgatttcaagaacataagatctgtgataaagtaacaaatactcagaataaattatgttctttcaaatacaatatttcttttatttcttcttgtatattctttccttgttggaggaaactgatttgttcaaaggaattagttaacccttgagttccatatgtctatggaaggagatagaatattgccaacatgtggtttaaataaaaattatggtatttgtgtatatatatatatattttttttttttcaatgacagcaaaaccaaaggagtacccctgagatggaaagacagagagctgtgtaccatctagccactaggcttgttcaaactgctcgaaactctcaattggatccagacagtttacgaatatatttaagtaacctcaagaagaagtacaaagaagattttcccaggactgaacaagttccagaaaagactgaagaataatcacaattctaatgtaataatatatcttaattcaaggaacctagaatttatttttctccttagagataaggaaaataacatttgccaaatttcatattttaattgaaaattacattatattaacatcacaattgtcatctatatattctatatgaaaaatatttattataacttaacaaatgagaactacttaaaggaatggtttttatgttaggagaaaatacaatacaccacttttttctcacaaaaattcacattattaagacctaagttcatttatacttacaagttatagtttaaaatattattgtaaataccctagtttaataaacacctttctttttaggtctg

SEQ ID NO: 61 - DNA, 22731 bp, Homo Sapiens
agcggttaggagggcggggcgcgtgcgcgcgcacctcgctcacgcgccggcgcgctccttttgcaggctcgtggcggtcggtcagcggggcgttctcccacctgtagcgactcaggttactgaaaaggcgggaaaacgctgcgatggcggcagctgggggaggaggaagataagcgcgtgaggctggggtcctggcgcgtggttggcagaggcagagacataagacgtgcacgactcgccccacagggccctcagaccccttccttccaaagggtaacctccgcgtgacaggaatgagggtggggcgcgtggagtttcccacaatctgtactttagttaaatacccgagaattcacctcctgtgtccacagctctccacgcccctcagccctgccccgcagccctgtagcagaagtacttagtgctttgcattctgcgcgccaccctaccccggcctcctctgtgaatcgttgcttccgaaccgccctcactttttgcatccgcagagcctccaagctcatggcctccttaggagcgaacccaaggaggacaccgcagggaccgagacctggggcggcctcctccggcttccccagcccggccccagtgccgggccccagggaggccgaggaggaggaagtcgaggaggaggaggagctggccgaggtctctgaggggagtagaaacttgaatggagagttgatgggaagttagaataaaagagggttgggagccgggcgcggtggctcacacctgtaatcttagcactttgggagactgaggcgggcggatcacctgagctcaggagttggagaccagcctgggcaacatggcgaaaccccgtctctactaaaaatataaaaattagccgagcgtggtggcacgtgcctgttatcccagctactgggaaggctgaggcaggagaatcactgtaactcgggaggcggaggttgcaatgagctgagattgctccactgcacttcagcctgggcgacagagcaagactccgtctcaaagaaagaaagaaaaaaaaaacagggttgggaagagctgggcaagtctcttacctcctgagtggctgtttcacattcactaaatgggggtgatgatgcctatctcagagatttgagaaaatgattaaattatataagacatggtaaaccctacacttatgagtgattctaatagtgatttcctttcttccttgctggacagatccatctgtgtgtgctgtggaattcaggatacttgggcattgcctactatgatactagtgactccactatccacttcatgccagatgccccagaccacgagagcctcaagcttctccagagaggtggggatggaaccatgaattcctctgctctctgggattgcagatgtgttacacacacacacacacacacacacacacacacacacacacacacacatattttttttttctagacagagtcttgctctgttacccaggctcaagtgcagtggcgcaatcttggctcactgcagcctccacctcctgggttcaagcaattctcctgactcaacctcccgagtagctgggactacaggcgtgtgccaccacacccagctagttttttgtgtgtgtttttagcacagacggtgtttcaccatgttggccagggtggtctcaaactcctgaccttgtgatccgcccaccttggcctcctaaagtgctgggactacaggtgtgagtcaccacgcccagccatgttttacttacattaactcacctcactgtctagcatattttgtgttgctgtaaggaaatacctgactctgagtaatttgttaaaaaaaaaaaaaaagttttatttggcttatggttctggatggttggaaagctcaaaattgggcatcttcactggtgagagcctcagactgcttcaactcatggaagaagggaaggcagggtgtgtagaggtcacatggcagagaagaagcaagggggagggagatgccaggctctttttgacaaccagctctctcaggaactaatagagtgagaacctctcactcatacccaccaacacactccaggaagggcattaatctgttcatgagcgatccactcccatcacccacacacctcctgctaggccctacctcacaacactatcacactggggattaaatttcaacacgatatttggcagggacaaatcacatccaaactatagcactgactcaatatattttacagttgcttcacagaggctccctcttttgtttttatgaattcatttcattatttaacaaatatttgtgaggctgttttttggtttgtttggttgttcttttttgagacagtgtcttgctccgtcactcaggctggaagtgtagtggtgccatcttggctcactgcaacctccgtctcccggattcaagcaattctcctgcctcagtctcccgagtagctgggattacaagaatctgccatcacgcctggctaatttttatatttttagtagaggcagggtttcaccacgttggctaggcttgtcttgagctcctggcctccagtgatctgcctgccttggcctcccaaagggcagggattataggcatgagccactgtgcctggccacaaatatatatgacgtatttacaatgtttcaggtgcttcagattcagccctgggcaaatcagtcatgtctgttctccaggggtttacagcctagtgacaacatccagaacatcccacttccctctcaccatcccaccactcttaactacttttctaaatctcaacttctacctgtgttcccactgtgcagagcactccctactcctagggaggaaatgtttttgagaaggagaggggtaggaagaggagggctatgggttttctcttagtcaaagacaaagatcctttaactcatttgatctctgttctccttccaagttctggatgagatcaatccccagtctgttgttacgagtgccaaacaggatgagaatatgactcgatttctgggaaagcttggtaaggacttggtaaaggatagagggaaaatggggaaggactaatatatggaatattccagggggctagaattgggtgagagggagtgtcagacagaggtagaaggactgagatgtaaagaatgatagccttttctttcctcccccacagcctcccaggagcacagagagcctaaaagacctgaaatcatatttttgccaagtgtggattttggtatctccttccttttgctttgcctaactccctgttccggtgtcccattctttcccccaactctaccttcatcatcacagatctcccctctgccttatgtcatcctaaacctttgtgctcctcatgccctatgacctgtccccccaagatctctcctgctccctaccctttaataacctgcagcttattgggaagcctctgcttaagtcatgtctagggatgagggcctcccctgaggagtggtgacactttttggacagggttttattgttggaattctccccattaagttaaagccttttatcaccaaaccaaaaggcactgcctcagtgacccttattatgatccataaggcacttctataactttcctaggtttacaataagaacaggagtgtactatcctaattagatattaaggcattagtgttactagttctattaataccattattttgaccaaaatcctcaattccagacagatgtctactttcctcagccatttatctttctcaggctgtgctttcagacaagtatctttatattatatgtagaataaaaagagaattagactaagagtctgaaaatttggttcttgctctagctttccattaactgcctgtgtgagcttgggcaagtcaaataatctctcttgcttctattgtctcattcttaaaatggggtgaaaaaattgagctacaagaccgttccctttgcttgcctccctcaaataggtctggagataagcaaacaacgcctcctttctggaaactactccttcatcccagacgccatgactgccactgagaaaatcctcttcctctcttccattattccctttgactgcctcctcacagtgagattggtcctgggggataagggctgggaggcggcacaagtgctagggctgaattctgggaggtactggcctagccctggaaaatagtaactttccctggtgctctgcagcccccaggagatttaagatttaccccgattccactgctgatcccctcccaggttcgagcacttggagggctgctgaagttcctgggtcgaagaagaatcggggttgaactggaagactataatgtcagcgtccccatcctgggctttaagaaatttatgttgtaggtgattcaccccaaccccaaccaaagtaatgtgggattgggaggcctgaaaagtaaagtgggggtggggtgtggatgtggctgtgacccagtgggtcaagtgctctaggacacccgggagaatctaagggctaatgagactttgggaagaagactgggacaatattcagagagggggacaaaggaagtggagttgtggaacgaactcagactgcttcctgcttttttgttttctgtcctcaggactcatctggtgaacatagatcaagacacttacaggtaaagaggtggaggcatgctgctgtctctggggagggagaaggattaagtttaatgccccaataatcctaatgaggctctagtttccctaatcctggggctattaagatctctctccttgaaggaaagggaaggggggttttgagggaaagagaggaagaaaagcataaagatactagctttcttttctatagggagaaactgaggcaaagaaaagtaagggacaaaccttacatcaagatatgatctcggctgggcgcggtggctcatgcctgtaatccccgcgctttgggaggccaaggcgggtggatcgcctgaggtcaggagtttgagacctgaccaatatggtaaaaccccgtctctactaaaaatataaaaattagctgggtgtgttgtgcgcctgtaatcccagccactcaggaggctgaggcaggattgcttgaatccaggaggcagaggttgcagtgagctgaaattgcaccactgcactccagcctgggcgacagagcgagactccatctcaaaaaaaaaaaaaaaaaaaaaaagacgtgatctcaggaggatatcccctgtccccattccatttatcagtcctcaattcttattcccttcaaaagtccaagttaccccaaactcctccatttctcctcgacagtgttctacagatttttaagagtgagtctcacccctcagtgtacaaagtggccagtggactgaaggaggggctcagcctctttggtaggtgtgccccatccctcatctcacattacaaagacctaccagaaaagcaattggctccaaagatgtgtcccagcctcccttcccacttcactcccattgtcagatatctctttcatgccaatccaaatttcttacctatttgtaccccccgccccccaagcttgagcatcttcccatactttgtggctgtacagtgttgttgcatatcagccattactttaccaattctgtgttccttccctgggtttgtatgaatgtttctactagttgggtacctgttagggactttgggagaccttgtgtatagagaagagttttgtaactgcataactgcctatttgatttgtatagagtctttatcagttgtctctggctttagggtatattagggacatctccgcaaatatccatatagtttcatatctcagtaagttgtgtccaggttttttttttttttttttttgatacagagtctcgctctgtcgcccaggctggagtgcagtggtgcaatatcagctcactgcaagctctgcctcctgggttcacaccattctgctgcctcagcctcctgagtagctaggactacaggtgcccaccacgatgcctggctaatttttgtatttttagtagagaacgggtttcactgtgttagccaggatgatctcgatctcctgacctcgtgatccgtccacctcggcctcccaaagtgctgggattacaggcgtgagccaccgcgcctggccagttgtgtccagttttgtgtgtgtgtgtgtgtgtgtgtgtgtgtgtgtgagacgaagtctcgctcttgtcccccaggctggagtgcaatggtgcgatctcggctcaatgcaacctctgcctcctgggttcaagcgattctcctgcctcagcctcctgagtaactgggattacaggcacctgccaccacgcccagctaatttttgtatttttagtagagacggggtttcaccatgttgcccaggctggtcttgaactcctgacctcaggggatccactcgcctcagcctcccaaggtgctgggattacaggcatgagcgaccgcgcccggccgtccagttttttacatatgtgtgttgggctcttgagttttttgtttgtttgtttgttttttagatggaatcttgctgtgtcacccaggctggagtgcagtggtacaatttaggctcactgcaacctccgcctcttgggttcaagtgattcttctgcctcatcctacctcagcctcctgaatagctggaactacaggcctgcaccaccatgcccagctaatttttttgtatttttagtagagatggtgtttcgccatgttgcccaggctggtctcaaactcctgagctcaagtgatcctcctgccttggcctcccaaagtgctgggattataggcatgagccaccctgcccggccagctattgagtttttgtatttttggaggggcgggagggctcttgagttttttgtgttttgtttgtttgtttatttgtttcgttttgttttgagacggagtcttgctctgtcacccaggctggagtgcagtggcgcgatctccgctcactgcaagctctgcctcccgggttcatgccattctgcttcagcctcccgagtagctgggactacaggtgcctgccaccatgcccggctaattttttgtatttttagtagagactgcgtttcaccatgttagccaggatggtctcgatctcctgaccacgtgatccgtctgcctcggcctcccagagtgctgggattacaggcgtgagccaccgtgcctggccagttcttgagttttaactaggtctgctttgtgtatttttctggctaagtgtccctgtgagtgtccatcccttcccccatctccatgtacggtaatcccagctcatatttgtggccaggcaccagctttggctgcctttgtgccctcccaggccagcttcctcaacaaccagcacctctgacctggatgcctcagcttagacacataaacacattccattccctgtccctgccttgtaacaagttcactccctgccttatccctcacaggaatcctcaacagatgccactgtaagtggggagagaagctgctcaggtgagtgggtcccacacatactacacactaatgcatgaattccatatgcacactacatactaaagcctactaatggcagtatacagattctcacatacaccaccccacctagtagtagtaaagcaactgccctttactgagcactggctaactgcatttcatccttataacagctttgtgtagtagctgatatgcatctcattttttgttgtcagcgcaggtacacatatacccattgatgatacacagacttgcacacatacaagcagcaggaaaaaacacaaaatgtaaggccgggcacagtggctcacacctgtaatcccagcactttggggggccaaggtgggtgaatcacttgaggtcaggagtttgagaccagctggccaacatggtaaagccccatctctactaaaatgcaaaaattagccaagcgtgttggtaggtgcctgtaattccagctactcaggagactaaggcaggagaatcgcttgaacccaggaggtggaggttgcagtgagccaagattgtgcactgcacttcagcctgggcaacagagtgagactccgtctcaaaaaaaaaaaaaaatgctaatgtaacacatggctatgttagcatggttatctttagttatagaaaacacacttcacatttctgtgatgactctcaaatttgtgtctctagttttgaactccgtatgtgaatgttaattgcatatcaccacctgcagttttcacaggcagctcaaactcagagcatccaaactgatgcccaccagatctgttcctcttcctgcattccctttgctggttaatggcattgctggcagtacaccttctcaagccatgaaccttggattgatgctagaaacaaaaaacctgtcattccaaaacagagatctaagcatgtcactcctttttttttttttttttttttgtgactgagtttcgctcttgttgcccaggctggagtacaatggcacgatctctgctcactgcaacctccacttcccgggttcaagcaattcttctgcctcagcctcccaagtagctgggattacaggcgcccaccaccacacctggctaatttttgtattttcagtagaggcggggtttcaccatgttggtcaggctggtctcgaactcctggtgatccgcccacctcggcctcccaaagtgctgggattacaggcatgagtcactgcgcctggccgtcactccactttttaaatagcctaagtagaaagaaaataacataaaccttaggaggttttcccattaccttcaggattaagattagcatcttaagcagtataatgatgttcagggtccatcacgtttaccccagttttaatttccagactcaccttccaaagccccttctaagtcctttcctactggatctaccttatattctagtcatttagggccacttgccattatggaaacatgtcatgcctgtgtttatgctgctccttctggaaagtctttttttttttttttttgagacggagtctccctctgtcacccaggctggagtgcagtggcgcggtctttgctcactgcaacctccacctcccaggttcaagcaattctcctgcctcagcctccggagtagctgggattacagggacccaccaccatgcctggctaatttttgtatttttagtagagatgggatttcaccatgttggccacgctggtcttgaactgctgacctcgtgatctgcccacctcggcctcccaaagtgctgggattacaggcataagccactgtgcccggcctggaaagtcttttccttgttctgtacctatcaaaatcttacatccaggtcaggcgcggtggctcacgcctgtagtctcagcattttgggaggctgaggtgggtggatgatttgaggtcaggagttcaagaccagcctggccaacttggtgaaacttcacgtctaccgaaaatacaaaaattagcccagcatcatggcgcatgcctctagtaccagctactcaggaggctgaggcaggagaattgcttgaactcgggaggtagaggttgaagtgagcccagattgccccactgcactccagcctgggcaacagagtgagattctgtcttaaaaaaaaaaaaaagtgcatcctcttcaaggtgcaatccaactgttaccctttggcttttacaggtacctgtaaggagttgatgtgcaccttctttgtgctcacatagtgcttgtttatgtttttctagttgcactgtcacatcatgttagaattagcagtcagtgaatctgcttgcctccatagctatgaactctatctagtagctatacctgttacctcagtgtctgacacatggtcttgtacatagtagcactcaatgtgtgaacacaacgcaaatgtaaacgcactggtgacatcatctctaaacagagtggaaacctttgctagcctcaggtgcacaatccttcccctacctcacctcccgctgcaatatgtatcttgtaggagttaatttaggataatctctgaggtcatctccaggtaatcagcatctccaggaatcggcagggtaatttaattacccacacattcttcagtgcttcaggtgcagatctttaatctcagccacagatgggagggagagaattctcagtggagaagagagctggatttaaggtcggggaggaatgcgtattccccaaatggaatcagacagggcatgagatcatataacttgaagaatcatcatataatctaatgaactaaggacaggtgacatatttattaatatttctgtatacgaatttattttaatttattaggaaatacctctaacgtacaaaaagatgtaaataataatatagggccagatgtggtggctcacgcctataatcccagcatttgggaggctgaggcaggaggattgcttgaggccaggagttcaagaactaaaagctgtacaggcaccaagaatatgactgaatgtcacagtatgctctaaagggcactgtcctaggagtctggagacatgattttgagacttagctgttctcattggcggtatgactttgggcaagttgcttatcttttaacggtttcattttctcagttgttaaatttacagtttggtttaactaaagtctctcccagtacgagcagggcgtgagtcagagatacctaagtgtttagtgcagcgcatgtgctttctaaagtggggatggctatttacagactggcctacactgttctggtgggagccctcagtgaccaaggagcagaggtacctgaaacccacccttgaagccatctggatgctccgcttcattcaaatctggggtgttctaacccaaagtaactggccacagactgcaatgtaagatacaaatcttcaggacctagtgtgtgcacatgttggctcttatataagatggcatccttagtacttgttctatgtagaaaagaatttgtgggctcacaagtccctacagagtctcacactctcatggccaataagtatacagggatacccggaattagacaaacacagatgagacatttatttctgtatatgaatttattttatttatttatttattttttgagacagagtctcactctgtcacccatcctggagtgcagtggcctggctcattgcaagctccacctcccgggtttacaccattctgcctcaccctcccgagtagctgggactataggtgcccgccaacacgcccggctaattttgttgtgtttttagtagagacggggtttcaccgcgttagccaggatggtcttgatctcctgacctcgtgacccgccctccttggcctgccaaagtgctgggattacaggcgtgagccaccgcacctggcctgaatttattttcatttattaggaaatacctccaacacacaaaaagatgtaaataattagccgggcgtggtggctcatgactgtaatcccagcactttgggaggccgaggcaggtggaacaccagaggtccggagtttgagaccaggctggccaacatggtgaaacctcatctctactaaaaatacaaaaattagccgggagtggtggtgcacccctgtaatcccagctactccagaggctgagacacgagaatcgcttgaacctgggaggcggaggttgcagtgagctgagatcgcaccactgcactccagcctggacaacagagcaagactctgtctcagaaaaaaaaaaaaagatgtaaataataatactatcgggccaggtgcagtggcttatgcttgtaatcccagcactttgggaggccatggcaggaggactgcttgaggccaggagcttgagaacagcctgggcaacatagcaagacctcgtctctataaaaactattaatagtaatacaaatggccaggcgcagtagctcatgcctgtaattccagcactttaggaggctgaggcaggcagatcacctgaggtcacgattttgagaccagcctggccaacacagcgaaaccctatctctactaaaaatacaaaatttagctgggcatggtggcacacacctgtagttccagctgctggggaggctgaggcaggagaatcacttaagcctgtgaggcagaggttgcagtgacccgagatcccgccactgtaccctagcctgggcgacagagcaagactccatctcaaaaataataataataatacaaatatctatatatccatcagccaatttaagaataagacatgccgggcgcggtggctcatgcctgtaatcccagcactttgggaggccgaggcgggtggatcacaaggtcaggagttcaagaccagcctggccaagatggtgaaaccccgtctctactaaaaatacaaaaattagctgagcacagtggcgggtgcctgtaattccagaacctgggaggtggaggttgcagtaagccaagattgtgctactgcactctagcctgggcgacagagcaagactctatataaaaaataaaataaaaaaaaagaataagacactattggccgggtatggtgactcacgcctgtaatcccagcactttgggagccgaggcgggcagatcacgaggtcaagagatcgagatcattctggccaacatagtgaaaccctgactctactaaaaatacaacaattagctgggcatggtggcgcatacctgcagtcccagctactcgggaggctgaggcacgaaaatcacttgaacccgggaggtggaggttgcagtgagccgagatcgcatcactgcactccagcctggcgacaaagcgagactctgtctcaaaaaaaaaaaaaaaacgaaagaataagacgttgttgaagccccttaaatgtccctccccaatccttttttctctgcagtgttgaccattattatgaattaaagcttatcatccctaatgggacagttatgttttcacaggaagaatatgaaaagatgaatgtctgttgctgttacccagagacactttcacagctaaaaagacatacaaactcatactgactcaccgtctcttactcagcctcagagtgagctgcagtgttggcacacaaatacctcaacacactgctctccttctaaaatattgacaagctccgttacttatatacatggaatgacacacggtcttatccgttgaaactgtgatatgtagacacaattatgctcacatctagcaattttcagtagatacatgtaaacacacctgaatgggtaggacactgcacttgccactacattcccatagcacatcgtggatacatattgccacaatccccagggactgcaagcacactttttggcaaactgagatcaagatgatagatgtaacttgtagtacccccacccaaaccctcacttccaggctatggttcacacgtccgactcatgacctgggggagctcagttctcgtctggacgtcattcagttttttctgctgccccagaatctggacatggctcagatgctgcatcggctcctgggtcacatcaagaacgtgcctgtgagcccagggtggagggcagggaggtggggaaggaggttgagggctgatactgggcagtgggcttcttgaggggcattagagtgagggaagagaaaacagcggctgtaaccttgtctgactgtagctgattctgaaacgcatgaagttgtcccacaccaaggtcagcgactggcaggttctctacaaggtaaggccttccttcttgaatcccaaaagtccaggtaaaggccctcagcctgtattccagactgtctgtaccctagacatgctgtccaattttattctaccctcttttttttttttttggagacagcctcgctctgtcgcccaggctgaagtgccatggggcgatcttggctcactgcaacctccgcctcctgggttcaagcaattctgcctcagcctcccgagaagttgggattacaagcgcccgccaccatgcctggcaaatttttgtatttttagtagagacaggatttcaccatgttggccaggctggtcttgaactcctgacttcaggtgatccacctgcctcagcctcccaaggtgctgggattacaggtgtgaaccaccaggcccggcctccctctttttttttttaactttgtattcaggaaaatgtaaaaaatatttagaataatataattaacccccatgtacccaccatgcagtttcaacactttaacttacgccaatttttttttatttctttttctttttttttttagacagagtcttgctctgtcgcccaggctggattgcagtggtgcgatctcggctcactgcaacctctgcctcccaagttcaagtgattctcctacctcagcctcccaaatagctgggattacaggtgcccaccaccacactggagtgatttttgtatttttagtagagatgggatttcaccatgttggccaggctggtctcaaattcctggcctcaagtgatctgcccatctcggcctcccaaagtgctaggattataggtgggagccaccgtgcccagcctagtatgtgtcatctatatctttttctactttcccctcttggattattttgtgggttttgttgtcgtttgtttgtttttttaaataaggtcctgctttgtcacccatactagagcagagtggtgcagtcatatttcattgcagcctctaacttctgggctcaagcaatcctcccaccttagcctccagagtaactgggactataagcctgagatgctgcacctggctttcttggattattttgaagcaagtcccagccattatatcatttcatccataaatatttcagtgtaatttcttttttctttttttttttttttttgagatggagtctcactctgtcaccaggctggagtgcagtggcatgatctcggctcactgcaacctccgcctcccaggttcaagcgattctcctgcctcagcctcccatgtagctgggataacaggcacatgccaccatgcccaagttttttttttgtatttttagtagagacagggtttcaccatgttggccaggatggtcttgatctcctgacctcgtgatccacccgcctcggcctcccagagtgctgggattacaggcgtgagccacctcacccggccaatatttcagggtaatttctaaaagaaaattattttttaaaaagaataacagtattgttatcttactttaaaaattgtattatttggtatcatcaaatatctgaaatttttcttttttgagacagggtctcactctgtcacccaggcttgagtgcaatggcacaattgtagctcactgcagcctcaaactgttgggctcaagcgatcctcccccctcagcctcctgagtagcagggaccacaggtgatggccatcacaccgaactaagtttttattttttgcttgcatttatttatttatttatttatttatttatttatttatttttgagacgggattttgctcttgtagcccaggctggagtgcaatggtgtgatctcggctcaccgcaacctccacctcctgggttcaagtgattctcttgcctcagcctcccaagtagctgggattacaggtgcgtgccaccacgcccagctaattttgtatttttagtagagacagggtttctccctgttggtcgggctggtctcgaactcccgacctcagatgatctgcctgccccggcctcccaaagtgctgggattacaggcgtgagccattgcacctgaccaattttttattttttgtagagacaggatctcactatgttgctcaaggtggtctcaaactcctgagctcaagtgatcctcctgcttgggcctcccaaagtgctgagactattggtgtgagccacgatgcccagtcagatgatggccctagtcctttttaatctaccggttccttctctatcttttctctcttgttctttctttctttttctctttttcttctcctggcaatttgttgaagaaactagattattatttgtcttatagtgttttccattagcctggattttgctgtttgcatttcctagatgtttttggcacatttctctctcttctatagtttctgtaaattaatatttagttctagaagcatgattaggttcagagttttttttttttcaatactgttttagaagtagaggaacataatgtctgatatgtccgattgtctctctttttctgatgttggcaaatgttctgatgtttaatacctaaatctattattcatttatttatttatttatttagtttgaggtgagtctccctctgtcgccaggctgaagtgcagtggcacgatcttggctcactgcaacctccgcctcctgagttcaagtgattctcctgcctcagcctcctgagtagctgggacttacaggcgcacaccaccacgcccagctaatttttgtatttttagtagagacgggatttcaccatgttggccaggatggtcttgatctcttgacctcaggtgatccacccgcctcagcctcccaaagtgctgggattacaggcgtgaaccactacacccagccatctattaattctttagcaattacaaagtagtagcatttaaatctctgattctttcttcatttattagccagaaatttctgtaaagagaaacttccttttatgtactatttggttgccaagtgatagaaatcatatagaaatacagaaaattgcttgatatttcccccactcttttttttttgagacagagtcttgctctgtcaccaggctggagtgcagtggcacaatcttggctcactgcaacctccacctcccgggttgggtttcaagtgattctcctgcctcagcctcccgagtagctgggactataggcgtgtgccaccatgcctggctaatttttgtatttttagtagagacagggtttcaccatgatggccaggatggtcttgatctcttgacctcgtgatccacccgcctcggcctcccaaagtgctgggattacaggtgtgagccaccatgcccagcccttttttttttccccaatatggaacgcttcttgaatttgtgtcatccgtgcccagtggccgtgctaatccctgtaaccttcgaaatttcagtatatgtgctgcagaaatgagcaccccccacctttatttactagctatcaatatggtaaattagttccctaacattctccaagatagccatgagatttttttgttttttgtttgtttgtttgtttgtttgtttgagatggagtcttgcactgttgcccaggcaggagtgcagtggcgcgatctcggctcactgcaagctctgcctcccgggttcgcgccattctcctacctcagcctcctgagtgcctgggactacaggcgcccgccaccacgcctggctaattttttgtacttttagtagagacagggtttcaccctcttaaccaggatggtctcaatctcctgacctcgtgatccacccgcctcagcctcccaaagtgctgggattacaggtgtgagccaccgcgcccggccctgatagccgatgaggtttttttgtcattgttcttcttgtatcattacagactcatggccttttatagctatatttctctttctcccgactctgtacaaactcctttgttttagagtttgcacaaccctctatcaaagcacctaccacctcacttttaaatcttctgcatgtatttctgtcttccttcctagactgtgagcacatctgggacagggaccatatctttttttgtttatttgttttgttttgagacagagtctcgctctgtcggccaggctggagtgcaatggcgtgatctggctataacctccacctcccgggttcaagagattctcctgcctcagcctcccaagtagctggaattacatgtgcatgccaccaagcccagttaatttttgtattttgagtagagacagggtttcaccatgttggtgaggctgatctcgaactcctgacctcaggtgatctacccacctcagcctcccaaagtgctgggattacaggcatgagccactgtgcctggccaggaccatatcttaattgtctttgtagtttcagtgtttggtacagtgcctctcactgtttctttttgcctttgagatcttccctctttgttactgtgatcttccctactggtctttgttcttctgagtctgtccctatcaccacctcaacccgagctggatgtggcctgtcctcctttttgtgtttctctcacagactgtgtacagtgccctgggcctgagggatgcctgccgctccctgccgcagtccatccagctctttcgggacattgcccaagagttctctgatgacctgcaccatatcgccagcctcattgggaaagtagtgagtagaaggaaaaagggagtgcacccagggaggtcagggagagagaatgcagtgtgcaagatggggaaacatggaagatattgaggtcaattggataaagaatgggatggtgggaggaggcagcagaacttcagggaagtatctggagggtgagagttaaaggaggactgcagggagaattggggcccaaggagagctgaggaacaggacagagggtgccaggtcctaagaaacagtacttatctcctcaggtggactttgagggcagccttgctgaaaatcgcttcacagtcctccccaacatagatcctgaaattgatgagagtgagtgttgggtgtggatgggcctgtgagccctgcgcagtgatggagtaccatccttggcaggtggtcaccacagctggggatcttcatagcaaccagggcaggagactcacttttgataaccacgtgtcttccaccctcgtagaaaagcgaagactgatgggacttcccagtttccttactgaggttgcccgcaaggagctggagaatctggactcccgtattccttcatgcagtgtcatctacatccctctggtgagggcaggagagtgggtgtagccttcagatgtcttttgggggagatattaggcttatgaaagacatactggtagataagaaaacttgtggggcagcctgaagaacatgaacacttttttgtggggatacagggatcttttaagctccctctagggtggggaggtgtccagtaagtctccaagcaggagagtagagtatctcctctttactctccccagattggcttccttctttctattccccgcctgccttccatggtagaggccagtgactttgagattaatggactggacttcatggtaagaccctcaacctctgtaaggtgagtgatgaggaaaatgagtcagcagctgaggaagagcgttactctacagcagcactgcccaatatgggatctctcctctgtagttttactctgagctttaccagcactgagacaaaggaaagagaagtcagagttaggggctggaggtggggttagaaagatggggaaggagaggaggaccaagagatgcaaagtccacagctttgaacccctgtacccagtttctctcagaggagaagctgcactatcgtagtgcccgaaccaaggagctggatgcattgctgggggacctgcactgcgagatccggggtgaggaaaagccagaggttatatgcattgtaagatgtttaaaaaaagcagcagccaggggaaggaggggagtgggcaacttggggatgcttccaacaggcccctcctcttcctgctctctgtctcgctcactctgactctatcttttcctctgaatgtcttgaggtctcagattgtatctgcaacctgtttccagatccccctaggggcctctgcctctccttcactttcccctggaactgacctccagctcccttcctcacccactcccagaccaggagacgctgctgatgtaccagctacagtgccaggtgctggcacgagcagctgtcttaacccgagtattggaccttgcctcccgcctggacgtcctgctggctcttgccagtgctgcccgggactatggctactcaaggccgcgttactccccacaagtccttggggtacgaatccagaatggcaggtaagaatagaggcgggtggaggaatagacatgaggggcccaaaggctacatcttctgggggttcatctatcttgatccacaagccatgcgaggtgcctctccgcccactgcagacatcctctgatggaactctgtgcccgaacctttgtgcccaactccacagaatgtggtggggacaaagggagggtcaaagtcatcactggacccaactcatcagggaagagcatatacctcaaacaggtgaggagaagccctgcagcctgggcctctggcgtctcctgcatctactccacccctacttgccagccaactcaggctcctgcagctcttctcccattttctgaccccgctcttcatgaaaggaccatcacccacatccctgtgcttccacctcacatgttcttattctccactggagagccatgctctaatggaactttccgtggcccaaattccttcacctgcctctgagtaggtacacaccactcccaagtatgtctctgcccacgtcccgtgcctcttcactgattctaaattagcccacagggctatggtcaggattcggggaggagagacagagtcagtgtgtctgttacctatttctcctgtttcaccctgtccatttctctttgatgtgccattcatgccttgagcctcactttcacctcagcccacggcaccaggccccaggccctgtctccttccctattcaggtaggcttgatcacattcatggccctggtaggcagctttgtgccagcagaggaggccgaaattggggcagtagacgccatcttcacacgaattcatagctgcgaatccatctcccttggcctctccaccttcatgatcgacctcaaccaggtcaaagggaacaaagggaggtgggattgaggaaggggataatgggaaaggaacccctgaaaatgctcataacaggaaagcatgccctctgctgcatgccctttatactaaaagtggggagcactaaggtcagagataagaagaatcaataccataaacatttcttgaacccttgtttcatgtgagtcactgttggcaaagaggatgaacaaagcgtgcacctcaccattcaagaacttgcagtgcagtagggagggcatgtatacagctttattcacaggccaactgtggtcagtgcgttacgggcttccaatactaactttcccttgtccaccttatacccagcaggtggcgaaagcagtgaacaatgccactgcacagtcgctggtccttattgatgaatttggaaagggaaccaacacggtgaggggagaaactgatgaggggagaaactaaggaggggaaaatggaggaggatgaaggagcatgacagtgaggctgggcctctggaatggaatagggctgtgtgggcagaaaagaaatagaacacgagacagggaaaggcagtgcaagtgcagaggggcatatggggtccccatggctccgaatgctaacctctgccctctttgcaggtggatgggctcgcgcttctggccgctgtgctccgacactggctggcacgtggacccacatgcccccacatctttgtggccaccaactttctgagccttgttcagctacaactgctgccacaagggcccctggtgcagtatttggtgaggagaccaatctagctcctcggggacccccaggctgggcatttcccagaggtggggattggctcctctatcagaacaagggctccctcagcacagagaccacatcccttcccttttctccctccccacaggattggccaagggtttcaggacaggaaggaggtgattgatgatacactgtcttttattctcttttaagaccatggagacctgtgaggatggcaacgatcttgtcttcttctatcaggtttgcgaaggtgttgcgaaggccagccatgcctcccacacagctgcccaggctgggcttcctgacaagcttgtggctcgtggcaaggaggtgatgagatccaaatgtgcaaccacctccacatcagagctccctttcattcctagtcctactgggcctgggtctaggtccacaggatttctgacccttatttccccttctcttccccactccccttactcctcccaccttcttgcttgttcctaggtctcagacttgatccgcagtggaaaacccatcaagcctgtcaaggatttgctaaagaagaaccaaatggaaaagtgcgtatatggccccagtgtctttaccctctctgcatcttctcctgcaactcttctccccttttcagggactcagccttcctccagcactttgcccttcagaaacccaccatttctttctgaaatccctaaatcttcaagatcccaggttttctgtgccacagcctctcccctctgcccagggatttggttgtccattctgccataaatcttgcgattttctctcttcttcagttgccagacattagtggataagtttatgaaactggatttggaagatcctaacctggacttgaacgttttcatgagccaggaagtgctgcctgctgccaccagcatcctctgagagtccttccagtgtcctccccagcctcctgagactccggtgggctgccatgccctctttgtttccttatctccctcagacgcagagtttttagtttctctagaaattttgtttcatattaggaataaagtttattttgaagaaaga

SEQ ID NO: 62 - DNA, 37769 bp, Homo Sapiens
gaaggaaaaaggaaggaaggaagggtttatttgatgcagattcttcagcattttgttttcacagactcccttcttttcccctcttctggacccacctttttgccatctcaccgttgatgagcagcttcagcttagagggtaaagacaggcatgatcgcgactggccagcatactggccggttctctctgttagcagacttttgccaagggtttggatggaatgggtggctcttcaggtggaaaacaggtcgtgggggtcaggttttgggtgcctgaaactgctcttccttcactccactgtgccatgactggctcccacccgaagcttcagctgagctggcttgtcagggctcgctaggaactgctgagctgcatctgtccttacttggcgtggcttcctcagccccctccacatctcaagaacgtggccttgggcccctttctgctctgaccattttgcttgcctgggttttttcactgtctgccatgcgcagatcccagctgttcatttgtacctgacctctgactgctagaacctctccattcttacatctcatgtagttccaggtccccagccaggttctggatgttacccaagccccctccccattctccagcttcattctagcctacactttatgctttgccttaagcttttctgatactagctcctattaccatctctagtcttaattctgatagtgggactgctagctcctcttctttcaataataaagggctagctgtaactagctgtgactctgtgatacctaacgccagaagaagctactatattctatcattagtttccttgtctttctcagtgactaaagctaagcctcttgaaggtagagacagccataggaaccttcacttctcaatgaagtgttgatgaatgttacagaaaaaggaactctcaagaatggctgcattttacatctcatctctcaagttttactctgaagttactaaagccttcagcgaccagaatctaataaaggtgaatcaccaagtttataaatgaatgaattcctaataaattaaaaatataagggatagcatatgggtaataatgggaaggactgtgcagtttgaagtcactcagacctgggtctgaattctggctcttacagctaagccttcagcaaaccagttaacagctccgagcttcgaagttttattatacaaaggtgacaactaggttcctaagaggaaccttcgtttcccactttgtaaaatggtgataaagctaccaccttacctcatggactgtcaagaaactaaactaagataaagtatgagaaaaattattttgtaaaccttaaagcacaatataggtattaatgattactattataaattacatgtatctttgttcttatggcatctgagttaaaaacaacataaaaccctaacaggcgataaaggtaatctattagatatttttccctaataggttgtttttatgctgaggcatgcccccacacttataaattatgaaaacagaataattatctcttacattgcttgagtcaggctagtcaggaaggccggttacataatttatggaggactttttctaatcctctgctactctcaagaaaacagtagttgggattacatatagcaaaaccttctgaaatcataagaggcactgagacactttttaaaatccctcaaattggtctggccttaaaagatttttacaactcccaggacagttggcctccatgcagccctcaagcagggaggcggaggccctgaggccacactgccacactgggcctggaggcagagcccctgacagcctggcaaatcctctgaaaactctctcctttctaaggtcatgtcttcccatctataaaacatccgtttatatgtatttagaagaataaaagccattttttagacagtagggcctgttcttcaggattccaattacgtaaatctacaaggatccccttgaaaacaagtgaaggttttctctgaaccttctctggggcagacgctaatgaatgcaatactttcattgctcctgtaagattcacttcaaggctgctggcaaaggaacttttcttccatgagcacgaattggtttcctgtattaaaaaatgaggaaaatcattcaattgatataaaagccactttgagcaggctggtcaggaaatacaaaagtagaaattctcattgcatcatcttactaattgtatagcaccccagttgcaataaacattaccagctggctttttgcattttttttctactatgcaattttagtctgttgagtcctattaaccacaaatcatgtgaaaaggtgcgggaaaaatagattgagaatggcataacaagcatttgcagaacgatcagtcctggtcccaagtgatattataagggcaatagataggcataatgtaataacaccaagataccgtttgaaagggacccaaagaacccttgtctcctgaaagaaaaagtgtaaagatatttggttaggttgaacgtatgtatgctgtgttttgatatgacaattgctttcacataaagagatactttataaagtaccaaaaaaaatcatattttaaaaaacaagctcatagtattttcaccattttactggtttgggatattgaacatcagtctctgagtttttaaagaaaacataacaaaaaacccggaacaggactttaaattttctctgttctatccttgtcctttttatcaatagtttttatccctaaaataactaaaggcctgatgaaagaccctagagaatgttttcactgtagtagagaaactctttaagtctgagatgtagcacatgaagcagcagcatagggaagtgaagaagactgaagggaaaagaggggaccagtgcagaaaccctgggggcagcctgggaaggcagactaccccttggacttgagcatcagctgaattagatacacgcaaatgtgaagcttgaaaaaaaactgtacaaaaacaaaaatcacacccttcaaataacaaaccaagcaaccaatcaaactgtcattaaattttatcattaaataagtagcaaaaggtagatactatatagcaaccttctgtgcccatggatgcaaatgaatgaattgtctttaggcttgaatttcatctggctactcaactaggggaatcatctgctcaagaaagactgatacagagagccctgctgtctaagctgctcagggacactgggctgattcagtcagggccgtgctggtacctgctgctgctgctctctgctcagaggcatacagtgaacatccctttgttccttttagaccagtgattctgttctcatggtggctcacagggaggcatggattgctgcaggctctgccttgtatcacactctgcttttccaaagagacgccaggcctgggccattttgcgaagtttagtgaggttgggtttaatctatgggaagaaagaataacttcaattagcaatatgaaaaggtaggtagcatacaggctgggcgaggtgactcacacctgtaatcccagcactctgggaggccaaggcaggcggatcacaaggtcaggagtttgagaccagcctggccaatatggtgaaaccctgtctctactaaaaatacaaaaaaaaattagccgggtgtggtggcgcatgcctataatcccagctactcaggaggctgaggcaggagaattgattgaacctgggaggcggaggttgtggtgagccaagatcatgccactgcactccagcctgggcgacagagtgagactccgtctcaaaaaaaaaaaattgaaaatgtaggtagcatacaaatatttccaaagtctggctgttataatctgtttagatttctaacttctggattcaatagagattacagattgttttaaggatccaaggggactcagaactttaagtctagattcccagctctcagcaatggagaaaaactttcttcatatttttctttgtgaaacaaagaggttttaatgaagtaaaatcagctagttgagtcagacaacattagtacctgaaaactccatgcaagaaaagattttatatcccttagcagggaaaggttagcaaaagaaaagattttgggcagggcgcagtggctcatgcctataatcccagcactttgggaggccaaggtggacagttcacctgaggtcgggagttcgagaccagcctgaccaacatggagaaacgctgtctctactaaaaatacagaattagccgggcgtggtggcgcatgcctgtaatcccagctactcgggaggctgaggcaggagaattgcttgaacccgggaggcagaggttgcggtgagccaagatcgcaccattgcactccagcctgcgcaacaacagcaaaactccgtctcaaaaaacaaaaaaaaaggaaagattttggaaagcagcaacagggacattcctgttatgttctccatgttctccttcactgaagattataacaaggacagaagttcttcatttaagccattctgtgccttttctgcattatccacattgtagtttgcaggttgctgggtaattagggccaaagcataatgtagagatccccaagcttgggtccctgtctgatgatcctcaaaccataactcaagatccttggggatggccagctacagtcacagatcaccgtttccagcaggtactatcaagaaactggaagttgaggctctatattgccaacagtgaatttgctgtgcttctaccaactttcagtagcttcagaaagaactgcatattatgaaacctagagccagcaggcaatagatattcagggtacataagtctgtacatgtgttaagttttaaaatacaaagccattatgtaggtgacctgacagttcagtctaagttccattttggatttgagctggaaaatgaaatgggtgaggctttatgtgaaacttccagtgcagattttgcaaaactctcctattttggaaaggttaagacagattacagttgcatagtaaaagccagaaaagaaagagaaaataaactttgctccctcctgctcctgttagtcattaatgtacctgtttttcctgttccaagtggtctatgtcagctaacggcagcatagaaggtctcccgtgagcacactggaatggcagctggcatgaggacagagcttcaataaggcggcaactttcctgtaagctcaggccatcattaaacttaatggcccctaaatgaaagacagaaacaagaaggttatagtgtatatagtgggaaaccaatgctgaccttgggtcactgccaaatatctggaaaaagtaacatgtttcttaggcttctttaatgaagctttaatcctgcttgaaattggtgcttataggccgggcatggtgtctcacacctgtaatcccagcactttgggaggctgaggcgggcagatcatgaggtcaggagttcaagaccagcctggccaatatggtgaaatcccgcctctactaaaaatacaaaaattagccgggtgtggtggcacgcgcctatagtcccagctacttgggaggctgaggcagaagaatcacttgaacccaggaggcgggggttgcagtgagccgagatcacgccactgcactccagcctgggcaacaaagcgagactccgttctcaaaaaaaaaaaaaaaaaaaaaaaaagagggaaataaattagtgcttatgaccatggatgaaactaaggcttcaggactgaccttctgtctctcagctttttcttacggagtatttgtatttctaatctctgtaggaggcattccttaacttgttaggatctggctttcagagtttttctccaagaggcaagagcagtatttttgcctactctttatgggtttgtgaagttggggttatctttctccatggatcgtccaatagcaatctctgattgtttccttacaatgttcattttatttgcttctttttttctaatttccataataatcttcctaatctaaactctcatattgttataacctgcctttatgcacaatttacccagtcaacaaatatttattaagtatatactttgtattgggagctttgtcaggcagttagtgagacagataatttccatcctcatggcgcttatggtctaataggggagacaaacatgaagcagataattatacaataatttaaatgataaatataggtgctataaaatacaggatatgaatatataataggaagaccaaacccagtttaggagcttaaggaaggctttcctggcaaagtagtattcaagctgagactttaggttaagaaagacgtggctaattgaagaaggagagaaaagtgtttcaggtagaggagaaggccagtgcagaggccccgacgctgacaaatgtttagcacacaggaagcagaagaccaaaaaagcaggctgggatgtaaagaacaaggtggagagtgatatgacgtgacactggagaggcaggcaggggccaaatcacgaagacccttgtgggccacagtaaaaaatcacatttctatcccaagagcaatgggtcatcattgacacattttagttagaagaacaacatgcttggagggatgtttcaaaaagattcctctgggtgctgagagaagagcagcttgaaagggagccagagtggatgtgaagaactaagtaagagagctcaacagtggcaaaaatgagggaggagccagacagactgaatcagacggaccgaagatacattttgaaggtggcaatgatgacatttggtgatagaggagtatgagtctgttctcacactgccatgaagaaatgaccaagactcggtcatttataaaggaaagaccatttaaatgactcacagttctgcatggctggggaggcctcagaaaacttacaattatggcggaaggtgaaggagaagcaggcaccttcctcacagggcctcacccagctccccattttctatattgtatcatattaccctgctcaagaaccctcaatggtgttcgctttggcagcacatataataaaattggagtgatacggagaagattagcatggtccgtgcacaaggatgacatgcaaattcatgaagcattccatcttcattattattattattattattattattttgagatggagtctcactctgtcacccaggctggagtgcagtggcgtgatattggctcactgcaacctctacctcctggtttcaagtgattctcctgcctcagcctcctgagtagctgggattacaggtgcccgccaccacgcctggctaatttttatgtttttagtagagatggggtttcaccatgttggccaggctggtctcgaactcctgacctcaggtgatccatccgccttggtctcccaaagtgctgggattacaggcgtaagcaaccgcgcctgggcgcattccatctttttacaaaaaccctagaagaaaacctcagaaataccattctggacgtaggccttggcaaagatttcctggtaaagactctaaaagcaactgcaataaaacgaaaattgacaagtgagacttaattaaactaaagagcttctccacagcaaaagaaactatcaacagaatagacggacaacttacagaatgggagaaaatatttgcaaactgcatccaacagaggtctaatatccagaatctatataaggaactaatatccagaatctataaggaacttaaataaattaacaagcaaaaaccaaaaaaccctattaaaaaatgggcaaaggacatgaacacacacttctcaaaagaagacatacacatggccaacaagcatataaaaaatgttcaatgtcactaatcattagagaaatgcaaatcaaaatcacagtgacataccatctcacaccagtcagaatggctggtattaaaaagttaaaaaataacagatgctggtgaggctgcaaagaaaacagaacacttatacactgctggtgggaaatataaattagttcagccactgtggaaaacagtttagagatttcttaaagaacttaaagcaaaactaccattcaacccagtaatcctattactgggaatatgcccaaagaaacagaaatcattctaccataaagacacatgcatgtgttatgctcactgcagcactatttacaatagcaaagacatggaatcaacctcaatgctcatcaatggtggattggataaagaaaatgtggtacatatacatcatggaatactatgtcgccataaaaaagaacgagatcacatcctttgcaaaaacatagagctagaggccatcatcctaagtgaattagaaaaccaaatactgcatgttcttacttaaaagtgggagccaaacattgaatacacatagaaacaaagaaggggtaacagacacctgggcctacttgagggtggagggtgggaggtgggtgaggatcagaactacctattgggtactatgctcattacctgggtgacaaaataatctgtacaccaaacccctgcgacatgcaactcacccatgttacaaagtgcacatgtaccccctgaacctaaaatgaaagttggaaagataaaaaaagaacgcttgctaattctaatgccttctgtatcaaatccaaaggttttgctgtgaccttctaggtttctgttctcttacctgcctagtttcttgatactctttgctgcttctcatataactaacttgtttctgttctgcctctctgcacaggctgtttactctccctatagtgaattcccctttccatgctatgaacccatgttccccagctcattcaaaattcatctcaaaatgcatctcctctaggagttattcctccactcatataggtcaggcagcactatagtcaaatttttgtgttgggattttgtttttgtaaaagtgatttttaaaagggtatattcagtttcttgatctaaattgtattctccaagagtcaagtagtaaatgtaccctctgcctcttttgtaatcccggcagccctgccagggctctgcatgcagaggtgtttgatcactgctatgttgaagggcttaccatggcaggcttgggatgccaacaccttctggacagtcagtggcaatgtcccttggatgcctccggtggtctggagtagctaatgcataaacacgttattaacaggaaaagaaaacggaacaacgaagccttttatgtgtggtgcttctgtgtgaaaccccaaaataaaggaaaagcttacctccagttgttctcggataaattcctgcaaagcaaaaggaaaatcggctttaatctacggttatgttttacttgccctttgatagtttacaaaatatctcaattttcttctttaaatcatgcctcctgaaagaaagagttccagcaatacagcacttgggtacaaatttatttgttgtaaggcactttgaatatgaaaaaaccaagcaactgaatagaactcttattgaacacagaatatatttagctactgagacttcctccagagatagcttctcaactaatgaggttatgtagctggtgagagtagccttgatgattcaaccaattcaaaacatcaggaaggcttctcactaaaaggctgtctgtttgtgtgtgtaatcttagccagaacaagcgtaatattacacacaaactgagaataaatacacaacaaccatcaacacaaccactgctcagtataacacttgcttaaatatcataaacataagtaaacagtcactttagttcccacgggctttttggggacaattcccttcaggtcagaaagtttattttctgaggccctttgttgagaaatttctcctcccttgcatgtctctgtccctggggtaaccttttcaatagttatatccctgtggatattaatatttacaaaagaagcttaaagaaatttaaagcagacactatttcatgctaccaatttgtttaacctctggaggtaaaaagaaaaaaacctgttgcacatttaatgatttctttataagaaaatcatttctttactcctggaaaaggctatgtgtaaatctgctcctaagattacaacatggtaccttttcttttaaaaccagactcaggaaattctcttccctccttcatctatactctagtctgccatgcctataaatgggcacagttatcaagagctaggtagtagatactatattacatataatttaaaaatcacatgttttcccaaacaaacctaaacagaaagatggtctcataagactcaatccactgacaaagcttagtgtggatggagagcaaacattcttgtgtttgtacatctgggatggtaaaacatctgtttgtaagcttagtgaaggggtgatgggtctcatctcagtccattttatattccaatggtctgtttaatgctggataatttaatatttttattttattttttatttatttatttagttagttagttacttattttgagatggagtttcactcttgttgcccaggctggagtgcaatggcacgatcttggctcaccgcaacctctgccttctgggttcaagcgattctcctgcctcagcctcctgagtagctgggattacaatcatgcaccaccacgcctggctaattttgtatctttagtagagacagggtttctccatgttggtcaggctggtctcgaactcccgacctcagatgatccgcctgcctcggcctcccaaagtgctgggattacagttgtgagccactgcacctggccgtatttatttattatttttaattttttgagacgtagtctcgttgttgcccaggctggagtgccatggcgcgatctcagctcactgcagcctccacctcctcaccaggctagaagatagagctttatagaaggatgtattaatgatctttcaactgctaggattcaaatagctacctcctcaaaacaccaaaactgttccagcttcttccagaatcacacaaagtctctcctgatcagcctgacataggataatcaagattttatgaaaccagaggtttgtttccatttgaagcaaactccttaacagtagtcttttaagttccttcaggaaaagtttttcttataattttctggttacatattagggattgaattacaataaaagactctaacagatcctatcttttggatttaggacaatttggagcaggggtcttagagaaagcatgtctgtggggaggaaagagctttgctggaagcagagcaaatctttggatctgtctgatccaaaggcgattctggaaagggcaaagccaagatgacccaagagctgactgacagctgctcttcctcttgaatgtttcccccttggcctgcaaacctgcttacgtcttttttgtcttaaagcaaacaaacacctttcctcagccttgaatcccaccccacacttcccaaccacttctaacctttagctctcaccccatctctcttcttctgtgtgtagccaaagttcctgaaagagttgtctacttagcttcacttcctcctgcttcacgcactcctgactcactgcactcttatcttctgccccacctcatccccaggaaatgattccacaagacaactaatgtcctcatgacagtcaagtccagcgtttcaggctctacttcatagccgttattgaccattccctccttgcttaaaactttccttagttttggcaatattgctttttcctggttttcctcctccctctctaaccaagtattttcagccatccttagaatttcctcttttcagcagagctttccagaccttttccaaagcatacgcaccctggatgctgatgttccacaggctccactcttttgtctcttccttttcactctccatattctccctggacaacctcacttcctcaaggcccttctccagcttctgatactatcaatatatatatactgttaactctcagatagatatgtacagcccagatttattttccaagtaccagatcttttaagtgtgcctatccactgggcattccacctgcaggcacattcactgtgtctaaacccaccttcacgatggaactcctaggcaggtttgttcctcctcatctgtgtcccttctctgtcaatggcaccaccatccttccagccatccatgctacaaccctcagaatcactgttgcttttgttttctcctttattcctttcacgtttgattgctcaccaagtcctcttgcttctgcctcccaaattctgtctcagatatgtcactcctctctactccctctgctactgactcagtccaatcctcatcttctcttaccttaaccactgcaataacccgtcagctgctctccctgactcaaatcttcccacataaatccatcccccaatttatctactacatctatcctctaattttagattttactattttagatattactaaagcacttcagacttctagatgaggtgggtgtggatttgcctgtgctccaaatcaagaaagctactgataaaggagaaggaacaatcatgaaaaaagcaggacaccataaaaaaggaagagtgagatttggggaaaaaaacacaacttctggaaataaaaaatatagccattgaaataaaaaatttagtcactgaaataaaaaactcagtggataagctaaacacataattaaacagaagatgaagagatactttagttcactggaagataagtgaggagatttcacagaatgtatcacagagagaaagcaatgggaaatatggaagagagttgaagaggcatgcagagtagaaagataaggcccagtagatatctgacaaaatttccaagagacaagagagagaatgggaaagaaacgtttgaggtgataatgactgcatactttccaaactgaagaagcatagtgaatctccagaaggaaatgaaaataaatccatacaaagatacatcatagggaaattgcagaacaccaaagacaaagtgaaccatcgtaaaagcaaccagagggaaaatcagattacctacagagtaataattggattgactaaggacttcaatggctaaaacagaaagtcaggctgggtgcagtggctcacacctgtaatcccagcactttgggaggccacggcaggcagatcacctgaggtcaggagtttgagaccagcctggccaacatggtgaaaccccatctctgctaaagatacaaaaattagctgggtgtggtggtgggcacctgtaatcccagctactttgtaggcttaggcaggagaatcgcttgaacctgggaggcggaggttgcagtgagctgagatcatcccattgcactccagcctgggtaacagagtgagactctgtctcaaaaaatgaaataaaataaaataaaatagaaagtcaaaagtagtgaaatattttcaaaatgcgggggggataactggcaatgtgaaattctgtttttagctagataatcatgcaagtatgaagacaaaataaagatactttaaaagacagcttatcattcacggacttttttttttttgagacagagtttcactcttgtcacccaggctggggtgcaatggcgtgatctcagctcattgcaacttccgcctcccgggttcaagtgattctcctgcctcagcctcccgagtagctggaattacaagtacctgccaccatgcccagctaatttttgtatttttggtagagacagggtttcaccacgttggccaggctggtctcaaaactcctgacctcaggtgatctgcccgccttggcctcccaaagtgctgggattacaggcatgagccaccatgcctggcccacggactcttactaaaataacttctatttatttttatatttttgtattttttgtctcaagatctgtttgtggataaaagatcttgtaagagatttacttcagtaaaaaaaaaaaaaaaaaaaaaaaaaaaaaacccaaaagaacacagaataagtaggatgcaagaggcaatggtgaacaaagactctggtgaacactttttttaatctaaataaagattgactataaaataaatgaccaccagggaattaaaaacaaggtggaattaaagtactagacagcaacatggaagatgggaggagggtgatgggagatgaacagtttgtaagattttggtacagttaggaagaggatagagaagtgaattacttttaaactttgataagtatgcatgctaaaagttaaggctaatctctaaaaggatataaatggaatatataacttctaaacgagtagagcaaaaaaaaaaagagaaatacagaaaactataatagaaaacaggaaaggagaggaaaaagacaataaagacaaaataaatgatatttgctataaaaaaagaaacatataagtaatcaaaataaaaagtaatagttctctctaatacctccaatgccacagcccagcagtagctttccaaacctttaccaaaacatatatgtaaagtaatcatatttggaatgcaatctaaaatggaccttactctcctgcttaaaagttttcactggctgcctataggataaaatgcaaactacttagtagaatatgctaaattattttatgatttgaccttgacaacccatctagccaactcccatccagtcaaagatccaagtataacttctgatttccccccaatttttttttttttttttttgagacggagtcttactgtgtcactcaggctggagtgcagtgcagtgatcttggatcactgcaacctccaccttccgggttcaagcaattctcatgcctcagcctcccaagtagctgggattacaggcacataccatcatgcctggctaattttttaatttttagtagagacggggtctcatcatgttggccaggctggtcttgaactccagacctcaaatgatccgcccgccttggcctcccaaaatgctgggattacaggcgtgagccactgcacctggcctgatttccccaaatcttaactaccaatagcctaacgttgatcagaagcattaccaataatataaacagttgattaacacatattttgtgtgttgtatatattacacactgtattcttacaattaagtaagctagagaaaagaaaatgttggccaggcgtagtggctcatgcctgtaatcccagcactttgggaggccaaggcaggtggatcatttgaggtcaggagttcaataccagcttggccaacatggtgagaccccatctctactaaaaatacaaaaattagccggggcatggtggtgtgcgcctgtaatcccagctacttgggaggctgaggtaggagaatcgctttaacccgggaggtggaggttgcagtgagctgagattgtgccattgcactccagcctgggcatcgcaaaaaaaaaaaaaaaagaaagaaagaaagaaagaaagaaaaagaaaatgttaagaaaatcataagaaacagaaaatatatttattattcattaagtggaaatgaatcatcataaaggtcttcaccctcatcattttcacattgaataggctaaggaggaggaagaagaggaaaggttggtcttgctgtctcaggaatggcagaggtgaaagaaaatctgcatttaagtgtacctgcgcagttcagacccaagttatccaaggatcaactgtagatcttaatttgagccatatctattgatagttccctaaacataggatgtatctcaagtctctgatatgtattcctctgtctagaatgcccttctcccctcttctgtactcagcactttcccactattctttttttctttttttttttgagacagagtttcactcttgttgcccaggctggagtacaatggtgcaatcttggctcaatgcaacctccgcctcccaggttcaagccattctcctgcctcagcctcctgagtagctgggattataggcatgcaccaccacgcccggctaattttctatttttagtagagatggggtttttccatgcttgtcaggctggtctcgaactcccgacctcaggtgaaccacccaccacggcctcccaaagtgctggcattacaggtgtgagccaccttgcccagcctagtttcccactattctgtaagacttttctggctgtgtgcagtggctcatgcctgtagtgccgggggtttgggaagccaatgcaaggggattgcttgaggccagaagttcaggaccagcctgggcaacatagtgaggcccccatctctacaaaaaaaaaaaaggaaaaaattagccaggcatggtggtgcgtgtctgtagtccgagttacttgggaggctgaggcaggaagattgcttgtgcccaggagatcaaggctacagtgagctatgattgcaccactgcactccagcttgggcaacagagtgagacctggtctctcaaaagtaaaaacttttcttaagaaaacagcttttctgtgacattttcattgacttcacctccccaggcacacaagtcattctgtgtttccataacacttctgaaaaactatcttggtgcattctagactcttagttttcattacctttatcactgggaagaaagcaaaacacatacctctactagccaaagttcactgactataattctttaaatgcccttcttccttattttgagctaactcatctctgaatttctagctcctggcacaccgcaggtaaataccatgaatacttgttgaagaaaagatgaattcagagaatctacagacaaaatatgaggttaccatcactcagcaatttccttaacatctgcagctgtgtcttacctccacaatactcttggtcacagtagatcttcctctccgaagttcattggcttctctttccacaaaacatagtggtacttttcccacaaggaccagagaatcactagtgtctggaaatacaaattcaaggcccagatcttccagatttttgtggtaacacctaaagagataacctcaaatgttaaaaaaaaaaagagtgctacttcatttgcacttcactactggttccaaatactacttaatagtttttcaaaagctgccacagggcttaacaaccgtattgtttttctcacacttatgtgtgggtgtttgggattttttattatcaaatttcctttttgaattacagtaacctttattgtttttctcttttccattgggaatcaatctgtgtctaagtcttgtttctaagtgtgttttcttcattgaggaactgctaacttctggctgctggcacttaagggagtctggcatgaagaaaaggtctgagagtgatttgaatcagcattaaagcagggaggtaattaacagcccaaggaattgagaagtcctgactaacgggatgtaagtaaatagatctgcctctaatataaattatgtcatagggaaaaaaagatttactggcagtatcatattcccaaacctgaaacatattgggagaaatttctttttcattttcaataatttgtgctgcctagaagaggaaaaatatcctatcttgtgactcactatatgattcgccccttccttacatcccaatgttttactttcttcccattatgattacgataatgaaaactaagagtctagaatgcaccaaagcaaagcagaatgggaccaattactgcagaaactttgctttcacaaagcatggcataaacacagactgttccaagaaatgagaagagtgttctaagccaactgctggaaaaaattatcagggaaactctatcctatactcttcagctgggatacagtggaaagaataggctgggtccagtggctcacgcctgtaatcccagcactttgggaggccaaagtgggaggatcgcttgagcctaggagttcagaccagcctgggtaacatggcgaaaacccatctctaccaaaaaattacaaaaattagtccagcatggtggtgctcacctgtagttccaggtacttgggaggctgaagtgggaggactgcttgagcctggaaggtggaggttgcagtgagcagagattgtgccactgcactccagcctggacaacagagtgagaccatgtctcacaaaataaatattttaatggatgattggatgcagaaaaaaatatattttaaaaaaggaaacaaacagcctgtggagtcagacgacctgcctttgagtgcctgctccactacttaataactgctatgaccttagacaagtcttgtaacctctcttggtctcatctgagaaatggaacaatagttatgcttattcctcacagaattattgtgagaattgataccatcaacatcacattctcatggtggtactgaccataagagtctcctttgttcctctgtcactgttatctctagcggaggaattagagtagaagacagtaattttttccgaccagagccttgtgcctgttgcttctcgtaggaatctattggcagaaagatgaatgggttaagagtaggaagggaagtcttctagattcagataaaaataaagcacggccttgagataatcattctaatgcaaagcagaatgtttaatgttcagttttagattttggatttccatttttaaagtcaaactaataaatattcagcctattaacaattttggtagtatttttcaaaataagaaatataagacttgcatcttacattcagatgaacaagccaatgttcctgtagttaataaatgttgttttgatgacagaggtgaataatgtggattaccaggaacatatgtgggttgaccacacagtcttatggctccagaaggcttccctttccttgagcagggtctcccagtctctggagagaattagtactattctcaaatggtgcagggcctgtagaggtaagtttttctaacactgtttttactatatctttcccaactcttaggccgtcattttataaggaaaagtgaaaacagtagtaatatcattgccattctagtccatgaagcactccttaggtccttgcctaactctttgacattactcattggccacaggagtaaagactttcctggtattttaccacttggtgaacacactgcctcatgatgaggaaaagggtagcaaaaaaaaacatttaaaaagcatatattgctttggaaagatagatttaaaaaccagagatattggttgtctctggggagagaaactaggaggggtggggacaaggatagaaaggagactttattatattcccttttgtgcctttcagaattggatctatttgattatactgcatattcaaaagcaaactaaattttaaaatcaaaacagcatactgggccttctgagctgccactggtctctgcctgatggagtgtgggaaggcatgccaagatcaccgggcatatggaggggcagagctttgtgctggatgtcagagtaagcagcctatccttgcgtacttctgggttgttaataacatctggcaaatatgcctctgaccacataaataagttcacatctttcaattagtgaactaccacattctttcaattataacacaggccaaactgcaggactttagtttaatttttgaacatacagtacaaagtgtgctttctcacaacagttgcagttagaaaagctctttgaggtgtactgattctgctgggagtctcaaattttttctggctgcaaacagatccttaccaatgataagctgctccagacgtatacgctcatgggcagcgtgctgatccaccagcacgagcaggttcccacctagatgagcaaggattgtgaactttgattctcagagcaagacgacaaccatcatgtgtgttgaggacagagaagacttaattcaaactatctaacaacagcataagacaaaacattctgaggagtaacaattgtatcttttatttcctaaaacatgaaattatggggaaaatgatagcaaacttatcccatatgtttgaatcccagatccaattctgaaaggcacaaaagggaatttaataaagtctcctttatactcttgcccccaccccttctagtttctctctccagagattaccagtattactaatttttatcctataagttttattattttccccataatttcattttttaggaaacaaaaggtaaactaagaaactctttagttcaccagcatctcatttagaaaacatagtcagggctgggtgcagtgtctcacacctgtaatcccagcacactgggaggctgaggcgggcggatcatgaggtcaagaaatcgagatcatcctggccaacatggtgaaaccctgtctctactaaaaatacaaaaattagctgggtgtggtggcacgcgcctgtagttccagctacttgggaggctgaggcaggagaatcgcttgaacccaggaggtgtaggttgcagtgagccgagattgcaccactgcactccagcctggtgacagagtgagactccatcttaaaaaaaaaaaaaaaagtcaaagtggcatttcctcaagtttgaagcttgaatatataattcttatgtttaaatactgattttgccttattaattcaactttaatatgataaaggatcgttaaacaacacattgttataatcagctaaccttggtgtacaagctacttggaaacccacaaagaatgtacttccagtgcactttagatcacaagccggagaacgttttctgaagggccagatcataaatattttaggctttttgggccacacgatttctgtcatgcctactcaacaattctttttgagccaaagcagccatagacaatatgtgaatatcgtagctgtgttccaataaaactttatttatggacactgaaatactaatttcatataattttaatgtgtcaagaaatagtcttctttttttttcccaaccattaaaaaatgtaaaaaccattcccatctccctggctgtacagaaagaggtgatgcccagattcccctcgggccatgtttatcctgccttagacttgggcttctcaaacgttcatatcacataccccctggggatcttattaaaacacagattctggctgggcctgtggctcatgcctgtaatcccaacactttgggaggctgaggagggcagatcacttgaggtcaggaattcaagatcagctgaccaacatggtgaaaccctgtctctactaaaaatacaagaattagccgggcgtggtggcaggtgcctgtagtcccagctacttgggaggctgaggcagaagaattccttgaactcgggaaggggagactgcagtgagccgagattgcaccactgcaatcccacctgggcgacagagcaagactccatctcaaaaaaaaaaaaaaaaaaaaaaaagtaaagaaaaaaagagaaatttcaacagatccattttgcttctttcaacatctgcagattttgtagttacacccatcttgagtatcattagtagagattctgatctcaaaaacaacaaagaattccagataatgaaaacttaaaaaaaaaattggccaggcgggttggctcatgcctgtaatcccagcactttgggaggccaaggcgggcggatcacctgagatcaggagttcgagaccagcctggccaacatggagaaaccccgtctctactaaaaatacaaaattagctgggcgtgggtggcgggtgcctgtaattccagctacttggaaggctgaggctggtgaaccgcttgaacccaggaggcggaggttgcagtgagctgagattgcaccattgcactccagcctgggcaacaagagtgaaacttcgtctcaaaaacaacaacaacaaaaaactattacttttctagaaatagtaaaactataggaatttgatcttcacaaattctatattcatgataattctgacagaactttaggttaatttgcctttgatctgctatgacatttactaaacaaggtaaagggaatattttgaaatacatagagaataaatgctctaaaactttagcacttgcctgcaggtactatcaagctggagccagccctccactgctgctcagggctcagccactcaggccttttcagggactttatcccatcaggcatcccttgcaaatgtgctcaagtttctcccattaaaaaaaaaaggtcctctgtcaccctcaccctctgtagtccctcttccgtgtcatgggcacatttctgagtatctccttgcagtctccattagcaccatcagcatctcgtcctgtctattctctgaaacagctctcacttgctaaaatccctaatctctactgtcacaaaatcagatgatcctcatcttacttaatgtcttggcagcgtttggcatgacatcctggttttccaacataacattcttctgttttcttcctatttctctagctgttctttcacagtctcttttgctggttcatcctcttctaccgagctcttaagtgctagaattattctagattcaagacctctcctcactcttcttttttctaggtgataacatttatatccagggtttcagtgatcacttttctgcatctgatggctcaaatttgtatctccatgtcagaacacttgtctaggccagacttgtaatatccaaccacattcttgacatctttttattttatttttttgacagagtttcgctctgtcacccaggctggagtgcagtggtgcgatcttggcgcactgcaacctccgcctcccgggttaaagcaattctctgcctcagcctcccgagtagctgggattacaggcatctgccaccatgtccagctaatttttgtatttttagtagagacagcgtttcagcatgttggccaggctggtctcaactcctgacctcaggtgatccacccacctcggcctcccaaagtgctgggattacaggcgtgagccaccgtgcctggccaccttgacatctcttctggagcatttcaaagactgaactcatgattttcatcctctctgctctgcctgcaacacgggtcctgcaacatcatcaactcagctatggaggccagaacaccagaagtcatcttttacatactttccccatatccaatccatcaccaagccctgctgactctatctcctaaatatctttccaatacattcactgctctctagtccaccctggtcccatctaaccatgtctcagatattgcaatattcttttaacagtcaatctacagttaactgggactccacccctactcctactccattctccacactacaaccagagcaatctttttaaaatgcaaatgtgatgtgacatgtaccaccccaaaaacaacatcaaaatacaaatgataaaaaatgaaaaaaaaaagctttcaatggtttccaacagtattgggacaaagcaaagcttgtagctggcatttaagatctgactcctacctacttctctagcctcatctccagttccccttgccctgtttccactcactgaggagaataaatcacaaattgcatggttgttccctcctttctttacttagttaactcatattcatattcagacctcattttaccaagaagcacttccctgaactccctgatgaaatcaaatctcccaatacaggttcttagagcatcttgtatctctttctccattacaggggctagaactaaaattttatgtttgtgtaattatttttttctcttgcatatatatcttttctcattattgtatccctagggcctggtacagtccctggcatacaatgggcactcaattaatacttgttgaatgagttaatatatttacaaactattattgtttcattagagcaggtcaccaagagattctgtgtaaatattgacaaacctagcagagttcattatatacactttctattattataaagggaaaacatgaaaatattattaaaaagtcaaacaatagaaaatatttaaaagaataaaagatgggctgggcgtggtggcttacacctgtaatcccagctgttagggaggcagaggtggaaggatagcttaagcccaggagttcgagacctacctgggcaatatagcgagaccccgttctccacaaaaaggaaaaaaaaaagacaaaaagagtaaaagttgaaatatctcctttgcacaccctcattttcactcccaaagtaaatactcttgatagtttaatgtgcatcctgagtatatgtatgtgtatgaacataaaactaaatgtctgtcgcccaggctggagtgtaatagcgcaatctcggctcactacatcctctgcctcccaagttcaagcgattcttgtgccttagcctcctgagtagctgggactacaggtgcacaccaccatgcccagctaatttttgtatttttagtagagacggggttttgccatgttgctcaggctggtcctgaactcctggcctcaagccatccacctgcctcacctcccaaagtgttgggattacaggtgtgagccaccgcacccagccttcataatattcttagttttagattggctttccctaatccatccaaatcattgaaactatattatataccaaaaataatcattaaaaaaaggttacaagaagaccagctggttaatcattcaggctaaactccattcttacctgcctcgccattctcttcagtcttagtgctcatcaaacaggcaataaacttgttatctacttgctggagaacctgtcagacattcaaataagtggtacaacactaaataaaaattaacaaaggcttatttgcatagaaagatacagaactgtattttatttagagttgtttgccttatcacactcctttctttgagactgggtaaggttctgatgaaccagaaaaagtcactaggaaggatgaaagaatgggcaggtggagttgatcagaagatgtaaggggagggaggcgacaggggaagacagactcccacgtctcagagtggtgtgctagcaatactttagagaaggcctgagatgttcccaacagagtgactcttgagaataggtaatgtgaccagagattgctaacatacaggctgaaataaatttttaaaatttatatgaaagcaaggaaaacgattatggagaaactagtctatttttatttttatttatttttaatttttttttttttgagacggagtctcactttgtcacccaggctggagtgcaatggtgtgatctcggctcactgcaagctctgcctcctgggttcatgccattctcctgcctccatgccattctcctgcctcagcctcccgagtagctgggagtacaggtgcccgccaccacgcccagctaattttttgtatttttagtagagacggggtttcaccgtgttagccaggatggtctcgaactcctgacctcatgatccacccacctcggcctcccaaagtgctgggattacaggcgtgagccagcgcgcccggctgctagtctattaaagaagtaagttaaaagccactggtggctttagaccttggtggttcctctctgtctaggtacttgaggctctccaatacccccgagcctataccactgccccagggtctatttctggatcaactgcttgcctgctctggtaccaggtcaatgccaggttaggagtttacccaaatttgttagcctcctaatttgtttccgtactgaaaacaaagggaataagacagccatggtggtaaacacaaggcaaaatagaaaagcagatcagacaaagggtcccttttgtgaaatgacttctcaatatgggctttcccaaacctgtgtaggctcacacaatagaaggtaatttctaaaagggcactgttgcacacttaaggacaaggtcactaaaggactttgatttataaattattgccaaatataaagtcaatatataatcttctgcaggagaaccttgagaatccttgaaactgtcagcctgaatccataattcattccctccaaacctacttacactactaaagatatttctttctttgtaattataattaatcccttgctttttcttctgatgataaaagttctagtaagaacacacacacacacacacacacacacacgtgccttgaccaaggtggtctatatcattaaataaatcaaattttagaagagttaggccatatatatatatatatatatatatatatatatatatttatgagattttgaagttaatcttttacctgcattgaatgaatcattcctttggtgaaacgatagggatacaagatgttgtgaattttaactgctaagctctcagcctggccactgcttacatcaacagcaacctagaaagactcagcaaaatataattgaaattttaatttttgtgtcagaattgttttaccaaagatatcagagtgctttaaaagcattcatttttatttagcctactagaggtgggtttaattcagggaatttatagaaattcaaaagaatcggccgggcgtggtggctcacacctgtaatctcagcactttgggaggctgaggcgggcagatcacgaggtcaggagatcgagaccatcctggctaacatggtgaaaccccatctctactaaaaaatacaaaaaattagctgggcgtggcggcaggcgcctttagtcccagctacttgggagactgaggcaggagaatggtgtgaacccgggaggcggagcttgcagtgagctgagatcacgccactgcacttcagcctgggcgacacagcaagactctgtcacaaaaaaaaaaaaaaaaaaaaaaaaaaaaaaaaaaattcaaaagaatttatgaataatgagtcttacataaaaatttttgcttataaacaaaattactgacaaaacaaaaaaaattgtttcacaacaacaatttgtctatgttccatgatcaagtcctcaaatgatatcttgaggaaagaactggtaaacaaatgctcatctattatacaccctgtttataacatgcacagtacattctgtgaaaatacactgaggagagaacatccatgcggggccaatgaggaactgttcctccagtagaagatgtgtggctttatctaatgataacaatttcattatcaccaccctgaatactgtgccaaagctacaagtcagggtttctgagagtggtaaacacattcactgttctcacattgattatacatgtttaatccaaaatgcctgagttcccaaatgctataaattttatttctcccctctacattaaacagtaatttccaaatacataatttggaaatatgcccagtttccaatcataattacaaattaatatagtcttgcatgcccatacccagcttaaataaaattcaaattttatttttaactaatttacttattttttaagagatggagtctcactgtgttgcccaggctatagtgtgcagtggctagtcacaggtgcaatcagcacactatatagccttgaacttctggcctcaagtgatcctcccacctcagcctcctgagtagctgagactataagtgcatgccactgtacccatcttgaaactcaaagtttaaaataacaggcaaagaaaggctgggcgtgatggctcacacctgtaatcccaggactttgggaggctgaggcgggcagatcacctgaggttgggagttagagaccagcctgaccaatatggagaaaccccatctctactaaaaatacaaaattcgctgggcgtggtggcaggtgcctgtaatcccagctgctcgagagactgaggcaggagaattgcttgaacctgggaagcgaaggttacgtgagccgagatcatgccattgcatttcagtctgggcaacaggagcaaaactccatctcaaaatttaaaaaataagaagaagaagaagaaaaaaaaaaggcaaagaaaaactgctacagacccacctctggataacgggcaaatactggattgtcccattctgagaacaaagactgaagcgattcgctactaacagtatcatccacagtatctagggcaaaagggaacaggtaaagttggcatccagaaccacagggaaaggagggaatggcatttcctgtttggtgagccatagcctcaagaccaaaggtcacgtacattgtttctatgttctacaaatgttcagtgtttgctgtatctctaaattattttgatctgttactttttaaactagagttggtgactgtatcttctggcattacagcttttctccaaactgttaaaagagatattgtggaatactgacagagaagctatggctcaaatttatagccttactgcctttaagcaaaatataccttatctatttttaaacatacacacaaaattgatgtctgtagctttttttgaagagttttgcttacataaaactacagcaacttggagtgcaagtccagcctttttaaaaataagaaacatgtcccctaatcacaagacaccacagactatgcataatcagcaaatattgacctcaagtctggaaaagtaatttctgacctaaatgcatgcgctgaattaattagttccgctgttaaacagggccgtggggaattcctgattccagtacagcacagctggcactgatcaagcttaatgcaagcctgctttgttttttgagttaggtggtacgatgtgtactgtgtgccccagcactctctgccacccttacctctgttatcctgtctcatcacagtcctctctgctcgagctctcggaaggaaaggaagaacaaggtcgcttctaaaaggttgacacctgtactgagaccctaaatataagaaagaaaaacctagaaatgtgaacttaaaatacaagtaaactctttaaaaatttaatcacataaaacctctttctgcacaaactgagtcaagacataaagcagactactaaacactagattgagaatcagaaatcctttaatgaaattatgctgtccatataggactctatattaatgcttagttccattatctattcataccagacagaatgaagacctagaataggtcactgtgattctcactggggggcaattttgcacgaggggacattggcaatgtcttgagacccttttttttttttttgagacggcgtctcgctctgtcgcccgggctggagtacagtggcgtgatctcggcttactgcaacttccgcctcccgggttcaagcaattctcctgcctcagcctcccgagtagctgggattacaggcatgcgtcaccacacccggctaatttttttgtatttttagtagacatggggtttcaccatattggccgggctggtctcaaactcttgaccttgtgatccacccgcctcggcctcccaaagtgttgggattacaggcgtgagccactgtgcccggcttgagacacttttcattgtcacaacttgagtaaagggttctacgttctactagcatctagcagataaaggccacggatgctgctaaatattctacaatgcataggacaaaccttacaacaaaaaattacccagagaagccctgtgttagacatacagcagtacttgtcagccataacttggtgcaaccttcacaaatctccaacttatgtctcttatctccaatgtatgtctctatcctaacatttgtctcattataatacaattatatttagatagctatcttccctaatagtactgtgaactcctaaaagcaaagtcagttaacctgcaacgtgacagcacctagcacagtgtggatgatcaacaaatgctgcatgaaaaagtgaacaggtagacaaatgaaaggttctcaattcaaactccagagtctagtaagatctggcccaaatgctgttcttctccatgaaggataatcagatttgagttttagaaacaatgctgaatttgacagctttagaacaggaggaaaacatgagagataaatctgttggactaaacctggagaggttaagaatgataaaattaagataatgaagtgaaataaggtttataactacaatagaaagaactgcataaaatatattttaaagaaaaaattaccaaggcttggggacttgacactactcctcaaaatcacctttatagatcctccttctgtacattaaaatgtatcttttaggctggtggctcacgcctgtaatcccagcactttgggaggccgaggcgggcagatcacctgaggttgggagtttgagaccagcctgaccaacatggagaaatcccgtctctactaaaaatacaaaattagccaggcatggtggcgcatgcctgtaattccagctactcaggaggctgaggcaggagaatcgcttgaactcagaaggcggaggttgcagtgagccgagatcgcaccatttcactttagcctgggcaacaagagcgaaactccgtctcaaaaaaaaaaaattgtcttttaacaatttatttcatgtaacacttttatgtaaagtttgacaatgtcctgatgtcatgatgtatatcagccatttccagaaaggtagcagggtactgaggagccatctgttcatggaacttctttctataccaaaaatatttttcattaggaaactatcagttaacatgaccctcaaaagttcataaaaaagtatgctaatccagaatgttaagtaggttaaagtgttttaaacgtctatattcaaaaggaagaaatatttacgttgaatatggcagctaagatttccccctttcttttagcaacagccatctcacagtataatgtaatccagttattttttggcaccatatcagaagcagttgcatttcaggaagatgaggtgtcagtgctgtagatttacctctgaaaagccttcagtgtaagtcaggacataaaaccacatagattgaaaagcacataaagtggctttaagagcaacttgatagtctcaggaacaacagtgaaagaaatgagttttctcctaatgaatactacaaaatactatgaaatactactgaagttactacagtgatttttttttcacaaggaaaaacagaaaaacactgaaaagtaaaggtttcatttaaccttaaagaaaccacagctttctgctagagatattcatcgtcaggagaaattagaaattgacttataactacatttatacatgttccattcttctgcagcattcaaaattttaaatacggatacagatgtaatgtttatcctcctagtgcaaagccaagattatagccagatggaaatcagctttatcacctcccaacatctggctctcaacacactgccaaagcaatatcactttaaatgtggaccgagaacccagagtcctagtgcaggctctaatgtagccctgtggtacgatctaaaagctatattggttgggtgcagtggctcacgcctataatcccaccactttgggaggccgaggcaggtggatcacctgaggtcaggagatcgagacaagcctggccaacacggtaaaaccctgtctctacaaaaacacaaaaaattagccgggtgtggtagcgggtgcctgtaatcccagctacttgggaggctgaggcaggaggatcccttgaacctgggaggcggaggttatagtgagccgagatcacgccactacactccagcctgggcaacaagagtgaaactctgtctcaaataaataaatgccatattattgtcttcctgaataacagctacttgtaccataaacacatcaaggagattttaccatatgcattataataaagtacatttgaaaagtatagtcatgaaagtatatacttgacctatattttgaaaattcatggacaagtcctactttctagaaagaaaaagctcataaatgtagtactgtactaagccatagagtttactgggaaacctaggatgattacagaatcattctggcccttaacctggaagccacgcagagaaacttccagtaaaataccatgctgacactgcaggtgcctttaaagacacatttctaggaaagctgggcatttaacaggaagggaaaacaaggtaggaaagtactgtggatcttcccaactattaatagtatcatttttattaaaattggacagtctcaccccttttgttgttgctctaggtatatacccatcaccccctttcttacacatacacacacccatagacacatatacacacactgacatcctttcactgtacttctccatttaaatagtgttggacctagaggctgcgtgcgggctcacacctataatcccaacactctgggaggccgaggcaggtggatcacttgaggctaggagtttgagaccagcctggccaacatagtgaaatcctgtctctactgaaaataaaaaaatttagctgggcatggtggcatgctcttgtaatccaagctacactggaggctgaggcaggagaatcgcttgaaccaggggggcagaggttgcagtgagctgagatcgcaccactgcactccagcctgggtgacagagcaagactccgtctcaaaaaaaaaaaaaaaaaaaagtagtgttggacgtagcaaatcttcatatagcatgaaaatacaacatatgttttataagtggtcttcaaaatgttctatctgttgagataatctctttggataatgaggatcttactccttgtccagcattcccatcttcaaaagcatctcatgcacatgaatactacgtacttaccattctcaagtacaacatccacagccacagttgtcaggtctttagtacaagcagcctgaatgtcctcagttggggcaatgaatgtgctgagtccagtcattttgttgacataaaccattcttcccagggctacatcgaaatgccgctgccaatctgaacaacacgtgtttgactcttcagtttcagaacaagctcttgctttagattcctcactctgaaaacaaattccattttggtcacctgtggcatcttctaccggattcattaacattccactgggagagtcaagacttcctatctgttgttctgaggctctgataagaacatctgaatctttaccggtaactttagaattattatagggcaataccaaaggagtttctgatatcacacagttctctgttgtattgctgttagaatgtgttttactatttttattaaaggaattatcctgtgtggcagaatctgatgttgggatgacaccattctctgttttttcatgcttgttgttaaataacatacaaaaatcttgtgttaacacactgcacaacttgctgtctttcctactggaatctgaatttggaagttcattaaaacgactcatcatccccattgtttgagtttctctttcggaacccttcagtctggataatttagaggctagtgattcagatgacttctcaaggtccaaaggttttctattaaagagagataactccttcagggtcataggactttctctcaaactaggcatctgttgttctaaacaatcttcatccttggagaatggaaacttctctgagttaaggatgtggcttgctggttgacaactactatctgaatcactatgctccatagtagtgattttacaaacatcagagttctctaagcggttcttgtccttcagcagaatgtcaggttcaacttgaagactgagattggtagtgactccattactttcctctacttctgtatccagaggattttcaaccttcccatattgcctcttaaacttctctaaagatcctagctgtgaactcaagcttagcttcttacggacgattggtttggagaaaccaattaatttatctgttttcctactatcattggaaacgtgtctataccaggggaaagagggggatgtatcagataatatgcaatctgtttgtgattttttgctaccttcctgaaaagcagaaaacattgtataagttgctgtaggttcattctctagcccataacttatattcgttctgcaattttttttgttgggcaattgaccagattctttacttaaagtgctggctaaatctttgatgtctggagtttcaactgaatgacgtgttctatttccaaatgtttcttgggcacgtgtgggaccaggtctaacataatttttaaatgaatgttctgtttcagttgatttagttttttcattttgtactacatgagttataaagccagtggaacataatttaactcgcccataactaaaaacatttcttcttccacaattgctagattctttttttttctctttctctgtctgagcactatgtactccccataatgttgttgcaaaaggcagaggctggcatcccacttcagtagcatctttaaatctctttggttgattctgaattctattatttttcaagatgttggcagccatgccattaacagtagtactttctttccatatttctagatcctgcccactctcctcaaagtgacatggtgtctgaaaagggcttaaaaacatttctaaactggttccacacggattttctaaagagctatgttccaggaaagattttttatgtttctcattttctccagcttctgatgctacaattgtctcttgttctaacatctttgattctgagcaagagctgtctttgttttgtaaagatggctctgtcattttgctatggcctggaccacctgattcataaatgtacaaaaatgcatcatttgtattttttctggtagcttctgaatccctagaactctgtgtgtttacgttttctgcagtagtttttcttttcacagcttttgactgcaaattaaacatctcataggaatctaaaatattattacatgcttcctggaaattgctcctctcatcggaagtcacacgcttctgaagagtagcatcaaataaactaaaaccattatcttcactaaattccttaatatcctcacctgataattccacaaataatttttcttgctttaaaaacattttcactccttcctgaatgcaaaacaagagagtgtcccagttctgaaattcaatcagagttttggctggctccatgcacacatcatactcacagaattggcactgcacattaattacatatatgccatagagttctggggtagaccggtgccgaagacttgaattcatttgcctactggtgggaccattctttggcttgcatataatactttctttccttaataaaaagtcaatgagtttatgtagctttgtccttaaaactagtcttttgttcacaaacaaaaactgcatattcttgttgtaatgtgcttcagagctgatatagccactaagctcaaactctttatatttaaaacttatttctcttagcttttgggactttcccaatccataaatttgacaaaatcgggaacatacgtctttggttttagggagctgaagaaccatggaaccagaaacatcatttctcaaagagaaagaaatggaagggtgcatgagtgagagagcttctattctctgcctaaccttctcaaactccagtctagggtccatgcatttcctccttacaggaagctggtaaaataggttatacactgttacagtagtcccagcgcttgctctagtcacatcagcttcacaagctttcagggcttttccactctgaaacagtttcacaaaagttttcattgtcctgtttttcttggacgaaatttccacagcactggccatgtcagcaatatttgccaaggcctctcctcggaaaccataaaaccttggattctccaagtcctgtaccgagtggcatttactggtgaaataacgatttcccactttctctacatcatcactccccatcccaaatccattgtctatcacttgaacttggaaggtttccatattcaccctgacagccacacattttgcttcagcatcaatactgttgagggcaagttcctcaacacattggcccaaggagcttatggccaaaccagaacgcaatttggcttgtacttcaactgacaagcacttgatcatggtaggtagaaagatggtgagaatgccaggcactggtttccttctctgactggaaataattgcctattggagaaaaaaaccacacacgcacataatcaaagctttagcattacacagcattatgaagaaatagcacttgaggtaaatgaaatcactcttattaaaccaaattgtgaaacaaagcaaaacaaagttataccgctgatctctaggcacagctcatgcttggtgcaatggattaacatccaaaaaaaattcataatttcataattttcaatgctcctttctaaatcccacatgtcctaaagtgaaatcataattacacttgaagttgaccagtaaacacagtattcgaaattctaaccacttcaccaaaaacagatgcctaaattaaatacagctaaggaacattagctagaaattattcatgacaaaaatgtccaagctagtttcataacatttatacattacacaataaccatgacttttagaaaaatacttataatgaattgctaagacattgtaataaggtgaagcaataggaagaaattttaagaatcaaattgtatcaaagagagattgggggcattaagaggttattattattatggttaagtatagtcacctcagggaaagaggctgggaatgggaaaagataaagcaggaaaattccttttcatataaacctttctttgccatttgattgttaaatcctgttcatgtattactctgatgtttttagaaagtcgttattattcttttttgaaacagtctcactctgtcacccaggctggagtgcaatgacacaatctcggctcactgcagcctgcacctcccgggctcaagcaatcctccagccttagcctcccgagtagctgggattacaggcgctcgccaccatgcctggctaatttttgtctcttatgtagagatggggtttcaccatgttaaccagcctggtctcgaactcctgaactcaagtgatcctcccgccttggcctcccaaagtgctgggattacaggtgtgaaccaccgcgcccggccagaaggtcattattaatattcttttggtctttacagatgggcataaactaccttggtaataataatgatggcatggggctgcctgaacttgattttaagttttcctgcaagtgaaaacacaaaaacaaaaaacaaaacaaaaaaaaccaaaccctaagattccagtgccattaaaggtctccccttcttctccatcagtgagagccacgtgggtgggcccctgcaggcggtggggccggttttccaaactcgggacaaatcagggctcttaactgcagaatttctgctgctttctaagctaatgcactaagcagccggcagcaactgacgggtaaacgtttaacaagtattccgattaatgtaaacccaatgatttcctgatgacgcctcccagcgcctgggactgacgggacgcacgggcctggatccagggcacgggggcctgggagggccgcgcgggccgagtccggggcagcgctgccttcccgccaggcccagcccctccctggccagccccgtccttgtccccaaactgggcccgcccggccgccaggccgccgggcctccggggccctcgcgcatccggctccgaaagctgcgcgcagccatcatcagggcccttctggtgttagaagagaccccggcatcatcttttcgtcgcgtgcttcccccagagtcacctggagtcccgcttaacaaattctccgacaccaaccgcctcggacgccgacgcgcgcaccttggatcttgaggctcgtgcgtgcccacgagcatgcgcttcggagggggcgcgccaggccgcgagacaccagtgcgcatgcgcaccagttgtt

SEQ ID NO: 63 - DNA, 93545 bp, Homo Sapiens
ggcaagacaacgaggatttgcgtagggggcgagcctctgaggccacttggctcttacggccacgcagggcgccgcagatgcagccggagcccgcttttccctctcaggacgacccctaggccgccagcagttccctaccgacgaaggcgactgtacagcgtccaccgcgttcgtgcccacttacccgccgccccactccgggccgccggctcgcagcaggaccagcccggctgctacggccgcggatacacgccctcaggcccggcgctgcgcagcttgcggaagctttcccggacagactcgctgccagcggattggctgcgagcagcgccaatctcacgttgcccccgggcgaggcgggactcagtgccgcgctctctgcacccgctctgccgcgcgcgtgcgtgctgggtgcgggtgcgggtgcggggttgggcctgcgcatcgggtgagacgctggctgcttgcggctagtggatggtaattgcctgcctcgcgctagcaggaaggtagtgtggtgtgactaacgggtatttattatatcctcgatggctcgagggccccgtcccctctactcgtcctggtccgggcgcgaacgctatagggcagctaagggcgctccccgcggggcgggaagcgaagccgggcttgcgggcgcgcacacgtggaacgcgttttctgagcaggtctgggctccggggtgttctggcttggtctttgttgcgtcccattccccagacccttctgggtggaggacttaaaatttgttttccaggcagcagatttaacccatggcaactgtaactcatcttgtgtgagtggcggtttatagtattgtatcctgtggcatcatacaaggggtgcaagttaaactctttaaagttaatcacgatttttgctcttggccttctgggtttatccgtacgccgaagacaggcacctgtattacatgctaaggaaatgtgaataccaaaaattgatcctgaggaaagtcttgattaggtttttttggaatcgcctttgaaatgtaatttccctcaccttggcagtgcagaaagtttgtgatttttattgccgaaatagctttcaacattttgaaattgacttaagagaatgttggctgtgtatgtctgtatcttgcatttctgttggctttgtgaacctaattgttttggatttagtctgatctttaaataaatgatttctttgtgttctctctaatggaagtctgtgagttctctgatctttacttcttttttaggcacacctgttgtccttaactgactttccgggtcatcagcacttcttcagaagtgttccttttccctcccagcaaatatggaagactgactatcctgatattcccagacattctttgctgtgatttgtaagcccgatataaacccttccatttggtacacatatggtatagagtgctatattccaggggctatgctagcgatgtgtgattgatataaaacccctgtcctcaaagaactctgagtcaggagcaacagacagaaacacatattaatagagtaacttgtgatgaggttaattagaaatgaggtaaagggggactgcaggggaaggaatacctaatctgttggcaggtgaaggaaaggaggctgcagcagggaagaaaggcttgaagagttgatactgaactaaatctggaaggatgattagaagtcagctgagagagaaccatgtgagctgaggaaggagtgagtgtcaccatgttaagagagacaagttggctgggcacggtggctcacacctgtaatcccagcactttgggaggccaaggcgggcggatcacctgaggtcaggagttcgagaccagcctggccaacatggtgaaaccctgtctctactaaaaatacgaaaattagccgggcgtggtagtgcgctcctgtaatcccagctacttgcagggctgggacaggagaattgcttgaacctgggaggcagaggttgcagtgagccaaaatcgctgcactctggcctgggcaacaaagtgagaccctgtcacaaaaaataaaaaataaaaaaagacgagctgtgcagtatgatcgccctagagcacatttgggcaacgatgggatgactgggagaggaggcaaaaatccagttgttaagaagtttgtacttaacctggttggcaattggaaacctttataaaaattttaagtggggcagcaacatgatgaaatttaaatacagaaagaaccctataggtggttgagattcgagtcaaaatatcaattaggtggttattgcagtagttcaggagagaaaggccgaatggaggcagtacaaagaggagaggactagtttgggaaacatttagatagtaggagagagatgactgggtggcaggatgtagagagcgagtagaatttctaggatgacttcaaggtttctaattttgctttatgtgcttggatggaaggtgtttgagagcatggcctttggagtcaaacatgccaaggtgtgcatctgccacttaatagttttgtgatcttgagcaagttaccatgcctttaaatcctatttggtgataaaggatgatagaatacgtagagttgttgtgaggattaaataggataatatatataaaattctcatgttggctattacttttattatcaaacaagaaatataggaagaaagttgattagaggccagtcgtggtggctcacgcctgtaatcccagcactttgggaggccgaggcgggcggatcacctgaggtcaggagtttgagaccagcctggccaacatggtgaaaccttggctctactaaaaatacaaaaaattagccaggtgtggtggcgggcacctgtaatcccagctactcgggaggctgaggcaggagaatcgcttgaacccgggaggtggaggctgcagtgagcggagattgtgccattgcatttcagcctgggcaacaagagcgaaacctgaaactctgtctcaaaaaaaagaaagagaaagattctctgatcagtttgggacatgttatgtttaggttgccttcaggtcatctaaatgatgatatttagaaggtagatggaagtaaggccctaaagtccagaaaaaaagtgtgagatacaggtgagctggaggatggtgtggaagccaattgaaattatgtatataaagggaaggaggatactttttctaatgtttgcgttagcataagaaagatgctgataaattatatttagtggtccttcattaatattcatgaagtgaagggcttgccatgggtgaagcatttgattgttctgcctggcatccagagatacataatacataatttcctacattcaaaagttgtacagcaggaaaaaaaaagttttacagttcaggacaaagatgtagtaggtttaattatacaatttaattaatttaatctttacagttatcttacattgattataggacaaaatgatatttgatattttgaatatattagattatccaaatacgtaattaagattaacttcacttttttattttttttttagcttttttaatgtgagtactagaaaattttaaatgatgtatgtacattatagttctgttgaacagtgctggatagagtactggttaaaatggcaggctctgaaatcacgctactttggttttatcctagctcttactaacagctatatgatactgaggaaattaaactttctaaaactcaatcagctaatctataaaatggagacaatacagatatcatatgcttatgaatttggtagagacacaaatattcagactgtagcaattaggagagaagaaagatgacatgacatggaagaagagtatgaaaagagatgcagacatcttaagaccagaggatgcaatgggatggggtagataaagtgtgacagaattcatgctatgaattgccatgatcttagtaaactagaagaatgaggaatattgggatgcaattatagagatttaaaaaaaaaagatcttggatttggcattgtaggagatgaggtattataggaaacgagacaaagatgatgagattaagactgctcagaaggagtcagtctaagtttataccccaaagttttgttgatcagtgtttttcttagatccttgggatttcctagctgaggtggaagacttcttgaacccaggcctaatgtgtgagcccctttggggtaggggttagaggtggggggattgttcatttaggggtttagaggagctcagtttagtcccagtatcctgggatgtttttagcacttatatgccaaacactgtaatacattatttatatatactactttatttacttctcaccacaatcatatgatatcattattagatccattttatagattaggtgattgcattttagagagtttaatttcctcagtgttacatatctgttagtgtaagagctaggataaaaccaaagtagtgtgatttcagagcctgccattttaaccactgctctatccagcactgttcaatggaactataagccacatctatcattttaaattttctagtagtcacattaaacagattttttaaaaggttagttttaataatatattttatgtaatctagtgtatccaaataggataaaatcatttcatcctataatcaatgtaaaaaattgatatgatttttattaatgctgagttggaaattgagtgtgtattagcacatctcaatttggactacccacgtttctagtgctctagtgttcagtaagctacatatgactgatggctaccatattggacagtgcagatctgtcccttagatcgaggtaattctgaagctttggaaaagtgcagaggtgccttttgcttgtgacagcactaatttgtgtgaatgttatgatgatggagtagcctatagtccactgtttccctgcttgattgggacaggaaagcctcccagctgttgagaacaacaaaaacaactattgaaaggtagttgttcacagctgctctcctgagaactgggtaccccaaaactaaatcaaatatatagattaattagagggtagttagtatttaaaaagaattctcagcattcctttacataatgatctcttattataatactctacattttataaggccttatcatttgtagaacaacactttatatattcttccttatttgattcttcacagtaaaccagtgaggtattagctccatctttacagatgatgaattgatttatggagggatttgagtgatttgctccatttttatagatgacaaattgatttatggagggatttcagtgatttgctgagtttatgtgtaataaaggtgaacccccaatacctattttataggctctggtctgttacatttttttcattgtgccaatcacctttgccttctatatagcaaaatatactgtatttatgaactgtgatcagttaacactctcagaacccaatatgtcggcctcttcccagaagtgcattccttaaactcctgtgtaattgttatagtgcctgtactccatttcctactcaattactgagtctttctttacatgtctttgtcttatgctgcctgagaaataatcctaaactgatgactttttgttgtgtttgttttcggtgttgctattttatttgcacctagattgcataggattaaatcatcataggagcatgtaactagtcatgggaaacaaagtaccttgagtccacccccagcccccattttttttggtccaataaaatcttgattctgcagaggaattgcatgttgtcaagcttgtgcttattttcctgtaatcttttctgaaattaggcaataagatgcaaaaagcacccccctccctgcatgctttacagatggaatttccataggacgtttttggatttttcgtttgtttgaacaaaggatttccagttaccaacagagattttggatctgcaggttggatctataaaggacctcaaatgccaacttagagatttgagctttatattattggctttgaggagccacatgattaaaataatgtcgtaggcagaataatatagaggatagttatctgacatgtctggtatgagaccagttcagattaacagtaatcctaactctaaaggagctcagtgattgaaaaagacattataattcatcagaatgtatggatgactaatgatgtttaaatgagactgttggtaaggcacataactgattgtcattatccacttcccaaagttatattatcacttggtcattctcagccaacattacactcattatagcacaattgttcttatcattattcagttattaccatagcatttgtttttaagaaatctttttagaacatgcatgtcttgattccagtatctgtgagctttcggtgatctactgtaatgagtttggaccaagatgtagttggcacagacatttaaggaaatatatttgaaataaaaatctcaaaagtacctgggcccagttacttactcagctttcagcctcttaaatgtccataataataagtataatgttttattcatagtacctactttctatggtttagcggtttaaatgcaatcctatatgtaaagtgtttagcatactatatatttaatgtagtagttgctgttcttattgtaatcatcattttaataaacggcagtatagactgggtgaccaaaggtgaagagtcattgaggctaattaggaaattatattgggaactaaatgtgagaaatactgagaaaagaattgataggatttaggagttgattagatttgagtcagggtgaatggataattcctgtaggaaagttgtgggtttagggtagggattggtaattatacccggagtttgagctagtgattatttcagcaggcagttggaaatacagagttcgagtttgcaagaaaagtcagaatataattagtcacacaaaatcctggaagaaattagaaaaaaagcaatttcttcctctaatgttattgtggactttttttttttaggtgcttgtggcagaatattgtggattttttgaacccatttttggttatttttattcataggcatttatatgtattcatatattaggtatcaatagaggaattgttgaaggacttgccttagctctgcctcttaataactggatgaccttggacaagttttctaatttctttatgccttagtagttttataaaattgaggtgataatggcacctattttcatagggtaataataagaaatagaagacttatggctgggcgtggtggctcacgcctgtaatctcagtactttgggaggccaaggcaggcggatcagttggggtcaggagtttgagaccagcctgaccaacttggcaaaaccccatttctactaaaaatgtaaaaattagccaggtgtcctggtgggcacctgtaatcccagctactctggaggctggggcaggggtggctgaacctgggaggcagaggttgcagtgagtcgagatcacgccactgcactccagcctgggtgacagcgagatttcatctccaaaaaaaaaaaaagaagaaatagaagacttaatattgtatgtgctaacagttgagcgtagcatacagtaagtctcagtgaagatgatctattttcatctgtcattattattgccatttgtcctgttggtcaggaatgcttaacaattcttacaagttgcatttttatcttctagctgctctgttaaaagcgaaaatgaaacaattgcctgcggcaacagttcgactcctttcaagttctcagatcatcacttcggtggtcagtgttgtaaaagagcttattgaaaactccttggatgctggtgccacaagcgtagatgttaaactggtgagtgtccttgagaacccaaatacctttaagacaaagaaaagggtctggacacatgttttctccttaaactgttacctttattttatttctttacaccaataaattattcttaggacattggaccctttgtcttaagagtaaatccttaaaaataaattttaatttaaattaacattatagtaacactaaaggaaatataaaagaaaacatgttctttaggtctccatcacctaagacatctaatgtttgtattttctacaaatattggttattcatatttccttgttttagggatttacttttgcattttattttttccatctaatctaatttcaaaccatttcccttgttacttttttcacattttaaaatttaagtgctgtatattaaatcatttgagtaaatatggcctatatcactcattatgatttattgcaattagtttccatgactagttcccctgttctaaattgctaacacatagagatatggtctattttattcatttttgtgtcctctgtacctggctagtacctagtatgcactaggaaggtaaataaatctgattgaatgtaagaatacattttttaaaatctcttaattatcagatatttatgctatttctagtgttatagaactagaaacaatgctgatagaaatatatttgtaggaaagggacctaactttttcttatctaccagataagattctatgagataaacatgtatatatatatggacacaaatatatatatatatatatatatatatatatatgtaaaataaaatcccttctataaatcacttctcataaaacactgtgacttaactactactatacccattttattttttatttatttatttatttattttttatttttttgaggcagagtctcgctttttcgcccaggctggagtgcaatggcgcgatctcagcttactgcactctccctccccggttcatgcaattctcctgccccagcctcctgaatagctgggattacaggcacctgttaccacgcctggcaaatttttgtatttttagtagagatggggtttcgccatgtcggccagtctggtcttgaactcctgacctcaggtgatccgcccacctcggcctcccaaagtgttgggattacaggcgtgagccactcatgcccagccatactatacccattttacagataatgttctgagaagtttcccaaagtctcataattagtaagtagtggagctaagactagaatccaggtctttctgactcttaaaacccattcttgatcttctctctgtgccagtggttctcatgatgtttgggtgcatcagaataacttaggatgtttgttaaaactgttactgggtcttactcatacaacttcatagtctagatggggcctgagaatttgcatttctagtaaatttctaattgatgctgatgctggtgggttatggaacacactttgagaaccattcttctatatcaaacctctgttctgttttgaatacactataagctttataaacgagaaaacaagtatattaaattatacccaaagaaagacaatttgtttttcttaggcatttcatatagtcagttcagtctgattagagtataattgataataattaaacaggattagatagttatatctgacagacttcacttaagaatctttggcaggcagacatctttttcttaaacatttctggaagaaaaactggtttttaaaacagtgttacaaagccaacagaagtcctgtataaactaagttaaatattttaatctggctgtaaattttagtctcttgacatttaccagtatttgctttgtagaattttaagatatacaccttaaatgtgtggctctacatgataagacctgtttcattatggttttatgctataatagctatcctgactagatatgttttcataattaattaaacgtgatggtactattttgaacatttaaacaaatctttgtgttcttattacgggatttcgagaccatgttgcccaggctggtctcgaactgctgacctcaagtgatccacccatctcagcctcgtaaattgctgggagtacaggcgtgagccaccatacttggcctgatttttctttaaaatatagaagaccgacagttcccagaatgtaaacttaactttattcatttatttatttattttgagacagtctcattctgttgcccattctgaagtgcagtggtgcgatctcagctcactgtaacctccgtctcccggtctcaagcgattctcctgcctcagcctcccaagtagctgggattacaggtgtgtgccaccatgcccggctaattttttgtatttttagtagtgaccgaggtttcaccatgttgaccaggctggtctcaaactcctgacctctaatgatctgcctgccttggcctcccaaagtgctgcaattacttgcatgagccactgtgcccagccaaactgaattttagattgagagaggtgtgaggaacaaaatcttaggcatctctctccaatgttttgtatatctaatttatctaaaaattgccgacatatacagtattatatcattttaggttattaaaaagatgtgattttattttaaataccagagtcagtataattatagaaagattttatttccccctttgtaacttgcatctgtggtcatacacataagactttgtggagtaaagtcagacttatttattatggaagttggctgccaaatttagaatatggtgttcatagaaagtatgatcactatgggaatttaaattttgtttttgttatatatgtatatttttagtataagaatataaaactaagctatgaattgagattttgaaaagattttcatctgatatgatggctcacacctgtaattccagcactttgggaagctgaggcaggaggatcgcttggagccaggagtttgataccagcctggacaacaaagtgagaccccacctgtacaaaaaataaaaataaaaatagttaggcactgtggcatgcagctatagtcccagcacctcaagaggctgaggtgggaggatcacaagcccaggcattcaaggctacagtgagctgtgatcatgccactgtactgtatgtagcctgagtgacaaagtatctaaaaaaagtcttgattttttttcaaattaaaaacttactgtggttgctaaattagatgtgttttctcagcagtttcctgttagatggctgtttgcagaaaaagatttagaaagttataatgtagtaaacatagatttttatgtaagggagaaagtattaaatattaggttgattcctgccatagaaaagcaaaataagaaaacaaaaaacaaaataaataaataaaaatcaggttgaataatgatacttgctaggttctgcctgactagaacatgtgttactttgtcgctgatggagttctgttctgttctgttttgttttggggccatgcataccaaaggtgtatgtaattcagaagaatttttttagtcaaatttaaacataaattattgtttattgtaaatacccatgataatgaaacagtgaaaagcaaccttaaagatcagcctaacctccttattcaacagttgaatctgtgtccagagaaaacaagggagttgcctgttgcaccataactagaaattagtagagctgaagaatttaaactcttatatccataatgctatgcttccataaaagtaaataaatgtcaaaattctttcacttgtgtttctttctaagtgtgataacagtttaatatttttacatattaaaagtgttttttgacattttataggagaactatggatttgataaaattgaggtgcgagataacggggagggtatcaaggctgttgatgcacctgtaatggcaatgaagtactacacctcaaaaataaatagtcatgaagatcttgaaaatttgacaacttacggttttcgtggagaagccttggggtcaatttgttgtatagctgaggtaaggtaattatattggttattttagtgatttcatattcactgaacattacagttaaaactaacccagtatttggtgaagtatggttttaattatttttattatggtaaaatatacataacataagccgggcgaggtggctcacgcctgtaatcccagcactttgggaggctgaggcaggtggatcacctgaggtcaggagttcgagactagcctggccaacatggtgaaaccccgtctctactaaaaatacaaaattagctgggtatggtgcctcacgtctgtagtcccagctacttgagaggctgaggcaggagaattgcttgaacccgggaaacagaggctgcagtgacccgagatcatgccactgcactcccacctaggcaagatagagtgagattctgtctcaaaaaaatatatatatacataacataaaatgtatcattttaattatttttaaatgtacaattcagtggcagtggcattagctacagtcacattgtcgtgtatctataaccattattcatctccgcaaccttttcattatttcaaactctgtacccattaaacaataatgccttttccccccatcccctagtactcactgttctactttctgtctctatgaattagactattctaggtatcacatataagtggactcataaaatatttgttcttttgtatctggcctatttctcttataatgtcttcagggttcatccatgttgtaacatgcatcagaatttccttcctttttaaggctgaataatattccatcatgtgtatataccacattttgtttatctgttcattttcatcggtggacacctgggttactttcacccacctttgggctattgtgaataatgtttctgtgaacattggtgtacaaatacctgtttgagtccctgcttttacttctttggggtatatatccagaagtagacttgctatgtcatatcataattctgtgtctaattttttgaggagcagcaaagtgtgttttgcatttaaaaattgtattaagaaaattaagcagatatttaactatagcacttctcagagcctttactatattcaagcacattgtaaatctctaaggttggtggtttatatacgcactttttcctatacctacttgaccatgaaattcttttattgagaaagcatatcatttttgtttgtttgtttgcttgttctgtggactacactttagaaataccactctaaccggtacagttagtgagattacgctctagagatgtgaattgacttggtctaaaccttaactagttaagggcagattggatttaagaactttactcttctgactgtgagttaggtgctcagtgtctatgaactcctgagttcagtgcttggcacattcacttgcatagtaccaattatactacgctgcctctgccccagatcttataactagtttgtagcaaagcccgtctagaaccttgatctcttcatttctgttatctcagttgtgtttgatcacgtgactctgtactactttttttgtactatactattaccctgtggatgttgggctcttattgtgtgacagtatctatgtgccaggtgacagggtgattgtgagggtctcttgagttattgaaatttgcccagtagccatgtaatccttcatttgtgcttaggctggcagaccctatttaggcaagaatgttccagtacagtaaaatgataggacttcatacttgttgttctggaaaagtggcacagaaatgagatactgttgctgtctccccttctggtctttggacatctgtttagtagtccagtcttgccaagaataatgatatattctctaggttcattgtggtcttccctcagcccttctgtttttgaagtgctggcataggatagtgtaggttttctccattttttgtggctaggattccagctcagtacagatactccttgacttatgaggggattacattcctgattaaacctttgtaagttgaaaatattgtaaatcgaaaatgcatttaatatgcttaacttgctgagcattacagcttagcctaacctactttaaacatgctcagaacacttacattggtctacagttgggcaaaattatctggcaacatagtacactggagaggatctgttgtttatcctcatcgtcacatggctgactgggagctgtgggtcactgcctcagcattgctagcttatccactgctttctactgaatgcatatcacttccgcgccactgtaaagtcgaaaaatcctaagtagcaccgttgttaaattggtgaccctctgggttcagttttttacttttgggcttttctggctgtgtaacatgtcttaagtaggccagagaaattgcaaaggagatgaagtttaagtgggagattttgctgttggagcatagaggactagggggccttgcttattagaatccagatgtttagagatcattaaagggaaattgtcatgtgtactcttaaaaccgctgtccaaaatctagcacactgtgtacttctctattttcctcagcactcgctttatttggagttcacagagccttcaaatagattttggggaagagggactagagggttcaattgggcattgtccgtttttctcctcaagactataaatgggaatccacaaccctggatcttgtacaaagagtttgtctttaaaattgcacgaggtttgcatcagggaacctctgaatctgccagtactatttagctgtcagtgactactctagaagtcatttttttttttctgttttagagcataagtatttgatttttttttttttttttttttagctgttgttcaaacttgacagataggctttaagctttatttggtagattatcaaaaagataatttggcatttctgtattttctgcaagatatatatgtaacccttcagagctgaaattagtcataattagctttgcctactaggtggcagcactatacttggtttttagaaataggtttcacatgagctgtatgatttattcaaatcttcactgtagttctgagtttagatggcagttttgtaagtctttctccattggtcactttctatcttgtttccttatttgattacttaaacccacttgataggcaagtttatcattttgtctttgttttattttgaggcactcaagtggccttgagtataaataaaataattttgctcatcagaattacaaaagaattgtcaaagtatcacaatagtggaaaactataaagtttttaaaaaaatgtttgcaatgccaagcatttatcttagaaaatattaacagtattttatggagtttcctttcttacaagtctttgggaaaaccacatatagatgtgtgtgtgtatgcatgcacacacacacctacactaacaacacaatgaatttttacatatgtatactcctgatcaagatttagaccattatcagaaccccagaaggttccctcatacccactcccagtcagtacttctcaaaggtaactgctattcagacctctgtcaacacagattagttctttatgttcttgaacttgatataaatgaaatcatatggtatgtattattttggcacagagtttttgatgatgatttaggtttgattgtacctgaaaactaaaggaaatacagagctagctggaaggaacttttatagtagtaggggaccctagtacaccatctagatcccccacttcaggactgagcagtcagcccccagctgccaagagtgttggtgactcacccctgagtctccatctggagcttgcccttaccgcagctgaagacagctgccttacccaagtcatgcagggcaacctgcatccaatgaatccagtgactggttgaggtgttataaacgtcccagttcaggacaacattgccctatgcccactggtgatcatcccaaagaaccccccaataaactgactgctcactaatctccatctcagaatgagcttcatggattagccagcctacaatgtaggtcttctgtgcttcagtttcttcatagtactgatgaggaaactgaggtcttttgaagccaaatgccaagtcttcttacccaacttcaaaacactgtctctaataactcaagtaatgttcattgtctacgcatgcagggtgctgcactaggtagttgatttcagaggaattgtacacagtgaaatatgaaatttgtaacctattcaggtatacatagtgtgttcaaggcaaagcccagaattcagtcctaatttcatgcctttcagtaatgtattttccgtggtaggttatattacctctttactagcatgattagaaatgtatttataaagtttaaaaatacttccatattaaatattaaattatttacaaatatacccaggcctgcagtgctaagttcaatagataagttgttaggagtaggtgagttgaaacttatatgtgaggactgtgaatagtatttgagaaaaacaggaagtaatgtatgtttgttgaagtcagttacatttaaaaataaatatttttaaataagacttaatgggtgcattttgggggaaaggagttcactttttaatcttaaggaatattccttagcactcagaaagaattgaggtttcatatatagaaaaaatatattttcaagactagcttattttgaaactttttagatgaaaattacagtgaatgcaataaaaattagtaatttggttattttatctaccaaactaactgatgcatataattttaaagtcatagagttgtaaaccatcctaggctcagtggatcgatatgtaattgggcacactattaaacagccatcacctataactctagttgttgacattattttctgtttatttaaaaaatgttattaagaagaaaaattaagttagactttcagcaaaattggctggagaaatctaaaatacatctaattctttgttctttatttatatacttgaatggtcagttttcctaatttgtcaattataaaataacttccaaccttaaacagtccaaagaagtaaagcattatttttgttttgttttgttttataatttttataattttttgtagagatagggtctcactctcttgttcaggctgggctcaaaatcctggcctcaagcaatcttcctgcttcagccacccgaattgctggcaggcaggagccactgtgccctgcaggcattctttttatatctgcagagtaaactattggtattttaaaatggaattattgctttcatgatctgtgatgagtatatcagcaactgacacaaatttactcgtaatggttttctttaaaatcataacagcaagcataacttcttgaaatttattgtttgtagagcaataattttgagaaatttgtcatcttcaatgtttaattactagtactaattactaagcacagtgactgggttgaaatagagagagtgaaaatcctgtcttgaccgtctcataaaaatttttataaagattgtgtatattattcctatcacataataaaaaacacaaaatatttttctttttaggttgatattttatatgtgttatcaaagaaatgtttaagaaactaacaacatttttgaactggattttacatggaggctggttttagaaatacagaacagtttattttattttattttttttcttaaagaacaaattctgaagtaggagtcagaagcctaattctaaatcctgagtgtttgaataagagacctggccaaaggccaaagtcagattaagttttctgagaattttttttttttcatttatcaagtgagggtcaaatacaataatacatcttacagtgtcttgaatattgtgtacatacagatgcaagttatttctactttggacttgtatgtgaaaagtagtatgcatctggataagatcattagacttgcttattcccctctgcaaatagtatttcacctccgcattctatgtatgctattccacattttggggaaatcctttctaaaatgtaatagccattcataggtaaattccttctaattctcaccaaatgtcttcatcccgtagtgttagttcatttttttctctcgtttttccctcagaagaataaatgtcatcctctgcataacatttacatttattgattcattcatccaccatttaaatggttacagtgtactgaatattattctcaccttatcaagctcattatgcagttgacccttgaacatcacccagttgaccccaccacttcgctatgcagtcaaaaattcacatgtaacttttgactcctttaaaacttaactactgttgaccggcctcctgttgaccggaagataacatattttgtatgttgcatgtattatatactgtattcttataataaactagtgaaaagaatgttattaagaaaattataagagaaaataaatatgtttgctattcattaagtggaagctgttcattaagtgttcatgttgagtaggctaaggaaagggtagaagagaagagattggtcttgctgtctctggtggcagaaaatctgtgtgttaagtggacctgcacagttcagacttgtgttgtggaagggtcaactgtacataattttgtgatgagataatataggatctgtaggtttgtttttgtatcacctcacattaagcctccagggcttagaggagcagaatgagaagctgagtcattttgttttgaagatggaagttgggactcacttatttgtgggcccacatactataaaagggtcaggggaagcccctaatgtcattatgatggttctaaaccaaggacttctgactccttttccacagtgtagggttgtctcgtatattttttatagctgtgatggaggagctttagtcaaaatacgtctgggaagttttgaagcagttggaatattttacttcctaaatgcagcttcatcacaggtgatggaactctattgaaaggagaaaagccagggccaagatctccctgttgctaggctccccatagtgggtatctgggaacaagtcctgcagtcagagtactttaattagtgcacaatacttgcacaggcaggcaggcatactcacatgcagaaaagaaaacatttcagccattcaggcaaaagtctgtatttcacctgaatcgtaaagactgtgcgttttcaactcgtttttgtgtcagttttcatctaaaacttagcccccccaaaaactcaaaaggctttatcataattaccttaaatgaatttttgtcaagaggatttttacctgaattatcaggatatattctaagttttttctttactttttatctaaacattgaagaaaaactatgtttatctgaagtttaaatgcttttatgtaattttaattttgtaatgatactgcgatttcttgaaactcagtaaactggaccagagagtcagtttttaataactgataactaatatagcctccaaggtcctctaaggacttgtaaaacttttccttttaaaatactggttttctttatttcttctcttgacaccactaggttcactctctgccaccattcctcaatgtctctagtaagaatcaccagtaatagtgtgtactgttagagatgctcctgatggtggagttactgcaggctcaaatgctagctcctgcacagctaatgaattctgaacctgtgcccggtccaaaaaaaagtttcctgctccagacacagggtcatatgatgaaacaaactctcgaaatacaattccctttccttcctctgtggaacacactgtatttcataaatttatgaagtacacttatgtgtttgctttatgctttactgtctttagccatgaattgcaaagcatttcatatctaaatacgttttcgtagtattctacaaattgtaattttacaaaattttaatgttggaaaatagagggtttttttttactttaacataaatgttacattatgagcactaaggtcttattttgctttttagcacttcagtttcttcgtctagactggagtatatatgtttaaaggatgagcaaattaatatcttgtaagataaagtggttaaaacaaaatcccatgtaaccttataaagtattagcatcatcttcatcttatcatcacccttcccttaaagatgatctgtgtaatcatttattcaggaccatctagaagccactggcagggttagtcctggaactcagagttccagggccgcctttgctcagtgacaccaactttaggtcaggtggctagttctttggagtagagaaatagaattcagttgaccttagcattttggaaaatcagttggttaaatgtagaattgtcttcaaagggataattatggaataatgagccacagaaaagaaaatctctagcactttctgtcctctaaattacaccatttttgaaccatggaatgtattttggaagaggtagatcccttaagagtactcagaaactcccaactttgttttaggttctgcttttttgggggatagtatcacagtaatagcttgacatagcgcccctagtaagagtttcatagacttcattttcagagagaatctaacgtcctctgctggtactgtgagctggagaagccgtttctttttgttgctctgatattccctgcatgctaccaacatgttccacagagctgtaggccctacagtaaatctgcttggttagggcagggtgacagaaccttcaaatatagacccacttggattcagatgagttccaacagtggggttggattcttatggtgtctaaattatatagatttactttagaatattcagctcttcgtataaagatggccaagaaagattactcccaattttgggtcatcattggctcaccagacatgtgaggaggctaccttcttcccaatgctttccttgccagcatccccactccccactttttttttgttttttttctgacaatggcatattttactattgtactttcatacctacctcatggggtaagtaaatagaaagctgaggatgaagctagctcaaaagagggcagacacttcaaaatttgtgtttctatgactaacatctgaggaaatattttcatgctgaatgaaatgtcttcttcacttatgcttacatgttttaaatttttttaattaataaaaaatttagccttaatgagtttaaagctcagttttaagaaaaaaatctgtaaatatatatataatttaattttttttggaccataatcttgaaatacagaagtgcagttttacacataataaagaagggggagggaatgatcactttaccaaagaactattcatttaccaacaaatttatggaaatagtctgttaaaaagcaagttcccttaatacagttgaagtacttgcttttacagacataagtcatataatgcatataatacaaatggcatttcaggtatacttgtttgtgtacgagtgttttaataaagtgaaatactcaaaacagtaatttgcaacataaaaaaaatacaagctggcctgttgcttatttgtgtaactctaaggaatattacaaaagaactggtcacaaatgtttattaggtaaaatacgctattgagtaaatatattatgcaataatcatttcaaatctttgataatgaacccatcgcaatatctaaagtgttagttttattagatgtttttttcccccaggttttaattacaacaagaacggctgctgataattttagcacccagtatgttttagatggcagtggccacatactttctcagaaaccttcacatcttggtcaaggtaagaaagtagctttgtatacaaacattctttaccttttctgtcttaattgttggtttaaaaaaaaaaagttactcggtgaatacaaatatattgctttgggcttggtcctgataaaggctagttaacttccaagtaaacattcagcctttattctagccaccaatttcttaaatatttagaattgttctcaaaaggaactgtatgagagactggacacttccatggactagttactcctctgtaaaaactaagagtatttattttaccagtgctggattaccagtgtcatcttcatatatgaagaagattaaaattttattgaaacatataaaacataattgatttggtaatagtggaaataaacgataccatcaagatatgattaaataatttaaaatctatttgttaattgatggaaaacttcaaacatgcataagaagttactgtacttatcactcagtttcaataatttatcaattcattgctaaagttctttcatgtaataccctcgcccatttcttccctttctatattactttgaagcaaatacgtattgtttctacttgtaatgtagttagtgttttatatacttttatgtaatattattacattttaattgatatcttatgttttttattttattttattttattttcctgagacagggtctcactctgtcacacaggctggactgcagtggcatcatcttggttcactgcaacctctgcctcccaggctcaagtgatcctcccacctcagcctcctcagtagctgggactacaggtgcataccaccacacccggctaatttttgtatttttagtagagacagggttttgctgtgttgcccagctggcctcgaactcctgagcccaagcgatacacctgccttggcctcccagagtgctgagattacagatgtgagccactgtgttcagctgataagtgtttaaatttctctaaaaactatttacttataaaggtaaaaaagatctctttaggcttcagtttcacatatctcctttaatctttttttaataatttctagtgatgggatgattaagagactattaaagctattacctctttagagtcatgttcaaaataattattagatctgaaaagggacttgtgggttttgttgttgttgtttatccttctgcttctccaatttgtgttgtaaattcatgtttaattttgtgttccctcattgcagtttatcaaagtacattctgtatattttctgtggtttttttccttcagttttaatattaaattattggattctttttttcaaatgacttctgtcttcatttcatgtataaaatataaatttcttatattttaatactggtaccaaattctctcactcattcacttattttgtaaatccttagcttaattactgattacttttgcccattaggaattgatatttttgttccacataaaggagagagttaatagaaactcctaagacaatgcacattttttcctcatttattcagttaatgaaaatgagctcaagtctaacagctattttatttgatgtagaatgatacaaatattatatatgttttaattaaaaataatagattataattcttttactgtatatcaaaggttaggacagacagaaggcatttttaaaatatggctcctctctagaaatactctgaccccagttcttacgagttcaaattaggacaccattaggagatatttgagtggctatccagtagagtactttgaagtaatctagtcgccttataaaacttaaaggaatttatttttgtcttagtagtgaccagtctaatctggatggccaatggctttgcatcactcatacttctcatgcttttctttattcatctccatgggaactatgaaataacaatccttagatatggaatccatctgatctttgcccttttgctgttgattttccttttcctgctgacctcagtcttataccttaagtaagtgagaccaggtatgcatattaaggaatttctgtagtcaacaaatgaactttactttctttagtatatttcttttatctcaagaaacaagaataaatacttagaagatcagtagttgcaaaactactaattgcttttcataactcagttttttcacctaattatagttgattggttaggaaaacagcagaaagttaaagtcttaattttaagttgttcttggtggacatattatatatatctacaaacactttcaaaagccttttatgtttatattgccttagtgctgataggttttgagtgattgaatcacatactcatatttcaccagctgtcatttagcttccatttaaatattttctgcgtaagataaaattacagttcaaccatcctaatttatacctgtacatgtagggttcttggactaatttctgctgtgaggtgaacatccctgcttagcatttactcttcatgtcatctgatataatgatacctgtgggtggcataattgtaggtacgggaacaacttacaacataattttatttaggcattggaaaatttgttacccctttaaaaaacgtaatttattattattattcttattttgagacagagtcttactctgtcgcccaggctggagtgcagtggcgtgatctcagctcagtgcagcctccacctcccaggttcaaacagttcttgtgccttggcctcccaagtagctgggattgcaggtgtgtgtcaccacacctggcgaatttttgtgttttttttagtagagacagggttttgccgtgttggccaggctggtctcgaactcctgacctcaagaaatctgccctcctcagccccgcaaagtgctgggattataggcgtgagccactgtgcccagcctaaaagacatattttacaatgtttaaaaatagtttactagaaattccagctctggtttttctaggtgtatatttgttttatggattaattcagccatttaaaatgatttatgtgtttaacagtatgtcaccctaagttgcccttgccttctgttcacttccattttaaagcatttttttaaactaaaaagaaaaatagaaatacatctctatcttttaaattattgtaccaagaacatggagtaaattaatagctttagtcctatcattttctgtcatcacttctattccctttaccctagataatcagtattaagctttccaaattgatttaccctcctagtcagattcttttaagatcttccagtacttctgccttagaaatttctcatatatcaaaagtagtatttaaagggctgtgatcattttcctaccctgttactagagtttcagaacatcatgttctttgtaaattcctacggtgtgtgattgtgcgtgtattaaaagatcttttcatcttaatttaagaatggaccttttattccttaaatattttaagaaaactttctgatatattcaagcaaccatacctttacattaggaatataaatagctgccattataataaatggcataccatagggtcatgtaaaaatataacagggagcatattacaacactgcagtttaattctggtgtttgtaggatgtgctaaagttagagagctgaatgattttcttgtaaaacatgatagtataatggggcctcctccctattattggccaatattacttggtgcttttaaggaagcacatttctttttttttttttttttttttttttttgctttttgagacagggttcatttggaatcagaaaagacttttccataagtatgttttattcaaacatataattcttattaatctcaattggctgggcacagtggctcacgcctgtaatcccagcactttaggaggccaaggcaggcagatcttgaggtcaggagttcaagacctgcctggccaacaaggtgaaaccctgtctctcctaaaaatacaaaaaattagccaggcatgggggcgggcacctgtaatcccactgaggcaggagaattgcatgaacccaggaggcggaggttgcagtgagccgagattgtgccattgcactccagcctgggcaacaagagtgaaactccatctcaaaataatgataattctcattttactttcagaggatattttgaggtgctgaagcaataatttatcaatatacagattaggtataatgtggtcttagatacatatatttaaaaatcaacaggtatctctttttactttcatatacacatttatattttgccctcttgatttctgtcttccttctgtctagagctacagtgcatgccattatatttgtcatctaggaacttactgactagtggggaacacaggtgagtgaataatgacaaaatgaagccactgactgcctagagagaggttagcaagtttttcagaaaagatgacgtttgagtttgaagatggtaggagtttgaagatgatagataagaagacatggagtgtaacctttcggcaagagaaaaatgatggatacagattttcaagagaccattgctatctgcgtagcaatgaggggaaaaaacataattttaaaaacttgtagtctttaaactcattgaagacctgtgtcacagagaagtttaaatgaacaaagctcaagagaaacactacatcctcctagaaaagaagtgcctggtggccatttgcatccctgggagcattaactgagtcataggtagataaaggaacaagtcttctacaaataagggagcttttatggtacaaggagaaaccagctgaacttttatagccacttgtgggcagacatgacagattagaatatgggatcctcaaacagagctagtccaacccccacactgaatctcagcaggacttttgttgagtaaaaagtgattaagaaaattgggactgagctagagaaagaaggatcttaaaaccttgctagagaaagagacctgattccatcttcaagacatttgaaaccaaagacatttgaactggaactaaaaggttcaactcagataaactcctagttagattgaagagatatattcttcactctactcttggcaggaaacaaagcactttctctgggagaaaatattttcttctttagtatccttttatattcaatgtttagcaaaaataaaaattttgagagacttgaggagaggaaaatgggatccgtaatcaagagaaacaatagtgtaaataaactcatcaataacccagatgtttgaattaacagacaaaaaaaaaaaaacttatgttaaagaatttagaagaaaagatggtcaaaactggtaagaaggtagcaaatttcagcagagaaatggaaactaaaaaactaaatgaaaattctagaacaaaaagtactatgaagaattaattggttggacttattggagtcaggtcagtaaaaataatatgcaaacagaagcacggaagtagaatgagaaaagagcatcagagacctgtggggcaacattaaatggtctaacatgcctgtgactggaatctcaggagagagaatggggcagaacaaaatctgaaaaaaaaaaaaaaaaagtctgagggctgggcacggtggctcacacctgtaatcctagcactttgggaggccaaggtgggcagatcacttgaagtcaggagtttaagaccagcctggccaaaatggttaaaccccatctctaccaaaaatacaaaaattacccaatttttttgtgttttggcgcatgcctgtaatcctggctacttaggtggctgaggcaggagaatctcttgaacccaggaattagaggttgcagggagccaagattgtgccatacactctagcctgggcaacagagtgagactcttgtcttcaacaacaaaaaaaactaataacataattaagattgaaaaaagaaaatgtctgagaatgtttcaagatttttgaaaagatacaaagccacataccaaagagtgaacagaaccaagtggaaaaaaaataaacagaaccacagctaactacatcataattgaattaccgaaaaccagtaatgtgttggacaggagtgttgttaaggcagtgtattatactttaattggaagtgttttttcttttttagagattcataaaagtgtggcgctatttacagctttcatgaaatattaaaagcagccagaggagaaaatacattgaattcagaggaacaataaaaataatgacagctgacttcccattggaaacatagaagtccaaagaaaatggaatgacatcttttaagtttttaaatttaaaattacaggcgggtgcggtggctcacgcctgtaatcccagcactttgggagaccgaggcaggtggatcatctgaggtcaggagttcaagaccagcctggccaacatggcgaaaccctgtttctactaaaaatacgaaaattatctgggtgtggtggtgcatacctgtaatcccagctactcgggagggtgaggcaggagaattgcttgaacccaggaggcggaggttgcagttagccgagatcacgccactgtactccagcctgggtgacagaattagactctcaaatgaaacaaaacaaaaagacaaacaaaatttgatttagacttctataaccagtaaaaatgtttaaagaatgagtacaaagtgaaggcaatttcatacaaataaaacagagaatctcccaccatgcactacaagaaatactaacagggtttttaagctgaaggaaaatgattctacatggcaacctgaatctgcaagaaggaaagaaaagcactagaaaatgtgtggaaaaaatggaaagacgagtattttaaaaacttattttacaaaaacaaaatcagtatattgtggagtttatcacacagaaaagtaaaacgcatgacaaaaactttacaaaaggtaagagtaaatgaggtacactattacaaagttgttacattgtgaaatataatttatttcatggtaatcaaggtaaactgataatttaagaatatatgttatactcactgaaagtaatacaaagttatatagctaaaaagccaattaaagcatataaaatggagtactgagaatgacatgacagaattcagtgtaaggattttggagtagtagaagcaggaggtttagcttagaaagtggtagcgtaggtgttagattatgaagggccttttatatcataccaggtagtttgtaccttaccattatgagccactggaatttattttaggcagacgattgatatcatgttatttacaaaattaactagtaggattaatatgttatttacaagattaactggtaatttctactataaattttgtcttactgtaagatactgtcttcaactactagggtttgaggggagggaaaggacttgacataaattggagagactcctaggatagaatagatagacctataagacttatgcaatattgcagtaagaagtagagggaagaatcaattctttctgtagtatctgcctttggaaaccattggatgttggtgttatatgagaaaggaaggttaggtgtagtatcaaacccaaggaagaagataatgagttccagcctgagtgtggtcgatttcatataccttgaggatagccaggtggagttaatgagtgagcatctgtctataaaacttaaaagagtagtgtaggtctcagatatgtgtcttagttaaccaattctaagatgcacattttgtcacacttgacgtccctggaaacagattgtggcttataattaatggcctcccaaaatcctttttggaaaagcagcagttttggatgttcttattgttgtatcaattgaattttgtgcaatattaataattcatgtgttgattggaggaataaacaacttcatattttattgcaacaattgctttatgagagttaaaaagggaaatagtcacaactaaatgaagctgcattaagtgccaaaggattgctgtcatatgcaaagcattgaaattgatggcaccagaagaaattgccatattcatgggagtaaagaaatttcaaaggaatgagaggctgatgtgtccatttcatgtgttacacgggactgttgttaaggcagtgtatcatagtttaattggaagtgtttttttcttttttagagatttataaaagtatggtgctgcttacaacttccatgaaaagaatcattggcatataggtagtagttgaagacatgggaatggaggaaacatctaggggaacaaagaatgaagtgaggtctctgtgaataggatctggtatagattctggtgtgtgtgtattttccatttagcagtagaggcagaatgcatacctgctctgactgctaaatgcatgcatttcttgatctccatcagcttttgctccaaaatttggcagtgacctttttactttcctaagccaaagaatagtagcgccaaagaatagtagcaccaaagtgttactagtgagaactatgtgttctcaccatgttagaacatggtgttccaaggaatttaatcctgcctctggaagtgatgtatgcaggtaagccaaggaaatgctctatataaaaatagaggaagacccccccccaaaaaaaaatcattagtaatgttatatgctaatgaggcaccagatcaagaaaaaagcagaaaaacatcaagtgtgagcaaaataggaatattgcacttcctttagtctttttccacaaaaatcttttccccccaatcttcttttatttttctcttatagtaaatttcctttcaaaaattgcaagtactatgtgtcttccataaataaataattcagacaaatacaaactttattactttctcttattttctttaagtattcatttaagacttttttgttaaatgcctacagattattcattgttgtttaaggtgctagggatataatggcaaacatggtagttctttgctctcatacttgtattctaagaggcgaggcagacaaaagttttttcaagtagtgacattttctaaaaagaaagaaaacatagttccactgtagaagcagcagccttggatagggcatttaaggatggattttcaaaacatacgatactctgggccaggcgctgtggctgacgcctgtaatcccagcactttgggaggccaaggtgggcagatcacgaggtcaggagatcgagaccatcctggctaacatggtgaaaccccgtctctaccaaaaaaatacaaaaaattagccaggcgggctggcaggttcctgtagtcccagctactcaggaatctgaagcaggagaatggcatgaacctaggaggcggagcttgcagtgagccgagatcatgccactgcactccagcctgggcaacagagagactccatctcaaaaaaaaaaaaaaaaaagatatgatactcaagctgagatctgaaagagttagctgtggaaaggttgacagaagaacatgtacaaagggtctgaggtggaaacaattctgatgtcctctaggaacagaaggaaggacatcggtaggagagaagatagccatggaacaggttgtgtaggacagtgtaagctttaattcccaccccttttctccagttaaccagtgttactgatatggtttggctctgtgtccccacccaaatctcatctcgaattgtaatctccatgtgttgagggagggacccgtaatccctatgtgtttagagaaggtggtgattggctcatgagggcagtttctcccatgctgttctcatgatagtgagttctcacgagatccaatggtttttataagtatttgacagttcctccttcatacactcacactctctcatgccgccttgtgaagaaggtgcctgcttccccttccgccatgaatgtgaatttcctgaggcctcccagccatgtggaactgtgagtcaattaaacctcctttgtttacagattacctattccagggtaatatctttatagcagtgtgagaaggaacggactaatacagttactgataacagtttgtaacattgagttacaagctactgttaggccttctcagacttacattatatctcatgaatctttatttaagttatgttgcaaagcccacccacattagcatcttctgtttacagtcaaacttttaagatgctttgcacaccacatttattttctcatcttgttgtcacaaaatgtctttttttccccccttagaaacagggttttgttctgtcacccgggcttgagtgcagtggcacagtcatagctcactgcagccttgaactcctgggctcaagggatcctctcacagcctcccaagtagctaggactataggcatatactaccatgccagactaattttttatttttaaagacagggtctcactgtgttgcccagtctggtctctacttcctgggctcaagccatcctactgcctaaggctcccaagtagttgggattataggtgcaaccaccacacctggtgaaatctctattttgatattatagtcatttggttagagtttatcttccattattttcatcaaatacatttgggtgctatacttctggatctttgcaagtccaaaaatgtcttcattttgccctatacctatcttaactgggtgtcaatttcttaatttcttcttaatagttagtaaattgtttgtcttctagtgttataggtgagaaatttgatgttagtcttttcttgtaagaaacttgttctttctgtatgacaatgtgtaaaattcttttcttgtcctcaaaatttaggatttccagtagaatgtactttcttttttcttcctaaaatatttctccttataatgaagtaagctcttgaaatctgcacttaagcctttaactcaaaaattttcttctagtatttatttaattacatctccatttgtttctttttctccttttggaactttaaaactaccagtaatttctttttctcctcttggaactttaaaactacgtaaaattttacactacagtttcaaagtcttatacgttccttatgattgccattttctttgtgtttttgctctgtgttataagcagtaggacaaaaattgacctattgcagcaacttcagcctttttgactgattcacggtaataaatatattttacatagcaacccagttcacacacagctaatcaaaacaaaatgtcatgacataatatttatcctaactataggtgatgcactctatttttctagtttattctatctttttattctattttatttttaaaaaaaaagatggtagtttttaaatactaaatcagtggttctcaaccaaggcaactttgtttcccagggaacatttggcagtatctggagatatttgattgtcacaactaaggaggatgctactggcatctagtgggtaagaggccagagatgctgctaaacattctacaatgcacagaacagtcccccacaacaaattacctggccaaatgtcaatgctgcgaaggttgagaagcactacactataaatttatttcattactcctcagtgtaatgattctctactctgactgtacattcataagaatcacatggggagattgatttcataactcagattaactggtgactagtagtttttaaatgtttcattcttcagtgttttaaaaatatgtacctatgtacctatcgtatatggctatgacaaacattcagtcctaattttatgtggtagtggtgtttttttgagtaaaagctagtggttaatctgatagttcagcagtataatttttgcacctttattcagctttccagttaaactataagttaaaaaaattcttttgttaggttatcctgtgtttttgaatgttgttgaaaatgaggtaaatttaactaggttaccagatattatttcaggtaagaatttccagtaacataaggttattatataaactgtaatattatatctcctataaattatattttaaagtccagaataagcaccattcccaggtagtttgagcacagcagatttcttatgatactgcgttcttgtaagcccatgtttctacgcagtgatagaagtaagattatacttctttagaccacatagacgaggtcatacttcgtaggtcagtcttgttacaaatagaagagtctagcatggaatcagagtagtttgcaaagttgagcctttgggtttctagaattggaggaggagaccttcagttatagaaggggttaattacaaattgtatacggatttgaagatctgtgacgttccttccaaatctaaatgtgcttttctcttgtctgccaacaggtacaactgtaactgctttaagattatttaagaatctacctgtaagaaagcagttttactcaactgcaaaaaaatgtaaagatgaaataaaaaagatccaagatctcctcatgagctttggtatccttaaacctgacttaaggattgtctttgtacataacaaggtaaacattattttatctttataagtttctgggtatatgatataataaacaatgtatactttataaatcagttagatatgggctatgactaaatgtttgtgtgccctcacaaaatttatttgttgaaaacctaaccaccatgtgatgttattagggcatggggcctttgaggagtgaaattcatgctcttaaaataaaggagacctcagagggctgccttccttcttctgccatgtgaggaggccactacatagtcagaggcaccacctatgaaccagaaagtgggacctcactagataccaagtcatctggtaccttgatcttggacttactcagcctccaaaattgtgaaaaataaatttctattgtttataagccacctagtttatggtattttgctatagcagcccaaagacaacatgtaaagagtctttttttcaaaatgttagtccacatttatctagttttatctttattacataaagagtgtctttaatttgttgcctaatatctatatgatctgattgaacttttcatttcttaatctctgaaatcagggattcccccagcagacgtttttcatctaagaaatggcttgagtgcttccttttatcgggtgctgtgatagattctcaaaatatgaaaatgagtaagactggttcttttcctttaaagacttcacaatttagtgacatttttcaccctctacactgttgattctttggaagagtgtgtgtgtcaggaggatacaagtgtaattttgttacatggatatgttgtgtagtggcgaagtcagagcttttagtatatccatcaccagaataacataccttttaccttttaaataatttgtcatcatccaccctcctccctctctacctttgtgagtctccattgtctatcattccacactctatgtccatacatgtggtttagcttccacttataagtgaaaacatgcagtatttgtctttttctgagtttcacttaagataatgacttccatttccatccttgttgctgcaaaagatgtgatttcattcttttttatggttgaatagtattccactgtgtatacatacacattttctttatccatttatatgttgatggcacttaagttgattctgtatctttactattgtgaataatgctgtgataaacatatgagcacaggcgtccttctggtataatgatttcctttgggtagatacccagtagggagattacttggtcaaatagtagctctatttttagtttttttagaactaaaaatactgttttccatagaggttatactaatttacattcccatcagcagtgagtaaatgttcccttttctctgcatcctcaccaacatctgttatttttcatccttttaatcatagccattctgactaaggcaagatgatatctcattgtggtttaatttgcatttttctagtgattagtaatgttgagcattttttcatatgcttgctggccttttgtcttcttttgaggaatgtcaattcatgtcctttgcccactttttaatgggattatttgtttttgttttttgagcttcttataccttctggatgttatctctgttggatgcagagtttgcaaatattttctcctattctgcaggctgtctgttcactctgttgattgtttcttttgctgtgcagaagcttttgagtttaaggaaaactccagctttctttccatttttcaaagcgccgataagagaaggtagtcatcttgttgcttggtgaatcttaaaggaaagaaaggtttatatattttctaattattctgtttatctaatgaaatttcacatgggtatcctgcaggaaagcaaactacacagcaatgtggaaacctgatgggaaatagggaattaacatctattgagggcctacacaatgccaggacctgtgctaggtgtattagttttctgtaatcctcacagcaacaaccaagtgatgtagggattatatcagttttgcagttgttctctgaatggaattcagataggtttaatactttgctcattgttgtgcgactagtaaattgagatgggatttgaaacttaacatgccttcagagtgctttgctctctaccatgctctcttccttttttttttctttccttttttgagagggtctcgttctgtcacccaggctggagtgcagtggcacgatcacagctcactgcagccttaggctcaagcaatcccttccacctcagcctcctgagtagctggggctacacatgtgtaccaccatgcctggctcatttttaattttttttgtagggatatggggggtctccctatgttgcctgggctggtctcaaacttctgagctttcaagcaatgcaccctcttcaagcaatacacgctcccaaagtgctgggattacaggtgtgtgagctactatgcctggccctttttcctattttaatactactttatatttatatagttttttcccatgtttcagaacagttacaataactttgtgagatagaaagcattatctctgtttatatgggggaacttaaagctcagagcaactaatggaattgttttatattttacagtaatagtgctgaggtcagaaccctttttgatccagttttcttattgtcaggaagattctttattaaagctatggtagaatgtttttgatcaaaatctttgatcatttaaaataagaatagcaacctgttcttgttggcatagagctcaaccaaatgataccttgagatcctttccagtgccaccgtgctatgattccttaggatgttgatggatggaggctcatcctattaataaaaataaccctatgacctctggatccagaggatatttagtaataaaaagtttgtccctaaattaaaaaaagaccaacatcagaaggaacataataattaggaaggaaaaatagatgaaaaaggtaaaatataaagagaaataggaattatatatttgtaaaagaaaagtgggctgggcgcagtggctcacacctgtaatcccagcactttgggaggctgaggtgagtggatcacgaggtcaggagatcgagactatcctggctaacacggtgaaaccctgtctctactaaaaatacaaaaatgaaccaggcatggtggcatgcgcctgtagtcccagctactcaggaggctgaggcaggagaatcacttaaacccgggaagcagggaggttgccgtgagccgagattgcgccactgcactccagcctgggctacagagggagactccgtctcaaaaaaaaaaaaaaagaaagaaaagtgagtggaagagaaatctttcgagttagaaaatataataagtgaaggctgggtccggtggctcacacctgtaatcccagcaccttgggaggccgaggtgggtggatcacctgaggtcaggagttggagaccagcctggccgacatggtgaaaccccatctctactaaaagtacaaaaattagacgggtgtggtggcagatgcctgtaatcccagctacttgtgaggctaagacaggagaatctcttgaacctaggaggcagaggttgcagtgagccgagatcgcaccactgcactccagcctgggcgacagagtgagaatctatctccaaaacataaataaataaataataggtaaaaacaagattattacttcacgtgataaaaatgaatatattagaaatatttgaaatgacagagttcttatttcaagtcaaatatgtatcttctaagtttttttgagaggtttatatcattttcccaaccaatgtaagattatcaatgtgggtattttctttagaaattggaaagcaggcgccccgccactcgctctccgggcggggcgggtggcgcctcgggcctccacctccccctgcctgcgcgtgtcctgcgtgagagggcagaggcagggtggaggcgttggcacgggacatgtgggccgcggttgccgactgtggcgcgggcagtggaggaggaggcggggctggcgctgaagtcggatccggatccgttgctgtgcaccctggtcggggagagtccgatgcgcctgggtaggagcaccgactgcggggcctctaccgaccttactagaaagatgaaacctgatgaaactcttatgtttgacccaagtctactcgaagaagtggactggaggcagaatacagctacattttctccagccatttccccaacacatcctggagaaggcttgattttgtggcctctttgtactgctgacttaaatagagggtttttttttaaggtattgggtcagctgatcgagactggagttgtcagccctgaacagtttatgaaatcttttgagtatatgaagaaatctggggattatgttacagttgtagaagatgtgactctaggacagattgttgctacagcaactctgataatagaacataaattcatccattcctgtgctaagagagtaagagtagaagatgttgtcgttagtgatgaatgcagaggaaagcagctcggctaattgttagtatcaacccttactttgctaagcaagaaactgaactgttacaagattacccttgaatgtctaccacaaaatgttggtttctataaaaagtttggatatactgtatctgaagaaaactacatgtgtctgtttctagagtaaaaatcttataagaaaattgtcaaaggagctaatgctacaaggctccactcttcctagagttaaaatattttgttgctgcagcagagtgacctccataaatagtagactgagaaaacattgtaatactacaagtataatgacatctacgagattactttgggctggtgggaaatgctgtgaatttagattacaaatgaatattataaaggggatttttttcatctcttttttctttttttattttattttacataattcatgtcttgatctctaaaactaggcagtcacctttaaaactttggatctttaaaaacaaataccccgttactcctaaaatttaactgaaaaaactcacagatttgggtttttttgttttgtttttttgttttgttttgctttctgcttagattttatttttatttttttaatttatttttattattgtactttaacttccagggtacatgtgcacaatgtgcaagtttgttacatatgtatacatgtgccatgttggtgtgctgcacccattaacttgtcatttacattaggaatatctcctaatgctatccctcccccttcctcccaccccctcaacaggccccggtgtgtgatgttccccaccctgtgtccaagtgttttcattgttcgattaaggggatgatttttaaccaagggaatatattttaaacttgaatcttttcttgcattgtatttttccaaaagtttggcttcatttcttggtagttaagagtatgggtaataaggagttatatgtctgccgtgttgctcatttaaaaaaagtatttattgaataaggctgttttttatcacaggcataaaatttaatctttttgtttcaaagaaacatctcagtacacttaggggtgtatcgtttcccacatataaagtatttattgaataaggctgttttttatcacaggcataaaatttaatctttttgtttcaaagaaacatctcagtacacttaggggtgtatcgtttcccacatataaagtcaggctggataaattagttattataactaaacacagtgtagtccaacatttgttgatcccaatacaggcaaataacctggtcagccttttaaagaagtagaagaaatgaaaattatttgacaagattaaaagtaaaacaatttaaatgttttactaaaagtttatataggtctatgtagataaaaagtaccacttgtcttatctgtgaattataactgttcctttgttaaaaacacctaagagcaattatggtgggacatctaaggtactttttaaacagtgaattagcaaacctcagcatatgtgtttctaccttgatttttttcttttcatgggtatctgaagcctcccttctgagtaacaggtttttcaaaaatggagtatcacaaaattgagtgaaatacaatactgaaacaatacttaaaaatatattgtaccagatttgtcaaattcataaaatgttgatggaagctttactttttagtgtgattataatggcactattctggtcattatcctgtttttattttatttattttaattattttttaaagttgaagaattaaatagtttaatggttctaattttttgcattccatgttacattaaacctgttcatatgatgagtaattttctgttaggaaataaaagaaattggaaagcagtatttatagtgtactacattttattattttcggaggacactgtatcagaacttatatttagcaaacacaagttcctctatagccttcagtaatttcagatgcagttcaaatcctggagagtatgttgaaatgattatactgtgaaagtaatataaagtttttaaaagtctttttgtaaaattaagtattagctattatagagagaaatcatggactgaattagaacaagctatttatgttcaagcttttttctcatagtagatttttttatttttatatttcttaatagtgctgttgcacctttaaaatgttaaaatatattgttaaacctcccaaaatagcaatgacatgttactataaatctctttgaacattgagtcctactttgctcttagcctttttcttttaagcatgcctactttcatcattctatatgtacttttttgtaaagaatttttttgtctgcttagaatttaaacctgacgatattgttgtctttattttttttctgcattagagacaaacaatcatattgcgcataatacgagaagtactattgctattttgataacttggattagatagtgttctttctttttatgaaggtttaacctgccaagacattctttgaatactgataatgttgatgttcttgccagtatggttatgttagaaagaggtatttttcttctttcatcaccatgttccttgaaagcatagtgaataatgacacagccaaagggaaataatttacaagtggattcagtgagtttatttaaagtagatattatttggagaactgctagagccattccttagatgagcactacagaagctttagttgtaataactgaatccctgtgaggtcctactgtaaatatttttatttataaagtagttattttgcagaattaacagttttttctcaatattatagtatctgaaaccactttagtattcttagctatttcatatgacaatgcataatttcctagaccactagttcagaacataatgtgaaatgtatgatttcaaataagggctactcctatatacattataattgctgatttgtgtgtgtacttgcttttccaaaaatattatttgtggttttaagaattgttttgattgaattttgttttgataattagaggcccactggtattgcaaaagctgaattggatgtcattgataaaagaaggttttaactgttacgaaagagagacatgaattaaagaatgttttccttcctattcccacttctatatcacatgagcattaaggcttattgagatgttggttttcagtgttgtctttgtttttgttgttgttgttgtttctttgtatgttttgtgctctgtaagaatgatgtcagctccgaagtgttgaatatctctgaattcagttaatctgggaagatgcaggcccttaaccaggaacagagacccaaaaaactggccgtggagatttggcagtgagtggtggctgaagatttggtttataagatgaagataaataagtgatgccctataatatatatcccctgcactcatgatattctccatggtcattttatccttctctaaccttttacgtgatcatcttgaatgtcccaggtttgtttcgcctgtgctatggggaatcaaagaaaagtcttttgccgcatttggaccaatgttaagggtcagttcccctcccgcaatcccagccaggaatgtggagtcagtataatcagagagaggttctaattcaggagtgtggctcaaatgccccttccttaggaatgaattattccagtgccaatctggaaagtttgggtgtgttttgtttttgtttcttttttaattaaagaaggcggacatcttttcagatatattttaagattagcttggggctgattatcaatatggtttggtttggggtcttttttttttttttgctacttacaaattaatgattactaaatttattaaatggttttcatgtgttcctcttttgttaaggattacttttcacctaaattttgtgaaatatagaaaagatgaaagacatataagtcaagttttagtgtagttttatgtttgtaagcactattaggagtctctgaagtcttccattatccctcagtaggacattattcctcaactgctctcattttgttttccacgtatttctgttatgtcattttgcttcagtggcagtgatttgcattctttctttcctatttgacagccttttataggagggagggctgcatctagttcatctatattccccttaatagtgagtgcatagtacaggatggaatattaaattaattaggtagtgttaaagccaaaatagtaagtgtatgaaacactagttttaaacactctggcctctctcagaccttattcataatatttattaataaaattcattcttttgaattccttggtgacctcttatgtatttagggagtatattttcacttgtattcacatatacaattctagtccattgcccttcctggaagctaagtcactgatacatcttctttagaactaataaagaatcatataaagactgcatggatggggcagttgaggggaaacacttgatggacagtctctaagagctgtcaatttaatgtattttgttgctattaacagtcaaatagaacaacataattgttcctttactgatcctctaaccacatacattttatatacttattattaacccaaacacacatttctctattccaacactgtagatttctcttccaaacaataatacccagagaatcctgtacaaatgtagctttttgagattaggccaatgaaagtcaatgacatgatctctaaggccctttttaactctaaaactctttgatttttaaggatgtttacatatgtatatcttgagcacttcatttctttcttagaaaattggaatttcacatttttacttagaagttctactgagttcatatatgaaatcataaaataataaaaggtagaaagttctgcaataaacatggttatgcagatctctttgacatactgattttcaacctaaatgcccatcaaatgatgaatggataaagaaaatatcatgtgtatccactgtatatacaacagaatgccatttagccataaaacagactgaaatcctgtcgtttgcagcaatatggatgatctcggaggacattatgttaagtgaagtgagccaggcacagagagacaaataccacatgatctcacttatatgtggaatctaagaaagttgatttcatagaaatagagagcagaatagttgttaccagaagctggggaggggagggagaaggaggaaaactggaggggttggtccatggggataaagttatggttaggaaaaataaggttttgtttgtttgtttgtttgtttgtttgagacagagtcttgctctgtcacccaggctggagtgcagtggtgtgatctcggctcactgcaagctccgcctcccgggttcacgccattctcctgcctcagcctcccgaatagctgggactgcaggcacctaccaccacgcccggctaattttttgttttttttagtagagacggggtttcaccatattagccaggatggtctcgatctcctgacctcgtgatctgcccaccttggcctcccaaagtgctgggattacaggcgtgagccactgcgcccggcccaggaagaataagttcttatattctgtcacaccgtagggacactatagcaaataacagtgtattgtgtatttcaagatatctagaagagcttttgaatgttgtcatcacaaagaaatgagaaatgtttgaaatgatagggtaattgccccgatttgatcattgtattatgtatacatgcattaaaacatcacattgtacctcataaatgtgtaattattgtgtgtcaattataaatttaaaatcaaatgctttaaacactcaattgcagagttcactggtaaatacttcactgtaataaagcatctctcacaatgtatctctgaagaaacattctcagatttagcttttcaacctgtatatgtaaactcttcacagtgtcacagtggtaaaattaaaatagttaaaaatcatgctctagatgaaaaaactagattatagggtttactggtaaacattaagttcactgtaataaataagctcacaatgcatctctgaagaaacatgcccaaacttagcttttcaacctttgtatataaactctgccataagtcgcaatggtcaaaaccatagttagaaagcatgttctaaacatttgatgacagagttcactgattggtaaacagtttaattcactgtgagaaagcagctcaaagtgtgtctctgaaaaaaaaaaaaaaaaagaggacgtagaaggatccttagatctttacatctgaaaagaccactgaaaatgttttttgtcctgcctcaaatcttttagcaaatagtgtttttaatcctgtccacctccccttttacctttatgtgaccccaagagttttagtggattgcccaatgacttaaacattgaatatagtagaggatgaactacagttcacatatcttaatttttaatgcatcattcatcctcccttactgtagcttcctcccaccaactatactcagagtactgagtaggtgctttggaagggttaagtgatggcttgcactctgaagaaagttacgatgtaaatgaggagataagatgtgaaagtgtgtaaacataacataaatataccgtagaccttgtcattgcccaaaaccacactcactccataatttcactgttaatgtgttccttctctaatcactacctgatgcctctctatcttactctcttcaacaatccttagactctgttggacctgtgatcccttgttcctactgctttttaactgtttcttgccccctggtgtccttggttctctccttaccctgcttaaattttgtggtccatcattatcatccttctcttgggcactctgtcagttctcttggtcctttctcacttaattgtacttgtttgactaaatcctgattaaatccatctggtcatcattttggtatctgagccagtatgtaggggaagaaaacccacacccatgctgaatagtgcctctgtaaattcatgagcattaatcttcatgctgccagacagtcatactcctgtttttccagtcagcaaaccagaagccttagggttattcttcgctactgattctctcacactctaatctgattccagagtaaattccgtaggtctatctttaaaatatatccagaatctaacgacttttcaccatgtctgtgactaccactgtggtccaagccaccattatctgtcacctggatttttgtaatagtatcctaatggactctccctgcttacttcttatcctcttcagtgtattttcagctcagtgattctgtaaaaatgtgtcagatcatataactcatgtttaattagttcccatctcattcagagtaaaatcaaagcctttataagcggactgtgaattctctattggggtcagtatatttttttctgtatagagtcagatggtaaatatgttaggtttttagggccgtatagtttctcttacagctgttcagccctgttgttgtagtgtgaatgtagccataaacaataatactttatttacaaaaacaggaaggccatgggctgtagtttgctgacctccgtagatctgatgcctcctttacctctgatttcattaatctttttccttttgctcattttgcttcagttgtttctggaacctgcgagtcatgcttccagctcaggactgtcgcatttgtagtttctttgcctagaacattttccctcaagtaactggttcaatcctcaacttttaggtcttcacttaaactttctccgtgaggctttctttagccttcctaaaattgcaaccatttcccctgtccccccgcttccccactttcctgctttatttttcttgaacttatcagtatccaatatgctatatattttatttgtcttgatttattctctctcctcctctagaatataatttccttgaagggaaggactttggctcttttttcactgtcatatccctagtgcttacagtagtgcctcaagtgggtgctcaaaaaacatgtcaaatgaatgagggctgacaacaggatcaagggctgagaacaggagcactccattatgctggtggcaccagcccagctggactgtaagcgtaggccttaaagcacctgagatccagaagcagatggtatcagtgtagattaaaggtaacaactggacagagagatagcaaaacagcaagtattagctctcatactctagacacttcccacttctattggttgggagacttctagaaagtcaccaaaaagggaggggtgagcctggccacttggtaggtgggtggtattcattcagtggagtaggaacaactctgaacgtgattttcatctaggacccccaggtggttgggttataggaaaattttgttacagcagaatttggttatgtggataaaatggtcaagattattctaagtagagatagagaaatagtttaaacataaaatacataggcaggagagcacatttagaggcagtgaagaagtttctttaaatgagttggtatttaatatgagagaatagaggaagataaatccagcaatttaaactttttaaatgagaaaattggaaggcattaaaagtttttaagtagggaattgacatgatcaagatgctgctacctttgaaagtcagtttggcagtactctacagggaggagctagggagaccataaacatttaggaagctgctataaattgtaggctttaagggcctgaattcagacaaacacattaggtgtgaaaagcacaaagtgtctattttcttttatagctattatgaggaagaatcaatgggactagctgtgagtggcaaaggaccagaaaaggtttgaagataactgatttatttaacttatatgcctaaggaaataatactgcatccttttttaaaccctgaatgcacacatttgagtttctcctataatgtattaccttcatgaattacactgacataattttgattttactcctaaaagaagcttatagaaacaaaacttttaaagtgaaatcattactgcaccagtagagagttgttagtcaattcagagagaaaagctaatcagctctaggctggatagtatttattttttaaaatttaaaaattttttttttaagacagaatcttgctctgttgcccagggtggagtgcagtggcatgatctcaactcactgcaccctccgcctcccaggttcaagcaatttctggttatttttagtatttttagtagagatggggtttcaccatgttggccaggctggtctcaaactcctgaccgcaaatgatcctcccgcctcggcctcccagtggatgttatttgttacccttaaaacttgttgcttgttttgaaaaaaggcccagaagtagaataaagaaccatattgttgagatgtttgcctgaacaaaataggttgtatgggaagggaaataacattggttaggtaccagggagctagctgatgggagtgttataagctcagtgtctgtgtgtttggtcttaatttgaaggagaataacttaagaatcatgtagaggatggagttgtaatgcagaagagatgattgggatggcttcattttgaatgaaaaacaatgtaatctatagggtgttctattaaatgaaaatagtaaaggctgaaatcaaatactgctatgttgttacaaagcaatagcagcttgatttgtgagtaaccttttctgtaaagtcaaatatgttagaaatgagcaattgcctcagggttcaaagactgaagaacttatcagcaaggctgaccagaagggttttcttttttttttattgagatggagtctcactctgtcgcccaggctggaatgcagtggcacaatctcggcttattgcaacctccgcctcctgggttcaagcgattctcctgcctcagcctcccgggtagctgggactacaggcgcgtgccaccatgcccagctaattttttgtatttttagtagagaccgggtttcactgtattaaccaggatggtcttgatctcctgaccgtgtgagccaccacacctggtcacgttttctttaaacagtattaagaagtacagataatatagaggcagagaagagagcttcaaatattgtcgtatttacctaactttagtgctgtttgaaaggtaggtagtgaactttagaaggccagttattgaaatatttgttacttaaatagtagtctcctattcctaaatcattttattatgtattttaaataataaaatacaaaatggatactactgtattgaacagctcctgaatattattactagtgtcaagaccaaccatctccctctgccagctttgttcttgaaaacagaatgttacacattttaatgtggtaagtgggccaagagagttctaaaaggtacgtttttaaaattcatccccaatgtctaaaaacacacattaacttctttttcttcttccttttctgtgtgaaatttgagtaaacttactgttgatttgcttctcatagaatagtgttgaccttttctcgtagttgcagtgacctatatttaagttaaagcttgagctggctagtataagaaacaaaatttgctttccattagttatttaaatatagttaatataagaagtaaatttatggccgggtgcagtggctcacacctgtaatcccagcactttgtgaggccgaggcaggtggatcatgaggtcaagagaccatcctggccaacatggtgaaaccccgtctctactaaaaatacaaaaattaactgggcatggtggcacgcgcctgtagtcccagctactcaggaggctgaggcaggagaattacttaaacctgggaggcagagattgcagtgagctgagatcacgccattgcactccagcctggtgacagagtgagactgtctcaaaaacaaaaaagaagtaaattcattttcatttgggtaattaaatatttcatatataccaactgatactttttcattaggctttgcttataaactttaaatgttataatgatatgattatttttaaaaacctgaaccccccctacttccctgctggaagaaaccatacctgtagcagcactatgtgggagacttgtcttgatggatgagaataattcttaattaatcttttttcctttatttgttataggaagtgctttagatcttcaagatttttacttttgaggaaaaaattatagaactttcagagaccaccacaatcttcctttcatccttaggaagaacttacttaactacatatcaataaaatagactctggagcatagtttccagttctgaccttacatattgtcactaactggcttacattacgtgtctaggcttcaatttctttgtctctttaaaatggaataatagtacctaccttacagagtaaggtttttaaatgagagcattcacagcacagcgcctgctccataagtactcagtagaggttaattgctattgttattgatgtgaatattgtttaaaatctgattagagtcaaaaaggattattagaggaagtggccttaagactggttcttcggaaagactatgtgggcagaggtattcaaagcagggagaacagcatgtgcaatgtcagggagtcatcagaggtcagagaaagcttgtctaagaaatgagatgaggctacgaagcttgcttggagccagattctgaaggaccttgtgtatcttacatgggaatgtgtacttcttgttgaagtgaccaagagggaactaaatgagacatttcagtaggagactaacaaaataagataattctcattgcagttggaggatggactaaattatgtttaattgttgttaagaatgtggaaaatgatctcgttgtctggcaagttacacaaggaatggagaagagggtctaggcaagaaaaatatttccgatgtaaataagatttgattacgaattggaaataatctttcttgtttttaaagactgcaaagaaatgagtctcaacaatatccctttgaaagttatgcagagattaactttatacctttacatttttattaatgttttattctatttcattttatttttagagacagggtctcactctgttgcccaggcttgagtgcagaggcatgatcatagctcacttcagcctcaaactcgtgggctcaagtgatcctcctacctcagccttctgagtagcaaggaacacaggtgcatgccaccataactggctaattttttaattttttgtagagacagggtctcactgtgttgcccaggctggtcttgaactcctgcctcagcctcccaaagtgctgggattacaggcctgaaccaacatgcccagcttattatttaattttttaaaagatcatacctttacatggttgaaaacccaaaaatgtatgaaaaggtagaatgaaaaaattattcttttctttatctttcatctgcctagctcctataaactgccccttctttaggtaaaatgtctattaatttctttgcaaccttcaggaaaaataattatgcatgttctctttcaagaaaagaatataaaattaaataagtgtaagagattttagaactcatttatactgcataaattttaccaagacaatcatttttgaaagtttgaggctgcttagcaataatcaattcatattaatgtttattatgtcagtagaatgtggtttgttcttttaacagtagtattgatactgtgatggaataatctataattttatactgaattcaaaacatttagcagtgtcttagtggtaagctgctgtggctcatattgttcctgtgttgccaatgtgggaaataaaacaaccttttaaatattgtgtttgtgcctctgtactttttggagtcagagtcagtgcaagtacatacgcaggagtaaataataatagatatagatctatttatagtaacttgtaagatcttagaagtaaacttatggtacttaagaaatttgcctgggtatggtggctcacacctgtaatcccagcactttgggagcccaaggtgggaggatcgcttgagtccaggagttcaagaccagcctaagcaacatggtgaaaccctttctcttcaaaacgtacaaaaaaattagctgggcgtggtagtgtgcacctgtagtcccagctaatcgggaggctgaggcaggagaatccttgagtccaggaggctgaggctgctgtcaactatgatcacaccactgtactctagcctgtctcaaaaaaaaaaaaaaaaaaaaaattcattggtgctgcttcttgtttggtggaaaaaaaaaaatccaaatatgagcttagtacatctgtgcctacaatttgcaagaattttggctgcagtctaggccaataatatatcctctttatttagaaggagttgactttgctcaagcagttttagcattgtactattcacttaactatgcatcatctgtgtgcagcctacatttctctttatcacaaattgcctttacaaacaattgaggtttactaattaaatatcgagtattctcatctaacttcattttcttcaagtagcgtatgtcagtgaggtaggaattaggggcaagatatatttggctaacttcaaacctaagatggtgtgcatgtaataatatatttttgaggtgtttttgcactgtcatcatactgactagagtcagattcttagttggcacatccaggtgctccaactttgtgtgacctagatagaaaacatatggaggtttgtgtgtatttttagcacatgttaagctttcggcctaagggcaagatttacaaaaaccttcaggaagtgaaaagaaaatctctgtttttgaaaataacatagaattgatgaaacggtagagaaagcaaactgaatactgtattctggattcccagtattcccagttcttattcatcacattttatagtttagttttttagtgatgggtcctgttttgaaaatgaatcttagttgcccaatgagaagattttacttgttggcagaccgctattatttattgctagcccaagtgtaactagtttagaaaatgctcttaaattagcccctcgatctgatgcaataaaaattgcctagtgtgaaataatgctcccagactcctagcatgtttactttaaagtgaaatcacattgcatagttctcatgtttcacagctttttctaggaccgatttcctgaagtgatctttttacggttgtgtatactaactattcagcaggtcaggcagtgaaatagcatccttgcattaatcagcagctaagatttatatctgtatctaaggcatctaatataaactaaaataaacaagatgatgtttacattagtaacactgcaggctttttagctatattcagtgcaggaattttaaaacattagttttttgaaatatttccttgaatgctttattttaaaaatgtcaatatcagagagttagcattcctttaaagaggtacactttttgtgaataagtttggtgtttttttttttttctttttagggagggggtcttgctctgtcacccaagctggagtgcagggtgagccactcccacctcagcctcctgagtagctgggactacaggcatgtgccaccatgcccagctaattttttattttttttttatagaaacagggtcacactatgttgcccagtctggtattgaactccggacctcaagtgatcctcccaccttagccttgtgaataagtttttatggttcagctattctttgtcataaggaacttctgatgtggaaagtatgaagcaggggacatttcatttcctgtaattgcagattattcagaaccttatttacttcctttaattttgaacattgttccttaaattattagctgttggctggcttaaaactagagccataatagcagaagccagtagtttgcctttccagagtgcatgtgcacgcaaagattacagtctggcagttcttcaaaaaacatggagctaccatgtggcccagcagttccactcatagatctatacccaagagaaatgaaaacatatgccaacataaaaacatgaacatgcatgtttatggcagcatcagttataatagccaaaaagtagaaacaactcaaatgctcattaactcataaaaggataattcaaatgtattatctacaatggaatattattcagccatttaaaaggaatgaagtactgatataaataaacttgaaaaggttatgctaagtgaaagaatccaatcaaagaccatatattgtatgattccatttatatgaaacatcctaagtgggcaaattttatatagagagaagatagattagtgattgaaaagggataggagtcactgatgatggatataggttttctttttggactgataaaattgttcaaagattaaatcatgctgttggttgcacagctctgtgaataataaaaaccattgaattataaatctaaagtgggtgaattgtagagtatatgaattataccttaaactgttatgttaagaggaaagaaaagcaaagattggtttggatttccttaggtcaagtagtagacaaaaagtgtaattttaacaggtatggtggtgtgacaactagcagccttatctctgaaaacaaagagctagttttcaactctactggggttacttttccctagggaaaaaaaaatgtgtttatttgctcattcctttaacgaaagtatttagtatttagtgggccttactaggtgtctggtactgttcttggtaccagagactcaacactcaacactgaacaagctgaactcatcatcttcctgccaccaatcctgctcttctgagtttcttatcttgttgagtgttactaccaccattccagtttcccaggtcagaaatctgggaggcattcttgattcttctctttttattccctctccacatggagtcagtcatcaagcccatttcgtaccctttagtctgtccgttttctcttttcctcctaccagagtgttggttctgttaacacagcccagtaattctcagccgcagtatattaatactagtaaagtaccaaagtttgcaaatggtttatcttaaaaagcaaacgaaaaaaacctaagggaataatcctgtcaacatcagtttcactgacttgcattccaccgaacttttgcaagaggaagagaaagctgtagcatgatagctagtatattaggaattaattacacatagtcctcaggtcacctatcggaatattttttgaatgtgaactttcagttttgcatgtctttcgtaaaagctgagagtctctgagttggaggaatacaatcacttttttttttctttttttgagacagagtctctctctctgttgcccacattggagtgcagtagcgcgatctcagctcactgcaacctccatctcctgggttcaagtgattctcatgccttagcctcccaagtagctaggattatgggtgcccgccaccatgcctggataatttttttgtttttagtagagatggggtttcaccatgctggccagctggtcttgaactcctgacctcaagtgatccacccgccttggcctcccaaagtgctgggattacaggcacgagccaccacacctggcctatgatcacattttataaaaatcatattgctatagtttcagttctcactaagtcattcttgccaaagatctttttctaatatctatctctgatcatggtattttcccaattagatttatccagtgactctacattgcacgtaagggaaactataaacccctttgcacgatgtgccaggtcattcgtgatttagcccctatctgtctagtttcatctctagcaaggcattctctctatatgttcatgatttggcatgtactatcctatttgtcaggaatgcacttcttgtgatttgtcttagagacaaactcctgtcaagtctgattgtacttgtggcttctctgtgcaactgacttaggtttcttctatgatgctcccactgtgctatgtaatagtagtttttataatgtattataattattttaagattttgctttctttttatatttttagctcctttagagctgggaccttgtccttttatctttatattcccagattttagtatggaatctggaacaaaattgatgctcaatatgtatttgttgaacaaactcaaaattagttactttaaaattttttatttaaccaaaatatgttatagtatgagacgaaattaagggattaaaatatgcttatggtgactctacatcccatttcctggagcaattccaaatttaaatagtctacttcattggccttgaaatgtaattaacaaaacacaccataattttgtttagaaatgcaatatacacattgaacctataccttatatttaaaattgtatacaatttatttttatactttgatttcatatacttgttaaaagaaaaactttagataaactaaatttaacagtgtttatttgagcaaataacagtttacaaatcaggcagcccccagagccagagtaatttcagagcaagtccagggctgctgcatggtcagatgttatttctggacaaaaaaaaatgaaagtgatggacagaaaaccaaagtgaggtgcagaaacagctggatcggttataacttagtgtttgccttatttgaacacagtttgaacaactggctgcctgtgattggccgaaactttgtgattggtacaagagtaggttacagcctgttgacacatccatttaggttacatttcactatgtatggagaaacttataggccaaatgtaaaatatacaaggaggcaactttaggctaaacttaatttaacatactttatgtcttttttcttatacaggtcactttgaaagcaataatagtgaaaagttgaaatttaggatggagaaatacctgaattattttttagctctgctattttgctgtgcattatgatactaattattgcatatctgtatgaaaatgaatgcaaatttttgagaatttataaatccttaggtataaggatctgcataatatgattaaggttgttaccaagaactatattctcaaaaatattcagactttaggatgctagaatagtagctttcaatctttttggactttactattctaatgtgctttttttgagttgagaaccccagtgtactccttgccctcctaaaagcagattatttatttgaataggataaaaataattttgttttgtcttcactggtaccctcaattggagattacacagcgtatcacaaggccatgggggataatcatacatgaaaaatgcatttgtcagtcagaccctttactttttgagaattcccaattagagtctggagttggttctaaattgttgttgtcattgactagacaggggataaatattggcaaagtaaaaggagtgaatgtttagagccaaaaagattgagtatagatcttggttccatgacctactatttttgtttctttgggtgtaacaatttcttttgagtttcagtttcctcatctgtaaaatgagataataatacctacctgaaatgattgtgaaaataaacagtagtttctagaacagtagtacctaacaaagaataaggttttcataaatttcagctcttatctgattggtatcaatacaactctaggaataggtaaaagatcttcctgttaaactaaatgttgagttatttgtcttactgagtagttgttacactatctctgctttcccaagcaggttgctgtttgagactctaaaaacaaagtggtttgcagatggcacagatcagcaagcagagtcattgattattgtcaccttttccaggagagtgcattccttcatttctattcctgatgtgctagttagagaacatgagtctgtttacttcacctttcatcttattatacgtaatatcattaccactacttcctgactacatagattcctggttatggttaaggagttcctttggccagaatcctttggtccagtctcctctctctttctctgttatagacttctgcctcttttagactgtaggaaaacaagactctcccaagagtgtgctggacatcattggttttcaaatggttaaacaatgcaacttcacacatgtagaatgggaagcagaattttatacctcctccataatcatcaaatatttaaatcactgttattttgctttcaacaaaagacctcctttctgcattttagaacaaaggggagctgtctcagcctccagccactgagtctccaaacctgcttgctagtgtacccattcttccccttcagtttcctggtcaaatgtgtcctattcctgcctcgttatttccctgtctgcttgcatttcccagccagactttctgaaacacttgtttcagaaaagtccttttttttatatcctccccatagtcactatccaaattggttccatttacttctctagaactgttctcacactcttgattgccgtttagccagccacgtctgttcctaccatactcactcaacattggaaacatatgatgactactttcttcaaaaacgtccttattctgtgtaccacactttgctgctgctctttctgcctctgtgaccactccttataggttccttttcttcttgtgcctgcccctttaatgctgatattgatgttttctcccaagccctttggacagtttcctccagacttaggaattgctaagtgaatttgttgaattctacctgtactgatgatttctcaagggatttgactgtaattggaccttgttgaactgaagaaattgcagtatgtcaaatctgattatgtacttcacagccaaaccttggtctagtctctctggaccatgattgtcttaaaatctaccccatgttgacctaaaaggaagaagctgaggcagaattaatattgagagtttatttgaaccagtgttgaggacagctgcctcagacacacttccaaattactttggggagtgctccattaggcttctgttacaagcaggtttttaaaagcaaaaagggagacaaagagtgagttgatagagttgtttgtcaggaattttgattagtaattagctatacatcattgagctatagggcatggattatggtgtctggtgtgtggcattgttaggtcagtggctacttgtggcaatagcaagcagttttcaataaatacttagctcaaggggggaaattactatcattttaatgcctctctgggcctgataatttaaaagggctcacattttgcagatacaaagtatttatatatatatatatacacacacacatatatgtgtgtgtgtatatatatatttttttcttattttctttttttaagacagagtcacgctctgtcacccaggctggagtgcagtggcgtgttctcgcctcactgcaacctccgcctccccagttcaaatgattctcctgcctcagcctcccaagtagctgggattataggggcatgccaccacacacagctgatttttgtatttttagtagagacagggtttcaccatattggctaggctggtctcgaactcctgacctcaagtgatccgcctgcctcagcctcccacagtgctgggattacaggtgtgagtcactgcaaacaacctattgtttctctctcatctccaacatactcgcagtgaaaaaatccagcctcattattcagcttttatgtttacagattcagttaacattttgtgaattctctatttcaaaggtacaaaggtaattttaaattatgatttaattaagaatgctctttccgaaatttttatacctgtttgactgtttatgtaaatcctgtaacatagctgatcatcctcagtaaaacagtaataccttacttgaagcagcaatttgtttttaaatatacacggaagtctatgttttgaatgtgaggattggaggtggagagagaatcgatatttagtgaaactgttttatgccaggcacaggcatatgtgcttgtctccatatggatttttatcttccaacaactctgagaaatcttgtaaagaggagaaaaccaaggtaaagggaagttaaatagatggtacactgcaacatatacagcttttaaaattcagaaccagagtttcttctgtcagacctcatagctcatgaatctcttctaagtgatactgaaattttaagctgaggatgaatgcaaaatataggaataaaatactgacttcttgagtttagtaaatctaaattgtattaaaagttatctatatcatttttgtccctaggcagttatttggcagaaaagcagagtatcagatcacaagatggctctcatgtcagttctggggactgctgttatgaacaatatggaatcctttcagtaccactctgaagaatctcaggtatactgcaaaaacattctcagataattctgatttactcatgaagctgttcacatatttccctttgggggagttacagtggcaagaggttagtcttttaatattttaatcaaatatgtgtgtaaggtaaaacagtcaatacagagcttatgttaaacctctttccccagccctgcttccctttttatcttttctgtttgttgcttacattgattttcaaaaaaattatgttcaatttagaatcttttctgtttactttctactataaaagaaaaatagttggctgggcatggtgactcatgcctgtaattccagcactttggaagtccggggcaggcagatgacgtgaggtcaggacttcaagaccagcctggccaacatggtgaaaccctgtctctactaaaaatacaaaaattagccaggtgtggtggcacatgcctgtaatcccagctactcgggaggctaaggcaggataatcacttgaatccaggaggcagaggttgcagtgagccgagattgcaccactgcactccagcctgggtgacagagtgagattccatctcaaaaaaaaaaaaaaaaaaaactgttttcccccacctttcccattccaaatatgtacttaaaactttttcttgatctatcagtttagatagtacttttttactccctaatactggatgacgttcttaactcaaacttttcttcttactccttcctctttcagtcatatcagcaatagttttatattttcaagcttaattatatatataatttttttcttctttctttttttttgagacagagtctcactctgtcacccaggctggagtgcagtggtgggatctcagcccactacagcctccatctcctgggttcaagtgattctcatgcctcagcctccctagtagctagaattacaggggtatgccaccacacccagctaatttttgtatttttagtggagacatcatttcactatgttgcccaggctggtctcgatcctctgacctcaggtgatctgcctgcctcagcctcccaaagtgctgggattataggcgtgagccaccacgcccagcctcataatttcttatgtagccattttttaagtcttctatcttttgtctgaagattgattctaaaagttgaaaacttgtatggactataaaacaatcttcgttaaaagcccagtattgtagtgggattacattttacctctaaagatccattgttgtatctcttatgccatgcaaatgagaatattcctagagccctgattaaatggaatctctgttcttgtactcccatcagttgctcaaaatttatcatgtttttctttgcttaataaatggactatcttatgtagtttttcgctttttctgggattttcaaaagtttttttttaatgaaaaagttttcttcatcatgttagcaataaaatccaactcttagtcatcctaactgtagttggtaatccagttcattacgtctttttgaagtcattgttcttagaccccacttatttcttatttggatcatatcttaggccttctgcacaactctcatcttcagatatctttttataggaatgatggttggttgcattattactggtatgtcatgccttcctctttcttggcacttatactcatttttcttttttttctttttgagatggagtctcgctttatcacccaggctgaagtgcagtagcgcagtttttgcacactgcaacttctgcttccgaggttcaaatgattctcctgcctcagcctcctgagtagctgggactacagccacaacacccggctaatttttgtatttttaatagagatggggtcttaccatgttggccgggctggtctcaaactcctgacctcaagtgatctgcccaccccggcctcccaaagtgctaggattacaggcgtgagccactgcatctggccccatgctcatttttctgaggcatatctttaagtaacttccacagaaagaggggacatgagaggtaatttttcatgtctgtggctgggcgtggtgggtcacacctgtctcaacactttgggaggctgaggcacttggggccagaagctcaagaccagcctgggcaacatagtaagaccctgtctctaaaaataaaaatgcaaaaattggcccggtgtggtggctcacacctgtaatcccagcactttgggaagccaaggcgggtggatcatctgagatcaggagtttgagagcagcctggccaacatggcaaaaccccatctctactaaaaatacagaaattagccgggtatggtggcaggtgcctgtaatcccagctacttgggaggctgaggcaggagaattgcttttgaacccaggaggcagaggttgcattgagcccagatcttgccactgcactccagcctgggcaacagagcaagactccgtctcaaaaaaaaaaaacaaactagtcaagcatggtagtacgtgcctgtagtcccagctacttgggaggctgaggtgggaggatcccttgagcccaaaagttaaaggttacagtgagctatgatcatgccactgcactccagcctcggccagaaagagaccgtgtctcaaaacaaacaaatgtaaaaaataagtccaaattttcatgcctgagaatgatttcatcttgcactttcgcttgttgatagtctggcagacatagacttttagattgaaattaatttttgaggtcttgagtatttttttactatccatttttgctaatgggaaacaatacattccacttcttttttttcttttttttttttttctgagacagtctcttgctctgtcacccaggctgaagtgcagtggtgcaatctcggctcactgaaacctctgccccccgggttcaagtgattctcctacctcagcctcctgagtagctgggattgcaggtgcgcaccaccacatccgactaatttttgtatttttaatagagatggggtttcaccatgttgaacaggctggtcttgaactcctgacctcatgatccacccgcctcggccccccaaagcgcccatttctttttttctagatgatatgttttcttctatttgaaagttcttaggatctgtcctttatccttacaaggatgtgtctaagtgtgtgtcttttattatttgtttattgtgctgagcatttgatgtggatcttttgaatctgaagggtcatttctttctcagccccaggttatatacttccatccattatcacttcgataatttctattttttatgaacctccctattgttattaagacctcctgttaattttctcctattgttttttctcaggtttcccgtctttaattttttccataagttttgagagatctgatttttaaactgtctatggatttttttttaattatgtttaatttccaagagtattttttattgcttttttatacatactgttttatggatacaaaacttgggtctctctaaagataattgtttttgtttttaaattatttgttcctttaataatttctgtttattaggaggtcagttttgttttacttgtcaggtctttttcctccagtcctctaattctcttgtctttctccatgaataggaaatctaattgggaacagggtgtttgtggctgggcttattcactgtcaggttccacttgagtgttgagtaattaaggtcctaattctgttcctggagttgtgctaagcagttggcttcttttcttctcttccattttttttcataatttgttgaaacctcctctgctactatgtcccttcccattctctttgtagtattgagttcttaatattgcttatcattttattaaaatcttggatggaagcttgtactcaggtaatgcttgggattttcttggccgggggaaaattcaggccaaccttagtggccagctacagtgttagccatgatgtgacatgggtcctatttttcagagctccctgaagagttgttttctagttttgacacactccagtgctacttcaaactggttacggtcgctgacttgggatggcaagggtactgtctgaattctgctggattcctcgtagcttcgtggtactttgttgcctacagtggtaacccaggcagcttatggcaggagatctagacttgatacctttaccatcatgccctggatattctagctatcataatttagtctgaagactagcagtgttggcatcacctggaagcttattgaaaataaagaatcctgggcttcatcccagatcgactgaatcagaatctgcattttaacaaggtccccaggtgcacattcaagtgtgaaaagcactgatctagactttggtcagctatgatttcatgagtgaacgagactattgcatgaatcagtcctgtacttggaaatcttttcctcccatctgttttgagatgtgttgccagatctgtgcttacccattgaatttttattttcaatgggcaagcacagatagaattgcataaagagtcctagtaatccatcatagatatgagaatttttgctgcacctctatgtggtttttttttcatggtggattgagggaatttggtaagcatgtgttaatgttccagttccatgggctgtcagaatgataaacttttgagtgtctctctggtgagagtgatcatctaaccaaatccctcttctgttattgcactgtgtgtctaaggtgttgtatttatgttgccaccagctacccattatcactccattctttctgggcttatatggttgaaggagaatggtcctgtatcacagtttctttgagccctttctccatccctggccaaaagcaatcttaagttatttgccactgctggttagtggttgtcctcactcacctcacttctgtccccattatatgcctttaagttgtgcaacttggccaccaaggcctcttgactagtctgggatgacagtgctattggccattaaggaaccttggatgtggagaatctttatatatctcttcccataatgtgagggtaacttttttttttttcctcctgcagggaccccacatgggaagaactaattattggtggtgatctcaacagggccactgctctggtggcttttgtgaggcatttcccatcgtgactttgtgggcttgatggagctcctgaagttatcctttttgacatctgtcttctctttgaaatttccatctctgcattagtttatgctaagttctgaataaattcctcatcattgcctgattttaattctcaaaactatatattttgtttctaggatttacaatttatttgttttcatattcttctcttctaaacttgatttatagctaccaattctaatttctttacctttttttaagtgtacgctacttttcttttttaagaagcatgttacatatactaataatttcaaagtccttttcatattgctctatcatttctgctttcttgagacaaaattatctaattctctgatatttcatatgctttgaaaatttaatttcaaaatcatcttgaatgcaggtttattgtttttgttgctttgtttttgctttccccaacttccacttctttcccatagtttggcagataattcactcgccagccccaatttgacaccaggtatcatattagtaatgcatgcctcatcctgccaagcttttacaggccccttttcttagccagtttggctcagccttgttcttggtttggagttgtctctgttctttcttgtgactctggcaagcagctccagacagtggccacggtatttttaaactttttttttttttttttttggagaagaggtgctatatgagcccccttttttaaatggaaagacagatttcagtcccctgtcttgaatggggtgttttcagtccttatttctgtaccagaatttaatttccagctgacacatcttgtttctgatcctagaccacataggacatttgaccttagccgtcactccctgttaaatgttttgcagtcataacatctttaactacttttatgtgggtggccttttgaaaatttgtattttatctatcactgttatatatttgcagttggaatggcagagaaggggatttcacatgaacttgtttcactgtcctgaacaaaagtgcttaaattactactgtaaaaatgtaacttcttggtgttgtggaggtttactgaaagaggagaaggattagtgttaggagaccagccagggttacatcaatataatcagggttaagaagaggagatgggtttaacagactaggtagctggcagagcccttatcatagtaaaggagtataggatgagctagcaggatagaagtaggatgaaatattttaccaagttttgaatgtggtgagattgagaatatttttgtgacagccagttgaagatggtaagcactggggagtgaaataaatagcagctatacagctatatcttagcatcactggtgtatgggtagttgttgaaactataggtgtgaatgaaattaggaagagtaactagagagcaggaaaaagggggctgataatggaacttggggaccatcatcatttatacgggataaggaaaaggagagaaaccagcaaaccagaatgaagaggaggcattagagaggaagcagaaagaccaaaggagaaggatgaaacaaattcattcagtgagacacttcccagatgagagaattgtgagggtgtcgggctgcagggagtcaaataagagaagggctgcgtagtgtccctttagtgtcccttggagttggttattgaagtagaagcctgcttatacgggattagagatgaagggaagagaggggcggaccatagttgagaagcaattagggaggagaggtatttgtattttgccttcaatttttgttatgctttttaggaaattgaggaatacatttgggtacagaattttgtaaagtcttatctaattttcaattttgttgcactgatttggtgtctcaagttatttttccatgaactggcctgattttcactttttacagcattttatgagtctactgttttattttactttgccatgtaacttaaacatagtttgttcttaagattatcctaaaccatttttaaagctcagtatctagaatagtaattattaagtggccaaccaaggtggtgtgaaaggaaatcactagcaatattacatatttcttcttcattttattatttattcttatcctctcagggcagactttttttaaagtcacaaacccaataagtctttcagaggctaaacaggttctccctgatgcccagcaggtgctttaagaagggtctcatgttacctggtaaattatacaaccatttttaaatgctgtgaagttttgcagttaattaagtagtatcattttataatggattatacagattaatttattttttcaaattggcacaatttggcattgtgacaataatgcacttagtgttctaaaactggtaatgcatctccttaaacacttatttccaagggcagggatagccatagacataggtggtggcttacaggctatgttaataaggagccccacggttcctgcttaactaaaaatagtacccccagtgacttgcttgtttttctcaacctaagctaaaattttactatgagtgttccttgacagattaataacacatctagttctagttgtttctgataagagattttaagcctatattttaaataacttaacaaaaatcacatagctagtggtagaactgggattcaaaccttgtcaatctggctctgtcttatattcttaacagtataggatgttgtctttagctgtgttcattaactaaagataaaagtgggagcatgttctctgcttcctatcccttcaatatctttctcttctctctggtattcttttctagtatccttcttcattttctctttcttctttatacatttgtaaagtagagaaagatagcatataaatattcagtaaaatttttatagaagagttttctgaacaaaaatgaagctaaagtacaacagtgcaatcagtatttagccctgaggaagttaatacagagtaaaagagtttttttttttaactcagaaatgaaaacccagtaagattggctttatatagcatactcagaatgaagatagaaacagcaacttctttataggaaaagatggttaaagacaaaaggacaaacagccagagaaaagtcacaatgtgaggaaagaaacttttaaaagacagaaaaaaggttgagtatagattgaatgctctatgtcctatgacagttaaatatctgaaagtataaccattcatgaagattttataaatgccaatttttccttagagttgccaacaaaaagaggcagacagcaccagtgtagcatgctttactattttatttaaagttaatacttaagacatgattatcaggaagtatatggctttttagaccttaagatgaaaatctgttttttaatttttttatacctttcaaagtgttatatatagccagacccgtggaactacattgttgacattgcatattctgtaattattatatagatttatctcagtggatttcttccaaagtgtgatgcagaccactctttcactagtctttcaacaccagaaagaagtttcatcttcataaacagtcgaccagtacatcaaaaagatatcttaaaggtagtatgctttagaaaaaaaaaattatttgaattggaaatttgtcacattgtaacaaggactgcttccaagaatttgctctaaaataaaaaaaaagaaatacaatgtcatttattaaacattatgcatgatagaaagacatatgatgtctctcttattcttcctggcaattctggactgcattatcatccccatttatagtgaggaaacaaatgttcaatgtttctcttaggccacatagccaggaaattagagagttagtagttttttttgtttttgtttttgttcttttgagatggagtttcgctctccaggctggattgcaatggcgtgtcccgtgatcttggctcactgcaacctccatctcctgggtttgagcaattcgcctgcctcagcctcacaagtagctggtattacaggcacccgccactatgcccagctaattttttttgtagttttagtagagatggggtttcaccatttggccaggctggtctcgaactcctgtcctcaagtgatccgcccacctcggcctcccaaagtgctgtgattacaagccagagccaccatgccagagttttgatttgaaccctaagccttcagaacttccatgacattgtgatgtttaattattaagccagttttattgcatgtttgtacttgttttgaatgcttgtgcttcatttaggttcaaggcctccaaaggagtattacagataatgcttttcttttcttttcttttctttttttttttttgagatgcagccttgttgttttgcccatgctggaatgcagtagcatgatttcggctcactgcaacctccatctcccaggttcaagcaattctcctgcctcatcctcccaagtatctgggattacatgttcctgccactatgcccggctaatttttgtactttttagtagagatggggtttcatcatgttggccaggctggtcttgaactcctgacctcaagtgatccccccaccttggcctcccaaagtgctgggatcccaggcatgagccactgtgccgggtcatgataatgcttttcctaataagcagttgcatctactcaatttctcagttgaatttgctgggttttattgtactttttaattacatattattttttcttttatttattacatgtatttctagttaatccgacatcattacaatctgaaatgcctaaaggaatctactcgtttgtatcctgttttctttctgaaaatcgatgttcctacagctgatgttgatgtaaatttaacaccagataaaagccaagtattattacaaaataaggtaactcttttcagataattttttcttatgctatttataaacatatattactgttttcatataaaaagatttgtttatatttatcttttttattatttaaaatcttgtctattattttcataatttcccctaacatttgttaatttgtatttttaggaatctgttttaattgctcttgaaaatctgatgacgacttgttatggaccattacctagtacaaattcttatgaaaataataaaacagatgtttccgcagctgacatcgttcttagtaaaacagcagaaacagatgtgctttttaataaagtggaatcatctggaaagaattattcaaatgttgatacttcagtcattccattccaaaatgatatgcataatgatgaatctggaaaaaacactgatgattgtttaaatcaccagataagtattggtgactttggttatggtcattgtagtagtgaaatttctaacattgataaaaacactaagaatgcatttcaggacatttcaatgagtaatgtatcatgggagaactctcagacggaatatagtaaaacttgttttataagttccgttaagcacacccagtcagaaaatggcaataaagaccatatagatgagagtggggaaaatgaggaagaagcaggtcttgaaaactcttcggaaatttctgcagatgagtggagcaggggaaatatacttaaaaattcagtgggagagaatattgaacctgtgaaaattttagtgcctgaaaaaagtttaccatgtaaagtaagtaataataattatccaatccctgaacaaatgaatcttaatgaagattcatgtaacaaaaaatcaaatgtaatagataataaatctggaaaagttacagcttatgatttacttagcaatcgagtaatcaagaaacccatgtcagcaagtgctctttttgttcaagatcatcgtcctcagtttctcatagaaaatcctaagactagtttagaggatgcaacactacaaattgaagaactgtggaagacattgagtgaagaggaaaaactgaagtaagtttccagagcttgcatgtgacttgaatgttcagctatttccattctatatgactcactgtttaaaaagaatttttttcacttcttatttatggaaaagcagatcagaaaatacctttggcttggatagagtaccttttttggtaacactttttttttctgctaatttaggttttttgttggggcgggggcttgtattattttgttttttttttgtttaagccttaactgctttctgatattattaaattttttgctaaaggttttccattcatcttctcaatttcaaaccaccatttatcttctattttttttttgttttatgtttaataacttttctgttgtagaactttttaaaaaagcttttgcattggaacagttgtaactggtgtttttaatatcttaactattccctttcttaaattggtctccaaaatatgtaatacaacacaaaaaaatttgtattattggcgattcaatttagtgttgttcatttatactgtttctattcagtataacttaaggcttgcttctaagatgtattatttattataacttataaactatagtgggtatttttattacataaataggtgatttgatctgtctttgattaaaatagtatttgccatatttaaattagattttctgaataaatgttccaaaataatatgatgaatgtttttaattgacttaggacacttaatataaacacaaaatattatgttctggtgatctaatccagcagaaaatgagagtgaaattatacctccaatcatatacaggtatctgagtatctcaatattatgtcaaatgtgtggaaaaaattttaaacgtaatccatcatctggagtttatatttggtgataaactacctagatacttgaccaattttttttttcattctttccttagcttattcagtcttataaaaacaatatcaatttaaaatgataaagaccactattaacaccaaaatgaaaagcctccataaagcttttctcttcagccttttttgtcatctttttttttttttaagtgggaatggttattatattttgttcttttggaaatatccacaaaagtagacattttgaagtataaagccattaccccatttcaccaccaatcatctcatagtcagccctattagtcctgtttcatccatacttccattcactttctttccctttgtttattattctgaagcaaatcataggcatatcatctatttcagtatgtatctctaagagataaagatattcatattttaaacataaccataattgtcataacttttttaaaggtatagattccttaatatatcaaatactcagtgttcaaatttataattgtttcataaatgtcagatttttaaagatttgttttgaattatgatgcaaataaggttcacacaattgtgattgtctttagttttacctaaatgacacaactatgcagtttaaaggtgaggggacttaacttttaaatacagtaagcccacaaaagttgaattgcattgcccagggaaatgaattgagaattgtctgagaataggaaaaaaccatagatgtttcaagttctcatggaaatagggacagtgtacaagcttatgatggaaacttatcttgctgactgttcctttgcagcctcacaacagcaggtatcattccagttgctttttggggaatgtctgcattgtttctccttgtgggtcccaaggtgtcaggttactaggattatgattaataggcctcatctaaaaatccatttaccatcaattaccggaatattccaggtaatattctggaatcaagcttactttctctcacattgccataaagtagacaaaagaggctttgatggtcaagacctctgaagcttcacctggattctaatcacagttctttgttagctttgtatttaaaagtgtggacagtctctcatggattgttgtgaggattaaataagatattgtgtgttatgatacaagatcaattactaacacatagtaaatgattgctcacaatgtcaatatgatcagtttttaatctatgaaagggaatttttctgttgagaagaacatttctcatttgttgagtcaagattaaattgaatttggaggccagaaatagaaacctatgaagaaaatataggtatcttgggatcagagttctaattgtatgtcacagagtgctgtgttagaacctttcagagccagggttcctgggaccatgatcagctgagtctagttgcatcatgattagtgagaaggtagagcaaaaatgatacaacacccaagaatcgtactagctaccatttctcttcctgtctttatcttggagttctgtccatgatcctaaattctctaaggtatattaagagatatgagagtagacgcctcttctatagaccttcagtccatccttttcttccttcttctttttttcttccttttttccttttcctttcttcttctctcgattcctcctttcccttcccttctttcaactaggaaatattaagggttttctgcatataaggcctgaggtactctagctagtcacagataaaacatactttcccaactcatgaatggtgtaggctagtaaggaagattcagttaaacaagaatgtgatgagctttaagatacaagttttaaatataaggaattaggggaaaacttggcagttggacttaatattatctgtgggacaggtaatgcttccctgcatagaaattagccagaaggattttagggaattgtgtaggttggaggaacagtatatgagaaggcccagaagctagaaggaacatggtgttattaaggaaataagattctatgacaggaacagaatatgagggagtatgtgtaaagaaagttgggggaaggtgagggatggataatggaaggttctcaaagctataacaaagagtttgaataaggagtaggatcaggattgttcagttttctgatgagagcttgggacagattttggagtcagggagttactgacattgttttagttcttcctttctggagtttgtttgttgttttttgtttttttccttcctcgcctttcttctagtggattaaaatccagatttgggccatgtgccctaccactggggtctcactcagttgacgttagcttgaacttttcatttgcagtagttatgaatatattgctatttaaactaaaaaaaaattgcaactagggtattatgaaaatgataaactttataactaaatgcaatgtttagtcgcaagaacattatttgacttgacttctggtcaaatcaggattaatattttccattcaagttactaaatcccttcttgacattaagtacaacagtagcagctgcttttacttaacatttacttaatattcctttggacataactttttatatttcccaaagatgagtaccatatgtgaaaatttgcacattataattaattacaaatggggacctttgttttgaactcattttaccactgcacaggaaaaatctttaatttgaatgtctaagagctaaaaatactatttctaggacctgttgaaagtaaactattgaaaatcatgtgttttgtatagctaatccagaacctcagattctaagtagaaaataactttaaaattgtgaatatagcaaggtaagtaaccaaaggagccatttttttaatgtagtttacagtgaaataaggtctttttttaacactcttattcaggtaacatttcttcattcagcagacaggtactgagcacaaactacatgccatgctgtgatctcctgtcttttaaatctcacttttaacagcactgttctctcaataatatttttatttcttcacattccatatttttccttgagattattatatgcagataatgaaattcagttagtgtttgaagagtatgagactagaaataaccttaattctctagtcccaagtttaaaactttcttaaaaagtaatcttttagcaaagttacttaatttccaaccattactcgcccctttgttgtgagatttgtgtttcttggtagaaaataatgagagcaaaacatttatcaccacttactctgtgctaagtaatattctaagtacttggcacactttaactcattttatttctcacaacaaaactgaagtagatgtgtattatccataagttacagttgagcatgagacacagaaagattaaataattttcataggtttacagaactactaaatggcagaaccaagccaggctgtcttcagagtctgtgttattaatcaccacactttgctgaacaaattacagtagtttccaattctgggtatgtactggaatcacctatggagctctgtgacagcagctgcccaatctcaacctaggcctagagaattagaagctctgaggatgggatccaggtatcactttttaagaaaaggggtgacataaccgctgtgctaggtctttggccctggaagtttcatttttctcatattgttgacaaaaagatctcttaactttctacccagtgtaatttttttttattcttgagttcttagaatctatccagtataatttttcgaacatccattatcttctacctttgaaattgagttaaattagatggtttgggtgtgtttaatttatccaaatttgtcttttcattgatgactaaaatgagaattaaaaaaactaacaattagctaatcacatactttctgttttgtgattattgtagtgactataatttcactagcagttaccaaatgaagtattatatacaaaaaattttccttaatgttgttcaggaaattgtttattccatgttgatgttaaagcagatatataaggaatgcttcagatctggaattgatccatttctttattcatcctctctttttctgattgtttgtggccccacactttcttaaatggtttttttaactgggtaaaatttacctaatgtgaattgcagagatgttaatggtgtaatttgatgcattttcatacatgtgtacacacacataaacatcaccccaaacaaaatagagaacatctccatcatcccagaatggttcctcatgccacctctcagccagtctccacaggcagccactcttttgagttttgttacactagtttggttttgccagtacttgaacttcacatgtgtataaaatcatgtgatgtatactctttcatatctggcttcttaggctcaacaaagatatttttgtgactcatccatgttgttgaatctatgtgtagtagtttttttttttaaatcaaagaataatattcagttgtataaatataccaaaatttgtttaatcagtctccagttgatggacatttgggttgtttccagtttggggctattatgagtaaaattgtgttgtttactttccaaatatttggggcttttccggatattttatttctaatttaagtgtttcatggatagagaaaatgctaagttagatttcaatcttttgaaaagtaatgagaattaaagcccagtatatgttctgtcttgacaaatgttccatgttcacttaaaaagaatcaggattctgcagttgctagatggtagtgttccaaaatgtcagttaagtcttaagtaggtgataatattgctaaaatcttctatatctttgaggaatttttttttttttttttttttttttttttttttttttttgaggaggaggatctctagttctgtcagttactgagggaggagtatatactgttgcaactctggcttcttatgcttactatttgcatggtatatctttttttcagtcttttagactatcctcgtctttacatttaaagtgtagacaaagttcgttgttactttttaaattcagtttgataatctttgcctttgaattgcaatatttagtccatgtaatataataattgatatggttgggtttaggtctgccattttcctgttttctgtttgtcctagctctattttgttcttttgttcctcctttttggggggagaggagccctttagggttaaaagaatatatttcagtatctaattttaatttctttattgagtttccattagtttttgctttggtgattacattatgcatccttataatctacttggagttaatgtaaaaaccctgtaagtataatttcacttgtatttggtgtcactttccttaattgtgcacatatactggcaactaattctcatcttaatctgaaaacatctatttcatcttcatttttgaaggactttttttttttttttaatgatatagccaaattctgggttcttttgccactgaaaagatttcactgttggccaggcgcagtggctcatgcctgtaatcccagcactttgggaggccaaggcaggtggatcacctgaagtcagaagtttgagaccagcctggccaacatggcgaaaccccatctctactaaaaatacaaaattagccaggggtggtggtgcacccctctaatcccagctactctggaggctgaggcaggaaaatcgcttagaacctgggaggcagaggttgcagtgagctgaaatcgtgccactgcactccagcctgggagacagagagactctgtctcaaaaaaaaaaaaaaagatttcactgtcatctggctctgcattgctctttacaatatccattatttttgcggtttcctatttgtactgtttttttcctctttattttcaggattttatcttaatctttggttttcagcctattatacctacctgtaaatttatctaatatacctacctgtatattagatataaatatatctaatatacctacctgtaaatttctttgcatttattctctttggaggtttgctgaccttcttgcatctgtaagttgtatttctccaaatttgctgattatcaaccctaatttcttcacattttattttctttcccagttttccattgtttatctgggactccaatgacatatatattagattgtttgttttgccttaggtcactgcaatgcttttccagttgtcttcacttttctgtaaaaacaacacattttatcatttctattgatctgtcttgaactttactgaccctttcttttgccatcttttatctgctgttaagcctacccggtgaatatttaatttctgatattgtattttttaggtctagaacttccactgtattttttttataatttccactaatctgttgagattcccccttctattttctcattatgataatcttttaagaccttaaacatttattaaacctgtttttaagtggttttttggtaatcttgacatctgggtcatcttgaggttggcttctactgaccactttttcttttgaccatgactctcattttcctgttttgttagagtgataacttttgattgtatagcaggcattgtgggtgatatgtttaaaactctggattctgttatcttcttctgaaaagtgctgatttttgttctaccaggtatttaaattactgacagatcaccttgagcttgtagaggttttgttttatattttgttagggagaagctgtttcaattttgttcttggacccagggcaacttccttagtttaggacgtaggttttttatcctaagatgtggccctcttccagttttaactgaaagcccaaagtgttcacccggccatgaaactgtggaattcagattccaaactttgtttccctgcaatgggcagcagctgaaatctctgttcagctcatttagccttctaatggttgtttttctttgggttcccacacatggaattttctgggattttctttctcaattttcagttgttctggaagcagacagctctgtgtcctggtgactcaggctaataagagtgcaactttctgactgagttctggccaccctgctccccattaatactgaggactgccctctggttaaaagtcctataaatgtgggtctctatttttttcacccctcaaggagtgaatccattctaatttcttcctgcttttggctgttcttcagtgcctactttaaataattgagggttttttgtttgtttgtttgtgtgtttgtttgttgttgttgttttttctttttggtgtttttttttggtttttttttttttgagacagagtcttgctctgtcgcccaggctggagtgcagtggcacgatctcggctcattgcaacttctgcctcctgggttcaagcaattctcatgcctcagccttctgagtagctgggactacaagtgcacaccaacatgcctggctaacttttgtgtttttagtagagacagtgtttcgccattttggccaggctagtcttgaactgctgacctcaggtgatctgccaacctcagcctcctaaaatgctgggattacaggtgtgaaccaccactatgcccggccaataattgatttttatattttgttcagtgtttgtcatagttatatgcaggagagttagtctaatacatgttcctttgtcattactatatctggaacaccagtactttatttttataaaatttacttcagatggttaatatatttctgattatgatctcattagttctattttatttctattcttagatatgaagagaaggctactaaagacttggaacgatacaatagtcaaatgaagagagccattgaacaggagtcacaaatgtcactaaaagatggcagaaaaaagataaaacccaccagcgcatggaatttggcccagaagcacaagttaaaaacctcattatctaatcaaccaaaacttgatgaactccttcagtcccaaattgaaaaaagaaggagtcaaaatattaaaatggtacagatccccttttctatgaaaaacttaaaaataaattttaagaaacaaaacaaagttgacttagaagagaaggatgaaccttgcttgatccacaatctcaggtttcctgatgcatggctaatgacatccaaaacagaggtaatgttattaaatccatatagagtagaagaagccctgctatttaaaagacttcttgagaatcataaacttcctgcagagccactggaaaagccaattatgttaacagagaggtatgatgatacaatactttttaagagtaaaaatatttattataatagttcatactagattaaaatcgaaggtagaaggttgggaatgtttcctagtaaggattagtggtatttatttattttaatcttttaaacatttgatttctaggccgggcgcagtggctcatgcctgtaatcccagcactttgggaggccaaggtgggtggatcacgaggtcaggagtttgagaccagcctggccaacatagtgaaaccctgtctctactaaaaatacaaaagttagccgggtgtgatggcacgcacctgtagtcccagctacttgggaggctgaggcaggagaatcgcttgaacctgggaggtggaggttgcagtgagctgagacggtgccattgcactccagcctgggtaacagagcaagagtctgtctcagaaaaaaaaaaaaaaaaaaaaaaaaaaaaaaatatatatatatatatatatatatatatatatatatatatatatatatgatttctaatctttaatggaattgtttagaaatagtatcagaatactctagatagttcacttctacatttaataagtatgaagctcatttctctggtacattagtgacttctctagggtaattttgaagttagattgccatgtctttattccattatgtactcattgttttgacattttcaaacacataataaaatagaagtatacgatgcatacctttatcagtaattatccaagactttgccacatttgctttacctttctatacagtatatacacgtacattttctttccttcgcaaaattagtttagaacaattccccctcctatatctttcaatatctctctctcaaaaaatggctgttttctcaactaaacacaatacctttttcataccttaaataataataattccttggaatttttcctcattatctcaaaatacctttttttccagttttttaaaaaatttatatttaatttgtatctaaacaagatccacatactacatttggttatcttgtttatatatcttaaaaatcactctattattgtagattctgagtcatttgttcagtggaatgttctgttgtctgtatttgctttcttatgttgttcaacttctctcccctatgtttaattgggggttaattaaacatggagggctgaatagatttagattctattttctgatgaatctacttaataggttggctatatgcttcatatttcatcacatcaaaaggcactatcactaggttcaggtaatgacagcctgtctttcactggaaagtttcccatcaacctttccatgcaatggtgccaatcattgatgatttttgcctgaaataattttattattggttgtaatatagggtatttccttttcttattctatatgagcaaattgctttctgtaaaaataaataaccttggatgacaaagcctggggaaacaaaaataaaaaagattaaaaaataaataatgactaacctattaacatttcccttttttaacttaatatttctttttcagtcagacacaggtagaagagaatcatgacaaaaataataaaaacctgaagtttaaaaagataatttgttccctaggacacatcgttagataattctgtttcagaacttccaagaataaagcagaaatcatttataaaatgtgttaaaactcttgttaaagacactgccatcattggaggagaaaaaaacagggacagaacacagaaaaacatctgttaagtctgtctttttaaataaggaaacagcaaccacattaaccaaaatccagtatgtttcatagtattctcttgagattggcttaggaaactgtcagaggaacaattagaaaatagtgtcttaggctacattcaaacagtttaaacatctgatggtgcttttctctttcttacctaaaagagctagggtacatctgaatttttagacttgactgcttttctgaatggcattttgtaaacttcatttaaatttcaaaaatctttttgagctttttcaaatgataggtttttaaaaatatttttctatgtgatgttctgttcttcaaaaaacaaatacattaaaaactattattgtgggaccatattggcctgaaaaaaaaatctttcttaattgagcataaacaggaataaagattaattcaaaatagtttttcctccttcttttggaatgtggcatccccatcacagttaatgatgtaagtttttcaaaactgagtcagggactagtttatcccacaatgcgacaatgtgggcagggtaattgtaggttgggctcagttttcttgccagagttctaatgctgtttgtgtaacttacctctaagtggaataatttaggtacctataaagtaagggctcaataacaataaccttaatgatggctaatatttattgaacatttactgtatgataggaatttggcaaagttttttcatgatcttcacatcaactttatgaggtagataatatccacattttatagctgaggaaactgaaatgtaatggttaaataacttaactaggctcacacggacagtaaataagctgtatgtccaagattacaatctagacagtttaactgtggagcctgcaccattaattgctatacagtatcataatcatcaccaccaccaccatccctactgtctctcagatcgatttttaggatattggttagatgaaacagagtacatgtgatatatagccaaagctctcttctctataatattagctctcacagccattggggtcttcaaccattcagagctgataagcaaagatatcagcgtactggaacacagaacagtgccttgcatacatacctaggacaatatctgccacaaggtaggcactcaaatattcattgaaggagtggcaagatggtaactattcacatcaaccccgacagacacctttttgcaatgactataacgcgtcctgaccaagcctaaaaccaatatgtgtggttgatttgtaccctaggtgatctttggcttcctcaagtttttgcaccactcagaatcatttcatataccacctttggcaaacatgccagacctgcagtagactgaaggaagctctcccaagctctaaattgattaatttattagttcctagaagaaagagattacatgtttatctttttgttacagaagaaactttgaatagcagttgaaaatttggcagggtggaccacctaacttgacagtgtattattgtgtctgttttgaaggaataaaatggaattatttataaagttttcatttgtattagagagagccatttttaaaatttcacattcaatttgtaacattctagaagacagattatcttctttctgtatactgtgtgcagtaggtatttaataaaatattaacagaaatgtaaaacagtgatttctcatagggctacttatacctttgtattttggttaatgatgataacacttgtcaaagggccctaggattaactttttcccgtaaacccccttattttgtgtttttaataagttaaagggccataatttctttttcagtctttttaatggatctcattatttagacgttttatataaaatgacagcagatgaccaaagatacagtggatcaacttacctgtctgatcctcgtcttacagcgaatggtttcaagataaaattgataccaggtatgatagtgtggtttaatattttctgatgtggaaaaattagtcttgttccaagagttacatttgggtttcatgatttacagatatggtggtatatttttgtctcactataagtacagtgtcagctatgttaaaacatttttttcaaaacatcacctctgcctgaaacaagtaagtttggcatctctttcagtccaatgctttgcatttgcattttcataactaatcaaatagttttattgtaatttttgtcatcctttgacacaatattcaaactgcctgctttgtttaaattattaaaatactcctttaaatgataaaacacaaacatgtaggatattggaattgcctaacaaaaatggacatctttgcttttcaaaaaacatttgcttgttttgccaattagacgtgtaacatcagcagttgtactatatggagaatggatgatttggttccatggctttggtaaaagactgataaccctctttgctcagtatggaaattcattgggtggatttaaaaagaaaaaagaaaatccatctggctagagacttcagttttcctggctggccccttctctgttcctttatagtttccatactcaactgccttctgccctatcttctgttactttctcttcatctggtatcagagaggtacattggaaccatgaggaaggactccactgtctcccttcctgcctctaaacttgtcatgcccaaagtatagaaaaacagagctcgaccaaaatagtgtttgaagatttttaaaggaatgctttactgagatatgaaaataagtaaaaacaatgtacaaaagcatggagctgggtatatacagaaaatactttggtgtcccaaacataaactaattttacttgatttttgtgatttttaaggatacctaacctaagcttcttacctcctacctcaattctattagtccaaatcccagcactgccatttaaaaacaatgtgttttggggaaagtcacctggcctcactgtgtcttcattgaaaacaactaataattattgaataattattatgtacagggcactattctaagtattaaatgtattaatttaatctccctaatatccttgtaaagtaggttctattactgtccccattttacagatggaaaaattgaggcacagaagttaagtttgctcaaggggacacagttattggtaaaaccagaatttgaacctaggcaatctgcctttaaagcctagctcttaactcatttattatattgccttcctgtcaaaatttagatatttactccaggaagtattggtgagcattaaccaaagtaacaattaaatcagtgagcatggtacttggcaatgggagatgctcacatattctcttttcttaccatccattagccccctttagcaggcttgcagtcatctgttttagtcttcctagaaatatttcttgctcagggtccctggcatcttaaaatttatgtgaagtgaatttacttgaagcaagggatgggtgggggtatatgtgttttattctcaacttaatctgtttttctaattatatggcgttggtggcaggtactggtttttttcatgaaagatattaaacaggccaggcacggtggctcatgcctgtaatcctagcactttgggaggccgaggtgggtggatcacctgagatcaggggttcaagaccagcctggccaacacggcgaaatactgtctctactacaaaatacaaaaattagccgggcatgtggcaggtgcctatgatcccagctacttgggaggctgaggcaggagaatcgcttgaacccaggaggtggaggttgcagtgagccaagatcacgccactgcactctagcctgcatgaccgagtgagactccatcttaaaaaaaaaaaaaaaaagatgttaaactgcaggttgttgttgttttaaggataactgtcctttcttacctgccactcaattccaagagcatttttttttaactacccagtaagtttatatctcacagatgctttcagctcttagcttgtaagtagtatttttttaaatcttattgaatgcctaatactttccatagcatcaaagatgcaaaaatgattaagtcacctgtaaactgacttgatttgattggaattaactttacttagattatcatcagcattatttcccttgtcaataacagagcaagttaaagatatttatgttttctttcttcatttctttgtttttttatttttttaattaggttgtattttcttaacagttctgtcttgtgtgagagtattgtattttactaactttgaatcaacagtttgcctgtagtcacagtacttctttggataaggataaaaacatttgaaagagaaggaatacatctggctttgagagagaagattctcaatgtgactctaagaactttgcatgctaataggaatagctttttgtcctgcatcaataagaattccatattttaggaagtgaaaacttgtcaaaccacttactcatttgatgtattttccctgaaaattggtaagcatttcacagtattttatggaaacttttcaagggttattgttacatagttccaatgtctctaacttttccatatctgaattttacaaacacagaagttaaaatattgctcaatttccttattcgttgccaagtaccttttacccatttccactagtaattctgtgaaatgtgtatcattttccagggcaaatgtagttagtattagacttttcattctaatcatactgtaaaagatttaaaactaccaatagtgaaaaatcacttagactgatatttttggcaattttcatatctatataaatagttaaaagagatgtgaactagaatattctgctactgctttttgcctaccacacacagttttgagtttcatttacgtttcccctattgctcaaactcatttcgtttccactgttagttcgtttgtgtttctataaaggaatacctgagactgtgtaagactcaggtagacctgagactaaaagaaatgaccacaagccttccttacaaagaaaagaggtttatttggctcatggttctgcaagctgtacatgaagcatagtgccagcgtctgctttccttttacatataagttccaagtttaagtcatttctttgctctgatggtagccatgccacttcttgaatgatttgctgcttaggaacttctttcgctagatagtgaaattaaatagtgatgacctgggtcatcactcttaagttcaaacttctaccgatcctaagggcagaggtgtccaatcttttggcttccctgggacacattggaagagttgtcttgggccacacataaaatatactaacactaataatagctcatgagctttaaaaaaaaaaattgcagaaaaaatctcatgatgtttaaaaaaatttacaaatttgtgttgggctgcattcaaagttgttctgggccacatgtggcccacagaccacaggttagacaagcttgccctgcggcatggatacagtgcagccaaaatccttgcggggacataaaaaggatgacctttactccagtttccaataaattcctcaatatcatctgagactttgtgagcctttcactctgcgtatttctatcagcattttagtcacaaccatttaaccagtttctaagaagttctaaactttccctcatcttcctgtcatcttctgagctttcaaactcttccagcctctgctcttacccagctccaaaaccacttctacatcttcagttatctttatagcagtgccccactcctcagtactaattttctgtgttagtttgtttgtgttgctataaaagaatacttgagactaggtaatgtataaagaaatgaggtttatttggctcatggttctgcaagctgtacatgaagcatagtgctagcatctgcttctggtaagggtctcaggaagcttacaatcatggcagaaggcaacaaggagccagcatgtcacatggtgaaagagggagcaagagagagatgccaggctcttttaaacaaccagctgttgtgtgaactaccacagagacctcactcattaccatggggatggcaccaagccattcatgatggatctgccccatgacccaatgcacctcccactaggcccacctttaacagtagaggtcacatttcaacattagatttggaggggacacacatctaaaccatagcatctcacttcattgaactctgtatctcatcccttaatgcttgataatataatattatatattattctccagttgttctctgggaaaaatgtttaggataccatctctgtagtctaccagcattgcatctgccaaccaggtcaaggatgtagtctgtaattgggaacaggtaagggattggattattgaagtctcaggatctgaaactcttcaagttatatcacatctctttttttaaattaatccattgatagctactacttatccaagattggactgtctcttttcctttaattccaggtagcattatgtagacttcatgaaagaacactgttacaccgatacagccaaagaagacacatctttgctatgttccaaaaatatgcattctaaagccaaatctgatgctttgaaatatgtgctgttatggattatgtacccagttatacatccaatcctttagctagtttctagttttattttattttattttattttttgagatggagtcttgctctgttgcccaggctggagtgcagtggcacgatctcagctcactgcaacctgtgcctcctgggatcaagtgatcctcccatctcagcttccctagtagctgggactacaggcacgtaccaccacactcgtctaattttttttgtatttttggtagagacagggtctcaccatgttggacaggctggtctcaaactcctgatgttgtgatctgcctgcctcggcctcccaaagtgctaggattgcaggtgtgagccactatgcccagccatttagttttattttaattactaagagtaatttaagtaacagttaacatgtcagttttatttgtcctattaaaatattttgaacaaacagtattttcttctaattaataatatctccataaattactatgtgactgcttttataattcgtaagttaaaatcacagaaataattcaggcgtttagatattgaaatggtagggtagaatttgaagagcagcagttgttaaaacacttaaaccagttttattttcataaatatcatgggactccattttctctccaaagcaagaaatgatctaaacaaatttaaggaacagaacagcaataactgggattaagttaaattatataaagcacatgtggtgtcagtgagcacttatgacttaatgtgagaccctatgggaaattactatttgttctccaactaaggaacaaaactttgtcctgactgtattaaatttgaatgagggttcactaaatgttttaacagcaatttttgtttttaatggacatgttctggaatatgaacttaactatgtgtttttattttttttctttcaggagtttcaattactgaaaattacttggaaatagaaggaatggctaattgtctcccattctatggagtagcagatttaaaagaaattcttaatgctatattaaacagaaatgcaaaggaagtttatgaatgtagacctcgcaaagtgataagttatttagaggtacgcattattttatatatatgttattgtatacaggggtcccaactcccgggccaagccggttaggaaccaggccacacagcaggaggtgagcggcctcctagcgggcatcaccacctgagctctgccttctgtcagatcagtggcagcattagattctcatggaagcacaaaccctattgtgaactgtgtatgcgagggatcgaggttgtgcacttcttgtggaacaatttcctgaaaccatccccacccgccaactggaaaaactcttccacaaaaccggtccctggtgccaaaaagcttggggactgctgctgattctatatatagaggtattatagattggccagactttaagatacttatttcttaaaatagtaaattatttccaaatagtagaatattatctgtaagttttattatgtatttgcaagaagaacactattaaaaaaaaaaagaacactctattaagtttcacatcatagactgactgtggtaaactctatcatggattcttaccataacattttcttgggtacatattgaggaaagactttataaatgagatattttgcagtgaagttcttttttaaaaacatttcataaataatcccctcagaaggggtttaaactaatgctacctttatattacatacttgtctaaaaagtattgtaatataattctaagtcctgatctcatcaagaggagtagaagggaaggaaagtgaaagatgggaatctttgaataagcggaaattttcatttttgtgacagtattcaccacaaaagagaaatgtaagagtgggttaaaagaaaaggattaaggaaggttataaactttaaaatataagatagtagcaggaaaacaatagtgtttccatctatatatcttgttctagatatccctcaagattggtattatttaaaaaacaaacctgaactctaatgaagtttttctccctttttaaaaatgagccatttttgtttacagttggtagtgtgcctgctgtattctgaaggtcggacttccttaacaggaaagtctgcttgttaaaccttctgaagaatgtattcagtaatgttctgtgaatcctttaggaactttgtcatgtggaaattcccagcctattgtgcgggtagcttaacattgatagtttctagagacttcaagggaatattttcttgtgaaagagttagtatgaacttaaaggttgagggagctgtgggttggaagaaccatgtggggagaaataagagttcagaaataacaggaataaagtaaattgggactggttttaaatatttttttgctaatactttacctttcagtatgttaaggtaatagtggtataagtgttaagaaaaatgggctaggaaaaaaaaagagagaacttaaaccacggggatgcttccatttaaggtcaataagatgaatcagagagaaaggaaagtgaaaggagaaccaagagaggggtggatgtaaaagtcaaggaaggaagtaaatttaagaataagtagtatcatgttctgtatagggtaataattgctagaagactatcagatatggctactagatgacattggtaaccttgaagagaatcgtaatggcaaagtacaattgtccttgtatatactcagtggattggttccagcaccacctgtggatactaaaatccaggcatgcttaagtcctgcagtcagccctccagaacccacatatatgaaaagttggccctccgtatatatggatttcgcatcccatggtactgtattttctatcacagttggggtcggaaaaacatccatgtataagtggacccacacagttaaaaccagtgttgttcaagggtctgctgtggtaggaatagacgacatttgccagtagttaaagagtgtagtagtggaaaagtaggcagcaagtcgtatgatagtgaatagtgaaaggaaggaaagagtatgttaaacatgtctgtgttgaactggtggaagactgacaataaaaaattgcagaggaggccaggcttactggctcatgcctgtaatcccagcactttgggaggctgaggtgagtgaatcacctgagatcaggagtttgagactagcctggccaacatggtgaagtcccgtctctaccaaaaatacaaaatttagccaggtgtggtggtgcgcacctgtaatcccagctactcaggaggctgagtgaggcaggagaactgcttgaacccaggaggtggaagttggagtgagctgaggacgcacactgcactccagcctgggcgatagagctagactctgtctcaaaaaaaaaaaaaaaaaaaaaaaaattgcaggggaaatgttccccaaaaggcaagagggaagataggatatgaatttaaggtttagaaagaagaaactgaatcaagagcagaaaacagaaaaggggaaaaatgaaaataatatttttacgtaaactttaaaaaaaaatttcttaatcattagaacctgtgaaattttaggggaacttgagagaagtcatgttgatatatgtggtgaaagagtagaagttacctgctgagagtggaggggttgtgggaaggagttggtaattttagtacagtaacaaagatctgaaaataagagctgtaggtactataagagaaggttaattagagaggaataagaagatttccaggtgtcactgagggatcttaagagttaacatttgtattggatccagccaggacagttttatgactcaacgatgctcagtagaatttgtccaagggtaaatcaaaacaccaattcctcaccctgtcctagagggtgatctggcctctgcctaatttccttttcttgttcctcttttttttaacaactatgatgcacccacactgaacatttagttctttctcttctgtctgcgtgagatgcttttctttgcccatgatctttccattaaggtttcttatttattaatttttatttatttattttgagacaaggtcttgctcaaaagctggagggcagtggcatgatcacagctcactgcagtcttgaccttcaggctcaagtgatcctcctgcctcggcctcccatgtagctgggactacaggcatgccccaccgtgcccacttttttttttttttttttttttgtggagactgggtctcactgtgttgcccaggctggtctcgaactcctggcctcaagcagttctcctgccttgtctcccaaagtgttgagattacaggcctgagccactgcacccagcctggttccttatttaaattcaagcttaaagtcatctcctcaagtaatctttttccaactctacaatcactctatcatgtggcccagtttaattttacgcattatttattgactaaaatgttctgtcttttgtctgttttctgtttctctgcactagaatgtaaattgcacaagagcaagtcttgttttttggttcaccactacatcccgagagctgacaacatagttgatacttaataaatatttgttgagtgaattcataaaatgaaaataatcaagattctgtcttcctttttgccaggataacatgttttcagcttcagggtatatcatggtaaaatgtgtgactttccctttggacagggagaagcagtgcgtctatccagacaattacccatgtacttatcaaaagaggacatccaagacattatctacagaatgaagcaccagtttggaaatgaaattaaagagtgtgttcatggtcgcccattttttcatcatttaacctatcttccagaaactacatgattaaatatgtttaagaagattagttaccattgaaattggttctgtcataaaacagcatgagtctggttttaaattatctttgtattatgtgtcacatggttattttttaaatgaggattcactgacttgtttttatattgaaaaaagttccacgtattgtagaaaacgtaaataaactaatatagactattca

SEQ ID NO: 64 - DNA, 20377 bp, Homo Sapiens
taatttatgaagaaaagaggtttaattgactcacagttctgcaggctgtacaggaagcatggctggggaggcctcaggaaactgacaatcacggcagaaggcgaaggggaagcaggcacgtctggccatgttggagcaggagagacagagagagtgaagtgggagggctgcacgcttttaaacaaccagatcccacaagcgctcactcaatatcacgagaacagcaagggggaagtcggcccccatgagccaatcacctcccaccaggtccctcccacaacactgggaattacaatttgacatgagatttgggtgtggatacagagctgaaccatgtcaagggtagttcaaccgctgagattgattgattgattgactgagatggagtcctgctctgttacctaggctggagtgcagtggcacaatctcggctcactgcaacctccgcctcccaggttcaagcaattctcctgcctcagcctccctagtagctgggactacagcacacgccaccacacctggctaatttttgtattttcagtagagacggggtttcaccatgtttgcccggctggtcttgaactcctgacctcgtgatcaccctgcctcggctcttcttttgctggaattacaggcgtgagccaccgcacccggacaaccactgagatttagaaggcagtcgagtccactataccgcacctcacctggtttcttcctctgttggggcccctcgtggccactgttctgttactttttggtcctatttatttaaatggatggtgagctgtttgtcctccaggctccaacacttccaccttcagcttgtattacaacaataccagcctttcaagctactctgggtgaccccagaactcatctgaactcagaagcccaagagtttcattcctttcactttaggggactcagtgccctgctcagcatgaagtcgaagcagaagcatgacctccatccctaatccctcaagaatgaggagtggaaggtgttggcaggagggtgggggtgaggtttgtagatctgtaactgcatcagaccaaatctggttcaacttttttttttttttttgacggagtttcactcttgtcacccaggctggagtgcaatggtatgaactcagctcactgcaacctccacctcctaggttcaagtgattctgctgcctcagcctccagatagctgggattataagggtgcaccaccacacctggctaatatttatatttttagtagagacggggttttaccattttggccaggctggtcttgaagtcctgacctccacctgccttggcctcccaaagtgctgggattacaggcgtgagtcactgcacccggctcagttcaacttttatgtaatgaggttgtcagttgtttttcaattgccatggacccacaggttgaagggcatgtaccctgtgcatgcccaggttaaccaagcatgcaaccacggagtggaaactaaaagctcggcctgaagagctgagactgatttaagaactggacactccatggcaggagccaggatccaatcagattgagttttgctgtcaccccatggcaggatccagtcagatcacacctcccagcattactttattgcaagatccaatcaaatcacaactcattaccctatgcttataaaacctgacatagcccccagctgggtaagggagatttgagtatttcttcctgtgttcttgctagctgactttcaaaaaagctttaaaaaaaaaagccaggcgtggtggctcacgcctgtaatcccagcactttgggaggctgaggtgggcagatcacttgaggtcaggggtgcaagaccagcctggccaacatggtgaaaccccatctctactaaaaatacaaaaattagctgggtgtggtgacacacacctataatcccagctacttgggaggctgaggtaggagaatcacttgaacccaggaggcggaggttgcagtgagccaagatcacaccactgcactccagcctgggcgacagagtgagaagactccgtctaaaaaaaaaagttaaaattagcaccaaacgctttacaagtaaaaaaagtttgtagctgcatatgtttaagtaactttttagattgtaaaaaatacacatacaaaatggaaaggcacaaagaagagagcaaaaagtgcatgagatctcacatccaaggataaccgctgagaacatgaaagtgctgactcttccagcctttatactatacacatttaggccgttgttttgtttttataaaaccgtaatcatataatacagatagttttataatctggtttttaaacacaacaattacataacatttagctgtttcttttgcattcagattcataagggttccagtaactcatttatcagaaaaccaagagaaatagtctcattaaaatataagtacataaggcaggcatggtggctcacgcctataatcccagcactttgagaggccgaggtgggcggatcacctgaggtcaggaatttgagaccagcctggccagcctggacaacgtggtgaaaccccgtctctgctaaaaatacaaaaatgagccaggtgtggtggtgcgcgcctgtaatcccagctattcagaaggctgaggcaggtgaatcgcttaaactcgggaggtggaggttgcagtgaatcgagatcgtgccactgcactccagccagggcgccaaagtgagactccatctcaaaaaaagataaaaataaaaaataaaaataaaatatatatatgtatatatatttttccagacagagtcttactctgtctcccagtctgaaatacagtggcacaatcatagctcactgcagcctcaagtttctgggctcaagtgaatctcccacttcagcttcccaagtagctggaactacaggtggatgccaccatgcccagtcaattttttttttaatttttcatagaaacagagtctcactatgttgcccagtcctaataaacactatgtgatgaaaagaaaaaagtaaatcaccctaaagttaagtctttaatgttaagtctttaacgagaaatgcaaataaagcatttctcaatagattatggcaagagaatcaactgaagaataaacatctttagtaaatcttttgctcatgtgcattaaccaatactcttgaaaaccaagattaatttactgtaccttcttaatattcctttgaaattccttatggcgcacaggtagcgtagaaaataactgcttcacgctgactgtggtccctctggggtgggggtagggggtttcctggatgattttcccatcgtgatcaaacaccagtcgagtcccaaccttcaccgacgcgtggcaggtagaaatggtgacatcgctgtgagagaataccaggcgtggtgtgttcagtgagagacccgtgatgttgagcattgactatgcttttcttcacttgcttttctctcaaaactttcttaaaaagctgatgatccctctgagataaccaagatctaaacggttgaggagtcattataaaatctaaggtttggcatctaaaagacagtgagacagagagcactaaacatgctttgttttgataaaagctttgatttcatttttcaggttgaattgcaaaaccataaatgatctcaaggtttatttattcacaaatagagatttgttttgttattactcttcaaataaaattgttttaaagaattttttaaagaattaaaaaatttttttaaatttttaaagaatccaagagatattataattaaaatgtatatgtagggcagggtacggtggctcatgcctgtaattccagcactttgggaggccgaggagcgcagatcacttgaggcctggagttccagaccagcctgggcaacatggcaaaaccccatctctactaaaaatacaaaaattagccaggagtggtggtgcacgctatagtcccagctcttcaggaggctgaggcatgagaatcacttgaacctgggaggcagagattgcagtgagctgagactgtgccactgcactccagcctgggtgacagagtgagactctgtctaaaaaaacaaacaaacaaacaaaaattatatatatacacatacatatatacacacacacatatatgtgtatatatatatacacacatatatatgtatatatatacacacatatatatgtatatatatatttaaatataattataaaaatttagtatctgttctataattaaatagtgctttggtgaaatgtttccctaaaatttgatgatgaaaagcagtggtaactatcatttattacctatatgttatgttaaaattgagaagttactgttctaataagggtaaccatttttttttaacaatactatttgcttcatttcattcatttatttcccacatttcagaagtactaggacttagattggcagtgagacaaaacagaattcagaagctagaagctgagataccgagatagaaaattgtaaataacgattccaattaactttctgagaggtttttctaaggggtcaagtgaatggataaaaacattgtatcacctcagtgcacacagtgagctcagagcttccccctgaaaaccgaaagtttcaacttcagttaggtcggcaaactcttgaatcttacatgtgtgatgtttcagagctgaaagagactgtaaagtaaggactaagatacctcaagtgccaaaacaacggatatacatgatatctagtaactggcttaaaaaactgtttttgcgtttcccaagacagtgttactcaaaattctgagacatgtggcccaattattttataataggattagaaaaagtcaacttacttaagccttcaaagttttcttcttctaccccacatccattgtctgaaacttcaatgagatccactccatagtccttaagctttagatctagaaagtttaaatatttatgtatttattaaaaatggacccatgctagaatggcatgaacccggggggcggagcttgcagtgagccgagatcgcgccactgcactccagcctgggagacagtgagactccgtctcaaaaagaaaaaaaaaaaaaatggacccatgctataagcttttatattgatattatttataacatgtgcaaattgaagagtcataactatacctttagttaaaagtacgagtatcattttgtatatttcatttttataaagccctttctggccatttactagcccagattaaatagtttagctttttctttcctcttttttttttttttttgtccataggctagtcaaatgaagcagttggagtggagaaggtacaaaaaaatctgtaactggttgtgatcaattagtggttaacaccgttgcactttgaccagccttttcttttgaaagaaataattttaacatacccagtaaggagaaaggggggcaggcgcggttgttcatgcctgtaatcccagcactttgggaggccaaagtgagcagatcacctgaggtcaggagttccagactagcctgaccaacgtggagaaaccctgtctctactaaaaatacaaaattagccaggtgtggtggtgcatgcctgtaatcccagctgctcataaggctgaggcagaattgcttgaacccgggaggcggaggttgcggtgagccgagatcgtgccgttgcactataccctgggcaacaagagtgaaactccatctcaaaaaaaaaaaaaaaggcaactgcttctggaatcagacttcctggatcctattttattagctttataatctcaaaaaaaggaaatttcctgttccttaatttcctcatctgtaaaatgaagataataagttctatctcataaagttactcagctgattaataatttttcaggtttattttattttgttatttttttttttcttgtttttttttgagatggagttttgctcttgtcaccgaggctggaatgcagtggcatgatctgatcttggctcactgcaacctccacctccgaggttcaagcaattctcctccctcagcctcccgaggagctgagattacagccatgcaccatcacatctggctaatttttgtatttttagtagagacagggttttaccatgttggttaggctggtcttgaactcctgacctcaaatgatcagccctgctctgcctcccaaagtgctgggattatagatgtgagccactactccatgcctattttatttttattgagacagagtcttgctctgtcccaggctggtgtgcagtggcacgatctcggctcactgcaacctctgcctcccgggttcaagccattctcatgcctcagcctcccaagtagctgggattacaggcttctgccaccaagtctggctaatttttatatttttagtagagacagagtttcaccattttggacaggctggtctcaaactgctgacctcaggtatccacccaccttggcctcccaaagtgctgggattacaggtgtgagccaccacacccggcctgctttatttttttaatagagatgaggtctcaccatgttggccaggttggtcttgaactctggcctcaagcaatccccccaccttggcctctcaaagggctaggattacaggcgtgaaacaccacgcccagctattctgcaaattaaatgagatatttctgtgcaattcttagcataacacctgcctggcacaccataagaacacaagaaaagctgtcgttattattattactacctagctaagtactaggcacataataggtgctaactttaacttaaaaataataatttattactacatcaacacttgatagtcttatttcaataacaaatgtttcttgactacaacaacacacactaatcatttcttgtggcttaaaactctcccaaacttaccaatattagtggcaccagcatccagactgttttctactaactccttcactgcagtgcttagactcagtaccactggcccagagcaaatctgatggactgacttccgatcaataggtttgatggccttagcaggttctgtactaaagaaatgttacaagaaacaaagcaagtattcagctatatattttcatcctgattttaactgtgggaaatgactcaacactgtaaatagtttatgggtctaatctgttcagttattatattaacaaatacatttattatatccagaaatagaaacactgttttacaatccttaaacatgtacccaaaatacttctggatagatacttcaaattcaacagatccttactatctaggatccacatggagaaaactacattgtatctctcaaattaccaaaatctttggcaacaatggtgtcttctttcttgaaaactgaaagcatggcctggtggggtggctcatgcctgtaatcccagcactttgggaggcagaggcaggcggatcacttgaggtcaggagttggagaccatcctggccaacatggtgaaaccctgtctctactaaaaatacaaaaaattaggcaggcatcatggtgggcgcctataaacccagctactcaggaggctgaggaaggagaatcgcttgaacctgagagatagtggttgcagtgagcgagagcataccagtgcacaccagcctgggtgatagaacaagactctgtctccaaaaaacaaacaaacaaacaaacaaacaaaaaactcacaacaattctctaatggcgagggagtaagtaagtgaccgataatgctggagaaagaggaagtgactgggtccccagtacaggttagaatgaaaaaatccctaccaatgtaaatcaaatgtaaaatcaacaaaagagttcatgtatgtggtatgtgtgtgggaaggaaagtgatatttgggggttgggaggtgttactgagggtaccgagtacatataaacaactctttagtcactcccaaaggtctgggatgagtgttttttaacatgtgataatctactaacttacctggactatgttgacatggaaattcaccttccattatccacggctcctctccctgctccacttccttcacctccactccatgatgatgtttggcttggtgataatcataccctgttaatgggaaaagaagaaggacttgggcaagctgcttggcttcagaatctccaaagtacaagatgttgccacctcattagctgcataacagaagtgctccatttttttttaccttatcaaagttagaacctttcaatgaagaataatataaacactccagctagtgcccacaaggaattaaatggtgtcatcacttatttcttcaaactcaaggataaaaccccattcaactgagagcattcagaaagcaagccatcctcacccacagaaactagatggctgtagttctccaacatcacatccccgtatgctatcttctcatcagggtccagttgccgccactcctcctgggtgaaatccacagccacatctttgaatgacactggcccctgtaatggcaacatgatcagaattgggagatatggaaaagggatagggggatatcattttacaaagttcactcgtaaagttaaccatgaacattgtataccttattttatgttacagattatggaagggaaatcatattggaaatcatagaggaaacatatatcctttggggatatatatatataaaatatatattaccccacaaaaataaaaacccaaaacacaactgaactcctattttgcaactgaactgagttttggggatatgagatgagtgaaacaccatgcctgctctcagaaagcagacaacctaataaggagataaacatgtaaacaaacacaagcattttactccttgtcacttctttgctgccaggccctccccttctcctggacctcttcatgttggagtgcccaccactcagttcctggtcttcttcttcctaactcactgctctggggctctcacctagtttcagctccttgttcttttgtcttttttattctcatagtcagtggcctctggctatctgcatggctgagttttatctcaaacatctcaatctcacagcaataaatattcgttaaatgaatgaatgcccaaagctgttattagagtaatgcagacaaggtgcagaatgatttaacaaaagaggatcaaattattttaactttatgccatcagttaggcttcacagactcagttaacttgaagtccttaaagatgaattgtgtattctatgggatgaaggggaagaagaatatgatgaggtgtaaaaagtaccaatggcaaacatgaagcagcttcaatttttaagaggttggggctgggcatggtggctcatgcctatagtcctagcactttgggaggccgagatgggaggatcatttgagctcaggagttcgagaccaggttgggcaacatagtaagaacctcatctctactaaaaataaaaattttttaaaaaattggctgggcatcatggcacatgcctgtagttccagctacctgggaggctaaggcaggaggatggcttgagcctgggaggtcaaggctgcagtgagctgtgaatgcaacactgcactccagcctaggcaacagagcgagaccttgtctcaagaaaaagaaaagaaaaatgcaaaactcctgggctccagcaatccacctgctttggcctcccaaagtgttgggattacagtcttgggccagcataccccgcccaaacttgtagtttagaaaaaggaagtgcccagtaagcaagttacattatcctgttatttataaagaagatatcaacaaggggttcaaacccagtgatatagctaggaccatgtagatcccaagagatagcagagtcagagccgctaggctggtgggctgagaaactaaagcagaacatccaagcttatccacaggcaggccaaaggagctgataaaatcaccgagagagagtaataaccttctaggttaagttagtccaaaaggcaaggaggtggaggggttagaagatggatcagccaataaataacataaaattacatgccactacaataccacttatatcaatacaaatacccaaaatgaaacataaccaaacaaaatccagtaccagattaaaaacataatatacaacagacaaataggacttattccaataatatagactagtttagtatttggaaatctattaatatgataggccactataacacagcaaagaagaaaaatcttgtatccatgaagatacttgaaaaagcttgacagaaaaacctgatttaaaaaaactaaagaaaacagaaactgatggatgcttcattaacatcaatattatgtatatatacaaatataaatattacaccctaatatgcagtagtacatatgatatatatgtgacatatgtatttcaattacacacaagcatatatatagtttgtgtgtatacacacacagacacatgtacgtgcacacacacggacacacataaactcttatgcctcagtcttcttggtccaaaagtcaggattttacttaacagggaaaaactacataccttcccactaagatcaagaacaaggtattaataaaatgctcattatctacaactagagaagagaaaacaattagaggaatataactaaggaaaagtaaaagtgctcgggcggccaggcgcggtggctcacgcctgtaatcccagcactttgggaggccaaggcgggcggatcacaaggtcaggagatcgagaccatcctggctaacatggtgaaaccccgtctctactaaaaatacaaaacattagccgggcatggcggcgggtgcctgtggtcccagctactcgggaagctgaggcaggagaatgacgtgaacccaggaggcggagtttgcagtaagctgagattgtgccactgcactccagcctgggcgacaagtgagacgccatctcaaaaaaaaaaaaaaaagtgctcgggcacggtggctcacgcctgtaatcccaacactttgggaggctgaggcgggcagatcacctgaggtcaggagtttaagaccagcctggtcaacatggtgaaaccccatctctactaaaaatccaaaaaaaaaaaattagttgtattattaaggtcaacgtaataatacaaagatatcagttaccctaaattactttataaatatacaatcccaataaaaataccaaaaagctttttcctggaactagataagccgacactacagttcatatgaggtggaagaaaatcaaaaacagctcagggaaaaaaaatatttggacatggataaaactggacccaggccaggtgtggtggctcatgcctgtaatcccagcactctggaaagctgagccagaaggactgcttgaggccaggagcttgagaccagccttggcaacatagcaagaccctgtctctacaaagaaaaaaatatatatattagaaaaaatagagagagagagacatgaggacttctgccctcaggtgtgataaactaacaggtactgcatataccctccaacctgaaacagcacacaccaaagaacaacaacaaaatcaaaaacagaaagaaaaataaaatggagaacatatatgaagcaatggtttgtttgtttttgtttttgttttttatgagacaaagtctcactcttgtcttccaggctggagtgcgatggcacaatcttggctcactgcaacctccgtctcccgagttccagcgattcacctgcctcagcctcccaagtagctgggattacaagcatgcaccagcacgcccggctaatttttgtatttttagtagagacggggtttcaccatgttggccaggctggtcttgaactcctgacctcatgatccgcctgccttggcctcccaaagtgctgtgattacaggtatgagccaccacgcctgggctgaagcaatggctttcaaggcactgattatcaggcagtagagttatctatgagtgatgggaaataaacaaggtgaaccaatcaacttctgccttgagtgactccaggccacggagcagggaagaagaacagaggcagatgtgaggagaaagagctgcgagtcgggaaaatgggcaggaaactacaacccataaggaaaacaatcagtccatcaaaactggcccagaattgacacagagtttacaactggcacagagcactgagagagttcatcattctattccaaatgttcaaaaaaattgagacaggcaagatgtgaaaaagacccatgctaaccttctacagatagaaactacaatatctgagatgaaaattatactggacaagatgaacagcatcgtggaaaaaagagattagtgaatataaagacagcaacagaagttacataaaatgaaacagagaaagaagaattaaaagcaaataaagagcaacagtatgttgtgggaaaatttcaagtggcctaatatacaggcaacaagaatcaatggaggggaggtggtgggtacttgaagaaataatgataaaaatgttccccaagtgatgacaccataaacccaagatccaagaagttcaatgatccccaaaacagaaacatgaaaaaaagataccatgacatattgcaatcaaattgtccaaaactagtgataaaaagtttaaaacaataaggggggaagaaaaaaagacatgttatatataggggaacaaacatgagtatgagatcagatttctcttagaaaaaaatgtaagcaggaagacaacagagaaacatatttaaagcactgtggagaaaaatccagcaaaaacacctttaaaagcaaagacacaatgaagacatttgcagacctacaagaattcatcatcaactagaagaaatgttaaagaaagtccttcaggcagaagtaaaatgacagaaaataaaaatttagatttacataaaggaatgaagagtaccagaaatggtaactgtgtattttctctcattacttaaatctctttaaaagatacctgggccaagtgtggtggctcacacctgtaatcccagcactttgggaggctgaggcagacaggtcacctgaggtcaggagttcgaaaccagcctggccaacatggcgaaacctcatctctactaaaaatacaaaaattagccgggcgtggtggtaggtgtctgtaatcccagctgagggaggctgaggcaggagaatcacttgaacccaggaggtagaggttgcagtgagccgagatcgcacccctgcactccagcctgggggacagagtgagactctgtctctaaataaataaataaataaataaacaaataaaagataactgtttaattaacaacaacgtaatagatagtgtgtggcactgataccacctgtaaaaatgaaatgaacaacggtgtaaagaccaagaggagagaaatggaagtgtcctattgtaagcttctcttactctaagaaaaatggtatattacttaagaataaactatgataattaaggctgcatactataaattctaactcactaaaataataacagtgtgatagccaaaaacccaacaaaagatataaagtagaatcataaaaaattctcaactaatcaaaaggaaggaagacaaacagagacattttaaaaagaaacaaagaagatgagactaaaagaaagcaaagacagtggactataacctaactcgttttatcaataatcacattacatgtaaacggtttatacatccccaattatgagacagaaacagactgatgaaaacaagcaagatccaaatcttgctgcctacaagaaataatactttagatataaagatgcaaataggttaaaagtaaaaggatggaataagatatagcatgcatgcattactcaaaagaatgcttcataaataacaaagtacatttcacagcctggaatattagcagggataaggaaggccattttacaaagtggttaattaatcaacaggacgtaataaccttgaacatttatgtatctaatataacacataaagcaaaaagtggtaaaattgcaaagagaaacagaaccacaactgcagcagatttcaatcccctctcccccacaattgatacaagtgggcacacaatcaacaaggatatagtacacctgaacaacacaaccaaccaacttgatctcattaacatttatcaaacactccacccaaccagagcagaacaagccatcttctcaggcatgcacagaattttcccaagacagatcctattatgagccataaatttaagaggttccatgtagtattccagacaaaaattcagtctaaatctaatcatgaagaaagatcagggaaacctaaatttaaagacttctataaaatcactggcctgtattcttcaaatattataatggcactgaggaacaaatccatattaaacagacttaaaaagcatgaaaactaaaggcaattaacagtcctagactgaatcttctaccaaaaattaaaaattgctataagggaaattattgggaaattggccaaactggaaaatgaactacagataaaagtattaaatcaatgataaatttcctgaattcaattactgtgctatggatatttaacagaatgttcttgattttatgagatataatctaaaactttatagggtaaagaggcatgacatacccactctcaaatagttcagaaaatatatatagacacatatgtatatatgcatataaatgattaatgtgggaaaatgttaagaatgaagtgtctgaacaaaaggaagtgtctgggatttctttgtaaaatccttgcaatttttctgaaaatttgaaatgatttcaaaataaaatgctaaatagaaaataatgctatcaaatatatattatatgtatacatttgctatcaaatatatcaaatatatttcaaaaggactcagaaaccaacttaaagggattccgtctggccaaagatggaaccacttaattttcaaaaagaatcacaacttctatgtactgaaatatttactatctgtttaaacccatgagctcatgatggtaacaaaacaaaaaaaccttcctgcttagaagcctactcaatattatagaaactgtctttcctgcatgaattacataaacaaataaagaatagaaatttatctttagaaaagtattctaggccagctgtggtggctcatgcctattatcccaacactgggaggtcaaagaagaggatcacttgagcccagttcaagaccagcctgggcaacaaagagaaacctgtctctactaaaaattaaaaaatcagctgggcattgtggcatatgactatactcccagctacttgggaggctgaagtgggaggatcacttgagcacaggagtttgaggctgcagtgagccataaatgcgccagcctgggcgacagagtgagactctgtctccaaaaagagaaaagaaaagaaacgtattttggctagtaaataaagaataaatggtagaattagcagatcaccattttgcctcccctaatgaactagtaaatcacagcaataatcaacagtcaatagttcttaacttcacaaaaacaaagaaggtaacacgtgcctccagaagtagacaaatgccacatatggtatagttgtgtgaaaagaactgaacataaacttgattagacttctagatcaaactaccaattttacaaggcatatgagatattttttaaaaatttgctaaaggtgaaacaagggtaacacaatccaaactgaggataaccaacacagtttcttcaaaacaatgagcacgcaagagacatactatgggaactattaaaagatttaacgcaactgccacatgtattaagagagtattatgggttattcctagcccctttaaaaaaattctttattggccacgtgtggtggcttacacctgtaatcctagcactttgggaggccaaagtgaaaggataacttgaggccaggagtttgagaccagcctgagcaatacagtgagaatacatctctaggccaggagcagtggctcacgcctgtaatcctagcactttgggaggccgaggcaggcagactgcctgagctcaggagttcgacaccagcctgtgtgacacagtgaaagccagtctctactaaaatacaaaaaaaattagccaggtgtggcagcgtgcatctgtagtcccagctacgtgggaggctgaggcaggaggatcgcatgagcccaggagattgaggctgcagtgagttttgatcacatctacactccagcctggatgacacagcaagaccctatctcaaaaaaagaaaaaaagaaacaaaacaaaagacttcaccatttaaagacaaacagaaatacttacagatgaatctttttaagagccaagaaaagagagactccatggagaaaatatcagtttcgaagtaacggatgtcaaaggcagacaaagggtcctgtgaggaaggggctaggaattgcccgctggatttgactgcaattaaatcactggtcatctttactgactgactcagcaaagtgaaaaggacaaaacgaaaacactgagaactgaaatgagaaacagaaatgaggaaatcttcacaagagagtaactgtttgtattgtttgctgtgcaacccaaacaaaaagacgaacaaatatctgaaggatgatcatgtcattcattccccccatgatctaggactcaacagtaaaaacagaattctgtttacttggatcacgatatttccgtccctggaaaaattatatgcaccaagttctccttgggcagcaggccctctgcttacataagcaccaagaataagccataagtcagtaatttaatggttgttgttaggaaagctatccacaattatatcaacttgaatgaagaaatttttccaagtcctagaaaatcttttaaatccacaagtaacaaaattggtttctccttataatcaatgcaaatcatgtcatggatggtgatatggtttcagtttgtgtcgcctcccaaatctcatattcaattgtaatccccaatgttggaggtgggacctggtgggaggtgattggatcatggggacaatttcccttttggtgctgatactgagtgagttatcacaagatgtggttgtttaaaagtgtgtagcgcctccccctccttcttccttctcctctggtgatgaagatgtacccgcttttccttcgccttccaccatgactgtaagtttcctgaggcctccccagccatgcttcccatgatagagcctgcaggtgtgagccaattaaacctcttttctttataaattacccagtcttggttatttctctatagcagtgtgagaatggactaatacagatggcattttccttttgtgatgactgccaagaatgtcagtcctgggtgcggctcaatttcaacagccttaaaatatactacccatacatacaagcttcacaaatcatttttggtgctgatctgccacactaactatattttacaggataatgtctatttccacattcccattttaaagtatgaatcctggctgggcgtggtggctcatgcctgtaatcccagaactttgggaggctgaggtgggaggatcacctgaggtcaggagtttgagaccagcctggccaacacggtgaaaccccgtctcttctaaaaatacaaaaaattggctgcgcacggtggctcacgcctgtaatcccagcactttgggaggccgaggcgggtggatcacaaggtcagcagatcaagaccacgatgaaaccccgtctctactaaaaatacaaaaaaaaaaaaaattagccaggcgcagtggcgggcacctatagtcccagctgctcaggaggctgaggcaggagaatggcgtgaacccaggaggcggagcttgcagtgagccgagatcacgccactgcactccagcctgggcaacagagtgagactccgtctcaaaaaaaaaaaaaaattagctgggcatggtggcgcatgcctgtaatcccagctactctggaggctgagaccggagaatcgcttgaacccaggaggtggaggtggcagtgaagcaagatcatgccactgcactgcaggctgggcaatagagcaagactgcatctcaagaaaaaaaaaaaaagtatgaatccttacaagcctcttaaaatgcatcataaaataaagttgaggaacatatatacaagcaggaaaactcacctgcaatgtgttcatttcctgttgctcttggaaacatgcagagactgtggctgatagacctagaggggcagaagcaggtcactgaagtcatgagggctccggcctgcaaaggcagaaatctcctgcattacgaaccacaaaagaaagctcaaataggttaacaccctgtgaacactcagctgcaaacactcagaagggcctaaaagagtgatacagggtttcaccacattggccaggctggtctcgaattctggcctcaagtgatccacctgcctcgggccaacatggcaaaaccccgtctctacttaaaaatagcaaaaaaattagccaggcatagtgtcacatgcctgtagtcccagctactcaggaggctgaggcacaagaatcatttgaatctgggaggtggaggttgcagtgagcggagaccacgctgttgcactccagactgggtgagagatactgtctcaaaaaaaaaaaaaaaaaaaaaaaaaagtgataggggaagcatgcacttgtaactttgtaactctaagataatcagatagtaattaggtgagttaagactctcatgggtaacatggtctgccatcaagtacaacgtgcaaaaagaaaaaaatttcccattatacagctcatgatttttgtggtttgtttgctgagacagggtctcaatctgccacccaggctggagtgcagtggtgcattcacggctctctgcagcctcgacctcctgggctccatccatcctcccacttcagcctcctgagtagttaggaccacaggtgcatcccagcatgcctggctgcttttgtattttttgtagagtcagggtctccctatgttgcctaggctggtctctaactcctggtctcaagggatactcctgctctaggcccgcaaagtgctgggattacaggtatgagccactgcatccggcccgcgttttcttattgtctctctaaactgcttaaaatcaaagaagccataggaattgaatatgtgagctctcagaaatgaaatgaatgtgtataaaatatggttttgtttctaaattatctaactgaacttggttattgctgcacctaataatcttctattaagaaaactaggatacgggagaaagagcactggcctgggagataagactcctgagttctactatgagtaattccatccacaaagccagtgacctggtcaagtcacccacctgctaaggcccagtctcttcccctagcaactgaggcagcaggagagaatccctgcaggctgttcctgcattactacgattctcccagggcagatctaaggggcgaatcagcagacacttaaatgagagaacagaggtgctgagggacgtttagaggcggtcgaaatctggagcacggagaggaggaggaagggctgttaggggttagcggggagtggagacgacgtccgcagctgagggtggtgacaccctccacgcccccgtaagcctcgtcctcccagatcttcccatgcagcgcctgttccgtgcagccggaccctgccctcgaacccaaacacacgtctctcctgcaagcgatcgggaccctccccctgccccacactcaaaggtccccaacacacggtgacttcacccaggcccttctcgctctgggcccgaaaatcccagacttaccctcctggggctccgcagcctctgccccccggctcccgagaggccggggcggggctgctgtcgctggcgcgcgcgtctgctcgcgaggtcccctcctgtccacctcaccaaggctgttctgctcccgaggggcccgggccgggcctacggggcaaatccaggcgggtgtccttctgggggcccagatccgcctccctggggctcaccatacagcgacggcctagtctaggccgccaaggacacatacgggccaggcccgggtcccgccgccccttcgcctccgccgccacttcgcctccgccgccacctcagccgactccctcccggcccctctggccccagcgccgccgactccggggctcacgctccggggtccccgcttgagcctccacccggcccgcgcgaaccctggtctgcacagctccgcgtccgcctaggtgctggcccgggcggtcagcatccagccccgcaggctatgcgatgctcgtccactgcaggccaaaccctaggaacgagagcaagcggcgacctgaagactcacaggaagcgagggcagtgc

SEQ ID NO: 65 - DNA, 33526 bp, Homo Sapiens
tttagataaatgctttattattttctcaaaatgttataaaagtcatttctccttagtacagagagctttatacattttatctagtaatgaatacaatctagtttaacactcatctattttactaacatttccttaattttcaattcgtatttttccttttctttcctgattttagctttttttaggcttctgtcaccacaaaatgttacttggaaaactagatcccagcagatgacctgtacttctctgctctctcccctactgcaaagaggcagtgagggcagcattagtaagcctgactcaggggaaggtaagtggcctgcagagaaatggtcctaggtccgcaaccgaggcgagtgaacttgtcggacagatgaagactctaactggaagaaacgatcagcgcattcacggatgcaccaccatccagaaatctcccggtggcttccatacaaaaactgatgtttctaaagatggaaagaacaggtctaggaggcagaagagtatctcctagcaaagtgttctgtagctcaaagggtgagtgggctttggtagcaaaaagctttgaaggcttcaccctgggtgaatctgacaagggctggagccagacgggacctgcagcacctcctcagcttggcctcgtctcccctgaccccgcctccgtgcatgctgcctcagtttgccttctcagcagagaagcccccaccaccaggggctgggcatgcccagggcaggtgtggggcctgtagtggggcagcagcaactggtgggtgcccctctagtgggcgctcagctcacagctgctcaaatgggaacaggtgggaagctgctgctttcttttcccttttggtcttcttgggcccacccttcagcttctgcttttcttcatcttctcggttttgaggccaggaggcagccagtatcctggccgcttctgcttgagagctggtcccctcctcttcatcagaagagagtccacctcctgcatctgtgtggggagctgctgcctcactctggacaggtggcagtggtgggaggacacaggcgagggttagtaatcagataccaggaagccccatgaagaggcagcaagttcccagcctgccctaagctgtgtaactctgggaggacaagggcatgggacagggcagggagagagcccagacccttcttactgagccgtcccagcctggggtgcatccaagcagacactggagcacctgctacgagctgagtgcaggggaacacaaggatgatggctgggcaggaagctgccctctaggagcacactgcctcatctggggatgcctgtgattcgtgccttgcatttgctacctcatttctggaccaaagcacatgatgtcttgaacgggcaagatgcacagttcagccctcggagccctaagatctgaggcggcactccctgccagctgggatggctagggagggtttggatggagaaggcggcaaggagctggtcagaacataaagtcagatgaagggcttttctccaccagagggactggaatgaggagcgtgacaaaaaaatgttgaaaggcaaacaggcagcacagagggttggagagagggaacaaaacatgccagagcagtttctgctgtgtctgacacagcactgactataccatgtaactgggcctagggtccatctgccccagggaggggcccccttgagggctgcatgtcaaattcacacctgtgtccaagcctggcctggcacatggcaggtgctgtgagagaggtactgagcgggccactgcaggcctgcagcatggtcacaggcactgggaacactggaaggcggaagggtgcaccaaatgcaggacacttggccctccctatgtgttcagcgccaaatcagacccatggcattgctcatgtggacagtagaaacggggacactgggacagggcttggggcagaagagccagctgaggcctcactccagggacacctttcccaacaaggtaaaaacaagcggccttagagacagaagactgaggtgtcctaacacaaagctatccctgacttgaggctggggcagaatctgggccaggcctttctgagctgcatctccaagaaactgaccctgagcttgtcttctctgcaaagaacctgcactgaccttgggcccgtagcgacgcttcagcctctccctgatgagcagacctttggccagcaacttccagttccctagagcccgcttctcctttttctgcaggcaaaaatgaagtgggagaaaagtgttaagcactgacattttcaggaaaaatattaagatggaaactgtgaatgtaaagacagatatatacaccactttagaatatagcctctccttcacaccaagtctcacttccaaaaaattgatctgatttacaaagtgatatactatacctgaaagccacaaaaacagataactttttaatcgttactgactccaaaatctttagtgggtgaggtcttccagaacctggacacaggcaattcaagacagaggcaggtgtgggcagcaggggcagtagaccccagagcccggacccaggctcctcagggacagtgatagtctgcggggtgggcaggagcctgctgtattcagtgctcgctccctcgggtgcctgccatgatgtcagagagggctgggaagagcctgggagcacacggaggcggcctggggaaggaagaggccacccgctgagtgttgcttcccgcttctgctgtccctcagtcctgcatatgcgcttacctccttctccttcctttcaatgactgcctgctcattttcccaggcagtcaggagcacgtctttgaattcctcgcagacgatgtatccatcagtcctgtggggacacaacgcgatgtcaaccctcgaacctgctgcctgctctgcctctcctccctccccagtttgtggaagacagtgggccacatctgagcactaggggtcctgaaggatgtcgcgggtcagccagtgtcccacatcctccgtgcagaaggcaggcctgtggaagctggcactgcctcttcctccccagattctgccgaagaaagctggggtgaaagcccctatccagcctcacccatcatggaacagagctcactaaccaggcagctgccggggaaagatgctgactgttttttgctcactagcctgtgagtccctaaacctgggaagaacgttttaatccagcattacgatgccagtttcattggctccgttccctctggagggaagccagaattggtaaagcactgactttgcaaatccagtgtaacatcctgaaaattggagccaccaggcctcaactcccagcagccccatgccagctttccatccccatctctggagccacccctccccatccctgtgtttagcctccatcgaaggcccctcacgcacacgggatgggagtagccgccatggaaatcaaagccagtgatggcctggacacagtcgatgtccagcttgcgggccacgcggtgtagattgggcaggttcagctggacacagccaataggcatcatgctgggcaggaagaggtacacattcccaaactcgttccggggcacctgtgtcgggtgagcaagtcagcatttggccagcaggggaacaaggcggcctggtcctgagcccttctgatgctgcccttaccttcccgtccacggccactgggggctgatactcctctgtctgccagtagccaaacaggcccaggtcattttcttcccgcagctggggctcagcaagtcgggctttccgagcacggttagaaaagcctttcaccatctgcaccagaggacacggccaccgtttacaacaaaggcatccagttcctcagcaccgggccaggcaccatgctcagtgccgcatgcctggtacctggtgaaccctcagaacacacctaccagctggggtgctttttctcccttttttttttttgagacagagtctcgctctgtcgcccaggctggagtacagtggtgcaatcttggctcgctgcaacctctgcctcctgggtttaagcaattctcctgcctcagcctcctgagtagctgggattacaggtgcctgccaccacgcccggctaatttttgtatttttagtagagacgggggtttcaccatgttggccaggctggtctcgaactcctgacctcaggtgatgcactcgcctcaacctcccaaagggctgggattacaggcgtgagccaccgtgcccggctgctccccttttcttactacaagcactagctaacatttatggaacattctctgtcccagacactattctcggtgttttttgtttttttatccccctgagacggagtctcactctgttgcccaggctggagtgccctggtgtgatctcagctcactacaacctccacctcccggattcaagtgattctcgtgcctgtctcctgagtagctgggactacaggtacccgccaccatgcccagctaatttttatatttttggtagagatggggtgtcaccatattggcctggctggtctcaaacttctgacctcaaatgatccacctgccttggcctccgaaagtgctggaattacaggcatgagccactgcgcccagcctatcttcagtgctttatatgttattatttaattttttcaacaaacccacaaggtaggtcttattattgtttccattttacagatgaacaccacagacggggtaaatgatttgcctaaagtcacacagctcgtaagggccagagcccacactttcatccactagcctatattctgtgctgtcatcactgatagcagtgactgagactgagagacaaagtcacttaagagctgatggctggtaagtgacaagaaccaggatttacaattcaggtaactgtccatcagtagagcctgtgtctcaacatataacctatgtctgctcacacgccctagaaagcactgacagttcaggactcccagtgtgctccccaacagcgtgcagtggccaaggccaagatcttccctggggagtgaagtggtgagaggggcgcaggacaggcaaggacagagtcacgtaactcttagaggagtcaggcatgggcgtgcggctgagggctggcccctgggcctcagcatacagacttcctctagtgcaggggcccacaagcttgttctgtaaagggtcatgcgtggcctccatcacatattctttattcttctcattcttataaccctttaaaaatgtgaaaagccattccccaggttgggggtggcctgcgagctctcatgtccattcctgccatgatctctgggcgcaccctctctgtcaccacttcagggacagagggactctgagttctgacaaccgtccctttctgagaagccattcacccagcacactgttcagtaaacttccactgggatctcctggagaccaggccatgacccagtcatgaaggagggatggagcgaggacagtctttgctcttaggagctcaggctcctgcaggggaagagacagagctacgactcagcgtgatgagtacagggtggaacaggagctcagaggcaagccattgcccagccctgaggacagtggaggcaagaaaggctgctcaaaacaggtcccgcctgagcagaggcttaaaggggcaaggggttgcccaagagaacagggctggaccccacagggcacagaggtgggagaacactgggacctggggcctaagtcctctggaatgcagaggcagtgagcaccagaacatcactgtgcaccatggggagggtgcgggactcagactaaaggcgctggccaaggtgggacaaggatggccaagatgcacagaaagagcctagtgactgacaggggaatggattcaggctgggaaggaggctgtggctgttgcccaagcaaaagatactgaggcaggagctggggtggtggggatcagaacaaggggtgaatttgagagatttgggattccagaactgtgctaccatgacagccaccagtcacgtgtggccactgcacacctgaaacgtggctggtctgaactaaggtacagaaagtcaaatacacagaagattagagagacttaggaacaaaatggatttaaatatctcatcaacactttaaaatatttcttactgctgaaatagtattttagatatatctggatatattttaatgttaaaattccacctgtttttggtttttaatgtagctactaaaaaatttaaatgtgtggctcacgttacatttcaactgaacactgctatgctggttccagcacaaaagacaggtgagatggtgcagagaaaatcctcagcaaccctgcaggcccaggcagggggcatcgcccactccagcctgctgctggcagtgactgtgaccagcgcctgcagcctttcccactaagcggaggcccctccactccccactcagcttcccggagtcttgcaacccccaaggactcctggggtctgatgagaagtaaatggtctctgtgatcagccactgtacacttccggtcgtacggagctgtgtgtcctgtgaatagtctctgtgggacctcgctcggttcgtgttcctcaagagcaaccagcctaacagtgccgcagcacagtgtgaaaggagcactggctttaaggcagagcctgggattctcacctgggctctgctctgccattttactaactgtggggacttggacaagtcacttgccctgagcttcagttttctcatctgtaaaatgggcatcataatgccaattcctatggcttttgaggcaacagagatcacatacatgcaaaatgctcagtgaactgccaaacagaagggcaatctgactggagaacgtgctgctataaagcagggctctgacctcccaggacccagtaactcaattccaacctgtagaacctttgaattcacaacaggagtctgaggcctactttttggcctagatttcttttgtgttttggaagatccatttcttacaaatgtcttattaataagacaatttaaatgtttctctcctccttgaatcctgctcaagccgggaaagtgagacatttctgatcaggatcctgggcaggactgggaggctcatcatcacttctctgcccccagctctcccgctcagctacaggcctgtgtcaccactccccacagggaccccccagctccagttaccttgtagggtacttctccaagcctcaccactcttgctttcttcagccacgtgtccctggaatgcagagtgtgcacacaatccctgtggaaccaacacaggacacaaaggtaactcagtccacagccccactgcgggaatgcgggacagtggagagcgcagccctgcaggctccctcctcaggttcagccaccctggagcaggccgagctcctagggggcccagagaagctgtgctaggcaaacagccttgaacgtggactgcctgtcttttgggggatgtgtccacttacaaaccctaatctgcagcctttgtgccttgcctccaccactcctccccttcataggttttcttctcctctgctgtccagagcctgtgagagctccagctgcagactatcaggatggggtaaaggccgctgtgcgcaggcacactcacgtttactaccaccaccaagcgaacacctgctgaggctctgatctgctgttaacaccatgtgggggagggaagtgtccaggagggggcagtgaacccaaaggaaggctgcagagaagccaactataataagctaataagctatcacagaatcaagacacctgcacatggaacagtcaaatgattcctgcaggcaaagttcctctggcttcactcttcctcccgagctaagagctcaccaaagccgtgcaaatctactttccaatgaggctcaacccctcccttgccaagccatttttaataaggcacgcccatctcattagtttgcacccccttcactctgtccagggagcggctccaatgagcaagggcaccccatttcctcctagtgcaggttcagacccttacccacagaggaatctgaggctgaatttcagcacagcacaatggatggaggttgaaccttgcctgtgccacttcctggctgggccacctggacaagtcactttaccttcctgagcctcagtacagacagtccccaaagtccagtggtttgattcaagatttttcaactttatgatgatgcaaaagcaatatgcacttgggagaaactgtgcctcaagtacccatacaaccattctctttttcattttcggtattcaataaactacatgagatattcaatacttcattataggctttgtgttagacagctttacccaactgtaggctaatgtgttctcagcacgtttaagggaggctcagctaagctatgacccatgctacatacaacaggagtgaaccttgaggactttatgctaagtgaaataagccagtcacaaaatgaccataaataccgtatgattccacctacatgaggtccggttaggttcggcaggttaggtatattaaatgcattctcaacttaggatatcctattttcagcttccaatgggtttatggggatccaacctcatcctaagtcaaggagcatctgtgtcctcacctaccaactagggacagtgagcttgccctttctaccgcacatggttgctgggaggaccagacgtttcctgtgtgccagagcagcgcttctgccagtagcaccaacctgccagagctcaaagctccactcatgctcccactgggggcggaacatctttgactgcccagaggagtgattatgtcatggtcgtggtcttcagacaggagcgggtaaaaaaggggtcttaggggttgacaggtaggcagcatctggacatcttcctaaggaaaacagcagggaaatggacacagtcctctcagaataaatgtgaacttctaaccatttcacacccgttaaaatggctattaacaaaacacagaaagtaacaagtgtcagtgaggatgtggagaaagtggagaccttgtggactgtcggtgaaaatgtaaaatgggtgcagctgcggtggaaatggtaaggtggttcctaaaaaaatgatgggaattaccatctggcctagtaattgtactgggtatatgcaaacaaacaaacaaacaaacaaaaactgaaagcagaatcttgaagagctatctgcacacccatgttcacagcagcataattcacaacagccaaaaggtggagacgagccaagtgcccattgatggatgaaggcacaaacaaaatgtggtccacccacacaatggagtatcagcctaaaaaggaaggaaattctgacccatgctacaatatggatgaaccctgaggcattatgctaagtgaaataagccagtcacgatgtgactataaataccgcatgattccacctacatgggtccctatagtaggcacactcagagacagaaaggagaatggtgggtgcagggctggagaaggggaattcggagtttttgatggggacggagttttggtttgggaagaggaaaagaaatctggagatggatggtggtgatggctggatgacagtgtgaatgtgcttaatgctgtaggctgtacacttaaaaaatggttgagatggtaaattttataatatttataaatattataaatttatttatatatataaatatatataatttataaatattataaattattataaaaaatttataaatattttaccacaataaaaaataaatcaataaatatgcacctctaatgcttccttctgtcactgacatggtgcctctggacgacgcctgcattctcttcccaacaggctttctcccgactacccgtacatacccataagaggaagcctctatcagggcagcccaggccccctgctgcctttgactgctgggtgctaaagtcccagaacagcaaagccctgcccctgcccagggcatcatgccccccaccgacatcaaacagaaagctccaagacagggcagagccctgaagagagggtccagcatgactcccatggggggctgacaagcaggaagtcatccccagtgggaggactcaaatcgcccactctcatgtgggtttccctacgcttcctttttctcttttctgtaccttcctgttttctcatttattaagaacatctcctatttcttggtcttgtacatcccatgtcttttaaaatcacttattttacttgctttttattcccatttctcaaaattcctgtttctatttttttcttacctcaaaattgtattaacatttttcaattttaattttatatatattttattcattttttgctcttattccactctttttttagctatttctttttactgtggtataaaacacagtcacataaaatacaccattttaaccatttttttgtttttgatacggagtctcgttctgtcacccaggctggagtgcagtggcgcgatcttggctcactgcaagctccgcctcccgggttcacgccattctcctgcctcagcctctccgagtcgctgggactacaggcacccgccaccacacccggctaattttttgtatttttagtagagacagggtttcatcgtgttagccaggatggtctcgatctcctgacctcgggatccgcccgcctcggcctcccaaagtgctgggattacaagcgtgagccaccgcgcccggcccattttaaccatttttaagtgtgcagttcagtggcattaggtccattcacaacattgtacaaccattaccaccatccattcccagaactttttcatcccaaacagggctctgtacccatgaaaaatccactcacttttaactttcataatcaaatcctttattccttccttttgtatgtttttgacttatatttgtggggtgtgttttatactgccctatcttaaattttatttttcctactttgtattttattttccctgtaactgtttttcccctgccattcttttaatccctgttttaattttcaaattttcttctctcctacacatcacacacacacagcacacgcacactggctcagcccgagaatgctgtccagtcagatgagctcccatcagcaacccttgcctaggaagaaggctgctaatcccatgccatcaggaagcccctgaggccaaccaggctgcctcacgcacctggagtagaccgcttctccacgacaatacccaaggatggcagctgtctcgggatagatggcctcatatttcaggagatgccgcttcagggcatacagagggtggttcttatataagccaatggcagtgggcaaaggctggtccatgtgtttagcctgaaactgcaaaggccagacagacaaggttgagcatgttatttagaagaggaaatgaagtttgagggagatgatccttagactaacttgttctgacaacagatggtggagccaaggtttcatgaacactaatggttttgtaacatcgcatctgtacctccggccagtaagtcagttacagatcaatcaaaagctttaaagaatcaaataaatctgtggcttgtggcaacttcaaaaagttgtctaacctatttgaatgcttagacacctaacccagccccagcagatgtgttaaaggtctgcaaggaagaaaaacacacagtgctcttcagtaagaaggtcttatttcaaagggacaatcctcttctagagcgtgagcttacctgtctgctctcacaggaaactgagagcagcggttctcaccctgcgacttttctcttcgtccactatgacagtgttctctctgcccttctctgagattgctcatttctcagtaggcaattcactgctgtaagtcaccctgttcactaggctctctaaggcttgcccttggcatctcttcaaaaaccccaacagactagaaaggactggcaatgtggagttgctgagagtgggagaggacgctgcacgttcagcttccactgcgctttaggtaggttagttacgataccatctgcatactttccacttaacctgtcattactaagtaaaatgaacttagtaatgcacccattttacttagcattactaagtaaaatgcacccctggagcaaacactcaatatgggatgcattgcactcctataggaaatgattaataaatctgcaatttacctatcctgagggattggaaataaacctgcgacaaatctgggcatgttcctgtgtagaaatggcaagctccacccaccaccaccactgccatacacacaggcggctcgggcactattcctggtgtcagtgctggttctaggatcaagtgacatagctgtcatgttctagaagtctctgcctcccggtctgccttctcaatagactgaagatactgtctcattccgagacagtatcatgtctgtctcattccgagacccctctttcccaggaggtgagtgttctatgtatgaggggtgtttgcacgtacatctttacattcacgcatgatgggggaggggggagaatatatccatgggttattccttctttcactcagtctgagttatattacttgcataaattattttaaagctccaaatttataactgggcaataactaaaagtatacaggctccaaagccacacagacctgggctcaagcaccgcggcagttcatctttcaactccacaactttttacactaaaattaaggcagcaactgccccagctttatatggctgtgacaattaaatgagacaacccattaaaaacacccaacatagtgctgggcatatataaggtgctcaaaaacaggaataattttaataacctgactgtgtcttggagcccctggcagccaaggccttacctccaagtcttctttcttctccctgtccataaatgggctctggtatggtctcaaggtctcggcccaccactcagcatcaacccggcacttgcgggtcactgtcatccagactgggtcgtacctctgtgtgacatctcggacccagccgtcactgtcaatgcccaccacataggtcatgggcttggtggcgtacttgtaacaggtcagaggctggcccaccacaccgtgcacacagtctacacatacccacttttcctcctgctcacagaacacctctagccactggtctataccagctatgcttcttttttctgccttctcaccatcgctgcacattttcttgcctcttttactgcttgaagagcttgaggatgccgctggcaagcttgggtccttacgatggctcccacgatgggtcctggaggcactcttggacccagcctttgtcctctgaggagcgggggctttcctctgctttggagggccaggttcggaatcctcatcagagggatcagaggcttctccactggagagctcaaaatcagagccgctgccagcctcatcactcccactctcctctttataagacaccctggaggccacccgccgctcccggccatgcggacgtcgctgggttgccttctcctgcttgtctcctgggccctcatcttcctcgctggaggagggcttgctccgtttctttctgcctcccttgttcctcttccctttggcacttggcctgcaggtgcccttagcaaaggtttcctcttgtttggttcctttgctggtctttggtttggtgtggttttctagaacttggctggaagtttctgaggagcctcctggatccgcagtcaatctttccttggaaggtttctttcccttaaacagaataagaaattttgcttttttttctcccccctcttttgctaatgatatgatagaaatcctgtaatctaatagggttaagtcaccagctagagaaccaatacatcaagatgtccccagctcagacagtgatcaaccagctatccttcagggttgtatgtatgtattggctaaaatctgtagcatcttagataaggccacagtataattcttttcaccctaactgtaaagagaaaagaacatgggatttggacagccaaacatgggtctgaattccagttctaactcttattggttacgtaaattaggtaaattacttaacctccgagtttcagtttcctcagcagtactactacccaccttggacatacgcattttgcaaacaaatacttatggacttaatacagctgtagttttaagaatacagatattatgaaaatcagcttctagaccatcaggcttcagacaatgccaataccccaatgagtacagcatttagcttcttgaagctaacccagaccacctcaaaatccacagtgcttcactcatcagcactccacggagcaagcaaggacaggcaccattccacacaatttacagaacagaacaaaagcagcactgggccgaggcctctcacaggccactctgcacacgtgaagttcaggctgctagatacccactcacatgcccaagtcttccctaacacagggtatgtgcaaggctcgaaagaacccacactccgtgaataccagctcttaaaaaatataataatgatcaatttttttaagtgtgacaatttcctgtcaattgctcctcttctctggcagccctgcgcacctcacctttgctgttgctgacttcagaggaattggctgtagagacaataccagccgggtcaagagctgcagagcccggagaatcagtaagaatatctatgatgaaaaggaagaacatagttatcctaagaaagtaattaaagatgtaatgagttcaatgttgtttgttatggtgcttgttcaagacagggaaaagctggaaacagccagactgtctaacagtaggcgacggaaactccagacactgttaaaaacgatgatgcagaagtttatcttcgtagaagaacaggaacatgctcatcatatattaaaggaaaatagaagttttcctttaaaaagtatgatgtgattacatttttataagaaaaatatgtatatataaatttagacatacacgtatatttgaaaaagcatccatatactgggttatgggtgtttacatgctttttttctctgcttacctaccttctgattgttctgtagtcaatatgtgttgcgtttgtgactaaaataataaaatgaaataccactttgggaagaagaagtagaaagtatcattatcgtcagatcaccaggtctgttccctgttttccaattttccccacattgaatctttaactgagtctgcagctctgaaagctgttaacttggaagtctgggagcccctcaggggacttaactccaatggcaacagtgataatgtactcggccaaggccttcctacacgggtctccaggtcccagcatctctccttgattactgccacagcctcgggagaaagtccggtgtgagaagccattgttatggtgagaaaaatgattgcttttgccttgtttcttctgcggctaaaaatttccaaagtgtcaaggtcatgaaagacagggaaagcccaaaacactgtcacacactggaggagactaaggagacatgatgactaaatacaaactggtatcatggaacagaaaaaggatatcagtgagaaaacgtggaaaatccaaataatgtctgtagtttagctgatggcattgtaccagtattaatttctcagtttcttcttgtacagcatggcacaggagcacaggtccagaagtctggataactaagtgttcaccactagctgagtgacttccctaagcctggatttctgcatctagaataatccctgcctcggcttcctcacaggactctaaagaggattagacaagataatgcaggtgacaggactctggaaacagtctagtgctacccaagcatacacagtcaccacctttagtaagaaatctatcaatgtacattgctgaggaaaaaaatcaggttacagaactgtacgatccctacaaattagataacatagagaaaatggacaaaatcccagaaacatacatatatgaccaaacctgactcaagaagtaatggaaaatctgaacagatctgtaataacagatcgagtcagaactcaaaaacctcccaacaaagaaaatgtctaggactagatgacctcactggtgaattctagcaaatatttaaagtggaatttacctcaatctttctccaactctttcaaacgttagaagaggaaatattttttaacttgttctatgaggcaagcattaccctgacaccaaagccagacaaatacatcacaagaaaataaaccaatttatgaatatagatgcaaaaatcctgaataaaatactaaaaaacaaattgaacatatgaaaaggcttatacaacatgaccaagtggtacttatcctaggaatgcaaggatggttcaacataagaaaatcaatcaattaaatatacattaatagaatgaaggaaagaaaatccagaggatcatttcaactgacaaagaaaaacgcacctgagacaatccaacaggctttcatgattaaaaaaaaaaaaaaaaaattcagaacactaggaatagaagggaactgagtcaacgtgataacccagatctagtatgatacttaatggtgaaagattgagagctttccctctaattatcaggaacaaaacaaggatgcctgctgtcaccaccattattcaacattgtacttgaagtcctagccagagcaattaggcaagaaaaaggcatgcaaactggacaggaagaagtaaaatgatctactcatagatggcatgatcctatacatagaaaatttcaaagaatgcacaagaaagctagtagagctaataaatgaattcagcaaagctgcagggtacaagacaacacaaaaaaatcagttgtgtttctatacatttgcaatgaacaacctaaaagagaaattaagaaaacaatgctatttccaagagcatcaagaagaataaagtacctaggaaaaaatttaaccaaggtaaaaggctgtacactgaaaattacaaaatacagctgagaaattaaagacaaaaataaaaggagagacatccatgcttatggactggaagacctaataaccagatggcaatggcacccaaattaatctacagatcagtgcagtccctatcaaaattccacagctttttcacagaaatggaaaaacagatcatcaaattcatatggaattgcaagaggccccagataaccaaagcacactgtaaatgaacagagttacactgaggcttcctgatttcgcaacttactacaaagctatagtaatcaaaacagtgttgtactggcgtaagaacagacatgtagaccaacagcatagaattgagaggctggaaattaacccatacatttatggccagttgatttttgaaaaggatgccatgaccatccaagccccattgaaaaaattgtctcttcaacaaataatgctgggacaaatggatatccacatgcataagaatgatattgaacacctacctgatatatgcaaatattaactcacaacgtatgtaagagcagtaactataaatctcttacaagaaaacacaggggtcgatctttatgaccttggatttgacaatggaatcttagatacgacaccaaaagcaaaaagaacaaaagaaaaataggtaacttggactttgtcaaaattcaaaacttttgggtatcaaaggacttcatcaagaaagtaaaaaggcaacctacaaaatgggagaaaccatgtggaaagcatgtatctgataggtaactaatatccagaatatacaaggagctcttacaaatcatcaacaaaaaggcaacataattaaaaaataggcaaatacttgaacagacatgtcctcaaaaaagatacacaaatgaccaagaagcccatgaaaagacactcatcatcatgtcattggagaaatgctatcaaaaccacaatgaggtatcacttgacacccatcataatgactataatcaaaacatcagaaaataaccaagtgttggtaaagatttggaatcctcgttcattgctggtggcaatgtaaaatggtacagtaactgcagaaaacagtttggtggtttctccaaaaattacatatagaatatacatatgacctagcaatttcaatcctaggtatatacccaaaagaacagaaaacagggtatgtaaataaatatatgtatagacattattaacaacactcttcacaacagccacaaggtggaaactaactaaatgtctgccaatggataaatggatagagaaaatgtataaacatgtaatggaatattattcagctataaatattaatgaaatactgatacatgctaaaatgcagatgaatcttgaaaacattatactaagcaaaagacaggcagaaaaggccacatagtgtataatttcttttatactaaatatcctaaataggtaaatccacagagacacaagacagattggtggttgccacgagcagggacaggggggtaacaatgaggagtttaatgcgtatatacagggtttcccttgggggtgacaaaaacattttggaaatagaggtggtagttgcacaacattgtaaatgtactaaatggtcactgaattgtaccccctctttaaaagctgtgtgatcctattttgcttaaacaaataaacaaaacaaatacatacgtacacacatacacaggaacaaagtctgggaggacaatactaaaatattaatgagttaccagcctggccaacagggtgaagggtgaaaccccatctctactaaaaatacaaaaatcagccaggcatggtggtgggcacctgtaatcccagctactcgcgaggctgaggcatgagaatcacttgaacccaggaggtggaggttgcagtgagctgagattgcaccactgcactccagcctaggcggcagagagagactctgtctcaaaaaacaaaaacaaacaaacaaaaaaattggcagcacattataacataattatcagccttgccaaatatcttagacttgttaaagccaacacggaagaagagaactaaagatgtcaaccatctttttctccagagaatctgggactcccagattgaactgtatggattaataggaatcttctagggataaaaccacatttccatctctgtttttgttttattcagacagagccttacctacaggtgcctgtaggcatttgataaagcctgcctgtccctggagcactctgccatcacgattcctttttatggacagaaccctcctcactgcactgctgcctgccagtgtcaacacccaaatgtgagatacaaaaacacattctcaaggacttcagcatccaatttgaaaaaacatttccttgggacttctgaagacaaaattggaaaaattaatgaaaatatttctagcacatctgaccaaaaactacgggctttttggtacaccacaactagaggcgatagggaggaaagcatacaggccctccactcagactctgatcccaatctcgattctcaggctcaccaaggaaaagaccttagaggcatcatgtagctattctgggcttcagcagctatcaacgtcattatgaggactgaataaggtagtgtcggtaacacacctggaatggcatctggcacatggctgccattatcattagttaacagtactgataaaaaacagtgatccgggaggatcacttacatggaccaattcctcatcatctcgagcagagtaaatagcaaatctcctttccaatgtagtctgcaggttatcttgttcactggctgaaagttctgcattaactgtaaatgttccaatgaacctggggagaaagcaggcattccttgtgtcagaggtcagggcaaaggggaattttcatttccagccaagaaaataaaaagagggagtgaatcgtgagacccgcctgcctctgtcctactttccccagcccgtctagctaactcctatcatcactgcagacccagctcagactttacctccttggggagccttcccagacctcccagctgagaaaagcgcccctgctatgtgagcctgcagtccccagaacaccccttccagggcactcctcatgccatcctgtaattacctggtatgtatttgtctccccaccagtctggcagctctaccagggcaagatcatacctggcatttctctatcttcaatgccatgcccaccacctgatacatagttaccgcctcagggaaggtctgtggaagtgacctgaacccagcctctgagagaaacacaaatcctacactccccagctctgcaggacaagcggagggccttaccacttcaccaggtttgagaggtagtaggtgtccacatctcgaggcagcactctggtaaagcgggctgggatgatggacaggccaatagcatgcagatctggctggctgcagatgttatttcgatagaagccatttgctagcaggcagagaaggtgaacctgtgaagaggaaaggaggaaggggcagcatggaaggaaggccggacaccaggaggaatttttgctgccaaagtcaagacatgctgtggacaagaaatatgtgttgccatttctacatataagaaagtaaaaacactagcattggccacttcccaagcttgtctttgaccctctctttttctctctgtatactcattccttcaaaggaatcatcaaacctcaaagcttcaaaatacaaattgctttgttttcaaaatacaaactgtttttgttttggtcttgtctttcagagatacatactgaaagatttctggatgaaatgctgccatgtctggggtttgctccacgagatcagaagaaaaggcaagtggagtggagctggagagactgctggaagcctgtggaagccggcgggatgcaccccactgggctcactgggctgctctcgccacctctctgggtgtttgagcccaaccttctctgtcacaggctccacatctttgcccttcctctgaccccaaaacccacccttcatccacctactgaaatgattatatgacctcttcacctcttttcacatactgctttgtgtcattttcccttcaacattggcttcctcccccccgactaacagcctccctattttaatcaatagtgctgcctctctctcctcactcaggcctcaaacctgagagtcatcttccctttctttcacctccagcacccaacaagaggtgaaaggcacacagctgtctcgtttcgtgccccaggcctgggtgagggaggcgacccctctctaacctcgtcaccatccttgcacctctagatttctgcagtagctgcacacaaagcaactcacccatcccatcactatcctctcaggcagcccaccatccatcaaagggaaaccaaagcccaccctcccttcacccccaccccccaacacctacatactccacacacgcaggtgagctgggcacctcgccgtcccctccacaacttggctagagtcttcaactttttctcctagacctggctctaatcctttcccctacataaagccttccccagctccacagagccacgctgatctctttcactgttccaggcatagccttgagtttctctgtttggaagtccttgttccatctagagatcagatactcctcaattgtaggaaataagctttatccaagtctctatccccaccatgccaagcaccttgctaggtgtgtgcaagtgttcaataactgtcagctaaagtcaaaagccagtgcctgcagctgggattagaattaatgacattaaatggctgaaaggagagatggaaggcaagtgctctttatttagcctctgctgcatgccaggcattgtgctgcaagttaccttacctataatacacaaccaccctccaagacagacactattactacccccacctcccagatgaggatgcaaaggctcagagagagtaagaaacttgccatggccacagagcagcaaagccagaaataaagcctcggtgagcacaagctctttgcaccgacaaggaaaagtccttccccatcattccttgcccttaccttgtgtgtgtcctcatggacccctttattgaaacgtttcatcgccctccgaagatatgtctcaaactccagttttatcttttcactgcaacaaatagtgaaaaatctgggaatgaaggggggaactgaaaccagactccactcccccaggcaattccttctcctcggatgacagtgaatcactctccctgtttccctacacaaggctgtgctactcaagtccgtctgcaagccagctatttcctgcaggctctttggctccttctcaccagcaaacctcggcctgggacattctgtacccagacaaccctcctctcaaccagcagcagatcacacctcacctacatgcctcaaagctcacttcttccaggaagtcttctctggctgtccaactcttccgactactgactctctccttagcaaccattacctttattaatgttaaattaacacaccatcatttatgtgacactgttctagtgtaaaatctctttttcagtctgtatcccattaatcttcaagacaacttgacacttcttgaatgatttgtattatctccctcttctgtgcctagtaatgtgcccatcgcacattggaattcccaagccatcagaggctgcagaggtactccgggatgctgggaaggataggggctccctaccacggcgggcactgcctcaagtcctgcagcatgacatggtgaggaaaatgtgaatgccaagtcaatgagaaggattaggtctcagctcttccattactggctgagtgactcttgaaacgttacttagcgtctgaacgttacttagctcctcattcacaacactgttctaaggattaggtaagataacggatgacctgctcaatccttggcacacaggagttccctctcctcatccctcaccagccccagccaggacacgaaggtgtctcattcaagtctctaaaggtaaatcaggttcctgacccaaggttctcgaccactttgatactcagtcctggtcccctacaagtttctccaaagtcctcctaagcagcagctgttgcctactgcatgtgacaggagcctagaagcaagggcctaagcttaccttctttctcttgtcttcgcctgctctggcgtttcaatctctatctccactggcttcacaggcagaagagatcgagagaaggctgtactttctctcacgtcacccagcacaggctcactaagttctatcaacaagcatttttaaaaatcagtaatagtaataacaataataatagctactgtactgaacagaatcaaggttctgctgggaaggaggaagtgaggcatgaatgtgagggagacagcccacagagacccctagacatgccttgccctgagtcctaccatgtgccgggcagtgtgctgagtgttatatattcgtgtgtctcatttaacccacacaacccagacagtctttagataaagaacctaaagcatagagatactgggttgaatcagatacagacccctctatcaaaaagctgacactcatgcatgtatgtatatacttaaaactctttaaaaaaaaaaaacccaagtgagaataatctccttttctctgtattctgtattaccacaataacaattagcacaatttgctttgtatagagtcatgactcaggtgtccatctttcattctcaattataaacttgtaagtgacaaaaaatatatccttttcatctcttcaccccctacgttgcttgtatacagtagctgagaaggactgaacttgctgaactggatctaattgaaaacttcattagcaaaagttccttaaaagaggctctgggcctagaagccatgacatcttactggcaaagaatgcatctaatgccagatcttggtctctatacatgaatctctattaaaatgaaccacagcttcttgaagaaaaaaaggctggtttcaagtctacagcaagaaaagtataagctgaacaaaaatgttctcaaagactaatgaggccatgtcaaaaggacatggtagtacagctagcttaaaggtagcatgactagaagaggaacaacctgacattagaggtggcttaatcaatgcaagatgaggtttaaagcatcatctaggaaggattcttggaaaaaaaataaaagtttaatcaaaattacatgtctttggacttagtttacaagaaatacaggggatattgaaacaagtttaacaccaccatgagatgtgtgactgtttatcagacaaaactagaacatgagacagtctacaaaacaaaagactaggatccttcaaaaaaggcagtgctatgaaaagcaaaacaaggcggtaggtgggaaatactgctctatattaagagagtaaagtgacataaagaccaaatacaaggcttggttggatcttggtatggaaaaagaaacaggcataaaggatgctttcataacaattggggacttatttttcattttcgtaggtgtgatgaggtcattttgtcatgcaggagaatgtctaattattaggaaatgcaggctgaagtattcagcagtggagtatcagaatatctacaacttattttcaaatggttccacaatgaatatttacagagagaaacatacattcaatgtggcaaaatgttaatgaacctaggtgaaggacatatattacatttttcactctttttataaatttgaacactttcaaaataaaaaggtgaggaaaagtcaggccagacagaaggaatcagggatgataacattagctggtatttactgtgagtgtatgatacattaggcccattacatttgcaaactttcttttccccacaataatcctacagcctatactgtgaatggctcacactaaacattcagtgtttacagagtgttaccaatgagaaaactcagttcagagaggtgaagttacttgctcaagattaaattactcactcacactgccacctaagtggcaaagttgagcactgaacccaattctaactactttcaaagcctgtgctccttctcctaaatagtgctgcctctctatttatatctaccccattgacagtcaccagaggaagagagtaaacagccttctttggtaacttggccatgagtttttccatatatatcaaagcaagtccctagtacaaccttatctgtggtctaattagctcaaaagaaaacaaaaggattgcaattagtgatctgactccaaacagaatcaaacaaaaaaacaaacagaaccaaacagttctgaaaacaaagaaagatgtttcaccttcaacctcttcccaatcattttcactttcttcctcttcttcattgctgtcttcattcatggtagcccctctcttcagatggtgtgccttcttgaggtcacttggaaagtccctgtgtaaagaccacaggaaggaagatgaagaagactcagacatcctagtgttccattcaagctaaatggaatttttaaaacccctcctatttattgagaatctgttgcaactatttaaagatgattagtaagctctgagcctcacttcctccatcaacatgtgttccaaatctcatcaagatgtgctctgatcatctgtctaattactaccagatgtgctgttaaaaaacctacaatctagatcgtgtgaaagaaaacatagctgtgcctggacatgacaaggaaaaattagaagacaccaaaataataatgagttccagaactgtgatatctgtgtgatatatgtgcagttggaggccagaaagaacagaataaaatctccatttatatatcctactataagcctactcagacttcttttccatctttaagaaatatgatgtaaggagactgaaattcatagcattctaacttcaagcagggatgtaactacacataggtgagtcataaataacaagagacatagacagctagctagctaagtagataataacatagataagtagctggctaaacaatggctcaaggctaagtacttgctgatacgtaatatatttctgcaaattcatatataaaatgtgtctagagtatccagttacttttaacttgtgtaaactttggcacttggtaccaagtgagaatattatctaggattttggtataaacatttaaaataaccaatcatcaatcttgagctctaataatacactctttttttagagtaccactttctctcaaaacaccagcaataaaaatttccccttagaatgaacatagcagaaatgaccacagtcaatgctcaggggagagggaaagggggacccagagctttccttggcagtatcgtggcctatctctatgtatatgtctctggagatagaattcaactagtgaggggaggcaactggaaagcagtaagttcagaggtattcttcagaaaagtctagggaaggccaggcgcaatggctcacgcctgtaagcccagcactttgggaggctgagcagggcagatcacctgaggtcaggagttcgacaccaacatggtggaaccctgtttctactaaaaatacaaaaattagctgggcgtggtggtgggcacctacagtcccagctactcaggaggctcacttgaacctgggaggcggaggttgcagtgagccaagattgcatcactagactccagcctgggcaacagagcgagactccattaaggacgggaccgggatggggacgggacggggcgggacgggaagggaagtctagagaaaaggagaagagatggatcatggcggaaaatcatcatgctgtcccgtgtcccttcctgtgccctctactggactactctcccatcccaggactagaggctgctggaaaagctgatactggcagtgaggatttgtttatgaagcaaatgaaaaactatccctctgttcttcctcttctccccacccctcaactttcttaggaggcagaaaatcaagtgttccctgggctcataatcactgttcacaacatattaatataaatgctcattcattgcaaaaatacttgttcagtttctgccaaataaaagggcctgcaatggatgctacagggcatatgaaaaggaaccccacatggttccagccctctgagaggtcacagggtagtaagcctgggtatgtggcatggtaacaataactggcagacatatcacactccctagaagcgctacaggaagtcagaggagagaagggggaagaatcagtgaagcctctggagtaggtggtttcagatctgcatcttcaagatggaagccagcaagcactccaggtagagggaataccatgagcacaatgcaggtgtagaaagtaggagaatgtgttcagtgaatgatgagaagctcaggtgggccggagaagagcgtgcttgaggacagtagtatgagataaagctggaatggcaggtaaatattttgtatacatctaatatttttgtgtagtagaaagagcactggaccaggagtcagaagacctgggttctcctgcttttgccactgtccagctgtggaagcatgaataaatcacttactgcatgctgtcactgttcttatctgaaaagtttccagctcttaccggtctgagttgtacctagaagaatttaaagatccaatcttccatggaccccagtgacaagtaagaatagaggttttcattattcacaattctctgatgagaaaaatcaagacccgagacaaagctttgcagacatctcacctgaggtcatccccatcgctgagggcttcatcctttataaccttgaggttttcagatttaacagtcaccttggccactttcttttttgctggaccatctgctgaacccccaggatgactgcagcctcttttcctctttccttgtgaaactttggagagaaggctcttctttgggggtttctcatcttcaaaggcatctaggtgacaacacagaacataaggtgaggggtggaaggaaaggtggaggcagtgcagcttatgggcaggggcataaaacggctctatgacctgtctccaaaccccatctccatcactggttcaccatcccctgtctggtcagcaaccagctctcagcttcttcccacctgcggctagtctatattcacagtaaaaaccatcttcctttatcagcactttacttctcctatgactacagaaaataccataggactcaaataaaacctaacttccagatcttaaatgtcagctaacctcctgccaggaaaatacaacatccattaattagcaccttatttattatctgccaaaattaattgtcttagggataatgtactcctaagtaaaatgttaagtacataaacatgtccaagttttaccacaacatcattactattaatctacatttctgccaaccttcaagaccaaactgctcaaaacacatactgctctgaaacctttccaatgtaacccaaatggcactcatataccaaccacctcagcaaacttacagttggaaaaagacagcaataattcaaaagtattttcttaaagtaattatttttttgttaaagggaaataaaaaatgcataagctgctggttttagtcaaattggggtatctaaaattatggtttatttacatataataattatattaatagattagttttaacaaataatatggcagggaaggatagttttctattttgcaaatatattcacacaaattatcttgaatctgaaataaatcttttgtctttgcatgactctgcttcaattaattttagaaaataaaaatactctaccttttattgaggttccaaaagggattgcaatattaacctaaaatataaaattatttaataattcagtcttttcattgtttgtcttgctgactctctggatgggtatttatattccacaagaatatacttttgcatgagggaaaaaagactctcccttctgatctaaatgaaatcatgattaaatgttaataaaattcataacaaaggagcatttattttaatgttagatcattgattccgttgtttctttaaatgttttataaaaaaggaatttatgcattcccatttttaaacattgtatggaaaccaaaaaataaggaaaaattttgaagtacaaattatttcaaaattaattttttcaaatctgagaacagattgcctactccaaggccagaggttgcataaagcttaagatttgacagtttgaggagggtgcccctaaaatcaagatttctggatcttacaatggtagttagccctctaataataggcaaagatgctaaacacttcaatttctactaatctaaaaaaatgcacgtaggaggatacttcagaggcatcacaaacttttctagttggttaaaaagcacagcttttatttccgtttgaagagaaaggtagaggagttaaaagggaaagggggataaaggaaacacaaaaactctgaatcaaaaggatgttcatagtattcaaaagcatctaacaataatctgaatgtccaaccatgagataattgttaagtaacttatggcagagccacacaacaaaatataattgagtcatcctttaagataaagaaaaacgatatatgatgtaatgttactcatgcaaagttgattttacagtatgctttctgctatataaaaaacagactagaaggaaacagaccactatttcatggtggctatttctggatggcagaaatatgggtgactttctgttctctgctattttttggtccctaagcatctagagactcttttccaggactctccaaaatcttgagttatctaatatgcctaaccagactccttgagttcagtgttctttcagtagggcaggaattaccactgtggtctgcttgcccatctactgggatttaataagaacaccggagtaaaccttccagcagcaactcatagcactcagaataaaattccaactccttagcttggtatccaagctcaggcccttgctcacttctcctacccagcccctcgctcgctgtgtccagccaactggccaagttcattccctcctaagagtgtttaaacacactgttctctctgcctagaactcttttccccagaacttcctatgaatggctcaaaattacactaaatgcctcaaaatgccacctccttacaaaggccttccctgacactgattcccatttagctgcctctcccccagccccatataagtttgagggtttttcttttcatctatagaagcattttctgctatgtacccaaataagttttatcacagcagtcttagcacagggtgatagctcttatcatcatgtgaatccgtttttttttaacttgttatctgctctaagtacccctccccccagattataatcatgagagcaggtgcctcatctgtcttgttcaatattatcctagtacctggaacagtgtgtgaaaatagtaggcgctcaataaacagctgttgaaggaattaatggatatcactgaaggtgttaacacagagaagaaatgaaaagaaaccagaggtgctttagtaacacaaaggaaatcatgtggaagcctgttttcttttctcctatttgtcaaaagcagccaagtatcaccttcatttgcatgtacaggggtgctattaaaacctacactattacagtgttagcaactacactgacagtcaccaaattattgtcatctgcagcccaaaccatacttgctaagtctatgcttccccacaaaaccaccaaaccacaacaaaggttgtaactctgcagatcctggaagctgccttgggaactgactgctagctcctctggctagcagaataaacttgggtgcatctttacctccgtttaggctgaatgacaccagctagcccaactaatttacctaacatgggtaaagctaaagctcttggctttatatgctatcccactgaaaactcacagccaccccgcaaggcagttattacatttcacagaggaaattcagaagggctaaaacatttgtccaaaataattcacccaagtgcataaaactaagaattgaagctctaccaagctggaaccgaggtgaagtgttgagctgggaagaatacaggtagcatttccatcagattaaaaccgtaaatttttaattgccatatatccaaattacattctgactagaataccggcccctttttgtgaccccttgctaaaataccaaccatcctttaaatcacagatcaaactacttcagagagcgttccccgatcacgccagtcaaacttgattaatcctttggaagctacaaagccttgtaccttcttccacaatatttagcacactttgccttgaatgttttacatgtaaatgtcatgtcaacactactctatgatcctccaagatatgtttatctctcatgtcacctcattcatgtacagcacatagtagatactcaaaagatgttatttgaatgagtaaatgagtgaataaaatggaactcgtaatattacatatgaggtaaatcacctcctaagtttacgaattattaccatttcactatttcctaatggatgatgaatttataaccggtatagaaacagaatctagtgtgatagcctttgccggttacctagtctaatctacccagttttttcaggagacccagaaattccttctacagcctgcattttgcaattatttaaaatatttactagccgggcgcagtggctcatgcctgtaatcccaacacttcgggaggccgaggcaaacggatcacctgaggtcaggagtttgagaccagcctggccaacatggcgaaaccccatctatacaaaaatacaaaaattagccggacatggtgtcaggcacctgtaacaccagctactcgggaggctgaggcaggagaatcacttgaacctaggaggcggaggtcacgccactgcactccagcctcagcgacagagtgagacactgtctcgaaaaaaataaaaaataaataaaatatttatttagcatttagccctaccaatccacgggccctgcatccacagattcaaccaaccacagatgaatatatttcgggaaaaaaaatacaaatttaaaaaatacagcatgacaactatttccatagtatccacattgtattaggtattattagtgatctagagatgatttaaagtatgtcggaggatgtgcataggttacatggaaacactaggccatttgatataaggtacttgagcatcacaggttttagtatccgcggggtatctgggaaggaccaccttagtttgctcaaggaatgtctaacttgagttttgaagaaatagaaaaaatcagccctggtaaaagccatggggggttcactctaggcagaaggaacatcaaaggaaaagactcaaggaataacttggcatatttgaggaagagaaaggaggccaataaggagggtatctggcaaggaaacaagtggtaagagaaacaggagaggtagcaagagccaaaacatgtagtatcttgtaggccaggataaaacaactggattttaagctaagagcaatggaaaaccaaggggagtttaaagcaggagcagggcatgattttttttttttttaagattatttgggttgctggatgcagagctgggaggccagtaaagaggaaactgcagtcactcaactgaaaggtgatgatgacttggacaggggctgtggtcatggaaatgaagagaagtggacaaatttgaaatacactcttgaggctgaactgactggacttgctgacggactggatgtgtggacataagaaaaaggtgggctttgctttataacaagtattgagactggaaaaacggaggaaagcatagatttaaagaggaaaaccatgagttctgcattgcccatgacaaatgtaagaagcctatcaaatatccatgaggggaagtcaggtgggatcccactgtggaactctgggtgagactcagctgaagttatcattcgggagtcagcacactgcatcactctacgtcctggtccgtccgtctgtcttcctgggacacaaataactgccttctccgagttcaaccctgaacatctgtatcctctggacaacggggagcgggaaaaaagctacgcaggagcttggatcgggcgaagctcgcgggaaaccgctctgggtgcgcaggacaaagacgcggggacagcggggagggccggccgcagcctgccgggctgcccccacggcgcggaacgcgcgcagcaacctccaccaggcctccgcgtctggactcccgccctgcctctgggcctcctccgcccaccggcggcgtctcccgcgaagcccgctgggcctcgctctcaccctcctcctcctcctcacgccgggccttgctcttggccttggatttctggctgcgcagttcgcgtccccgcggctccccgccggccgcgcgtttccgagccatgttgcttgtctgggcaaattccacttcgcgagtgacgcacccggccgcgatgcgctagaacgccggccccgccccgaggcggtgcgcttggccacgccccttcg

SEQ ID NO: 66 - DNA, 48959 bp, Homo Sapiens
atccccccaggtttttcgcgtgggggagggggcacgtctcggcgagtcacgatgatggcggccaccatcctgtggtgagctagcggattccctgcttgtctcgccgaccccctcgcgccttctgcagactccgtggctggcgctcggcgcgtgaggaagcacggcggcccgagttcgcggggaaggccgcagtcgcggaggcagcggcgcggtccggggcacgggctgggggagaggccgctccgctgggcgaatgtgacaagcccccacccccaccgccttcctccccagagcgcgaggagcgcgggcgaccccggggccccgccaggccacagaccccgcccagcggccagcacccggcgcaggcccggcagccgagctgcgcggcggcaccatgcaggtcaccctgaagaccctccagcagcagaccttcaagatagacattgaccccgaggagacggtatgcgcgcgggccgggggcaggggcagccgcgtgcgggccgcggggagcgccaggagctcgtggggccgggcggcgcgctccagcgggggaagccccggagggcgcgatgagggccctgggtcctggtgccggccctggcggcgtacagcggagccgatcctcctgtcttggccgtgggctttgtggcaggagaatggggaagcagtggccggacgccgaaggcctggtggcagatggcgtggagcgcacgcccgcgggcctgggcctaggagctcgtgctagcggggccggagggggatgggaaggtccaggccgtctcagccgtagagcctggctttctggtatgggtgcacaggtgggggagggagacgtaggcgtcgccactacccctgtgtggacctggttagccgcttagttcccagagttggtaacccgagaagatgagccttaagaaaaaaaaaagtatcaggttccgtttgccgccgagaggtgagtggtggtgaaaatgaatttgcccctttcccctcagaattgtttacccttttatttgcaaatgaatcgttctgctgccttcctcccgccaccaaacccacacccttgcgtagattgcactttgaggcctctttggtgatggttttagctgttagagctcttcacagccatccaggctcaaactaaacttcagatttaacgggttttctgtgttagaaatcttggaattgtaggagttggaacgctgcagccaccctcccccgatgccccaaacagtagcagttcaagggggaaaaaagaaaaaaaaaacaaaaaacaacaactttgaatcctttctgcagttaaagccttaaacatttcagaagtccacattatacatttttctgtatttgtgactgcataaagagacactgttgaggtcagtacaactttatgccaagaatctaaaaacgctgtgagtgtaaatttactgcttatgttcggaaatacaccgccaagattgtcataatactaagtttaaaccagcagctttctgcccaactctatttttaaaagtagttgattctattttgggtggagatcaggggctttggtgttaagtagacctgagttccatttgtggttttgtaacttatttgctatgaccttgggcaaattacggttagtttcattctctgtataatagggataatacctgccttgcagagatgtgaagattagatggtatgtatttacttggtggtcagtaaatggaatcgattatttaaacaatggattcctttgagtggagatacagtgttacgttttacttatctcatttaatcttaagttttgtacatctttaattttttaagaaacagcctttttgggattttggtacaaaattatttgatttcagaatatttatatgtgggtgtatgctgtgtgattaacttcttaaaagtacaggagatctcagttatacatgagaaacttttcagtgtcctcagaagtaattgacaataccctgtggactgacagtactaatagaatctaatttctcttgaatatttctttactgcttaatgtgcattaataagttgaagggtgaaagttaaaatggagtttgtttgatgatttcagacaaactacgtaaaatgcctatttgactttggttctttgtggtaacaaatgttggtgccccagtaacttaatcggcttataatactcagttaatttcagaattattgaaagctaaagaaatattgtggctttttggtaaatatgtgtgggtgtattgaagttatgcagtgactctgtcaacagctccactgaagtatttacgttctgtaagatttgtttagcgttttaggcactttacgcatactgttaactgagagtcaatgctgtacctgtgtttgtgtgaattcttaactatttttgctgttttccagtttatttccaaggaaaagtaatatgttatacgtctggaagtatatttttgaaaagcccattgttagggagcggtttctacagctttcgctgctatttatataaatataattttgttgctgttagtataaaaaaactaatactgttagtccggggcaagaaattaaagcatttcctctgggatatatggaacgtttgcatttaatgacttgtcagtttttattttaatgactttaggaaatatttttcatgacaactgtttcaattctatgtttgtagtgggttttaattagtatgtgtttttgatacgacaccttagaattccagtaagaaaataaacaatgaaaattatgttttctagggcaacgctaagtgtcctgtttctaagttgttgtgagaacgaggtaaccaaggatattagaaatagatctaaaataagataggatcttattgagacctgtttttggtctggtcacagatttgtccttgtttaatttttacctagaaggaaccaaggaaattaagtaacttacgtagccagtatagcaactcttgtgagcttgagatgagcatgagcaaaaatggaagaaaggactgtgagataagtggaatcatgggaatgattcatttgttgaacaagtaaatgtttagtgagctttgctggcaggactggaggagtacagggacctgtagaacgtggtctggggcttctgggagccttattgacttagtcaaagctcattggctatagagtagggggatatacaaaatggaaagagcaagataatttgttttaaggtgtttttatttgccctagttttaacaaaactttcttagacttattaggcattttgtaccatttacttgactattactgtgatacattacatgaccactgcctttagtgttaatctttgcaaagatctttttgtttctacaattgtaatgcaagccttcttataaaatattcaaacaatatagaaacaaaatgagaaggtggtatgtgtggggtagggagaccattgctaggagattttcttcattatgtgctttttttgttttttactgtaaaaattgtgggagacttttaagtagcctacatattaaagcattttgagatgtgtgatagagcactgcttctctgaaattcttaaaaattctgaagtttaggctgggtgtggtggctcatgcctgtaatcccagcactttgggaggccgaggtgggcggatcacaaggtcaggagatcgagaccatcctggttaacacggtgaaaccccgtctctactaaaaaaaatacaaaaaattagacggacgtggtggcatgcacctgtagtcccagctacttgggaggctgaggcaggagaatcgcttgaacccaggaggcagaggttgcagtgagctgagatcactccattgcactccagcctgggcgacaaagcgagactccgtctcaaaaaaaaaaaaaaaaaattctgaagtttaatggtgtgatggacatttagagggaaatggaatacagtttttaagctcagttttatagtcaattagtgttttatattactgttgcttaaaaacattaagaaaggtagatttaggaataaaccttttgagataaaaaaaatacagtgcagtattttattgcatcactgaaatggtgacaagaaaaagtatgtgatatacaaattaatcctgcagtctaactcttgacactgtttgccttgaacaactaaaaacaaaactcagtaaatttgagatgagactttaaatgcaaaagctgaaatgtgattggattagtatataagtgacattaaaattctacatatacattggatgtttttgctaagagaattgcaaagacatcagttttaatatctataaatagcatattagtgtgctgtgaagaattacctaatttcgtggtttacctctataatgtgattgttataaaatactgctttacccagcaccttgggaagccgaggcgggtggatcacctgaggtcaggagttccagaccagcctgaccaacatggtgaaacctggtctctactaaaaatagaaaattagctgggcatggtggtgcatgcctgtaatcccagccacttaggaggctgaggcaggagagtcgcttgaacctgggaggaggaggttgcagtgagctgagatcgcaccattgcactccagcctgggtaacaagagcgaaactccatctcaaaaaaaaaaaaaaaacaaaaaaactgtgtgtgtatattgctttagtacttgctctgtattatacagtatttactagccatcatttattagtgaagtattcctgtggtggtttattgtattttcaatatagtcatgctagatacaatttcatattatacaagcttcctagattaaggtaatgagtagtaaatgtattaaaaatactatatcacagaggtgaaattaagagttcttggcatattggcagaacaagatacaggaagaaactgagaaatctggtacatttttgccagacttttgctgttttgatgccgtgcacacagtaggcatttagtaaagatctttgaatgaactgaatatattcttttggtgaactggcaaagcagtgatcccccaacgtagtgtgtttgcatgttgatttatttatttaataaatatttgctgtgtacttactagatgtcaggccctgctgtgatggtatgtgcattctagtgggataaaactgtcaaaaaatacattttaaaaaccaggtaatggtaagtgctatgcagaaagttgaaataggataaagtatttgataatacttcactgggtggctacatttttgttgttgttttgttttgtttttgagatgcagtcttactctgtagcccaagctggagtgcagtggcgccatcttggctcactgcagccttcgcctctggggctcaagcgattctcctgcctcagcctcccaagtagctgggactagaggtgtgccccaccacacctggttaatttttttgtatttttagtagagacagggtttcatcatgttgccctgggtggtcttgaactcctgagctcaggagatctgggtggctacttttaaatttactagtcactgaaggcctttctgaataaggtgacatttaagctgagagctgagtaaaaatgagcactcgagaatgaagagaatgttttctatagggaactgctagagcaaagacctttaagaatgtgttttgggtactgaaaaaaagcctgcattgctaaggtgatgggtaagagataagggtgagttgggtaagagataagagagtgagttaggcaagtgagttaggctaggggttttcagggtaaacttggaaacatttacaagcaggacagaaatctttgtttctttgtctctgtctctcttttctctttttccctcccttcctctctcccttcctccctcccttcttcccttcctccctcccttcctccctcctttcctcccttcttccctccctccctcccttcccccttccctctcctttcctctccttccctcctttcctcccttccttccccactcctttcccttccttccttcccttcctttttcaacaaggtcttgctctgtcacccaggatagagtacagtggcatgatcatagctcactgcagccccaaactcctgggctcaagtgatcctccaccctaagcctccccagtagctgggactacgggggcatgccaccacgcccagctaattttagtttttttttgtagggatggggtcttgatgttttatccaggctggtctccaacttctagcctcaagtgatcctcctgcctcagcctcctaaagtgctgggatgacaggcatgagccagcacacctagccaagaaatatttcttgtaggatttttaaaggttactttgatgctgtggggtgggcaagagtgaaaagcagagacatcagttagggggcttgtgcagtagttttaagtaattgcagcttgaaccagggcagtaggagtggagatgtagagaagtagatggaattaggatatgttttgagaggtacagttggctgtaccacttgctgtgtcacctcaggcaagttactcagtatgtgccttttggtcctctgctgtaaaatgagaatactagtatgaaagtactaacttattggtatatgggttttgaaataatattaacagtgcttggcaatgtggtaccactctccctccattgttcttgcttagaaagcctcaaatgtgattaaattcaactcagtgtttgtacttgcacctgagtggccagagatgcaccttgtagccacattgacttgtcttgcttaaatttatgaacattaaggaacttaagttcatgagcactaaggaacattaaggcacactaaggaaccttaattgggtccttagtatgcagcacctgacagtcttacagtttactagtccagtcactcttccactgccacaggatgctttcatatcatctagcctgcttattttcacttgatgaccctagtctttatttgattgagaatttggaaataatcgagacagaatgtctacaaggtcctaccgtagctacctacctgctagcctcttcttactgtagatagttctgaattgtgggcggtgctatctaaggcaggtccttccacttttccactgtacctcatcccctgtcatgtgtgaaggacatcactccatcagatcttttctcttcatcactgatttttcccatttctagggtatacaaacatttttccccatcttaatgatacactcccttgtgtccacatccctctttagctgctgccctatttccctgcttctcaagaaaattcaggagtatctcttaattctgtttacttttttccacatcttgctcttttcagatccaccatactgttcctaaaagggagtcctcacaactttgtacttgtgctttgtccttaagcacaatacttttaaaaaagtctttctcctctttattaaaatgagagtaataataattgaactgctttcctaacagttgtgaaaatcaggtgagatcatgggcatggaaatatttagtgaattgtgaaattagaaataaattttgcagtttttaaacaaatcctgctttcatcagtttttatttcgatcatttcactattctttctttaaaaggtttgtatgaatgagatattctcattttcttagattgacataatcagcaattttgaacagtgtgtaaaatcaatgaacaaggtcctgccgcgatagatgccgtataggattccagttaatttctgaaagaaatttgctaaatttaaccctactgtggcacagtgaatcgtacgaaggacactacaccatctgttccctgtaagtttagataaataaatgttttttatagtgtcacgaaagctaattttacaactgaatgagctttataaaacttgtaaacattgtataaacttatttcgaggaggtagaccagctacaaatgactgacaatacatgaacagattctggaggcttaaacaggtagataaagttgttctcaccaattattccccacacacttctggttgaattaggtaggcaccttgtttttgctagtgcactggcgagatccattctttgcctatatagaaacttacaggtatcttgggaattctgcttactcagttttcaaattcctgtgtttcttttggtcttgttgaaatcatactgttaggaatatattttataatagattaaattggcatgaattggttggcttaatttctgtgggacaaatgggttttggatttcaaatcatatatttaaaataatagccttttggatcataaccccagtttgaggattgcctttgttatagtgcctgcctcttctcacataattaatgttatgctatcagttattgtttcaattgtaaaaatctcctgtactaaattattttattccttgggtccagtgaggagatttttcctatttgtactgaagtcagctgacatttttaaaatcaaatttgtatttgtagaaatatcaggaacctaccttgggacagaaattccccaggaaatactctggtgcctgtaccagtttctcaagtggaaggagaagaaccgaagaaccaaaaaagaaaaagcattacctgtagtgtaaacataagaaatcctttagtacacatttggctttgggaatctcctttattttgctaattgttgattgccaaaatttaattgctgctattattttttaattaggccgtgtagtattagaactgccttagacctttttcttttaaatgaaatctctttttctctttgaaagtccagttttccctaaattactcaagtaattcaggctcattatagtaaataaagtatagtaaaatgagaatggcttttgccatcggtctaaggaaccactgtagactctgtatatccctctagtcttttcaaaaaatacatttacacataatacatgaacacaactacactatttgtttaaaaaaattaattagcaactagctttttttcctcaaacatagttataaatattcatttatattgcataatgttcaaatgaatttatgtacattaatttattttaccatttctcctttgtggatgtttagggtggttttcagtttttagtattgcaaaaagcaatgtagtgcacatactttgtacctttgtctttgaagtagttacatgagcacctctagcattgatttctagatgcgaaattatttggtcaaagtgtggcagattgcctttaaaaatgcctggtcaggctgagcgccgtggcttatgcctgtaatcccagcactttgggaggctgaggtgggcggatcacgaggtcaggagttcgagaccctcctggccaatgtgatgaaaccctgtctctactaaaaatacaaaaaattagctaggtgtggtggcgtgcacctgtagtctcagctacttgggaggctgaggcaggagaatcgcttgaactcgtgaggtggaggttgcagtgagccaagatcgtgccactacactccagcctggtgacagagcgagactctgtcaaaaaaaaaaaaaaaaaaaaaagcctggtcagtacttacacacattaacaatacttgttatttacaaataccatctcccatatgagtagccaggattcaaatttagagactctgcctctagagcctgtatgtttaacctttttatttcatctgccttagtgtccccattagaaaaagaggataatagtatctacctgtgtactagttaacctattactgcataacaaattaccccaaaacttaattagaacagtaaacacttactatttcataatttctgtgagtcagaaattcagggatattttagctgtgtggttcttactcaagagtctcaggaagttggatttaaggacttcattctatgcattaaaggcttgactggctggagggttcccactgaaagtgacttcctcacatggctaacagcttggtgatggttattgactggaggcctcagatcctccccatatgtcctcatgacattgtggctggcttctcccagtgttagtgatccaagagagcaaaatagaaacgatggcttttatatataaaccagcctcagaagtcacacttttacttcagcagtatcttactgttcttgtggactagccataatttagtatgtgaagggtatgtaccaaaggcttgaataccaagagatgggagtcattgggggccatcttgggtgttggctactacaacctcatagagatgtagtacagattaaaagagttaattattgtgaggctcttagtacactgcctggcatatggcaagtacatagcctgcattagcttttattcagatgttatatttcagggctacccattaaaactttacacaattatttatactgtatatagttacaacagtaataaggaacaacatagttacaaaagtaagaagaaaaaataatactgtaacagtgagcacgctgttatatggaatatgcaattgctgacctaattaacaagcagtagcctagaaatcttatgcaaagtgctgtgtaagaagattgacatggcagctcattatactatcataggaatatgatttacaagatattattttgatgtctcatgcatgacctaaatttgtcgaatgaaaaatgactgcttttttaaagagacagagtcttgctctgttgctcaggctggagtacgctgacaagattatagctcactccaaccttgaactcctgggctcagtcaatcctttcacgtcagcctcctgaggtaactgggactacaagcgggcaccacagcacccgtctaattaaaaaaatttttttggagatggtggctcactatgttgaccaggctgacctcaaactattgggataacaggggaaatgactacttttaatggttgttggcctgaactagaatagtgccagtgccacagagatgcacggtagtgctcacattagggaataattagatggtaagtttagctttgtggcggcacttttaaatacactttatgattgtcttcctttggaggaaaaaagaaaaaccatgcccatcatgtttaatattatgttgagtacgtttttatttttaaatgcacgattttttaagagagaattaagtagctagaaaaaatgtttgatttcttgaatgttaaccatgtctttgtctctagtggaattgatgataaaccaccattatttatgtagtgggaaatgcagcacaatgaaagttctagccttggttatgtactgggactgtggtgctcaggtttatattcactctgttgagatggcttactggaatgggagcattggtgtggggctcagcgcagttaaaggagtcataattgcatctgttggtgggccatatcctttccaagagaaaccttgtgctgagttcatacctcttcctttgaagcatccagaaagaaggcagtctttcttgctaatctgttttgaagtatgctcaattaggttggattagggatgatttaaacaaagtaatttagacacagttcttctacagatacattatggtttaaatacctctaggacatcccgtgaaggtgttcagtagagagttaagtgtgcataaatgaaggtcagggagagagagctgggctagaaatacagatgacatctgcatggttattgaaactaggagtagacacgatggattatcctggaagtctaagtagcacttaaagggctggccagggaggaggatttcgtgaagcagtgaatggagagataggaaaaccaaaagtgtggcatcctggaagccaagagatggcagtatgtaaaggagggacaggtcagtactgtcacacgtgacaagaggaagataggagaggattaagaagtgtggtatcattatggtgttgcagaattcagtgatgttggtaaagagcagtgttaatggaatggccagcggtgggtggggggggactaccagagaaaataagcagcagaatgagaataaatttcatgtttttgtttatcagcacagtattgctctcttttgagtagttggtttgggattatgaataagtgaggacagtggtgtgtatttaagtttttgaagaattagattgtggggggagagagtctaggaggagacgtgattgttaagtgtttgtttttaaaatgatgaagtattaggtctaagtgtgaatgaaagtgaactgagtgagagagaggctgaaaaagctgggggagataggaaatataatgaatttagtaagatactgaaaaatacttggaggcgaaccagaggacaggtggaaataattaggtttgaaagaaagggatacttttttcatttaataggtgagaaggagatgtaggtgggtctggatgcaacaaagttagacaaagatgaaaataagttcctctgtcttctgtttttaataaggtagaaagtggtcacctgcagacagtacgagaggatgctgtgaatcagatttagagtagaatgcagatttgagatattcttttggaggatggagaagagggctaactagggggaacagaagatttagtgtatccttttctccactagcatttagaaaacggtataaatgtagataggcagtctcttaggtaaaagttgagatttgttagctaagcaaggttaggacaatgagacaccacagagtggttggagtaaattttagaggttgagtactgacaaataaatggtgttggtccaaatacagaattttgtgtgttaggagcagcagaaagacaaggaagtttttgatattagaaagaaggtgataggagcaatgatagtgaagattgaaatgaaagtagagactctagggaccaagtcttaaggagattcaagagcaagtatagtgaacagttaactaagagctggtaggaacaggagattggtcacttataattttaaacatggagtggtttttagatgacaaaattcagcctgtagggttctgtaagtatagattggattgtaagtaaagatcactgttttgttcaaggtaaggaacaatgccagaattttagacaggtcagtgcacctggttccaaagtctggttcagttattttctttgaagtgatactgttgggtcaaatccccgtgccttcccccaccaccttaaaaatgttgaagcatcttggcatgttgccctcaaaaattttgatcatttgatactttaattcttattctgagaatgtatttcttcactttcaatgccaagaattattcaaaacaatctttccagtgtgatagtctattggattaataacatgaggcatcaaaatttatgtctttggttactaatgaggttgagcttttctgtgctgtgactgtgtaattgtgaattgcctgcccaatcatttgtccaatttttttattagtgcaaaaacagttttgtgccttgtctctctctctttttttttttctttttcttgagacagtctcattctgtcacccaggctagagtgcagtggcatgatcttgactcactgcagcctcagcctcccgagtagctgggattacaggcgtgcaccaccatgcccagttaatttttgtatttttagtagagatggagttttgccatgttgaccaggctggccttgagctcctggcctcaaatgatccgcccacttcggccttccagggtgttgggattacaggcgtgagccatggcacccagctgccttttctctttttttaattgcttttttttttttttttgagatgcagtattgctctgtcgccaggctggagtgcagtggcacaatttcggctcactgcaacctccagctccctggttcatttggttcccctgcctcagcctcccgagtagctgggactacaagtgtgcaccaccatgcccggctaatttttttatttcagtagagacggggtttcaccatgttggccaggatgatcgtgatctcttaaccttgtgatctgcccgccttggcctcccaaagtgctgggattacaggcatgagccactgcgcctggcctcttaatttcttttttttttaatttttatttgtcctttttttctgtttgagttgcatgtttagcctgttaatttttcttctttattgaataaacatttttagtgtttagtctacaattacttctttagccaaatcatataggtatcttgtgttgagctcccattgttatgttcttaatattctgtgtttgttttgttttgtttttgagacagaatcttgctcttgtcatccaggctggagtgcaatggtatgatcttggctcactgcaacctctgcctcctgggattcaagcagttctcctgcctcagcctccgaagtagctgggattacaggtgccagccaccatgcccggctaatttttgtatttttagtagagatggggtttcaccatgttggccaggctggtctcgaatccaaccttaggtgatccgtctgccttggcctcccaaagtatgggattacaggcgtgaaccactgtgcccagccttaatattttttaatcaattttgatttctttgaagcaaaagttatttagtagtaaattactaaagggccttttttttttttttggtccagcttttcttaatttatggggcttttttttcctttggtcctccctcatttttgatataaagctagagagtcccgttacttatttaagcgttttgaaatatgaaatatttaagtctgtcttatacttcattgtaacctgtcaagaatgagatattcctgcatgtttattttcttttatttgttgcttcatatgtgtctttttttcttcacatatgtctatgctctgttcatttattcatccagcacaggataatggagcacccactccatgccaagccactatgtattgttctgagaactgggtttatgcatagagatacacttggtctgtaatttatttgtagttttcctaaataatcacacttgcaaatattgtatccttttgtccctctacaaacaaagtttgagaagaaatttaccatacaccactgagtgctccacccatgctctgccatcagttggttgacttggcaagtctcttagcatgtaggatagcagtcttcaaatgacttggtttcaagacttgtttacatttaaataagttattgagggctccaaaataacttttgtcgatatgcttacgttttattttatttatttattttttaaggcagattctcactctgtcacccaggctggagtgcagtggtatgatcttggcccactgcaacctccacttttcaaatgattcttgtacctcgtcctcccaagtagctgggattacaggcatttaccgccatgcttggctaattttttttttttttttttttttttttttgcatttttagtagagacagggttttaccatgttagccaggctgacctcgaactcctggcctcaggtgatcctcccactgcagcctcccaaagtgctgggattacaggcatcagccactgcgcctgacccaatgtacttacatttattaatgtttaccacattagaaattaaaacaaactttattaatgttcatttaaaaataaatataaacttattataataaatattatacttactttttttgcaaaaaataactatctgccaaaacaacagtaacaccaaagcactgaaaagactgacactgttttacttttttttttgcaaatctgatgtttggctttaaaaaaattttacttgtgttttacctttgaaatggggaacagtggaaaatagtggattgagatttttgtgatggatttctactttggggaacatcagaatagcagtgatgctactgacccatttcaggaagatcagtgcagcaaggaaggtttatatggtatttgcaaaatactctgcttggagtcataaggggtggtaacctctttatttccgtctcctcatctataaaattgagtgggtgacatttccttttgtcccagagttttgaggattgtgtgaaattgtatgttaacatctgaagctaaataagctttttttatctttgaagtacacaccatcactttttaattgtacaaaagaaacctttatttgtatccctttctgtctaaaactcaagagaactgtcaacttagataattttcaagaagtattgaatttttctccttggtttttgtgcctttaaagtaatgaaagtagttctataaaggcaaatgggaaagccatctctgccttttttactcctgtacctccctacttaacaagttaagaagttcattagactcatttttgtaaatactgtataatgagcctaattgtcacacaattttaggaaatgaagagactataaaggtcatggattccagctcctcttacagatgaatgaagctgatgctgagagaagctaagctgcttgtttaagagcattgaagttgtctggaggttttcagcctgggctgaactttggaaacacctgtaaaactttttaaaaatactgatgtcaaggtcccactctcagagattatgttttaattggtgtttgtaaagtccccctggtgattgtaatgaaacataacacttaaaatgaatcatttgccttttaacattcacaatttaacctttaacattgaagtattcttattgttgatgagactgttttatttcttagattttttaggtgatcaagctttactttcttgctccgtgggaaataaacccatgaacagtatataaaccaaaactttgatgttgaaaactttattttaaattatcagttcaactagtaaatttttaaaaatctgtgtgtatcagatggtgttaaagtttatggctatcataactagtaatatgagttaatgttgaatcttttttgatataaattggaaaaacataatatttgaggttttggaaacattaataattatgtatataatttttgtcttccattatttattcagattctggattgtcattttttatttagactttttccaaaacaaatctttatttttcctataggtgaaagcactgaaagagaagattgaatctgaaaaggggaaagatgcctttccagtagcaggtcaaaaattaatttatgcaggtatgaattaaatattaaaattaacatgccatgtcttgatattcttttagttttagaaatgttatcttatatattgtagtatattcaaattgtcagaaaaatgattgtacaaataaaagcagtgaaagagcagtcatttgaatctaatattaatattcaatcttctctttattcacatttgccctgtgtatttttccatcaaatggtattagttttgttttatcttttgtaagcatcgtgtaactggcttttgtttttttaatcaaacggagcttttttttttaaattgaattgaaaccatttatactgattgtgttattattagtatgcttggaatcattcctgtaaaattattttaaccaaaactaactgaagagtacagaaaaaacacatcacacagacacctacaggaagaaaaaaaattaatattcagattatgtaaagaattcttagaaatcagtaaggaaaggatgaccaataaagcaacaaaggataagagtaggaattatacatttgactagcctcactaataaccaggaaaatgtatattaaaaatacatttgatatccaaatttttagagaaaatgctttcattgtagatgttagtaaggtgggtgtttgatcacccatggattcttctctttttctgaatagtgtttcctaaagtgagacagcctggaggaaatgctaacctggtgattcagtcccattatttttataggtcagaattcagaagcctaaagaagcggacataaaattcaaatttccagtttcttgttttggcctgttttctcattcctatccatattcctttctgacttaatgttagcagcttttgattcaatagctttttaaaggtggaaaactaaattcatgtagcaagaaacactagagagtcctagctacctaatagtgaccttcagcacgaccacagttttgtgtacttcgtgcatttctaagttctgtagcatcttgccctttcttgtgtatcatgtcgttttctgaagtacttttagtatcttgctttgatagtgttagaacatttctgatttatcagatatcagtattttggggagcaggaaatttgtttctctccctttcttcatatcataaaagaatataggttattttccagaggacccctgtgcaatcggagtattgaattttctttatcttcatgatctcctccttttcagggcctctttcatatttccttgcccagtaagtcttttatataatcaatacatttgtaaaaattgattgtcattctatatacactatataagtttgacatcttttagtcaaatgcttatgctttttagttttatttgtttgagagagggtcttgctctgtcacccaagctggagtgcagtggtgtgattatactcgctgtatccttgaactcctgagctcaggtgatcctcctgcctcagcctcccaagtagctaggaccataggcatgtgccacaatgcctggctaattttgaatttttttttttcataaacagggtcttgctatgttggccatgctggtttcaaactcctggcctcaagctatatttcctcctcagcctaccaaagtgttgggattacaggtgtgagccaccatgccctgccacttaggagttgttttatttttatcttgattgattggtttttctttgggaaaagtattaactgatagaatttatgttggtgattcatattttaatatttctgaaatattcatatttcgagtagaaagttgttttaactgaagtgtaagagaaagattatgccttaaatgatttttttttctcttaatgtattaggcaaaatcctcaatgatgatactgctctcaaagaatataaaattgatgagaaaaactttgtggtggttatggtgaccaaagtaagtttcaacctcattctgtatatctttatgcatgtaggtctttttaaaaatgatgatcacaagtccacacaatggacacagtttatacacatccatagtggtgtacacttaactactatgaaaggtttttaagaatttaccttaagtgaaacataaagttattaatgttttacattaattacacattaaactataatatagttttaataaaattttatgtaaattaaaacaattgaaaaataaaatgtcatgttaaaattatttttgctacagtagtgaaatcattatataattcttttaaaatgtctttataagtggaataaatgtttattctgtagtttttgtaagcttgccttaaatagacctgctaaattacgtactagtcctaacagattcctcaagacagaaaaggcatgaaagcttattattacagtgatagttcttagtgaaagaatatgtttttagaaactaaaaaaagggaaaagataactaaagaaatgatggaatgatttttatgaggaagttttttttgtttttgttttgtttttttttttttgagacggagtctcgctctgttgcccaggctggagcgcagtgacgctgtcttggctcactacaagctctgtctcccgggttcatgccattctcctgcctcagcctccctagtagctgggactacaggcgcatgccaccacgcccggctaatttttttgtatttttagtagagacagggtttcaccgtgttagccaggatggtctcgatttcctgacctcgtgatccgcccgcctcggcctcccaaagtgctgggattacaggcgtgagccaccgcgcccagcctggaagttttaaacagatacttttttgtgatttagtaggctggaatgtatttggaacaatttataaaattaaattttttttaaagcagagaatgaacatggatttttttaagagactatttatatacttgtttatttaaagatatataatgcagtgtagaattaagagacaaatggagaagtggtactcatgacattcatttttaggattggattgtcataatctgagaaagaacagtgttacttgtagcactgaaaatgagtttaaatcactaattgaaaccacttcatcaaaggccaaaagtggattaaatgtgggttttttctcaaagtcacaaaatagttaatagtaatagaaaatagagtcgaagaaataaattctaattaccacatgcttttgtactgggagcaagcagctaaatagtttacaagtgttgaacattttttaattcattaagaaccatgttgattttgctatacttaagaacttaagtcattatatgttaagtttaaaaacaagcagaatcgtgaggaaaccttgtatcatctaggtttttttattcaactgtggtaaaatataacaaacttccagtttaatcattttaagtgtacagttcaataacattatagttacattgttttgcagctatcaccatcatataagtggaatcctatggtatttgtctttttgtgactggcttatttcacttagcataatgtcattgaggttcatctgtctatgttatagcttgtgccagaatttgctgaacttttaagactgaatactatcctattttcctatctagttttagcatacatagtacataatgggaaatgtgatagccacacatttaaatatgttttgttactggtcttagtttcttttaatattacagtgatcctgactgtttagaacacaagaattaagcagaaaaagtctcaataggtgcgtgtgtttgaggaatagatacttgaagcctatcattatattgcatacagtccttttgtttttccttaaagtcttttattcctaatattacataggattctaatgatatttatgattgttttatttgaagttaatagaggacaactatgaaaagggagggaatgctgctacagtaaggcattatggaagcactgagaaatgaccttattaatacaaagaagggaaaggaaaaagctattaagatcaaaagcaagaataaaaactaaaaagcagagaagggcttggtactgtttagaataaagtataagtagctgttcttggcagtaggaaccttgaagggaagttacattgcaatattattttgataacaattaaggaaaatattaaatgagtataccacttttaaaaatacatttttatctagattggttattataaagttttggtgcttaagactctaaattttcacctttgtgaagctccagtttatccagaataactgaagatccagaatgatctcaggatttcagctcattttagttttagaacagtaataatctgcagaatattatattggctgttaagaaagttaagctaaataggaaaagaagggagtaatgctactagtattttttaaaaacctatcacctttcactaacctttttcctagtgtcttctttattagttcaaatcaaaaagacaaggcagctcattggttttagagtttgtttatgcctgtggcaaattatgttgaatttaagccttgtcttccactaaaacagctaccttttgtccttgggaaagttatgaactaaacaggtagcgagcattgagaggccttaggagaagactaaaaatcatgtatgatttttacacatgtacagttgacccttgaacaccactgagcttaggagtgctggcctctcccctacagtcagaaatctgcatataccttttgacttgcccaaaacttacctactaatagcctactcttgaccagaagccttactgataacgtaaacagtggattaatacatgttttatatgttacatgtatgatatactgtattaaagtaagctagagaaactattaagaaaatcatggccaggtgtggtggctgatgcctgtaatcccatcgccttgggaggccaaggtgggcggatcgcttgagctcaggtgttggagacctgtctgggtaacatggcgaaaccttgtctctacaaaaaaaaaaaatacaaaaatttagcagggagtggtagtgtgagcccgtagtcccagctacctggtgttgggggcgggggcagtggctgaggcaggagccttgggaggttgaggctgcagtgagctgtgatcataccactgcactccagtctgggcgatagagtgagaacctctctcaaaaagaaacaaaagaaaatcacgagagagaatatttttagtgttcattaagtgtaagtggatcatcataaaggtcttcatccttgtcttcacactgaataggctgagaaagagaaagggttggtattgcggtctcaaggtggcagagatggaggaggtagaaggagaggcaggcacactcagtgtaacttatattgaaaaaaattatcatgtaagtggacccagtgcagttcaaacccttgttgttcaagggtcaactaattgtttttttgctctgtgggaagctttatggctctatttccagttcagaaagtgctgagcgtgtggaggtaacttaatttggcctttatttttctgcttaattacatatatgtctgaaagtattgtgaacctttttgtacttggatctgttgatttgtagtcaattttgggattttcctccctcttctaaaaatacagtacaacagaatatttgacatgtttataaataaacatttatactgccatttcaagaacattattttgggctggatgtagtagtttatgcctgtaatcctagcgctttgggagcccgtggtgggaggattgcttcaggcccggagttcaagaccagcctgggcaaggtagcaagaccctgtctttaaaattaaagaaaattattttattaatgcttttaagtggtattaggtaccttaaagttacaacttaggtacataaagtttttttgggaaaatgatacggtttatatctatatatatatatatatatatctatatatctatatatatttcaaattttttattttatattaacttgatatgaagatggaaattgttgggtaaaattaattgtggttgatagttaagattaacatacgctgtcatgagctttgaaagagtaaccatgagtcagattgttaatattgatcatttattgtgtcattttacaaaattattttcaagttataggttgttattagtgctatgtttgtggcatcctgtaacggtacagtctaattagagatcaggcagtatgtagtattttattgtaattattttgtcttttaatgtgtttagcccaaagcagtgtccacaccagcaccagctacaactcagcagtcagctcctgccagcactacagcagttacttcctccaccaccacaactgtggctcaggctccaacccctgtccctgccttggcccccacttccacacctgcatccatcactccagcatcagcgacagcatcttctgaacctgcacctgctagtgcagctaaacaagagaagcctgcagaaaagccagcagagacaccagtggctactagcccaacagcaactgacaggtaggaactggattctaggacattctatctcaaaatccgtgtttaacaggaacttcatgcatttattttgattattgttttgatcaaaccgactatatctattacgttaagctttttttaaatgtttgactaaaacatatgctgcgtctgttttgatagcttactaaggagaatataagtacaaattttcataatcagatttctgtactctgttgatttgggcagggtggggggcagtggaaaggagaaagcaggtgaaagtcatttttttttttttgagtagaaacgttaggaaatacaaataaccaaaatgaataaggattacatcatgacattgccaccctgatcatcatttgtacttgatctgtattctttgtggtcattgtcatatatatcataagcatccttccatgttagtaaatctttcccgtagttatatagcattgtgtttggttctgacatttgttagctcttgtaacctgaacctatggactatttcagtttttcactgttgtatctgtatctttgtgaacttgtgagaaattcaggcttctgcctgtgtggatctttaggggaaaaaaaaggaaaagagtgttgagatatttgaggagcaagaaataatttcttgtgggaagttgacagcagagacacctcaactaagtggctgcttaggcagttaggattattgagcagtttaagacaagacttttgtttttctccccagacgatcaggtaaaatgaccaaagcaaatgcttaagtcagagttctcttggttggaaatcatacagcacaattccttgatctaagagcatgagttatattatgaccagccttcactggcactacagctgtttgtattttgtgacttagtgcaactcaggacctcagaggcagtagttatatgatctttggagtcagaatcagacacagtggaaaactatgcagtgactggaagggtttacagacatggaaaggggttaagatatatatgacaatgatcagaaagatatagttgtgatccttcattttagtgttctgcctttgagtgtggtttctgtgtctgacttagtcaaccatgtttggaggagtctgagccacctggttcattgcttacttgggggtctctttctaaataattgattccctaagaagacaacatgggtttaggcaatagaatatttgccctgttacttgcctagaacactgctttaagcattctatgacaccattgcctaacttgatccatctttcccatgtacaactagaaatgcattcaaccatcttatcctagtggataccacctagagtcaggttaagctgttacatcaaagggctgttgatcaggtctgtatatgagagggaacttacgcatttaaaaaattggtttactaaagcacttaaatattacaaacttaatatgtcttaagtcagcacaatacatcttattctcttaattgctttaagctcctttttaaaaaaaaaaagcttacagtgtgagaattttagagttgatcaatacattttaatgtgctaatgccatcaatttaaatttctttcttcattaactccatttttttttttttttttggagacagagtcttgctctgccacccaggcaggagtgcagtggcgtgacctcggctcactacaacctccacctcccgggttcaagcgattctcctgtctcagcctcctgagtagctgggattacaggcgcatggcaccatgcccagcttatttttgtatttttagtagagaaggggtttcaccatgttagccaggctggtctcgaactcctgacctcaggtgatctgcccacctcggcctcccaaagtgctgggattataggcatgagccaccatgcccagcccattaactctagttttattttcttcctggagttgcagttttacttacctattctaaaaagagccagggttatcttttcagaccttttcagacctacagaagttgcataagtaacttgatggtcagtgatccaggaaagcagacactagagtttgttacttagttggactttgtacaccaactgcttactcttatttctcaaaattttacctcagaaatacaacacaggaagagaggaatgagggaaactcagaaaacaagctgcttaaatgtgtcttagttcctttgtctttgctggaaaatatctagtgtcttgtgaagcacaaaacctagtgaataattatcaggagataagctgttaagactttgtggagtgactttgtgggaagtctgtttaggaccactgacctgacgttttgttattagggatttgtttctttaggtcaattttgttcttttaaaaattgtctgttacagtgcaaattccacttgatatctacctgagagaaactgcacttgtgcacatgactgtattgtttgtagtaaaggacaaattggaatcctaaattgacctgtggtttattcgtagtagagaacaggactactcaaagtgtggtagtcaataggctgcatcagcatcactgggagtgtgtttgacatgaattcttgggccaccctggacctgtaaatcagaattatctgggagtggatcccagaaatcaacaagccctcctggtgaatacttgggattctcggactttgtaaaatttgagaaaccctgatagctgatactacaagacagttaaagtatgtaatgtataagcatgttaaatgagtgtggttttgaggctttgttattgagtgaaaaaagcaggttgcagaagagtataggcaataaccataaaccagacaaaacccataaacaacattgttcattttctgtgggtatgcatgttaatgtgtagaagaaaagaaggcaagcgttgacatataactaatgagtggtttcctctgtggttggagaggggagaagtagtgagacagaatcaagattaaagaataatggttaaagtctatgtacatccagtcttatctgtggtgtttaaagagaactttttaaaaacaatgtgtgggccgggcgtggtggctcacgcctgtaatcccagcactttgggaggcagaggcaggcggatcacaaggtcaggagattgagaccatcctggctaacacagtgaaaccccgtctctactaaaaatacaaaaaattagctgggcgtggtggcgggcgcctgtagtcccaggtactcaggaggctgaggcaggagaatggcgtgaacccgggaggtggagcttgcagtgagccgagattgcgccgctgcactccagcctgggcgacagagtgagactccatctcaaaaaaaaaaaaaaaaaaaaccaatgtgtgataatagtgtaaattattctaagggagatgtgtcttaccggattttaaaatgtattatacagtaatgattaaaacagtttggaatggctcatattagaaagattggtcagcgaaatcaacaatagctttgaaatagacccagatagatacaggaacttaatataaaggtacagtttcagaacaatgtggggaaaatgctattgagatctcaccatctagaatgaaaaaagaatgacccctcatactgtacacctgcaaaaataaattatagatggatacggatttaatgtaaaagcaaagccataagctaatggagaacaaggaaacaaaagaatagtcttcactgtgagaagtcattcttaagcaagacaaccaaaaaaaaaattataacaggaaagattgatgaatttgactatagaaagaatttaaatgcaggaaaccaaactacacattgcttaataagagcttgatttggtcttttaaatggaatactgtgcacatttgggaagaaattgaagtagatttgattgtgccgacatagaatgattgttaagttaaaaaaacaccaaagcaagacacaagttgttattcttttaaatagaaattggtgtcatagtggttgtctctgggttaggggtaggaaaaatttagtttttatgtattgtgcgttttgaaattttattttctctgcattagttttacagtatatttaatgaagaacttaaattataccaagggattatattaatcatagtattcttattgggtgttacgatgccagacactttgctaagcactgtactagtgtagccctacccacaacactttggagtatatgatacggtcgttgacattgtactgatgaagaaacaggcttagaaaggttaagtaatttatgcatccaaacttgagttttctgctcttattatgtactaccaagggctttctcagaactgaaatataatgtgtgtgttgtttttaattgagatacaggtctaagtgtgtatgtgtgtctgctttaatttaaacttctaactactacctttaccactgttgtaaacttaagtttatatttctttggcttgctcttggtctttcataattttctgtcttttattgcagacttctctgtagtttcccaacagaaacttaatctctttaaactgattttcattacattcaaacttggatttaacccatatctaccttttttgcatatgctatatttctttatttgaatatcttctttcagtgtcctcattcagaacttacctataagacttcattatgtaaagactttatagcctaatttggtttctccatgtgctattttgtatactgcttttgatatttcttctggtgtgacttgatttataaattatttaacttctcatgtaaattatttcaggtaaataattgtgcattatcttttttgtattcaatagatagctgttaggatattattttatatattttgatatttaaagtgatggagtctcagaatagaaggagtaccaagattgaaaatttttcccaaaccacaaatgttgtagataaagcttttggatttaatctagaagagacagtttaaatactgtagtcagacttttatatttaattaaaatcaaagaatctgtttaccaattggatagttactaaactaatgtaaattaaattttatatactttttaaaatgtgatttttctaaaatccttttgtagtacatcgggtgattcttctcggtcaaacctttttgaagatgcaacgagtgcacttggtaagtatctgcttttccttataaataacctataaagagataggaaagaggtttcacttttctagatcatgataaaagtgttaataatttgcatggttgtttataatcaagctgtaagatgattgatttaggtaattattcaattaatagtgttactaaagacttttaatgtttatgtattgagttctttaaaacttgctctgagttgagcctacttggttaaagcaaataaatttccattttccggatgtgaattttaaatgtgatcctaacatggttgatctgtgtatggatttattacaaagggtctttgaaatgggtatgaaatttttctaagatctgcctcacacttcatgtgtattcaccattagacttaattcaacttgatggcactatacattcccatctacatcttgttgcttgcattggcttgcagcaaaaatgcctttttatcccaacttttaattttacctactgaataatgcctttccatctcccatcaccccaatctgtcaaaatgaagcagcattttttttctcccattgtagcatctctgatacagttcctgctaattactggtttattggctggcaactccattcctagtttgttacttttaaatggcagggagggagaaagcgaggaataggtagaaacagcagctttggtgcagtacaggcttctggattcctgcttagcttctacagcagcagggttccagcagcagtaccacctcctagcatctgagttggttctctgagctagttggactggaactccgtgatgcccttgttgctgtggaaaatggcatgtacatttagtggcaaaacggcagtttaaattatctaagatcgcctgggtgtgacaaccccagattttcatctttgaggagcagtgtcctaaaaccactctgctatcaaatacagtgtgagttagtctctagccaggaaaacagaaaccactctatttcaaagagggaaaggcttaatcttaggaaattgttaggaattggaagggctggaaaataggattacccagagaggcagtaaactgtctgtggcctcggctccagctggagccagctagcacttgcccctgatggtgttgaaggctctggctgtggtcactgctgctgcagctggaatgcattgatgctcctgagttcccgggagcctgggaggccatgctgtagctgctgctactcaagcctctgtgacgatgtcttcccattctcagctttatggtctcgggatccctctacattttcatctttaatttacccaagtctctatgttgattccctgcttttttattttattttatttttctgatttatcttgttgctgtacaaattaaccttgcttctttaaactttccttctttggctgctgtgacaccactcttttcctgatccatacctcaggctcttccttctcaagctttctagttaattcttttcttttttcctttattttcttttctcttttctttcttcctttccttttcctttcgtagtctcactctgtcgcccaggctggagtgcagtggcatgatctcagctcactgcaacctccacctcccaggtttaagcgattctcccgcctcagcctcctgagtagctgggattacaggcacgtgccaccacgcccgactaattttgtgtatttttagtagagatggggtttcaccctgctagccaggatggtctcaatctcctgaccttgtgatctgcccgcctcggcctccaaagtgctggggttacaggcgtgaaccacagtgcccggccagttaattcgttttattttacctgactattaaatgtatgagttttctatggttccattctaggtcatagttcaaagtttaaattatgggaatgaccaataccatccatatactatatagattccccaaattacagctgcagtacagatctccctctgaactcccaaactcgtatcttcacattgtcaactagaaaactttagaacctccatgacttcaggtttcaaactgactcattttttattccccagtctgattcttttcttgttcacttcttacttgtaccatcattcattcatccaccctctgcctcttttggcccagtaagtctgtttcttttcttttcctttctcctctctcctctgtcctctctcctttctcctttcctttctccttccttcctccttccttcctttctccttccttcctccttccctttcttcccctcattccacagttactaatgactctgtttcttaaagtctctggaatatttgttttcactgtcatttagttgccttagttcaggtccttatttcacttgtactcttgcattatccttatccacctggtctgcctcttccttaccagagtggaaagcaactctcatggggtctttgttaattcttttaatagttcctcatgacctggaagataagtccaaagcttattctttttaatttttaaaatttgtatatagggagtacaagtgcagatttcttacatgcatatattatgtggtggtgaagtttgggcttttagtgtagccatcacctgaataatgaacattgtaccaaacaggaagtttttgaacccacactccactccccaccttttttgtagtttccagtgtctgttattccactctatatgatgtgtgcctattgttcagctcccacttgtgaggacatggggtatttgactgttactgagttatttcatttaggatagtggcctctgtagttctatccatgttgctgtaaaaaagacatggttttattctttttgatgggtgagtattattacacacacacaccacattttctttatctcatcctccattgatgattccatatctttactattgtgaataatgttgtgattaacatacaagtgcaggtatctttttgatataatgatttatttccctttgggtatatatacatagtagtgggatttctggattaaatgatagttctgtttttaagttctttcagaaatttccgtactgttttccataaaggatgtactaatggacatttccgccagcagtgtataagcattctattttctccacatccttgcccaacatctggtataagatggggcatctcattgtggttttaatttgcatttctctgatgattggtgatgttgagcattttttcatgtttgttggccacttgtctgtcttcttttgaagaatgttttttgccagtcatgttttttgcccactttttaatggggttatttgtttttttcttgatgttttaaagttctggataatagcactttgttagattgcctaagccagtgtccagaagagtttttctaggttttcttctaggtttttttgtagtttcaggtcttaatatttaggctttaatctgttttgagttgacttttgtgtttgatgagaagtctgggtctagtttcgttcttctaaatatggctatccaatttcccagcaccatttgttgaatagggtgtcctttccccggtgtatgtttttgttgactttgttgaagatcattttggttgtaggtatgcagctttatttctgggttctctattctgttccattgattgatgtgtctgtttttataccagtaccatgctgttttggttacaatagcctggtagtattatttgaagtcaggcaatattgatcaaagcttattctgaatgacatatataaggttcttcatcaccacctcttttgcctcattactctgtttcttggccagtctctctcgtttttgttttttttgttttgttttgttttgtttttgagactctctctctttgtcacccaggctggagtgcagtggcacagtctcagctcactgcaacctccgcctcttaggttcaagaaattctcctgcctcagccttccaagtagctgggattacaggcgcctgccaccatgcccagataatttttgtatttttagtagatacggggtttcaccatgttggccaggctggtctcgaactcctgatcttaggtgatccgcctgcctcggcctcccagagtgctgggattacaggtgcgagccactgtgctggcctctctagttctttttacaagtcatttgcctttggacttttaagatctaaaaagtatcacattgcttatgggtatttttttgagattgtataatttaactaggaaacatgattttaggagtcatagtgtaatgattaggtgtggagactcttgactgtcagcctgtgtttgtatctctgcaccatgacttaatacttttacgaattttttttttttttggagacagtcttgctctgtcgccagactggagtgcagtggcgtgatcttggctcactgcaatctccgcctccggggttcaagcaattctcctgcctcagcctcctgagtaggtgggactacaggcacgtgccaccatgcccagctaattttttttgtatttttagtagaggcggggtttcaccatgttggccaggatggtctcgatctcctgatctcgtgatctgcccgcctcggcctcccaagtgctgggattacaggcgtgagccaccatacctagtctttaccaaattattaatctctccaagctgtaccctcctcatcttttaaaggagttgaaattaaacctttcttatgaagtagtgagagagaactaaatgagaaacaccatgttaaaatagtgcagttctgattttttgtagctcgtaatttcgtttgtattgatactgatttctgtatctgggaattaggttactgaacatgtattgctacttgagttgctttgtgctcgaattatatcagtagataagaaaataaataattaaaatttattgttttatgggatgggaaaaggaaagtcattattttaagcaagatatcaaatgcttaatctgtttgtgatatttgggggtttttagctattaaacacctttatttttgaaaattctgcagaaaaaaattattcaacagatactcggtttcagctgtgtatcagggaaacatgcagaatgacatggtttcctgcacagtcaaacttgcattcagttggggcaagaaaaaaataatgaaacattaaaaaaaaaaaaagataagtgatattaacacaaagggcttccctaaagaaaaaacagaaggctacctaggatgactaggcaatgccttttaaatatggaactgaagcatgttgaaggaactggccatctaagatggctggtgttgtgtaaaggccctggggcaggaaaaggtgtggcctgctgaagtaacaccgggaagatgagtgtggtgggtggaggattgttgagggctgggagccagaaataaaatgaggggttttgcgcacacgcgtgcgtgtgtgtgtgtgtgtgtgtgtgtgtttacttgacttttgcaactggctgaagaacagattatagatatggagacaagagttggaaacagggtgtaatcccatctagagactgttgtgggcttgtcttcagtgatgacagtagagaatgaagagatgggtttggggtgtaatttagagataggacctaccaggtatgctggtaagtgaggtgtggaaggaagaggaaaaggaactgaaatcaccagggtttttgtccaagtgcttaggtaaatagaggtgccatttgtttaaagagagcagacagacaatggtgggacacatttgagagggaaatctgaattgcaattagttgaggaatgagtggaatgtgagaaagtggacacatgttcaatagctatggctgtgatgagaagacagcagatggttcctcaaagaggaattaggatgaagtcaaaggtgggaggtgtgtttttgttttagagtgaaatataggacatagttaactactgacccaggataattacacagaggggtaaagatgttggtggagaagagggaggataaccaaatccagtttggtttgagtgtgaggcaacaataaaggtaatggtccccagaacacaagcagaagaaaggatagttttaagtgaggtaagtttatgaggaaaataggtttcatttattcagagtgttgtctgtattgagaggagggagcataggagtctgtaagaagtgacttggaatattagcgctttgggcattttaccaactttgtatagtgtacaagattttaactttctagctcctaacctctctttcccccgtttcagttatataaggtatcaaagggaaactgtgaacttgttccatcggagttgatggtttgaaataccatcccttccccagcatgttttcagaatttggtgtctcttcttaccagttgccttccctgacctcctgctaattctcccttaccttcatacctcatttttctattgtactctgaaacatattatatgagtttcctgttgctactgtagtaagttaccacaaacttattggtgtagaacaacacagattaactgtcttctagtactgtaggttagaagtgtgacacagggctcactgtactaaaatcagggagccggcattcctttttggagactccggggaagaatttttttcctgatcctgtcctaccataccttggctggtagcccctttctgcatcttcaaaggcaacagcataacatctctcatcctggttttgtctcctcctcctcacacctgtttctctgaccctctcatctgcctcctcctactactattaaggattcatgtcattacactggacccacctggataatccagaatgaggtctctgtcttaaagtcagctgattagcaaccttaattttatctataaccgcaatttccctttgccttgtaacctatttataggttccagggatcaaaccagagggcatctttgggggaccattacctactacatatatgttgtaatttatactgttactcatctttgtattcccagcatagtagttcctgaaatgttgtatacatgaatcaataaatgtatagagaatgcttatttattaaatgttcctttttttcccctccaccctccctttttagtgacgggtcagtcttacgagaatatggtaactgagatcatgtcaatgggctatgaacgagagcaagtaattgcagccctgagagccagtttcaacaaccctgacagagcagtggagtatcttttaatggtgagaaatatgttttactttactccattctgttgtttaagattaaaatctcaaagaaacagattttaaaggaccagttcacttgtcactgatatatgctagatgatatacataatgcttttttttttctagtatgtttgtattttgtgttaataaaatgtaaccttttttaatctaatggtccaacattgtagtagctttttaggtgccactatgcgtgaattattcagaacaaaaatttcttttttcttttttttttttttttttttgagacggagtctcgctctgtcgcccagactggagtgcagtggcatgatctctgctcaccacaagctccacctcccaggttcacgcctttctcctgcctcagcctcctaagtagctgggaccacaggcgcctgccaccatgctcggctaatttttttgtatttttagtaagatgggatttcaccatgttagccaggatggtcttgatctcctgacctcgtgatccgcccgcctcagcctcccaaagtgctgggattacaggtgtgagccaccgtgcctggccaaaatttcaagcttgagaatccgggccaaattcttttgcttatactgtgtatatttctgtaataagttgccagctttttaaaaactgggaaatttcacataaaagtacagatttctggtttaactggacaactttgatcccagatttttgcaagggattaaggaaaatattttagatcgtggaatctaattcattatcctctgattcactctgttaccaacgtaacatcatgcatttaatgaatgatgttactacctggttccgttggcatttgaatttgtttttatagtcagtaggagttgagggactttttgaataaagtattcttttttttactggtaatgggagtttttgagaaataggttgttgtggacatcaactgaaacccttggtattaagatgaaagtctgctagttttacagatgtgacacaggctaaagtaattgaattaagttttttaaaatctcagacttctataattgtctggtgttttggagtattatcaaagtctgaattgccctaaatatcatcttaaagttgcctgattctaacccttttgggaattacatccacagtttaacccattcctttgtgtctaggttgtacttctgttaaaaactcctttcaggtagctagctagtttcagaagagtcagttataagcctcataactgtactctgcctccaccatttatttgcctatgcctttgcatgtgaagttcacaaaacctttttcttagcatattattttatctttttaaattcactttttcattatcttcttgagtagtgtctttaaatgctggcagtttatccagtttgtttggaattgtggaattaataattgttgtgaatttgtttggtgaggagtgtgtaccctaaacagattgtataaaagtattagcttttatggagtggctttcatttacacctgatttagaattctgtataagttcaacagtatcagttattttgatctaatagatgtggagttttgaggtataaaaatacagaatcattgttaccaaatgctaaaactgctgtagagcatcaaatgcaaataaatagatgatacatgagttcatcaaaaacaatttataactaaaatgttttttatatatttgctctttgtttcatagactgaaggggaaaagttgcttttaactgttactagttaagagataggttaaggtgaacggatggaaagaagaaatgttgagcatttatataagaggctatgtaatgtgtgagaatagaggtcgatctatagcaataaagatgaactttttagtttaataaaagagaatttgatggacgccctggatcctaaatttgtatgtagtttgttagcacttaaataactgcccatctgagttaagggtttgcgttggttaactcattcaaaaacattggttttaatgcctggagtgacatctaatccatgcagccattttcctgctgtgttactcttcatcctttatatgttgttgcttttggcttctggtttattagggaatggaagcatttatcatcttattcaattgtaatacttggttctttattctcttcaaaatctataagaacttgataaagactttttaaaaattttaaatgacaagtctatcaatcatgtgcatcaaaataggtgtcccaaaagagtttagtgcatgcagttttaagctcttaataactttaaaagataagtactataaacttacaaaaggcatcacctaaaaactaaatggtttcaatttcttttatatcgattttatgaattttgaaaaattaaattttttgagatactttatctcattttttgagatactttaagtatctcatttatgagatactttaagtatctcatttatgagatactttgacactttaagaaacacttcactgaaaagtacctcaaatttatgagatactttctgagtgacactttctcagtaccatggatcagtaggggagatcctcctgcctggccactgtgtacctggtctgtatccattagatattttttcccccaggagtcatttcagaactgtcaagtgtgcatcaaaacctctttttggattatcttaagctagagttgcaaactcaatcctttttatcactgagtaacagctgataaagatttctaagaagttaaaaagtcaactgaactaataggtagcacaaaaacctttggttgtgttcagttttaagaaggtacatgtatcaatatttttcaaatttgatgctaattacgtgtgcctggtaggtgtcttattgaacaacacagagaatatttccatcatcatggtaagttctgttggacagtgctgctttgcattattatagcaatgtgggtttttctataatgcacccaggtcatttctaatctaatttgaatccatgcagcttaataatcctttacttttaattgaagcagacatctgtttgatgcttttgaaaatcaaacaagatgttaaatagactataaatcttttactctgtataatatttaattttgcatgatgggatatcttaaagcttggaaattctattacagggaatccctggagatagagaaagtcaggctgtggttgacccccctcaagcagctagtactggggctcctcagtcttcagcagtggctgcagctgcagcaactacgacagcaacaactacaacaacaagttctggaggtaaagcggaatcttctggatggggagggaatggccctgaatttttagtgtaaaataatttaacctgaaatacttcagaaatgacgttcattcccagagcagtcgaataattcgttaagttctctcttcactaatgtttgagaaaggcccaaaagaaactttcccaagtggatgtaaaaggtatccttgctgatattaaacatcagtgttgcagttttgccgaagggcatattctgttttatttgttttaaggaaaagatgctttccagtttgtatttagtgttactttctgatgccattcagaatggtttgctcactttgtctcttactctctccataaatgttacaaagtgtatgtaatttcaaagccagcaggattttagtaattatacagccaaggaaatgaaaccgtgagaggtttaaaaccttgtatctagaggagaaagcaaagcttgaattgaagtctctttactggggtgctgaccataccccacacattgctataggtctgactacagagcaaagcctggaacctgcggtcagcttaggaattacgcagtgttctccttcgttcgttcttctgtatattaataaagtaatttaaactgttgatcttgaaaaggccattcttccatgcatttcctagctctgataatgatagtcacctctggttgacaaaggtcactcagtgctttgtgtacagtctcccaaggacaggccctttgtttgttgtgattcagcatatgggagtggaaagagatgaccacagctctgctttggatttggggtcctgttcctttcagcacttattaggtgacatagtctctaagtctcgttgccttcacctgtaaagctggtattatatatggaagaacaaaaaacccatgtgctgtggtcatttcaattggaatgattgtcttcctgaataggaaattacaacatacatctaaaaattctcttttattcattagtaacctcaaaaacaattcctgtatgtacgatttttggtttcctatagcataaccagacaagtaccagcaccctgaaaaagccagaagttctgtattttatattttatttggcattattaacatttattattgtgaatggattttagactgaagagtttagatatattagtactagattgccatacagcttatttatccgagtttttgtagttcacaaatgtttgaaaattaatggtaataaccggaagtcttccttaatgtaagtttggattaaagtttctcctgatttgcaaaacctgacctcagactttaaatatctttttcttctttggtttcttgaattcctaggaattcaagctcagattgtgttcttttaggggttttcattgtttataaagtaagtgagtttttgtttttgttgtggtgtatatttttcttaggaacttttaagcaacaggaacaacttttagtactttttattttgatagaacacacacaggagacaagtttctagtattattttataacgttgagtgccaagggcaattataggaaagtttggttcatattacagtcagcgttctgcactccctgcctttgctaataggagtaatttttgccgtataaaacttgcaagttggtacagttggaagatttcatcattatttacttcattttattacatctgagaactcaaatcattttttctttgatagtgtttgctgtctaaatgtattatttaaccactgtttgtgtatgtatttactgcttttgtttagaaatgtttatgtgtattttaggacatccccttgaatttttacggaatcagcctcagtttcaacagatgagacaaattattcagcagaatccttccttgcttccagcgttactacagcagataggtcgagagaatcctcaattacttcaggtgactaatcagtgtcagtttcacaagtgatttagagtgtgtcacaatttgaaaaagtccatgaacggtccttcccctcctcaaatacaactctgtatttgagaatgtgaatgttttcttccaagctacacttagatattgtaatctagataggtgtactaaaaaaacagttgggatatggaggttgggttaaattaagttgaccaaatagtagtaagtttgggaaacattttatatttcctttttggagattcccactacacattaatatgttaaagaatttgggaagctgtttaacagagaaactgcctaactttaaatcacttttcacaagcttattactcagttcctttttcttaggaacttttaagcaacaggaacaacttactcttagaaaaaatagctgtggggcttctttagtgatcagatcaccaagtatttgaattttatacagcattttaatgcccactagtgtggaaggtaaaaaatacatgcaagtattaagaataagttctattcttatagtcccacagtagttttttttgtttgttttttgtttgttttgtttttttaagcacaggaggctcagagcacttaagaatttgaatttcttcactgtttactttgcccaaaagtactgaatttctttactattgtataagaaatcacatccttccaaagactgaataatccagaatcactaaattacgtttgcaaaagtgtagccttttctcttagtaatatttagaatttctctgttcctgcagatacttaatatcagtgtattatttttctctgtccttcatatcaccacagcaaattagccaacaccaggagcattttattcagatgttaaatgaaccagttcaagaagctggtggtcaaggaggaggaggtggaggtggcagtggaggaattgcagaagctggaagtggtcatatgaactacattcaagtaacacctcaggaaaaagaagctatagaaagggtgagtttaagtaaaactttaaaaaaattagttcttggctgggctcatgcctgtaattccagcactttgggaggccaaggcaggtggatcacctgaggtcaggagttcaagaccagcctggccaacgtggtgaaaccccatctctactaaaaatacaaaaattagctggcgtggtggcacatacctgtaatctcagctacttgggaggctgaggcaggagaattgcttggacctgggaggtggaggttgctgtgagccgagattgtgccactgcactccagcctgggcaacagagtgagactctgtctcaaaaaaaaaaaaaaaaaaaaaaaaaaaattccttagtcacactagccccatttcaaatgctcagaagtcacatattaataataaggtttttctataatttctttcaatagtgtcctgtagttttcagtgtagaagttgtgtaatacttttgttaaaattatttcgaagtatttttattctttttgatgctgttataaatggatttttctcttaatttcattttcagactgttcattgctaactatataaaaatacaatttaattgtgtatattgatcttttatcataaaaccttcttgaactgttatttattcattaagtagtttgtgcatgtgttcattaggattttccatatacaaggtcatgtcatctgcacatggagacagttttacttcttttccaatatggataccttttatttctttgtcttatttaactgccctatctggagcctccagtatattattagactagcaagaaccaacaacatccttgtctggttcttgatcttaagggaaagcattcagtctttcatcactaagtatgatattatctatgggttttttgtggatgccctttatcagattgaagaaattctcttctgttactagtttgttcatcacgaaaaggtgttggattttgtcaaattttttttctttctttattaagatgatcatgtgatttttgtcctttagtatgctttattacattgattgattttgtatgttgaaccaaccttgcatttctgagataaattttactggttacagcatatgatcttttttatatgttgctggatttagcctgcttgtattttgttgaggatttttgcatctgttcataagtcatattggtctgtagtttttttgtgatgtttttgtctgaatttggtgtctgggtaatactggcctcttagggtgagttgggaattattctctcctgttgtctggaagtatttattaagaattggtgtgggctaacacggtgaaaccccgtctctactaaaaatacaaaaaaaattagccaggcgtgatggtgggcgcctgtagtcccagctactcgggagactgaggcaggagaatggcgtgaacccgggaggcggagcttgcagtgagccgagattgcgccactgcactcccgcctgggccacagagcgagactctgtctcaaaaaaaaaaaaaaaaaagaattggtgtgaattttttgaatagttgatagaattcaccagtagtctggtcctgggctttttttggggggaagttttgtgattattgattcagtctcttgttacttgtctattcaacttttgtatttcttttttttttttttttttttttttgagacagagtctcgctctgttgcccaggctggattgcagtggcgtgatctccgctcattgcaagctccacctcctgggttcacaccattctcctgcctcagcctcccgagtagctgggaccacaggcacccgccaccatgcccggctaattttgttttgtatttttttagtagagacggggtttcaacatgttagccagggatggtctcgatctcatgacttcgtgatccacccgcctcggcctcctaaagtgctgggattacaggcgtgagccactgcacccggccaacttttctatttcttttagagtcagttttggtggtttttgacttggaatttgtctattttatctaagctgtctaatttgttggcgtgcaattgtacatatttccttataatcattttatttcctcttttgataaagtaataatgttcctgcatttattcctgatttcagtcatttgagtcctaagatatttttgttttttcccttcagtttagctaaaggttttaattttgttcattttgtggtggttgttgttaatgacaaaaataactttgggttttgttgattctccctattgtttttctagtcttttgttttgttttgttttaagtctctctaatgtttatttccctcttgcttgcttctagtttgttcttccttttttaggttaggtttagtttagttctttgtttagttttagtttaagattaaattattatctatctttgttagcatagatgtttatagctataatattccttctgcgtttatgctatagtagcatcccataagttttagtatgttgtatttttgctttctttcatctcaaaatgttttttaatttcccatttggtttctaatttaattcattcgttatttaggattgtgttaatttccacaagtttatgaatttcccacattttctcctttcgatttctaaattcattccattataatcagagaatatactttcaatacttttcaacttattgaggttcgttttgtggcctaacatggtatttctgaagaatgttctatgtatactgaagaagaatatagtgtagttcttattaagtggtctataaatatctgatagatctagtttgtagtcaagtcttcttccttagctgttttatctattattgaaggtggagctgtagttgtctctattattgttaattgccaatttctacctttaattctcagtttttattttatgtattttgtggctctgttatatataattgttgtgtcttcctgaaccctttttatcataaaatgccttttgtctatagtaacaatttttatcttaaatctgtttcctctgatatagccattctagctcttttttggttaccatttgcatagtatatacctttttctatcattttactttcaacctacttgtgtctttgaatctaaattgtgtgttttgtagaagcaggcagttggattgtaccctttacttcacctatcctagctttaatctggataaaacccagataacaaactgattttttagtttcttctgctttcatagatgaatagttattcgtgatgaattgggatttttgcccaaattttaagggttatttccaaatataatctgacacagcagtctttaacctttttggcaccagggaccagttacgtagaagacctttttttctaccaacataggtggggtgggcgcagtgattttgggatgaaactgttccacctccgatcatcaggcgttagttaggttaggaagtggggtggggcggtggttttgggatgaaactgtttcatctcacatcatcaggcatttgttaggctatcatacggagcacagaccctagatccctctcatgcacagttcacagtagggttcatgctcatatgagaatctaatgccgccactgatacaacaggagacggagctcaggtggtaattcgagtgatggggagtggctgtaaatacagatgaagcttcacttgttcgcccactgctcacctcctcccgtgcggcccagttccttgctcacccactgctcacctgctcctgggcagcccagttcctaacaggccaatggctggtgccagttcacggtcttggggtttgggacctgtgatctaactcaaggtgattgagacaattgaggagggtgacatttggctgagtttttaaaggcttttaaaaggagtgagtattgtcacaagtgatttttaatataatagactaggaaaatgaaattaagtagctggtattaccatttaaaatgctgtaactgttaagcagataaaaatagaacattatcttcaaaatgtaccatgtattactaataattggtcacctgtttttctagtatggagtgttgaataaagcaaggagattgagagtgatgtttgatccaaatgaaagacatgagttgacattaataaataaaacataatttgcttttaatttagaaataggtgaggtggttaaactatactgcaggtactctcatccttatcttcactcttaatatactaaaagccatttgatttacatatttctgtagagtcatttatttttaaaccatagcagttagcagctaatttttaattaggccaaagagtatttgcatagtatctattaagctttaactagaaacaaagacttttttaggtgattagtaaaggaaagggtctagattccatctaatcccttgggttgggcagtaaatccatattgatagagatgaattcatgtaaaattctcaagagcttttttgggttgcagtatgtttttgagtaatgatttatctttagtgctatgctggaatctataatatgtaaataaaattaaatgtgccataattggtgtgttggatttatatttttttcctttttcttccagttaaaggcattaggatttcctgaaggacttgtgatacaagcgtattttgcttgtgagaagaatgagaatttggctgccaattttcttctacagcagaactttgatgaagattgaaagggacttttttatatctcacacttcacaccagtgcattacactaacttgttcactggattgtctgggatgacttgggctcatatccacaatacttggtataaggtagtagattgttgggggtggggagggagggatctaggatacagggcagggataaatacagtgcatgtctgcttcaattagcagatgccgcaactccacacagtgtgtaaaatatatacaaccaaaaatcagcttttgcaggtctttatttcttctgtaaaacagtaggtaacttttcctaggtttcactctttttagtgtactagatccagaaacttagtgtaatgccctgctttatatttctttgacttaacattggtttcagaaagaatcttagctacctagaatttacagtctctgtttcatggcaacactggataatggctttgtgaaatttaaaaaatttttgtagcgactgtaaacagaaatgccaaattgatggttaattgttgctgcttcaaaaataagtataaaattaatatgtaaggaagcccattctttcatgttaaatacttggggtgggaggggagaaagggaaccttttcttaaaatgaaaataattactgctattttaaaatttcttgatcattgaatgtgagacccttctaacatgatttgagaagctgtacaagtataggcagagttattttcctgtttacattttttttttgttttggggaaaaaattggtaggtgtctaattactgtttacttcattgttatattgcagtaaaagttttaaaacaaccattgcatgtttgcttttgatgtatccctttgtgaaattagcacttttggggccaatggagaaatgcagcattcactctccctgtcttttccccttccctcagcagaaacgtgtttatcagcaagtcgtgagtcaaactgctgccttttaaaaaacccacaaaatgctgattcagttcaaaattaatgcaaatgtttcaaaactgggtttctgatatttgtaaatgtgtttctttattagataagagtgtattaccattaaagtcattagtataatattgctttcaaaaagaaatggtagacaaaactataatccagcatcttttattgcattggaaagactggcaaagtcttttggatgggttgggagatgtggctggaaagtactttggaaaatatacaatcaagatatctcatggcatattaaaagaaaaatcttaatagcagtgttggcttttatttggattttttcatctcagttttttctgtggaatctccttcattggcattgttatttaatcataaacggggcagatgtctacttgttcagtttttcaaatctgttttcctgagtataaataagagtatttaaagaaataatttggattgcttttgttttttgtttccttttttttaaccatctgatactaagaagatgaatttgcacagatttctctgcataatttctcaatatctttagcacagtatggtgatgatgacttttaagcatttacatcacgtactcataacctattatgaaaataaatgaaactggctgggtatggtggctcatgcctataatcccagcactttgggaggccgaggtgggcagatcacttgaggccaggagattgagaccagcctgaccgtcatggcgaaaccccgtctatactaaaaatacaaaaaatagccaggcatggtggcgcacgcctgtggtcccagctacttgggaggctgaggcatgagaattgcttgaacccgggaagtgaaggttgccgtgagctgagatcacaccactgccataaacatgacaggcttttggactttgtattacctgtatgttttataatggatcatgcataatttctcaggagaataaaatgagaattcatatatacgttcatctttcaagtcagagcaatgagttgggaaaagaggtggcatttctgatcggataatggaatactctcatttattttatgacattctctgtctactcagatcatagtgaaaactggaaacaaaaaaaaaaaacagcctcttcttggaaagtgacagcagaaggtggcatggagcttgtgtccttggacaacaaatctggatatactaggattaattatcagaagacagctcaggccaagttttgatcgttccatacagtaccttgtttatctgcttcttaaagaatcagccgagacaccataaaagaaataggctttttgtgccttttgctgttaatgtttaatttacaaactgttttggtaaatctcttaatgtaagtagctatttgactttggaattttgcattcgaggtatactgtcatttcttgaaatctttttctcgtttagttgctctgtgggaaatgtgaggaagcctaagtttgtatttgtaaatttcttatgccatcctctagtcaaattttttttcattgtttaaaaatacggaagtgttccaatataattttttcctgtactggatggctaggattctagagaattgattataaaatattttcaatacatccaa

SEQ ID NO: 67 - DNA, 3431 bp, Homo Sapiens
ttcaaactgagaaaggttttacttttaagacaaaacaaatagcattaacacacatccaaatgccagtgcaggagttcactgggtttataaaagagaaaactaaactcaagtgtcaaataaaaactggagccgtcaagaatgactgcttgtggcaacacaggtgtaacatgtgcttgtctaaagtcgttctgtgtttgtggatatgtggaaatgcatgacgagggaaacgatgcaaggcaaaatggcaggtgctcaaagctttaagatccttttcttcacgcttgtgtgctcttgttttgcttttgagaattagggtaattcgcaggtcattttacaaagaactgtaatatcaaagaacacttccaaacggctaaaataggctcaaggtcactattaaagtgataaagggaggtccgtgggggaaaagtttgtgttctcaaaagccagatttcacaccatggcaggcactaaatctagttacatgtgcttgcagtagaaaaagaagacactgatcttaatagaggctggtctttttcatgatgcgcaggaactcttgctcactgacctctccatctccatctcgatcagcttcatcaatcatttcctatatgacagtaaagattcaggttaatttataaactaatgccaaaaggtgactaagtaatagacttttttttttttagagatggggtctctatgctgcccacactggtctcaaattcctggccacaagagatcctcctgcctcagcctcccaaagtactgggattatatgcatgatccactgtgcctggcaagcaatagacttttaatctatgtgaatagataatttgtatctatgtgaatagatcattgtagtccacccaatgccagtatgctactcctgataatagcttggtttctgaaaagttatttgaaaaccaactcatactttgtcaaacatatcacctgggagggaccttgaagattgccttgactagagggattcctggaacctaaaatagtaagcaaaattgtgcatatgtgcatttttctggaagcagggttcataggtttgtctgactattaaaggagaattaagttgtctgcagagggacaaagtacactggcttttcttcaaagaggtgctcacactagggaaaatgtaatggaaaagtcacagagggctcaaaggtgggaattttaagttccagtgtgatgcattacaaacctgcagctcctcatcagtcaggttctcacccaactccttggccacgcgtttcagatttttgaacgaaatcttcccagtttcatcatcatcaaagagcttgaaagctttcaggatttcttctttagtatctttctcagacttaacaagtagaacataaaacacatgagtagggggacaccacggttggttactactgtcctgtagccctgccactgcctggtcaggtcaccctttcctttttaacaatgtaactcgagtctagacttgcggcaagtgtcaggaagcccattttggcctcaaagaaacaccaggcaagccaggcactccatccaaggtgacgtttgctacctatcgctatatctctccctatcccatatctatttcctaactgatttggaattctgtgggaagaggtatctgcttggaagtcttgagaaagaagcacaagggcttgttttgggagcccaaagtaacatgatgggagggcaggcctcctgatgcagttgctacctggactgctctgtggtcacatgactgttttaacaggaagacgccatggacctctgcagatgactggggctccataccatgataattgtcttagctacttaccattttctgggtcatcacagttaaaaagtcaccaaagttcatttttcctgtcccttccttatcaatttcacttatcattttcttaatttcttctttcttgggttcaaagcccagggccctcattgccacctataaagaaaacaggatcgtctcaataagcacatctaaagtagcaggagcaaaaataacagtgttgagagcattaagccagcatctgatgtggtcatgttaatatgattggggaacactatgacattgatctaattgatatttgcaatcaattttattgaataatactcaaagtaagtaaagacaggaaaacagcacagtacaacctcccctgttacttactgcagggagaagagggcaaaaggggtagagaggtgatagggagatgacaaggaagaggcagaggaaaggaagggcagtacggcaggaatgcacagagcttgccttcagttctttaacatctatggtgccagttccatccgcatcgaaaagatcaaaagcttcccggatctcctgcttttgctcttcagtaagctcaggcttagggctcattctttttcgctgagaacttgatgccatgtttgccttcttaaagttggaggcctttatatgttatgcaatacacaagcacaataatatatcatacagtccatatttacataacatagttacagacacccatatgtatttttaaagtcatttatataaccaattccaaagctttgcttaaaaagaaagataacagggtttactggcaagaacaatgaatctttccatgaacttctacccctcccttttctttactgttgtttctagaagcagggagatcacttgttcagtaaggacacctcttactgaaaatcatcccaaaagagagccagtcaagaagatgactgtgaataactagagataatcagctcttcccgaacgtggggatcctggttctgaaaacagtcttacgatgcccactcccagtactccccttcccagtaagtactccgacttcccaattacttctagatttggccaaatattagtaagttgttaagatgtatattgtgtcagtaccgagtaataaaactcaatccatctggcaccttcgtgccttctccaagaagctaaagcatcccctgaatgcccctgtatttaaattgtaaaaaacattgtaacagaacacgatacaccttttcccagctgtgtgtggaaattttggcagaatgaggaggccagggggccaaggtctgagagagtcaggggcctgtgagggattcgagtcttttttgcccagggaggttcaccgaggggatcagggaatgcaaggggagcccgaggggcgggtgtgggcctgttgtgggtgaagaggaggcagcagcgaagcgcaggcccagtaggttggttagcgtctgtaccctactctcccgggaaagagctcaaaggaaagactggtgcgctaaagccgagaaaggcgcaggagaggcggcgtggccgagctggggcctgggaagggctcagccgctgggcgtggggcgcgacagagcggcagcactcaccatagccaaaggagtccgctgccggttgttaggcaaccgacgtgtacact

SEQ ID NO: 68 - DNA, 7830 bp, Homo Sapiens
ggtggtcagcgcgcgcattgcctgccccggaagtggtcggcgcgcggcgcggcgcgcctgggcgctaagatggcggcggcgtgagttgcatgttgtgtgaggatcccggggccgccgcgtcgctcgggccccgccatggccgtcaccatcacgctcaaaacgctgcagcagcagaccttcaagatccgcatggagcctgacgagacggtgcgggccgggccggagcccgggggcgggagcgacgggtttcgggggtggggtgggggcggggaggctagaatcccaacgggaggggcagggaggacggcgcgggtcggccctgcccagacccccgacctgcccgactttcctggaccccccgatggtctttggcccagcccccagccgatcgggcggcgctcctgcgccggtctccgggcgaggccccacccccggggcgctggccaggccccggctccaatgtcagcgctctcgcggggcgcgggagtcacaagctcggattcctgggcaggccaagctctccaagactgggctccacgttcccagctttgcaggcgtctccttgggacactggtggtcgaatctaggagtaatgaccaggagatactgagtagtgacgacaacaacgatgttaatgataataaacgggtctcagtctttataattttggtggtccgtgtttgttggccgtttactttttatcagtcaccgagtgttgtagtgttgttttaccgctctgcaaaacgggcttgtcattggggacctctgatcattttacagatgtggaaacctagggattgaggaactttgccacagtcacacacaagtaatggcagagctgggattcaaattcggttctgcctcgtgtgagcgtccacgatataaatattatgctgcctttttagtcaaaagtagaattaggacctaattcaaacatactgaatgtctattgggtacttggcgctttttgcatagtgagggagacattgaagtccactttttgtagaaaaggaaacacacattttttgatccgctcaagtgtttggctttgggcaagttaacctgcctacctgtctgtgcctccgttttctcaaatatcaaatgaaccggtcgcctgctggcttccgcctgtaatcccagcacttagggaggcagagggaagaggagcccttgagcctaggaattcgagatcatcctggcaacacagtgagaccccgttctctacaaaaaaaagaaacaaaaatcaataaataaaatgagaccaattaaacgtatttcataggaaacttaaaaggtatgacacatatacatttacagtagcactattggccaggcacggtggctcatgcctctaatcctgatgatttgggaggcagaggcaggaggattgcttgaggccaggagtttgagaccagccagtctaacatagggagactcttatctacaaaaaaaaattatttttaattagtctggagtggtggtgtgtacctttagtcctagctactcccaaggctggacaagagtaccagttgagcccaggagtttgaggctgcagtcagcgatgatcgtgccacatcaatccagcatgggcggcagcgagatcctgcctcttaaaattaaaaaatatcactattaactattagtcacttattgtccaaggtagagtgtagagtgggggactgtcccctttattctgttaattatactttatactacccgaaattacattttcttcacattagtgttctctcattgagagcagggacttacttgtgttgagtttgttctgtgctgtggcctctgtgtctaaaacagcacctggcacataatgggtgtttagtataagtaaatactgtgttgaatggcatgatgattgaatgaattcaaatctagcatgctttagatgctgagaaagcttaaaaaacccagcgtgcttgcctttctgccatcagggctggcagtttctctgtcctaaactagaagggaaaagagaatcttggggtctccagtgactgtctgtaccactccctctaggtgaaggtgctaaaggagaagatagaagctgagaagggtcgtgatgccttccccgtggctggacagaaactcatctatgccggcaagatcttgagtgacgatgtccctatcagggactatcgcatcgatgagaagaactttgtggtcgtcatggtgaccaaggtgggtgacgtgtgctggctgggagggtgggtggacgagctggggagctggcaaagagcctgtgtgcccaggagagattagctgtgaacagggcggggccacagcggagcgggttgttgggtctgatagggttgctgatgccagctccctttttcttgctgttgcagaccaaagccggccagggtacctcagcacccccagaggcctcacccacagctgccccagagtcctctacatccttcccgcctgcccccacctcaggcatgtcccatcccccacctgccgccagagaggacaagagcccatcagaggaatccgcccccacgacgtccccagagtctgtgtcagggtaaggcgggggcagcagtcccagcttgggccctgtcctcctagcacattccagcgtccacataagtggtcccacacacctggagggagggcaagccgccagaagccagggtccgatttctctctcttgaatttgcagctctgttccctcttcaggtagcagcgggcgagaggaagacgcggcctccacgctaggtgggtgggtggtccccagggcagaggtgactgggtgccccagccatcagctgggccttgtctgggtgcgggagggcctgggagctgccctttcctcttcctggtgacctaggctttgctgcttcctccacagtgacgggctctgagtatgagacgatgctgacggagatcatgtccatgggctatgagcgagagcgggtcgtggccgccctgagagccagctacaacaacccccaccgagccgtggagtatctgctcacggtgaggtggggcttccgcctcccggggaggccttgagggagtacccgggcgtcactgccctgatgggcggttgggaaggcaaaacctgccctgaaaagcctttgggtagtgattctagccactaaaggcttcccacaggaggctggatgtgagtgatgggtgggcctctggagggcagggccgaggcctcatctgtgtcctgccagggcatggaggagggtggcagcaggaggtctgtgcattagaactaaacaggacccctgacagggaattcctgggagccccgagccggaacacggttctgtccaggagagccaggtatcggagcagccggccacggaagcaggtgggtgtgcacatgccgcatctgccctccaggtacctgactcacattacactccaccccgcagtgctcctaggagcccggcgtggtgtctgactgcaccccttcctactaccagcaggagagaaccccctggagttcctgcgggaccagccccagttccagaacatgcggcaggtgattcagcagaaccctgcgctgctgcccgccctgctccagcagctgggccaggagaaccctcagcttttacaggtgtggtcccaagggcagagggagctagggcagccaccatttcccttccctgtgggcaccagagtccataacacgtaggaatcgttctaggtccggaaagcaggactaagcacatgcttcccccacgcccctgtgcttcctgtgacctggtgacccccctggtttctcagtcttcccaaccaccttgtaaggtgtgggtgctgtcaacatcacctcccacagaagaagacaccggaaacttagagcagcctgtcattcccagggtcacgcagctggtagtgtgtgtgtctgcctcctgcctcggggtggggtcctgggctggggctctggcttcacatacagatggtgctgcgtaaatgtctgtaaggtggcatgacgtcacccaggacagctgtgccccagttggctctgggacaactctgctcagtgaggctccatcttgcccttgaaggttcacaggaagagtgggggagtggccccctgggtgcaagtaggttcctctgggttctcggtgaagtgcctaccggtcttggctcaggaccctgctgtctgacccttctcctctcacttctcagtcccttgccagctcctcctggtcggtcgtgttcttcatctgcactcagccctccctcatagtgtcctggggccttcagtctgtatgggaacccccaaatctatgtagccagcccaggcctctctgaatgccacactccatggctggcttaattaactctccatcaaagtgctccctagactagacgtctaagacttagaacagacctccccagtcctccccgatctctgcaaggattagcttggggttgcttcagccccaggccctggggatctgctggggtctaccccttgtcctgtctgctcttcccactcagcccctccctgcactccagctctctggtagcctcttcctgggcctctgccactgcatagtcccacagtccacttttcaaccatgaggcagatgactaaaaagcactttcttttctttttttttttgagaggaaatctcgctctgtcgcccaggctggagtgcaatggcgcaatcccggctcactgcaacctccgcctcccgggttcaagcgattcttttgcccccgcccgagtagctgggactacaggcgcccgccaccacgcctgactaattttttgtatttttagtagagatgggatttcaccctgttagccaggatggtctcaatctcctgacctaatgatctgcccgccttggcctcccaaagtgctgcaattacaggcatgagccatcacacctggctgactgaaaagcactttcttctttaatgtgaaaatgatcagatgcatacaatggtagagttatatcagagcttccagatacccaggtagggcacagtggctcatgcctgtaatcccagcactttgggaggctaaggcaggcagaccacttggtcaggagttttagaccagcctggccaacatggcaaaaactcgtctctactataaatacaaaaagtagctgagcatggcggcaggccactgtagtcccagctactcaggaggtggaggcaggagaatcgcttgaacccaggaggcagaaattacagtgaaccgagattgccccactgcactccagcctgggtgacagagtgagagtgtctcaaaaagaacagaaacaaaaatgaacaaatgaacttccagatacctaaatccaacacccagatgagttcactttttttggtttgggggctggtaggtgggaatagagacagggtctatgttgcccaggctggttttgaactcttgggcccaagcagtccctcctgccttgcctcccaaattgttgaggttacaggcgtgagccaccacacccggccaagttcacctttctaaaagatccacagaccacgtcttttcccatgtaactgtcaccaccgtggcttccccctgctctagaaaatgggtctgacttgggccttcctctctggtgtcattgtctgcctcctcccccttcccttgttcgctgttttttgttttttttgttgttgttgtttgtttgtttttgagatggagtttcgctcttgttgcccaggctggagtgcagtggcgtgatctcagctcaccgtaacctccgcctcctgggttcaagagattctcctgcctcagcccccagagtagctgggattacaggcatgtgccaccacgccctgctaattttatatttttagtagagatgggatttctccatgttggtcaggctgctctcaaactcctgacctcaagtgatctgcctgcctcagcctcccaaagtactgggattgcaggcatgaggcaccgtgcccagccccattcactctgttcctgcttctgtttctgagacttcccagatgcatccaccctgggcctttgcacttgctgtttgctttacctggaggaaaccctctgcatccgccatactgcaggcctctccaccagccctcatctgcagttccttcctagccagacacttgcagttgtctggttcatttattggctcactcacttattttttgagagtctcttgcccaggctggagtgcagtggcacagtctcggctccctgcaacctctgcctcctgtgttcaagtgattctcctaccttagccttcttgagtagatgggattacaggcacgtgccatcacacccagctaatttttgtattttagtagagacggagtttcaccatattggccaggctggtctcgaactccaggctggtctagaatcacctgaagtgattataggtgtgaaccactgcagccagcctatttatgtatttatttattcaagacagggtcttgctctgttgcccaggctggagttcagtggcttactgcagcctccgcctcctgggttcagtcttatgcctcagcctgccaagtagctgggattacaggcgtctgccaccacacctggctactttttgtattcttagtagagatgggggttcaccatgttggccaggctggactcgaactcctgacctcaagtgatccacctgcctctgcctcccaaagtgctgggattacaggtgtgagccaccgtgcccggcttatttcttggctcacttaaaagcacatcatcagctcttccagggtagggcttgtgtcgactgctatgttgtgtttggccagaacaggctcctctggatatttgcctgactgaatgaaaaagcaagggctgtgatgacctggggagaggaggggaccagggctgtgaattaccttcccttccccaccctctcctgcagcaaatcagccggcaccaggagcagttcatccagatgctgaacgagccccctggggagctggcggacatctcagatgtggagggggaggtgggcgccataggagaggaggccccgcagatgaactacatccaggtgacgccgcaggagaaagaagctatagagagggtaagaggcctggctgaggggtgactgcaggtgggcaggacccctaccctctcctgctcacacttaacctatcttcccacagttgaaggccctgggcttcccagagagcctggtcatccaggcctatttcgcgtgtgaaaaaaatgagaacttggctgccaacttcctcctgagtcagaactttgatgacgagtgatgccaggaagccaggccaccgaagcccccaccctacccttattccatgaaagttttataaaagaaaaaatatatatatattcatgtttatttaagaaatggaaaaaaaaatcaaaaatcttaaaaaaacaagcaaacagtccagcttcctgtcctcctaaagtggcccctgttcccatctcccgggccagacagctgtccccccgtcctcctccccagcccagcctgctcagagaagctggcaggactgggaggcgacagatgggcccctcttggcctctgtcccagctctctgcagccagacggaaaggcggctgcttgcctctccatcctccgaaaaacccctgaggacccccccccatcctcttctaggatgaggggaagctggagccccaactttgatcctccattggagtggcccaaatctttccatctagggcaagtcctgaaaggcccaaggccccctccccagtctggccttggcctccagcctggagaagggctaacatcagctcattgtcaaggccacccccaccccagaacagaaccgtgtctctgataaaggttttgaagtgaataaagttttaaaaactag

SEQ ID NO: 69 - DNA, 43012 bp, Homo Sapiens
ttattttttaaagttttattatgggattgcagcaattaataatggaaaagcttgttttattgtaaaaattaccagtatgtgacacagagacaagaagcaagcagatgccattggaaaaatggtgccagtagacttgcttgttgcagggttgccacaaaccttcagttaaaaaaaaaaaaaagaagcaatttctgctaagcacaatgaaacaatgtatgcctgtgcgtatggaggggcatggggaaatttgggaggtgatgaaaatattatcttgatttcacgagtgtatgcaggtcagattcattatacatcactgatatttcaaagctgtaagaaaaaacaaaaacaagattgattgtgtgaaaagatgttcagcattattaatcattataaagacttgaaatgttttatttctattcttgtctattacaacttatttgggataaaagtggagaatagttttccttatcctaaattcacagcttgcacaggcaactgaaatgctatacatgcgtttggacacaatgaacactacctgtgtagacaggtacagtaatcgctttactgctgagctgagttagcagcttttacttcctgtacttcataaaggaatttgagaaagacatttttaagaatttccatgtttagtttttttcttgcctcccaaaataacctttgtataataaccagactcatacttaatgtaacattacgttttttgatgtccatgctatgattttctttaatttcattctctagtcaagtatcaaagactatactttggctctgccatttataaaatgttttatctgcaatttcttttttttatttgagacagggtcttgctctgtcacccaggctggagtgcagtgggatgagcatagctcattgtaaccttgaacttatgggctcaagcaatcctcctgccttagtctccatcccgagtagctgggattacaggcatgagccactgcacctggcctacaatttcataaaatttttttttttcttgcttcagtttcatcatcttttatatggagaaaataatatgtaccttggaagttgtgagaattaaataataaacatgttaggtgcccgcacaaaacaggtactagaattatatctgtcattgacctaaaaaggataaagagagttggcagaagatacaactgcatgtaggggaatatgcttttcattaactctgtaaagtcgggttttatctgtttgaaggcttatataagtttctgttctaaatcccagttattcttcctttttctctgcctacctcccccttctctacgtaggtttattaattggttttctcatcatctaagtaacttccagttccgttggagctgggaagattggtaagtgatggtttgttttatctttttctgtagtcaaaaaactactaatgtttaaaactgtaacataaaagtgtctgaaatatttaatttcttggaaactatttgtagttaagtacaaatagttacaagtgcaattataacttaacaaaacttgtaagttgttataagttaacagataattatagtacaaatgggtgtaagtgcagattatatgtaagcattgataaaactacatttcctccttaggtcagattgtcttagtcaagatcctgaaagtcccaaaccgaagtttgtaagagaagttctagaaaaatgtatgaggtaagttttttgtgttttctccttttaacttctttgggaggatttctttctcttctctgcacttgtgatgtgtgttcagaatattggattcaaaatccacttactcatcttccatcccatttttaatcaagacttaggctaagaaaaattaggcaaccatgccatatagattccatgtgaatttaagccaataagttcttttaaagatgtcacaggccgggcgcagtggctcacgcctgtaatcccagcactttgggaggccaaagcgggtggatcacatgatgtgaggagttcaggctagcatggccaacatggggaaaccccctctctactaaaaataaaaatttgcgaggcgtgttggcgaacgtctataatcccagctacttgggaggttgagggagagtcctttgagccaagatggcgccactgcactccaatctggccgacagagcgacactcttatctcaaaaaaataaaataaaaaaggtgttatatatgaaatgaattcagatttatagaaaagttggcacaacattacaaagaattctgtatcctcttcacctagattccatagctattaacattttatcatgtttgctctcatgctcactcccttttcgtctctccctagagacccattacgttggttttcctttgagaataagctgcatacccagctgatgtaatggcccattatcctttaatgttccattacatatcttcccaaaacaaaaccactctcctacctagccagcatacaaccttttagatcagaaaattagctgtggtacaatcctaccacataattcacaggtgctgctgaaattttgccagccgtcccaacacctgtatttcctgtctggtctggagtgttttttttgttttgttttgttttgtttttgagttggagtctcgctctgtcacccaggctggagtgcagtggcacgatctcggctcactgcaagcgccacctccgggttcacgccattctcctgcctcagcctcctggtagctgggactacaggcgcccgccaccacgcctggctaattttttgtagttttagtagagacggggtttcactgtgttagctgggatgatctcgatctcctgacctcgtgatccgcccgcctcggcctcccaaagtgctgagattacaggcatgagccaccgtgcccagcctggtctgaaatcttatccaggtacatatatagtgttgagttgtcattctcttcagattccttcagtcttgaacacttaactcttttttctatctttgtgtttttaccagtttgaaagagtctagaccttacttggattgctctgatatttctcatgagcagactgaggtcttaaattgttaatgctcttggtgtgtcacttctagaggcacatgattcccaccactggtgatgttaatcctgatccacctggtcatgtcaatatctgccagctttctctaccttaacctcaccatttttccctttagtagaattgataagtattttagatattctgaagttttactcttactctgttcttcatcagatctccatcctgcttttagcagctaccactaagatggttgccaagtgatgattttctcattccattattttttctacatttattagtgggccttctgtaagagctgtcctttctcccccatttatttattcctttatttatatatcagtagggactaattaatttatatttcattcgatgggttataaactatgaggattatttattttgatgcccaaattgtccctggtatgtacatgaggagccccggtaagctctctctctctctctctctctatatatatatatatatatatttttttttttttttttaacgtccccagccattcattgagcattcccttattttctagaacaacatatttaggatcatcttgcgttttcttgccctatcactggaatcatctatttattcatggagccctagtttctagtaaagtagtaatggaatatggtatttaggagccaagatctgggcacttgatatgctcattgccattggggtgtcattggttctaagcctcttggtggacacacatccatccatccataactgtttttatgtccacctgtgtgtatatatgcctccaattccaactcaataccttatttctacacttcttctctaccatgatttgtaaacaccttctcaggcagtaacaaacttggcttccattatcctcaatatttatttatttgatagaatatagccagtttccaaagcgtgcagtcatctccaccatgccccatcatcaccccacatacttggccaccaggctcatgagctcactcacccgcacctcagtgcaagccagtgagttttgcagtatgcctgagatttggtgtgctggcttagacaaaaactcaaaggatttttttttccctttcacttcttggttgtcagctgagttcaagttgttggagatcatgactttccaggtaagtcgggtgttaccgaagaatgggactgataaaagatattttctgaggctgttatttgtattgtaggttgtcttaccatcagcgtatattagatattgttcctcctaccttctcagctctgtgtcctgcaaacccaacctgcatttacaagtatggagatgaaagtagcagtaagtaatgaaactaatccctctgtctttaaaaggtaccagttcaagtatatctgaagttagttgtttaaagtggagaaattgaactttttcttttcttggggtttatatttcctgtatttgaaaggtggtctatcattagccactgttttatttgccctgtcatcattttgaggatttggttgtgataaaattaattactactggcttatcattttttctcttttgaatgtgttaagtatagcaagatgaatttatagttagaacttactaaactgaaaacgtgtatttgtcatggtgatggaggttacttgaattcattatcttgttcaggtgtggtattgagaacatagatgcacatatttgtggcagtatgcctttaaaagtaaattcttaattatgattttcttaccttttggtcacataatctctgaaattgcaccataaatcagggagtgtaatttgatgtgccattttgccctttgcatagtatttacacttaatgaaggtaaagtattatacattgttgatcactggtagagttaggtgtggagtttttccaacttgttctttgcagattacacttaacacagcccctccatgatccttccattttgtgttgtgtagaggttctttgtatctcacaactttctgctgttctttgcttttcatactgtgtgcctgtttctccacctctgtctctgactgtacctgttttccttgaaatgaactgtgtcggtcctggtacatttcctatttcattatgtcaactctgaagaatagatatgattatcaaaactacaatgaggaaatgacttccaagaggtcaagctagaatgagattgcttttgagtggtggagcccaaattcaggcgtaggtgcactaactgagtggccatgctgttagccactgtgctttttggcagatcaaaggtttatgcagtacttagaagtgctgggttttgagttttgtcctgtactggttccgagaatgataaggtgtagtctttgctatcagaaagctcaggcttttgttgaagattaagctttctttttgccccataggaataactccgcctaacattcaaggccttcataaccattgttcctactttgttatttttcacttctccccacatggacctctatttctgccaggtccatgtacttttttattttttccatactccctgttcttgactttgccattaccccagtctggaaagccctttctagctccacttccttttctccttctagattctagcccaagctcaatagctgtaaatattttttaaccgttagcaagccagttttgtattgcttcctggctgtgtctaatgtgaatatcttggttccccagctagaatgtagactggtgacaggggattctgtttttcttcgccttcttttttttagagaaaaagctcacagcaggtgtaatatgactgtcctcacatgactgttgtaatttactttattcattccagtaactcatactctataacaggattgccttttttgttacctctttgtctaccttacattaaaagcagatttcttgttgctctggtgatgccttacggtgtatattagcacaaatttttataataaggactcaactgataccaaccaatagtaaatacaaggagtcccatcacgtgagcatctgacttacgtagattcaagcttgtggactcagcaaaaaagaaaagtacaaaaacaaaacctctctgaagttggcagccattaccttgttgagactcagacttcatttccacggtcccgaggaaagaaagaggaagtgggtgttggcaaaatgaaagagaagtacgttggttctgggattttgagcccaggagagttgagggcattaaaagacagtttaactgtgtccacttttctccttaccattcatcttgaggatgatcagcaccttgtgctctaaattttacttagctaagtgtccttaatgaattgttgaaatgagaattgtccctttttaggtgaaaaaccattaacctattagaaaaagctttcacatacggtatttatatgtgattaaatattgaccttgggataaagagcatcctattttgaaaggaagaatttaaaaaaaatttttctcagttatttaactgttcattagaatagtcttgaaacctgatctgtcattccccttacccccaattctgtgtttagattctcttcctggacattctgttgccctctgtttagctgttgcctttaaaagtaaggcaaccaatgatgaaatcttcagcattctgaaagatgtaccaaatcctaaccaggatgatgacgacggtaagtggaattcagtatttcttaagtggaactatgtataggccaacttaaagcataaacataactctggcaacatgatgctcttaaagcaatatatctatatctgtttgacctgttcagactgttgttcttagcaccccaggtattttccccttatataaaaagagatcctaacatttctgtgatatagcttacttaagaatataaacttcatcgtaaatacaaagtgaaatatgttaccattcaaggatttttaacccctgctttcaccatagagaagttcctgaatagaaagacttggtgtgttataaagttggatgttttctccaagttaagctattagaataataatgtttaacatttactcagttatataccatgtaattccaaccagaatcctaggagtttttctgggcaagagtgggaaaattgacaaaataatttatacagttgcctgaatcaataaatggatatgcacatagaaaaactactgaatcaaaataagatattagtggcctttgggtatttattactgggattttgtttggatatctctaagaaatttgtattatgatattagagaaaatgagtttagaaagaataagccaaaatgatggcattaaattcagatgttgtcagacatcttaagacataagcttaagtgttttttttttttttttttggtattaatataatagaggctatgaataaggaaacctgtgtgatttttttttttcaaggaatggatgatagaattaagacagtcacataaaactaagacttaaaattacaagtggtttcatattttcagtgtttgaaatcagtgacggtcttttattgtttattagaaccaaaaaacattacacaaatatctgtgtatagatgtgagcaaccatctatttagcatttgaggtaaggcaccaaggaattgctgtgcttacatttttctgttttactataaaatatttttcagatgaaggattcagttttaacccattgaaaatagaagtctttgtacagactctgctacacttggcagccaaatcattcagccactccttcagtgctcttgcaaagtatgtatgagtacagagccttgcttgagagtttggaattttgcttggtgaacaccagtggtatggtaatttttacctaagattgttgaatatgaagatcttaatagtgtataattggacacagtgggtttgggtttgtggtagctgaaatccatatcctaaggcttccgtcagtctgtttgtacagttggcatatgtacatggtaagtgctttttttcatatagacatttaaagaaactagtgaaaaacctaggtttttgggacagtcatatgcagttggaagttcccacgctaaatatctttccaaagcaatgtaagaagaaattagaatcagctacactgttgggagtcacgcaaaggttggcatctgaagacaggtatttttaacttgtcagacagggtccaaaggaagaaagagcacatagattttccttctgccaagcagagaaactggacatctcaccccatctctgtctccaaggctttatattacttgcagggttcccacagaagatgcagtttgaatatttcaccatgtttgaagacagttccttagtccttacctattcttttaaactgtagccctgggctaacggtagtatattgtaaatgtcttgagattttgtgacagcttccttaaaaactatcaatctgtgatcacactttttgcatccttaatggttaatacttagttattttgcatttatatattgcattataaattgagtaacattgaaaaggctttgaaaacactaaaatgtttaatgaataagtatatatggtatttttttcccatcattatcaaaaggtttcatgaagtcttcaaaaccctagctgaaagtgatgaaggaaagttacatgtgctaagagttatgtttgaggtctggaggaaccatccacaggtaaaaattatttaattagacatgttgaagctctgattgtatgggtataaaaataaggccgttaattgccattgttttgtttgtaaaacatgaaatttgactctgcctagataatggtttttagatctaattctttcagtgctatgggagtaatgatgtttcattcattcttgaaagagtaagcattattatgatttggttttgaactataatatctcaatatgttttaaatgttcaggaaaaggtttatctagtctatccagtttctaaatgcaagctccagatttctcaaaccttgatatatattgtgtatgacaaagaaacatttaaataaatttcataaaacagtgagtgtgtaatgataaaacattgttttacatttaacttctggggttcattgaaattatgtatttttttgaatacgtattagtacctgaaatttaaatttttttttggagacagagtctcactctgtcacccaggctggagtgcagtggcgcaatcttggctcactgcaacctccgcctcccgggttcaagtgattcccctgcctcagcctcccgagtagctgggattacaggcgtccaccaccacacctggctgatttttgtatttttagtagagatggggtttcaccatgttggccaggctggtctggaactcctgacctcaggtgatctgcccacctcggcctcccaaagtgtgctagattacaggtgtgagccaccgcgcctggccagttttttcaaattttaactgttaccattcagagtttttgtttagtcaacctgtttcttgtagtgctagagcaaagcaaaggggagaataaatcttaagacctaatgatcaggccaggcgtggtggctcttacctgtaatcctagcactttgggaggccgagatggatggatcacttgaagccaggagttcgagaccagcctaggcaatacagtgaaaccccgtctatactaaaattacaaaaattagccaggcatggtggtgcacacctgtaatctgagctgctcaggaggttgaggcaggagaattgcttgaacctaggaggtggaggttgcagtgagctgagatcgtgccactccactcccgcctaggtgacagagcaactctgtctcccaaaaaaaagacctaatggtcagattgatcaatcaattccatagccaccaaaactaaattttatagccctcctattttacttttatagcagcagtgtggtggcacatatatatgtgtgtgtatgtgtgtgtgtgatttacttgaataattctctcattgtagatgattgctgtactagtggataagatgattcgtacacaaatagttgattgtgctgccgtagcaaattggatcttctcttcagaactatctcgtgactttaccaggtaatataaattattttatgaaacttgtgttccctaagaattgatatatgtgtggtctcttatacataagcttcaaattctggtccaaaccaggttgatattaatatactaatggtccaatctggtaggattggacatggcaaaaattcctagacagtggaaacatacacagcctatcaggttgcagcgtctcttagcagggacactcttaagttgaatcaaggctaagccagtgaagtagaaatcctgttgaaggatccagactgttgggagagaaaactagcaagagccagctatgtgcagagtctcagctagtccagatggaactcgggaagggttccagcttcagtggggatggcacctagaatgcacaccaggaagtaggagaaatcaaagtcaaagtagagtaaatcatggagggatccaggaaagcttggtgattaacaagacacctgagggatgggggaaaggggttctcaccacagtcataatcttaggtttaatgcagaagattcattctgccctcattccccctaacggaaagaaagtttttgctgtttggttcttatttatgaagttcacggactttacagctgataggaccagggcagcaggagttgacacaaagcaggaaactaaagcaaattacttgtaaaaacataaaagtccatcacaacctttaacttttccactgtatctgttactgccagaggacactgatcagaaatatactgaattgttagggtgatagggtgtgatctaaggttgtcataccggccaggttggccttcataaacaaagacaacagaagaaccttttcagatttgtaaactctcagaaaactaaccacccgagtatgttttaaccattgtcctgagtgatttacgttttcaattcattttatccttaccgcatcaccgtagagaaggttccattattgtccacattttacagaatagggaagtgtcacagagtgctttatcctgcccaaagtcacacaactaagtgcagagccagcattcaaacccaggcattctggaatctgtatagtgctcaacagctccatctgttctttaacacctagctcaaatatttgtaactctgcaaacctttccctgactatagtccaccccctccagagttaaagtgctctgctcttttgtcctgtttcctaacattctagacttggagttttatgaacagattgttttattatcttccacttaaactattatttgggtcaaaatttgtagaaggaagtacagttcacccttgaacaacaacaggggttagagacaccgacttcgccccacccaccccaccccacacagtcaaaaatctgcatagaacttttaactgcatggaaaatttaactagtagcctactgttgaccagaagccttagtgataacgtagtcaattaacacatatttgtgttgtatgtgttatatcctgtattcttacaataaatcataagagaggaaacattcatgaagtgagagtggatcatcataaaggtcatcttcattatcttcacattgagtaggctgaggaagaggaggggttggtcttattgactcaggtggaagaaaacccatgtgtaaatggacctgcacagttcaaacctgtattgttcaagggccaactgtactattctgtgctgggttaggagacctagtttatagacacaaaagtagctgagaagttactttttaaaagaaaaacacttatgcaacaaacatttcaaagcacctacaaagtgatcttagtatgtatttgctagtaagaaagctgacatataattatctcattcttagagcccatcagttgatacctattatcaactaatgagtttcttaaacattccaagagaataattggctgagtgtgtgctagttaaataatataaagcatgggaaataagtctcaggttaggtcaccattttgagaaaatttctacacataatgtttacatttaggagaggaaaaatgtatttccatttttaatgttaatgtccatcatagtttgccatttcaattcagtaagtatgtacctctggtaagggatggaaataagaaaaatgactacacagtgctgccctcagggggctcgcctgaatctaatgggtgtgaagatagatacttgcacaatttacaataaaagaccaatttgtaagtattgctggagaaagatgactaattcagccccaaggacagaaggctgtatcagctgttaagaatgaaattacaaaagttgaaagattttattttctgtaaccatagcttgacatacagtaaccaaatgccatatttctttaagattgtttgtttgggaaattttgcactctacaattcgtaagatgaacaaacatgtcctgaagatccagaaagagctggaagaagctaaagagaaacttgctaggcaacacaaacgggtaagttttgtgtaaacttgtaagtagttaaagaaaatataccagaaactctggagaggattcagagttcattatcttgatgatatttcattttttctgagcccaaattaatgcagagcagaaatttttctgagcccaatttaatgcagaagcagaagaggaggaaggagcaggtagtgtgttgtgtgctgttacactgcatgatgaaccagttcaggaagccacaaacttcacttcccatagttcactatctctgggtcggcctcacgtttgcacaagggaagtagcagaagggaagaggacacttgtatttctgtaggagtctctgggggaagagggagaggactatagatacttaacactttccccgtactgtgaggaggaatggggcagtcattcccaagttaacggaatacttctcatagtattaatttagtattttagccattttggagggaagcagtgagtgacttaacatgatactactattcattatgaaagtattttccagtgttatgcatatttaccatagtagaaggtgaaaaaaagttgagtttagtgccctataggaacctttcgcaagtttgagtaccagtctccatgtagacatacctgtatacatatatggatataaacactcagacctgaaatactgtaaggtaaatggtgtcatctcattttgtagatgttataaagtgagacatagagaagttaagtaacatagctagtaggttgcatagctggtaaatgaccagagctaggttctgacacaggtctgtcagactccagagacttttctctcatgccacactgtttctagaagtgtgctgtccaacacagtagccactagctgcacgtgactattttagttaaatacaatttaacattcagttctttggtcacacaaccatatttcaggtgctcagtagtaacgtgtggttgcggtcgtaacaggctgcacatatttatataacattggccccattgaagaaaggtctatctattaggtagtagtgctctagaaccttacctttgagtggtgttaggaaaggacagtcgtgtacccacgtgtctagaacatagagcagacctcataaatgggctgtgtttatagagagaaaagcaagattctgtgatatccgagagcagggttctgataattttgcttaaagtggagagatcagtagatggggccttagcagttaagtattaacctcgaagaattaccaggctttctagattcagtgatgccaccttcttgctgaaagtaccttggtatgtaacaccttagagccacgttctggctctgccactttctgactgggtgatgctgggaaagtcatctaacctctcagccttttttctctgtaaaatggaaataaaccatgccttgtttttcttttcctttaaaaagaaaaaattaaattctataaactcttcagagtgagctgggggcagggattattaaagctttacaggagtatattgagcccatcattgccagcagaaagtcttaaacagcccactttgaattattatatgtcggctggagccatttctaaattataacaagaatgagcagccttggcccataggacttgcccagtttttctgtatggcccattagcagatgaatgattagcaagctgtctccctgttgttactgctcaaatggtcaaatagtgataaattgtagccaagtccccccatgttgttaccaagacaagtgccactaaatttccctggcctagataagaacccatggaatttctgaatgagaagacagtgtctctgaaccacaacaggactttgaggtatatatgtgtgggtggcggggtgggggggtactttcactatagaatataagtcttaacatttggccagacacagtaaaatgcttcccctggaggagatttaacacactggaatctaaatggtattttccttttgttcatttgccttctatagcgaagtgatgatgacgacagaagcagtgacaggaaagacggggttcttgaggaacaaatagaacgacttcaggaaaaagtggaatctgctcagagtgaacaaaagaatcttttcctcgttatatttcaggtatcttggcttgggacatttatacataaaaggaaacaatacatttctttagttttagtttttaaaaatgttatttttcattgtaaaaggaatacacattcatttatagaagagattaaaaatacaaaaatttaggaaggaaataaaagttcactactcagaggcaaccatgtatgtctgagtttctctgctgtttacttagtattctcgcatgagcatttctccatgcttgaaaaaaaattgtgggttgctttttttatatatgtctcgtttaattattcctcattgctgatcattttccttccatgaacattttaatgcatagattcctgttaaaatttctgattacttcgttagaatagattccaggaagtaatattactaggataagtaatttaagacattaaaggtctttatgtattgccaggaagaatgtaccaactcatgttattaccagtctgcccttctaggttgacttcatgaataatggaagctaggcacacacaccacaaagacagggtggaacaggcaatactttggggtttctttgtcatgaatttttttccaaagtataagattctgtctgtagtactaccttaacttcttctccctttccagcggtttatcatgatcttgaccgagcacctagtacgatgcgaaactgatgggaccagtgtattaacaccatggtataagaactgtatagagaggctgcagcagatcttcctacaggtatgtggggaacttcgattaggtaataacactattctcagccacaaagatttttcattaaaaaaaatccttgtcaaatttgttaggaggttatatagtacctgttagaccctttagttcatgtccatttgctgctaccattgctcatcagaatatttaggcttaaactgattctgtaccacttagattcctaattgccacccccccaacaaccccccgccccaccttttttttgagatggcatctcactctgttgcccaggctggagttcagtgacacgatctcagctcactgcaacctccacctcctaggtttaagcaattcttctgcctcagcctcccatattgctgggattacaggcacccgtcactactcctgcctgatttttgtatttttagtagggacagagtttcaccatgttggccaggctagtctcaaactcctgacctcaggaggcctccgcctcccaaagtgctgctgggattataggcgtgagccacggtgcccagtctcctaattgtcattttctatgctggggatcctagctgtaatataaaatgtagaggacaaaaatatcaagaggacagtaattggatttataagtccctaaaaagccagtgttatccaatgtgcaggtggtaaactgtccacagaatcaaggtaagctccctggggtctctctgcaaaagcaaaatgccggcacctattctcacctagatttaagttaaaggtatataggagagtggagctaattcattgtatcttcggacactactcccctaaatcttcatttgttcattctagaagaatgattaatgtagaagtcactctaagttcaattctttgagcctccaaataggaattccctctgattttatagttactgccagttttaaaagctttaacagtctctagtcctataagaatctctgagagtattcatggcttatagaggaacacatagacaagagtatttcgttttctgactgtttatcttcctgtcagtccgtctggctgctttttaaaaagttacaatgtattatgccctgactggggagagagctagctgagcctagtccgtaatagtactaggagcaagcaggcactgctgccactgccttgaatcatgaattctgtttacatagaagttggtaagaactggattttttaaaaagctattgagcatccatttttttcatttccctttttatttttttaatgttggggattttcaggggtccattgttcctatcagcacttttttttccccttcctcttttcatcattctgcagcatgggtgggctgctgaaggaaatgttccacaagattgcttatatgctttttcctgacctaactacccccttttgtgtgtccacagcatcaccaaataatccagcagtacatggtgaccctggagaaccttctcttcactgctgaattagaccctcatatcttggccgtgttccagcagttctgtgccctgcaggcctaagggtcattttttcctcatgtcaaggttttttttgatatcttaaaataatttgtcttattttttgatggtttgaatgcttgctttcttgtagtatcctttcacttcttaaaggaaacaaaggggaagaggacagtgaatgaacatggcattacttttaattgccctgaaaagcaaatacttcctaacggcagtaatgtgactatgaccatgatatattatatatgtgacagatacaaattctctgtgatcagtttgttattttttttctccttaaggcacaaaataattggtttgaggtatgtgaaacactagaggtcaaccttacatagtatatagaactgatgggtttacccagctacccagtagcataacttttcacagctcggggatgaattaacatggctgaaataaaactaaaagtatggtttttaaactttggcatttcatgatttatcatctcactctactctaaaactggtggtttcttactgaaggtgttctccatttgaaattttatcttcaaagtatttttaagtagtatctttaagacatgacttgttagtaataaaagtgttactagttggaagagtagctctcaaatttgtcttaatgtaaatcacctgggaatctttcaagttattttgaaatttaaaccaccgtctgggggtggaacgcagacatcctcagtaatccttaaagtttccccaggtgattccaggtttggtcaccattatcttagagcatctactcacttcctctagccttggggttatttgtccaaggtcttgtagtgagttacagaatactaaagtggatgtagaagtggtcagattgactgaaactataccctgaattagatgtgagtttagattttgtttatatggaacctgatccaaaaaactacgaagtcctgagcttgtttcctgtatagtactgatgctgaaataagatgacagcagtttgtaaaataatacacaaatatgaggaattgtctgacattccaaatttcgaggatttttagacttttttcattaaaccttagaaaaaaattaccagtaatcctacaactactggtagtgttgttgtgcatttgcacaaaataggtataattttttcttattacatcccaagtttatgatgcattaagcgttttgcatattttgatatatttttgctttggtttaccatacattttagtggctacagaatgtagtctgcttaataaatgggaattcctagaatgtttaaataccatactatttaagacaaaatacaaaatatccagaaaaatccaggttgcgtggctggttagtaaaggactaaaacccaggttcttggctaaatgttttcgtttatactgtttatctttcccattgcttaagcacagcacaaactatgtaattatatataattacagttgacccttgaacaacatgggtttgaactgtgtgagtctccttacacacaggttttcttccacccctgagatggcaagaccagccccttgtcttcctcagcctgctcaacgtgaagatgatgaggatgaagacctttatgatgatccacttctacttattaaatagtaaatatatttttttcttatgattttattttcttttctctagcttcataagaatatagcatatgggctgggcgcagtggctcacgcctgtaatcccagcactttgggaggctgaggcgggcggatcacaaggtcaggagattgagaccatcctggctaacacagtgaaaccctgtctctactaaaaacacaaaaacttagccaggcgtggtggtacatggctgtagtcccagctacttgggaggctgagacaggagaatcgcttgaacctgggaggtggaggtttcagtgagccaagattgtgccactgcactccagcctgggtgatggagcgaggctctgtctcaaaaaagaaaaaaaatatatagcatataacatacaaaatgagtttatcaactgtttgttattggtaagtcagcagtgggctattggtggttaagttttgggggagtcaaaagttacatgcaaattttttactgtgcggggtgtcagcatccctaaccccatgttgttcaagggtcaactgtagtttaaaatgactcctgtctcaaaaaaccaaaggataacctttaagggattggtaactttgactcaaaactgctttgtaatcttttcacaatgtactgaaaagtgtggctagttatgtttgatccacattctagagaaatttgtaggttttaatttcttttctcttggtcctctcttcatgtataatggttgcttttaacagctgttcgctgatgtggtcctgctctgtcccagtctagcagctttagtgtatggaaaaattgaactaggaattgagttttgaagaaataaaggtgtaagagcaaacattcaacagttgctgtccccagtaatgaagttcatacagacaaaagatggcatgtcactgtacatcataccttgcaataaatattctgttaaattgtgctggtgcaatttaacatgcttttgtcaaagtaaacatactgttttcctaatttataactgtacttgaaaatgaaagatgaggaagggaccttgccaacctatgtagagcaggtttagctgttagtgatttctggataccaggattgtcttaaactggtaagggtgtagagggtgaatagaagcatcccttaactagacaaatctattttctgtaacatagtggccttggtaatacatgctcattaactagtggttattatgtgccaggtgctataggttcaccctattaactacttcaaacagtcctttgagatgattatgccctctttacagataaaaacaggttttggagtaatttacccacggtccacagctagtaagtggaatttgaacctagatccagttggcccaagagctccttccccgcccccataatgctcttacaacaacctgaacccctagttattctgttgtcatcatctgttgtcatcaagctgaaagcttttttccccagagacatcttgctgcccattcagaatcaatttttactaagctgtaatatttagcatagcacgtattagtcattgagtgtgaaggtgtttaaaaaaaaatcaaacttgaaaaatacacaaacatttctgtgtagtctgaattatttggacatgacttgttttgacttagcctttctccaagcataatctccattaaagaaaaaaaaatggaaatgtttaaacttcctattctatttgtacagtaggataaaatgtcatgtcaaacaatttgaaaatatcaggttattttaactaactggaatttgtttttgtcaaaaaataatgcatagacccaataattcttttgacaagctacaggaaaatttcactaaagttgatgcagatgcctgcggtgatgtgagacttcaccttcctttccttagaagtctgaaagcagcatggaagcaagcctgggactaaatgaacatactcctaaggcacttaggtgcatgcctggcacctggttggtaaatgctcagtaaatgttagcactacttaaaataaacatcagtgccttctttgatcaacaatcagatagtcaaccatgaaaacagctcttttccattttaatccagcatttaaaaagctatctagactaatgttaagtcccacaatagaggccccaagagtacagaaaacatgatcagactcgtacaactcaatgtttatttctgctattagggctttttccagcagtagttccccactgtttccaccatcgtggagacagaaatcgtcctaaaaaacacatgactagaacctggggtacagtggtgcaccaccattgctattatttgtttcttggttaagaatccagttcagcctttgttgaacccttttccctctaccccaatctagggtttgccttggtatcttgtcctcaaatttgtagctgacctaccacttctgcacctactctagcactcagctcccatctctgttgtaagaaggcaatcacagacatgacattgtgcacacaaccaggccaggtgaccttcactgaaacttgcttttaagccataacatacataattattactgaagtattacttatacaagggtttcattcatctatgaagatgttgcttttttttttgaattttgaaaaggaccaatctaaatttcctttatttaaatataaaattctataaaacaggtcactgaactaaaaaatcacattttttcatatgtcagttcatggccacacatagtacaagtcttacggtacatgtcatcttctaggttttcttctggtccatactcatgttgatgaacaatcgtctcccttttccacacgctgcttcttactgctcgccgcaattctgaaaaaaaaattttaaagtcatcttttcagtggtgctattcaggtgaatccaaaaatccaactccatcaagctttcagccatgtacatgtgtgtgtgtctatgtgtatttaaaccatatatagtttaccttaattttataacaaagttgattatacaaacttggcaaacttactttcttacctcactagttcggcctgtgaatcaagttgtcactggagcagtgtgaaacaagagattcagaaatggttatgtgggttggtggtatgcaaaacagaaccatattcagaagtgagttgagtaacacaataggacacattcaggtacgtttgacttcagataacagaatgccacagtaggaaaaggagtcagctgaaataattaagaaaaaggagtgtttttaagttcctgttaggagctacgtcaataagcatcaagtcaagctttgcaagaaaactagaaagtagagaactctaccactatgctggtatgttttcatcttagaaaaagtgcttgtgcaataagacctcaagtctgttgaagttcttataagatgacagcattattttaggagagggctaaaaataagaatcacagaatgttaagagctggaaagaaccacagagttttgattttacttcactttattttgcaagtagggaaactgagcaaagatagtttaactgtgaagccaggacactggtcatattctaatgtttggagctttttctgctacttcgtgtcaaaatcattttacaaagaaaattatattgggttctttgaaagcaaccaagtaaatcatattttaataaaaagcaacactttacacttctattctcaccagtgatccacccagttcttcattatctttgacagtggcattacctaagggagattatgatagctgtcttgtataatctcagctataaaaataacatacatcaagtaatcacatattttccctgatccattttagatctataagtagtatcaaaatactacttgaaccttattttcagcttttatgaggatgaaaacacagggctatgtataaggcagtgttcttaccactttaaatgcatttaatcctcacaaccctttaagataagtagaattactccaattttacagatgagaaaaccaaggcacagagaagttataagttgctcaaggttatatagttgatggatacctctagcatgaaaagtactttgacattattttagtgcatatacctctagatagtttttggtctggaagaaaaaaatgttcatccaaactcttcatttctttcagcatcctctcatattctgaagaccttggtttttctagatatagatctggaatgccctccttcctttaaattttacttaggatattttctaaataaaaaatgatatgctaaccagaactccacagatgccctctggtttcagataatgtaaggaagatgttgcctacttgaattctaatacctgcttttcaacttggttctcaccttatcccactgaaaatcctacaaaattttactgcagcgcaatcatgctaaactaacttctctgcctaatttgaatattatgtgtacttaaaaagaggtaccaaagaaaaattttctgaatactaaaaaaaaatacttgtagtaaaagtctgtctgtctagccataattgaacctaaggttttacattgactttgactttttctccccactcttcagccagtatgtcaggctatataatggtgagaataaagccatatctttaatacttactagacattcctagaaaaacttgtgccagaaagtaagaaagtattcggggccaggtgcaatggctcatgcctgtaatcccagcactttgggaggattacctgagcctgggagttcaagaccagcctgggcaacacagtgaaaccccaatctcttaaaataaataaataaaaaattaaaaaaatttttttaattagctagccacggtgacatgagcctgtagtcccagctacttgggaggctgaagtgggaggattgcttaagccgaggagtttgagcctgcagtgagccatgattgcaccactgcactccagcctaggtgacagagcaagactgtctcaaagaaaaaaacaacagaacataagaaagtatttaaaaatggataggtttgggtttttcttttttttttacccttctttccctttctgaacaatccagtcctatggagcaagcaagcatccataggagggtgagagagcccaagaaaaagggctccctccagaagaggaggcagcaacagtaatgggaattagtcacacatagggctttgatcaagtcactatattaaggatcatgggagccaccaggtttctcatcatccaaaaagccagtataagtaaaactaaaatgaaccatgaaattttaaaactggatgtatcagtgtaaactcaaggtttacatatatttatagacagagacatagaaatacagatacatgtgttgtgctagaaagcagaaaggagtgctcaagaaatgatgacataaggctgggcatggtggctcacgcctataattctagcactttgggaggccgaggcaggtggatcacctgaggtcaggagttcgagaccagcttggccaatatggtgaaaccccatctctactgaaaacacaaaaattagctggacatggtggcatatgcctgtaatctcagctacttgggaggctgagacaggagaatcgcatgaacccgggaggtgaaggttgcagtgagctgaggttgcgccactgcactccaacctgggtgacagagcaatactaggtctcaaaagtaaataagtaaataaaaaaagtaaggaaatgacatgtcaaaagatacaaaagctagtcactaggccaaatcagaccatttgagcaacaaagtaaggacagaaatgaaccaaagccactggagaaaaacagaaattaatgaattcataccaatgataagtaaatggggcaaaggatgctgcagaatgctgactgccaattgcttaaatgcagaaggaatgctggaattagaagacagttcttataaccatcatactaaagactggttctagcaagcaccatcaatggatggacactaaatctagggggatacaatttctttttgcttatcaaatcaaaatcagaattaccactgagggctgatagacatcagtgcctccagatatgaggcccggagaaaagcacatcacttactgtccctagcctgaaatgcataccctgcatccaaccagcaggacacaccagaaactgccccaagtgagaagcatgttttgaagggcagggcaggggaagcagacttttcttcaaaaatgtcaatgtcataaaaaatacgagctgtgtaaatatcccagaaaagtttagaaagacttggtacctaaagccaatacccaatcctagactggattctgttctagaaaggaattactaaaaagaacattagatcaactaacaaaactagaatatggagggcagattagacataaatactaaatcaatgttaaatttactcaagttaacaatatactttggttatgtaacaaaatatatccctattaggaaatatacactgtaatacttaagggtaaagggtggtgatgtatacaacttagtcttaaatggttcggaaaaaaataaatactgtgtatgtatagaaagagcatgcaaatgatgatgcaaatagcataaagtgttaacagtaggtaatctggaaaaaggatatatgagtggccctttgtattattatccttgcaattttttataagtttgaaatatttccaaacaaaatagtttaaaaagacaggagctaccttgaaggggattctactgggcaaattttggacaatttcaacaccaaaatgaatcatgactggaatggactataatacattgacttcagaataagaaacaatcagtccagctgatgcttaaaaaaaaatcagtttctaagagaagaaaagctcttctttccaaaagccaaataacaattacagaaagtgaaagaaatagaaaatcaccatttatatccaatataataactaaagtaagactcagccctgtgtactaaaaccactgagtgaaaggtaaggaatgagatattcacatagtattagatttctcactaattacaaaggataaagggtacctttacaatggaaaaacctggcagacaccaccttaactaagcagtcaaactaccactcccttaaaagacagagctggtaccatgtgtctactgataaatgctcaaacacatcaccttgaaagtattcctaccaaaaacattcgacctgagtctaactgaggaaacaagcagctaacaaatctgaatggagggacacactgaacagcagctggcctgggcactgcaaaatgtcaatgtcgtgaaagacaaaaaaggctgagggactagtttaaaagcagctatcaatatgcatcatccttgaataacacctggatccgacaaaaagctgtaaaggacaccaaaacaactggagaatattaaattatacacaaggtagcagcattatattaatgctaagtttcttgagtatgatcgttgttctttagctatgtagaagaacaccattgttttttgttttttgagacagggtttcactcttgttgcccaggctggagtgcaatggggggatctcagctcactgcaacctccacttcccaggttcaagcaattctcttgcctcagcctcctgagtagctgggactacaggcacacaccatcatgcccagctaatttttgtatttgtagtagagacaagatttcaccatgttggccaggctggtctcaaactcctggcctcaggtgatctacccgcctcggcctcctgaagtgttgggattacagaagtgttgggattacaggcataagccactgctcccagtcgaatgccattgttctgaggagaaacatgctgaagtgtttataagaatcacaatgtctgcaacttaaatggcttggcaaaatatgtgtgtgtgaaagaaaaagtaaatatggcaaatgtcaacatcaggtaaataaaaaaaatttaagataaatacttttttcacattacttcatttaacaacttaaaacttaggaaagcagaaatcaactacctactgctgagaatgagaaggaggtagttttaaaaacaaggtaaggctttagaagagtgaaaaaaggtctgtaggtctgaaatcgactttcggggagctgaggaaacctggggtgggtgcaggtcctacgcagtactgaaggcctaattgaagctggagacaaaacagtggtttaccacgttccaacctcctagttccattggcctagaatttcacaatgctggaagctattaactaaggactgcctttcatggaaatttataacaattttcagtgtaagcagtcttgttactgatatattcagggactgcttatactttttacagacgaaaaaattctcctaaatccttttttaaatgaaaatgttattttataccaatctaaaacttgtattcagtttaacatcttggttttgcaaaagaggtggtctgtattcatggaaacccaatgctgcttctgaggtaaatttaaaagacaactagctgcgagagacaagatacttctaaatactttatggtaggacagtaagtattgactcatggtgccccttgttaacaggaggaaaaaaaattacaaggaaaagacacaatgacaatatgatgctttggtcttctttagtcctccataaactaaagcagagtaacagagaactgagtctcccgaactctcttgagagatgactccagagtcataaatataaccacaggcccacaatgtacaatgtccacaaacttgggacccccataagagatttcttacctacctcttttgggaggaaagtacatagtaataaataatgaaaatgaatttattttcctttttttagaagggtaacctctaccagtatggaataagagaaagctggtataactaaagaaatgccttatctctaccttatttatagagtagacatgcaaacccaaaacgttctgtacatttgaaccagctgaacgttcccatctaatattaaggcctgtgcatcctgaagttttgaaatcaaaacatttctatattctgtaactgatttctgtaatgtgtaacagtcctctctttcagactccttaagatgcctgttcactactttatccttcaaggctctccttgctactgaagagaggaaggactggtgtagggcactgaaaagattaaaaggccaaattcaaaagaactctccaaatactctctatcggtcctttgaatattttgatacagagttttgataccagttaaaaaaactgaacagcagtttctgccttgtatctaacaaggcagaacaatttgaattcactaacaagaaaacactttcttgtctttcaccttatttttatctatctatctatctatctatctatacacaccttatactatttaaactgtaaaattctttttggtagtaagatcaattctcaaactgctaaagtagaagatcatattctcaaagcaggtaaatataatctcttaccttcccataaagaagtaaactgtgtcagcttctttgtggatcaaaatcagaagaccaagaggaaccaggttccaatttcttttcaactaaaatacttttagacttgcttttattcctctctgttctgagccttctgagaaaactgcacagtaagctccttgtgtctaatctctacagtgtctactccagtctcagccctttgtggcctattcaggaaggcgggaacaacctctaaagtaaatcaacaagaagccataattaaagaaggcatcacactgacctctctgcacattaaacaccagaagacagtggagtaatgttacagaacttaggtattcatatgcacaaaagcagtaaaacatttctatttacagagacacttggaaaatatatcactcatgtaaccactttggaaaatgtcctcaaaagacatccttcattcaaataacaagcgaactgaaaaagaaaccagacccaagaggtctaactctatgaaaaacttcagggcaaattcaaactcttcgaaaatgaggacaattgacagtagcttatctggtgattaacagcagcaatttaatgtaatgagaaaaaaagctaattatattaaagtttatatttctttaaaaagtaataccagtgaaaactaaatcttttaagagttctgttcatactactaatatatatgccacatagaattcttattaaaaaaagcatgtgatgaaatggatgccatcatctttcaatctgtttgtcaaattacaggaatttagttaccattagatgacactgaccaaattacagaattagtatctaagaaagtacagacagccctcgttttaaaaaatatttcatcactttgcagatacaggtttttaattaatacttattattttatccatgtattattatctgcaccaaaataccacctggaaatggtttaaggaggcagcaaagaggtaagagttgaggtgatttcaggtagctggagttaacaaaaaaccctaggctagtatataactaatctatcactctgtcctccctttcgcacctcttaaaatgccttttcactactttatctttcagggttctccttgctactacagaggaaggactggtgtaaagcactgaaaagattaaagggccaaattcatcagaactctttccaaatcctctcaatacagcagtggctaattttgggaaggttctttaatgaaatgctcttatatggcacagcttattacaggaaacctctctacaaagccatgaatgtgtgccttaccttgtgattcaggaattgctaagtaactatataaaaagatgtgtataaggatgttgatcatggagttgcttaacttcgtgtcaaacagtgcttccatttttattttaaaaaaaaatttaaggatcttaggatagaaaagaacaggaagagcaaaaattaaaatgttgctgatgattgtctctgagtaggaaaatcatgcaataagagctctttgtaattctcttttctgcactgtaactgaattacacttgtaatgacaaaggaaaaacaaatcctcacaatgagaaggattacaacaacttgtgttcctcacaacaaggaaggcttacattcaatttttggttttgcttttttgtttttaagacatctgaccttattcactctccaaaaccacttatgaatcctaaaaacatgagcaaaattatatggataggacgttcactttcaatgaattaatttagtatatatataaaaccgaatatatacataaagtatgtgttatctctacacactgtacactacaatgggactctgcataattactgcatgaagaacatgtatgtttccttttttaagactcttttagggattctgtgatagagcacaaagtgacctctgtgctcctgcagcaccgcacgttcatcactatcatggtacctagcacacttgcacgattttaagtttctctcctgacaaactctgactccagaatttatgttagcacagtgcctggcacatagctgacacttagtaaatactggatgtattgatggatggatggatggatgaacatacagacagacttaacagacatacatacctggatggataacagggacaaattaatgcagcgatagatggacaagggaatgcatgcaaagacagatgcatggatagagaaatgactacttcatggagactttcagtcaaaaaaccctgcttccagtcccaactctgccaataactatctacataacaagtcactccacctttctgggtcttttggtcatatataaaataaaagttccttctagctgctgaattagatgactaagacttagggcatggcttttcattttaagcaattagaggggattgttggtaggtgtgttttttataacacacctgttgatcatacttaagatttaattgatgccaaatccttgaccagtgataccactcctgatcctcacattgttcctatataaaaacatgattcactttaagatgatgacgtacatgcttttcagaaatgtcgtactgtgaggtttgagcttagtgccttgaagaccaacatactgagggcaaactgtaagtcatttttttcaacctctaaaaaacacattccaatctattggtgacattaaacaggaagaatctagctaaaggctttttgcaaaatggtaaaacacaatccttcacgatataaaatgtggccatctaccttttacttttttatcaaatttcttctgtttcattttttctcggttttcctgtcggacttcctttgcttcttctaatgcttcttgactaccccaaacttcaagagacctcttcacaatctacaacacaaaatccatatttaaataagttgtgattcagacttgcgaaatattatagttataactgtcaaatccaaaggtaccaaagaatgatctaactcaagtataaatttataaatacttattagaaatttaaagattttaaatattaatgatcagaaacaactctaataaaacatctatctaaacctatgaaactgtcagtaaacgtatgctgaattagattataaatagaaaagttgtcctctgactgtattgtcacaggaatcaaaagtacacgtggtcagtgagtttgatcaactgtggtgggctcaccaaagaaacagtttgttgacagattagccacatcagacctaaatatgaggtcatctccaaaaatctccaaccgcaggaaattaccaattactactactcatctccttcaagatcaataattgtctctatcgacttgacttctgatctgcaggatatatttttttttaattttggtaccaagatgatgtaaaaagtcttcattctacttttaaaactttacattatatacctttactctttatagtatttacttagattttaagagaatttacacactaagaattatgctcaggatacctctcacaatatgttaaaaggaccataatattaatcagcatagccaaactcaaatttaacataatcaagtgatacactcatatttcgtatattctgagacatcacgttttccgcaatttaacatccctgaaaatgctgcatcaccaatgcacttaatggtactttaacaactgtgagtcaaaaagtggtgcagaagaattggactctgaatgtaaagtttaggaataccttcataagtcttttgcacttgcattttcccttttatgtgtgcaaaagtcgtgatatatgacaaactataataaagtctaatggcactatttcaccaagtataaaaagcatcaagtgataagaaagcatatgttgattttaatcagcggcatttaaaaatatttaatggtacataaaacaatagtgaatgttctaatcaacagaatcttagtatttaatgaaattcagtacacgttttgttttacaatatggcttcttaattttatttggagatatgggattttctagtatagtatatattcaaactgtgctctaaagcaatgcctcccaatattttaagctaacagcacaaaaagaatattacaatatttgtaccactctgaggtagatacaagaggctgcttgtgactcaaagaaactggcctgggcactagcagtcctagccactaagtggatcaccgtcttggcacacctataacccatctgcagcaagtggagttgagacgatctgctctgagattatagagctatatggacactcgctagcattccagatgggtagagttagattttaggtatttatgaaattcttgaaatttttctttttttaaaatatttcttttttggtgggagatggaggtgaaagagggtaaggaaacagggcctgactcccattccaaccttttttagtttccaaattgtactcttaacatcacccaatagcaacaggtttctttcaaagtgccatattagaagcaaaatgaggccaggcgtggcggctcatgcctgtaatcccagcactttgcgaggccaaagcaggaggatcacttgagccctggagttcgagaccagcctgggcaatatggtaaaaccccatctctacaaaaaatacaaaaaactagccaggtgctactcagaaggctgaggtggaaggattacctgagcccgggaggtcaaggctgcagtgagccatgatctcaccactgcactccagcctgagtgacagagtgagaccttattgtttgaaaaaagaaaagaaaaaagcaaaatgagaaaacatgttattaaatgtcattatacatgactgtgaagcatatgcaaaactagggaaaagagtttttccacactctgtaagcaaaagccaaaccaattatgactagtttgttattaagaatttaccagagtgaaaaataataaatacaacttattagagacctgtaactttaagtagagtttcatatcaccccattgtgaatgatgtggattcttcttcacaataaatttaagaggtggctctcttttttctaaatcacagtctttcagaagatattcttgttttgcctctgttttggttataagcttgtgtttatcatcagcatctctgaaaacagattaagtccattatataaattagttattttaaataagctaagtttgcaaatagcccagcaacttaggggcacacacagcaaaaaggacatataaaatactttttcctgcaactctcatggttaaattagcaacataagaattctaacagaaaaatactttatcttttacttattctggtaagttacattatctagagaaaaaaacattcctagcaaagggaacagcaagggaaaaggctctagggcaggggtgtattttgcaaagagagcttacagcaagaggaccagtgtaactagaagacctgaagtaagcgatggtgaggagtggtgggagatacagtcagagacagtcaggaccttgcaagcaatggtgaagacaatggttagaaaccactagaaggttttgagcaaaatactatatgaaaaggagaccctaggggtgcgaaaggggtaatgggggagagaccagttagaacactactgcggtggtccaggcaagagctgatggtggcctagactaaggcagcagtgggagaggatgagatgccgatgaattcaggatatggtgaacctagagccaaacaggtttggaattaatacacacaggagagtggagacatagccagcgaatgaagctggctttactgaaatggtaaacactaaagagcaggtacagatcagggaggggagaaatcaaaggttctatcagaggattctatcacaaaaacataaaagttaaaactgggaagagctatacaaaagctaaataattcagaagtataaactaacaggagacatgtagactatatggtactaaaactatcatctttgatgatgttgaaaaagaatggaggactgtgttcctgattatgattaaatataaaagtgtaatgtttccagacttttcaaggtgttggcaggaccacgttcctttctggaggcactaggtaagaatccatctccttgccttttctagcttctagaggccacctgcattcctgaacacgaccccctccttccactttgacaggcagtgatgatggcttctcacattgcatcactcacttcttcactaatcgcatgtccctctgactctcagctttcctcttccacttctaagaaagctcatgtgcttgtattcggtctacctggataacccaggataatctccccatctcgaggtctttaaccttaatcatatctgcaaagtccttttgctatggcaaggtaatatattcacaactttctttaaactggtacaagagttgcttccattttctcttggaaataaaattctatgtagtgtttcagttcccaaaagctatactggcctttaagaatgacgacaatactgtggactttaaccactgtgtcggtgggaaatgagtttgtaatctatagttccagctgtggtgccagagcattcccagccatgtatctgatcatgagaccagggaccacatctccctctctatctaccaaggattctgctcagcaacaagccaatcatgatggctcccaatgtctgcagcagggactctgaaagggcaggtccttcaggcaggtgaggagttgatttaggactgtagggacaaagtaagcacagggaacaggtaagagggccaactaagattccaagataagaccttcaatgtgcaaaagatatcaacacagcatttggctgagtaaacagtagtgataggagaaccacgtgaagtgagaaaggttattctgggtgatataaaaaaaaaggataaagtctagaagaagaaaaagaatggaagaatatagttcttcctcatctattctctctatgagggtagcaaaagatgaatgaaaaaggtattcggagctactgtcctttcactgaaggccccactcctctgaccaagatgtaacacaccctggaataattaagaaatagagggatcattagggctgggtgaagagaagggttagcagcctactactgagagacgttaaaaaacaaaaacaaaaaaaaactcaggccagcagaaaaagaaaaggaaatttctatggcagaaccatcggcatccttcctattttatggggtatatcataagctttaataagcacagatttacagtatttggcaaaatagaaaccatagaaattttaggaaacacccaaaatgaaattcataattactaagaaaatatcaaatccaaacagatataacttgttttgccctaaacctacacataaacattagcaattaagaacaccatctaaaataagtacctgcagttatcacaagttggcaaatcaaagtggttcataagataagaatccataaattctttcccacattcttcgcatattacataatcaaattccataacaggtcctaagaaaaggaaaatgaactctagtttccttttttatgactagaacaatatattttcctctattttattagcttatcagcatgtatgcaatgcctgacataaatacatttaagtaaaagacaaaataagaccttatgtttatctaaaaaaaaaaattaaagaggaaaaaagaaaaggaagtaacataaagaaaaaaacgtagcaattccacaaatatttctgaatcccagccatgtacaaggtacttgtattagtgctacattagttataagaaactaccacagacagagtgacttaaaacaacacacatttattatcacacggatctctagtttattctgacatgggtctcagcaggctaaaatcaaggtgttggcagggctgtgttcctttctggaggctctaggcaagaatccatctccttgccttttccagcttctataggctgcctgcattccttgactcatgaccccttcctccatcttcatagccagcaatggtggcttctcacacggcatcacccacttcttccataatcacatgtccctctgactcttggctttcctcttctactttttttgtttttttgaaatggagtcttgctctgccacccaggctggagtgcagtggcacgatctcagctcagtgtaacctccacctctcgggttcaagcgattctcctgccttagcctcccaagtagctgggattacaggtgcaagccaccatgcccggataatttttgtttttgttttgttttgttttttgagatggaatctcgctctgttgctcaggttttagtgcagtggtgcaatctcagctcactgcaaccttcacctcctgggttcaagcgattctcctgcctcagcctcccaagtagctgggattacaggcacgcaccaccatgcccagttaattcttgtatttttagtagagatggggttttaccatgttggccaggctggtctcgatctcctaacctcgtgatccacccacctcagcctcccaaagtgctgggattacaggcatgagccactgtacccagccctaatttttgtatttttagtagagacagagttttgccatgttggccaggttggtcttgaactcctgaccgcaggtgatccacctgccttggcctcccagagtgctgggattacaggcgtgagccaccgtgcccggcccctcttccacttttaaggaaacctgtgtgcttacattgggtctacctgaataacccaggatattctccctatgtcaaggtctttaaccttaatcatatctgcaaagtcctttttgctatgataaggataatatattcacaggttccagggtgattaaggcatggacatctttgggggccattattctgcccaccacagcactgctgaaagtacaaaagagattagtcccagagtggtagggcaaaaagggatctgcttacagacagggcaccaacattgcacaagaaaaagcaataaacagcatggtaatagaagagagacaacaacagaattcacttccaaatggaaaaaaattttgtctccctccattctatcccctaccaacaaagcaaatagcttcttcaactgtctcaccttgtggattataaactctttaaggggagaggctgtattcagccatgtatcctcaactcccagcacagaaaaaccactctaggtaaggtaaagctagattatttaaggacttcaaatgcctagctaaggaacttaatcctgtaagaactgtttctcccagcaagtctttaaattttactagtaaggctggcacagtggctcacacctataatcccagcactttgggaggccaaggtgggtggatcacttgagtccaggagttcgacaccagcctggtcaacatggcaaagccctgtctctacaaaaaaaatccaaaaattagccaggtgtcaattagctgggtgacgggcacctgtaattccagctactctggaggctgggcaggagaatcgcttgtgcccatgaggtggaggttgcagcaagccaagattgccccactgcattccagcctgggcaacaagagtgaaactccgtctcaaaaacaaaaacaaaaaaaattagccaggcatggtagtgtgtgcctgtagtcccagctacttgggaggctgaggtaagagaatcgcttgaacccaggaggtggaggttgcagtaagccaagatcatgccactgcactccaggctggcgacagagcaaggctctttctaaataaatatatatatatatatatatatatatatatgtaaataaataaattttactaagaagtctttaggctgaatgctccaactctcagaactgccacaatttccaacaagaagaaaaaaggagttgtcggccaggtgcagtggctcacgcctgtaatcccagcactttgggaggccgaggagggtggatcacctgagattgggtgctcaagaccagctgaccaacatggagaaaccccgtctctactaaaagtacaaaattagctgggcctggtggtgcatgcctataatcccagctactcgggaggctgaggcaggagaatcgcttgaacccaggaggcagaggttgcggtgagctgagatcgcaccattacactccagcctgggcaacgagagtgaaactctgtctcaaagaaaaaaaaaagaaaaggggaattgtcattatgtcattaattgtttgtttcaaaatattcctatcactgccttcccttacctccttcattataacacactaatctccaaactttaagaaaacaaacaaacaaaaaaatcatgctttttttgtagaatattagagaagcatatctatagacaaaaggaaaactaaaaactttggaacaaggctagtgatagtcaaagtggtatctttgaaaaatttaccaggatgcattagaatgaagagaaagtgtggtagaaataccaattaggaagctattacatagcattattaatcaaaacatttaaaatgtgcagttttctaatttaaaatattctttataatgggaattcctaaataaacacaatgataattttcaaactgtcactcccttttacatttaccactcagaaactggcagtctaccataagcaagagttgtgtaattatttcattatatattacaatgtaataataatggaaataaagtacacaataaaatgtaatatgcttgaatcatcctgaaaccatccccagccaccccccaaccccaccctgggttttgtcttccacaaaaccagtccctgatgcaaataaaaacaaatattttaatccttcaagtctcagcttctgcaaacaacaatatagacacacatagatcaaagcagagcaaccacctacattgatgaatgcacaacacttctgtagctgcaactaaagactggaataggtcttttttttttttttttaataaaaagctgttatattgcactgttggctgccaaacttatgaacaaataaagtgtttctatctttttcccaaagagtgtgaaagtaccctcactgtgaagatatgtgtacatataagtgatttaccaaagcactaaccttagatcatagttacatccttctttttatgctggtctatcttatactttgtaagctgctttctttctccacagataaataaaagaatgtcctaaatgttatctcttggattctggtgcctcatttcagcctatcaagataattttgagtatttattctaccaatcaatatactggctaaccctgcctattataaaacaacagagagcagcaacccctaagtacatcagccacaagttaaataatcatttccatatgcatggctgtttctttgattgtttttttaatctactagcaaaactgccaaactttatcacttttataaagataatgtactcactgattaaagtagttatggcattatttagcatcactttgcatagaattatgcatgttactcaaaataaccaatctagatacttatttttgaaaaactcactttacctggttgatgaacaacttttccaattttctgttcttcttcttcttcctcttctaaaatgaagcctcctcctgtgtcaattatctttggggctgcttttacattagccatgcctacaaaagtaagtaaaagcagtcaacaattgaagtaggtaagcctgtatgttaccttgttcataaatagaaaattcctttgaattcaatatatctcaaacaacacaaggatgtccacaatcactacttctattcaacattatactgaaggtcccagctagtctaacagagcaagaaaaccaaaaaggcataaaggatgaaaagaaagaagtaaaacagcatctattcacagatgatgtaattatgtgtgtaaaatatccacaagaatctacaattagaattaagaaataacaacctaggaagagatgtgtacaacctctgccctgaaaactacaaaacactaagagaaatcaaaaaggacttaaatggagaaatatactgtgtatggattttaagcctcaatattataaaaacgtcaattcttcacaaatttatctaaagatgcaaggtgatctcagctagaactccagcagtggggtgcgttgtgtgtgtgtgcgtgcgcacgtgtgcacccggaaatttccatttcatattttgggccatggttgattgtgggtaactaaagccacagaaagtgaaaccttggaaaagggaggtctaacgtatgcatatctgacaaaggactcacattcagaatacataataaaatcctctaagtcagtaaaagacaacccaacttttaaaaacaggcaaaagatttgaacaggcacttcacaaatgaggatatccaaacggccaaaaagcacatgaaaaggttctcattatctctaatcattaggaaaatacaaattaaaaccataatgaagtatcattagactctcaccagaatgtctaaaatgaaaaagactgacaataccaagtgtgaggatgtggaacaaccagaactgccattttgctggtgagattggaaactgatataatcaccgtttggcaatatctactaaagcttaacataactacacctctcctatgacccagcaattccatctccaggcatatacacaagagaagtgagtgtgtatgtccactaaaatacataaaaaagaatgtgtacagaggtttcattcgtaacagccccaaagtggaaacaacccaaatagccaccaaaaggaaaatggaaaaaattgtggcataatacaaaagaatctatacaacatctaaatgcacaaactaccaatgcacgcaacaaaatgtgtgaatctctcagatactatgttgcgcaaaaaaagccagatactgtatgactcaatgtacatgaagtttggaaataggtaataccaatcaaatggtcagaagagtattacttctgagagtagagagtggacaccgactaggaaggcgcaataggaaaacttctaaggttccggaagtgtacatgtcttgatcacgatggtgtttacacaagcattcacataggtaaaattcagatgagtacattttacagtatgttacacctccatttattaagacagattaatatgttttattctgctacagtcactccccttctctggcctcaatttctccctctattaaatgaaaggattagattataaacttgtttccactgttaacagcaattctcacactataatgcctgttcatctctctgtatcccttcattagactgagtgcctttacttgtatacttctgacaaatagtaaacattccatgagtaccaactggatggatagaaatgaatgaacctaccagaatatgtaatataaatagcaaagtaaatgaatggaatgacagtaaacacaatgagaattaagaagagggaaagctggagtagtcgagcccatgacttgagcaggatcctaaacaatgctaactcatgcccaaaacaaagtccgatttctctctgctgctatgccttgctgtttccccaggaccttagcaccactcttcgtattctaagcaagttttttcagtctttcatggcatatgtcatggcacacagagaaaaagaaaattgtatagtaccatgaaataaaagtgtcacaaagataaaaatctcagcacttacctaactcttgaaacatggtgggttgtacacaatgctacaatacagttcagttcttggggaactgcctaagaaatcttaaagaatgttcattctaccttgctttccatgatcaaaagtttaatttaatgtcagtttttgctattttgcaccttccgttccacagccatgtcgtagacctggaaacctttatggaatcatgactatgaattaatcagtgcaaatgaactttctgtctgactctagcgtgcctcaagtttagaaaggaataaaaggtaaccactataaagtagaaaggatgagaccagtaccatcaaaagtagctggaatttgcagtttcggtgttagtatgaacatcaagacatgctgccagcctcagactcttctcactctcactacatctggctgataaaaaagagtaatacagctctaaactgtgctcgacaaagggcagtatagagctttaggaacacatgtacttcatgttatagaggcagccctgaagaactgcctgtcaaccaaactatattttaagtatcctgttaaagattattagttgaccccagtggcaaattctataagagaataatctgcaatgagagatcagtccttaatttacttcaatcaataaacacgttttgagcaactagtttttgccaagaaatcgcagaggtcacatgtccaagaaatagactcatggaatctatggattagaatcttaaaggtttactatccagtcccttcttctgattgctgagtaggagattctgattgctgaatctcctctcctccacataagtaagcgttcttccagttcctatttgagcgcttctagtaacgggaagctcatgagaagcaatccattgcacttttggcaactctaattgttgaaagctctccctaacaaacaccaagatctgcctcttccatcaactagttctaggtatagaggccagaatcaagaactagtctaactcctctttccgggacagctgaggccctgacacctggcagtggctgacacctcccggccggggcggctgcatccctaaacgaaaaatcgaagctgccagcagccgaggtgcagcgaagaaggcccggggctgggggtcaggaggcccgcgtgcgacagaggaacgctctgtggtcgtggacaggacgctttgacaaggcggctggctgggcggattccctctccgactcggggagaatctgcacacatacgccagcggagttgacgcgacccccgggccccgggactcggcttgcacgagccagtctggggaccggggaggcggggagagggaaggggaaagcgcggacgcggcccaaacctccagtagccgcagccgccgtcgccgagtagggccgggcagccagccgggcctggcgcagcatcagtgcccgctgccgcttccgctcgatactcgcccgcaccgaggcaggcagctccgcgggttgctctaaagccgccgcctccggcaaagccccgtcggccgccgccatctctggcccactccgaggacctagctcccagctccacgcacgcgcactgcacgccgaggcgagccagccgccctgcaccgcctctgcgctccccgcacccagcggcctttctgagtg

SEQ ID NO: 70 - DNA, 33766 bp, Homo Sapiens
tacctttcttcttatattctactttatttggtaaaactcagaaactaacaattcacatcctcccaccttcttctttccgaagaaggcagtttgcagagacaaaagggctgtggcgtggggatcatccaccatctccaggttttacacccaggctacccatggcttggcagtcaggcctctaggcctgatgctctcagaggcaatagaagaaaagtaaaaggaaggtctcacttcacagacaatgaaaccctcctaaccctcttccccactacccacaactccctacactgccaatctaaataaaaagaggacaatgcatgagtgtgagatacacatacacacacacacatacacacacacacacgcacagcttcctttcagccaaagaactgcaaaatccttccccggaaggaggacaactggcaacaccaatcaaggcttggtggtctaaggtgatggctggaatcatgtgagactggtaaaaatccagggagaaaatgtttcaccttcagctcattcccaagtctctatgaagcccgccccacttccacataggggaactgtggctctgggggcagctggcttagggaaaggcctcccatggccaagaagacgatggtggagaggagggggagggcagcagggcaaagcctttggggagggtcagcaaaggggccccctgcccttggctaatggatccgagttagctcctccacaaccttgatgaggtcgtctgcagtggcctctcgcttcataccgctgccatcgtcatactgcaatgagaagatgggcggggctgtgaggaccaagagggtgctctcccacaggtggggaagggaatgcccccagtgaaggaggcacaagactccaccattgtcatggcagaggaaggactcaccagaaacccacgcctccccctgggtggcacaggtcagcaaggacaccacctggtctatttctccctcttcaagattctccctcttctgctatccccgagacaccatctccagtgagcaatatcccaaactccagaattgtggccatttctcctccctacgggatcctgaccctgcctcccacctttgggtcttgctaaagatcccagatatgtcttcactgctcaaggacggggttaacatgggtagagttactagcacagcatctggtacctagtgggtacccacgagccacaactacaaacatctcttttccctcagactccaccttccatctggtaaggattacacagaggtcccctcgcatcttggaactgaggaggagaggtgcccagagacagtctcctggcatgccccaacctgcagtggacttgtctggcccagggttaaacaccacacagctcacctgtaggtttgccaccacctcctgcatcttggggcggctaatatccaggaaactctcaatcaagtcaccgtcgatgaaacctgtggctggttctgtcttccgctcggtgtgaaaggatctccaggtggatgggtgagttaaggaacacgtgcttatcaggaaacaccctcctcagtcatccccacctttgaataagaccacaatctaaagcaatcatcaggattagaaaggaaatgacacttcctttcgccttgcttttatttggacatttttggaattgaaaaaaatgtaaaaatatgacctaatctaattggttctcaattggggtgatcttcaaaatagtttttaaaagtacagatcagagtctattaatgtgaagcccgtatatgtatggaagttctttaaaagtgctctaggcaaagctgatgcacaagaaccacctaagtctagcctcaaagctccatagaggggtcagtgtggtggtggctcatgcctgtgaacccaacactttgggaggttgaggcagggggatcgtttgagtcccgaagttcaagaccaaaccggggcaacatcatgaactcctgtctctacaaaaaacaaaatttttttttaattagccaggtgagctgacacgtgcttacagtcccagctattcgggaggctgagatgggagaatcacttgagcccaggatgtcaaggctgcagtgagccatgatcatgtcactgcactctagcctggacaacagagcaagaacccacctccaattaaaacaaaaaaagaagaagaagaagaataaaagcagcagctccgttgatgaataaactgagactcagtgagacaaggctgccaaaagtcttgttagcaaaaaaccaataaaccagcccatcagccctccttggctagagcagggccagagtcacagacaggagctcctcccacctccaggggggcggggagggccctttatatctcctgtactacacaaacttccaatagcacttggattctgggggtcccagggtggcagattctttcagtgttttccgcttcttcacctttccctttcttctggtagtttctctagtctcagacactgttgccctcaaccaaatccctgaaaggatgtgctcctgtgttgtgatctaaattcacatttggcctgctacaccgagagggccagaggcggacacatttcaggaatataaatgtacatttccaagatggaccagcggaagctaggtgataagtactttgggagtcaatatactgttctattgtgtatgtttgaaattttccacatgaaaaagtcaaaaacaaaacaaaacaaaaaacctgttctgtacaggaacctaatcaagacatgtagtagcttccgggtaatgtgactccgtgtgccacatatgccgggatgtgcttcccagcaaggggatggctctgggaaggatataaggagtgctcgatcttccccacacttttgatgactttattgagtcgattctgcatgtccagcaggaggttgtaccagctctctgacagtgaggtcaccagccctgaagaagtgaaggaggcagtgagctgcagagagctcaaccccacagcatgtatcctctacgtaaagggcagcccaggtgagcagctcagggagggctaatgtgctgcagcctcctctagtaaacacctaggtcttgtacagttgctctccccagtccctcagaatgctggtatcaggaaggaggcctgtgtgggggtgtgccccacaggggtgaccttacctatcatgccgttgaccgtgccgaagagcaccgagccttgtgtgggggtggaagtctcacccagattctgcattaccagagagccgtggcaaaagacattgacaaactcgcccaggtggaaaagaccaacctcctggaggtgctgccgctcctcgtcagtggtggcagcgctgaaaggcggtaagaaagtcactttctgaacctcctgtttccaccacaggccctgagacaggaccacgtgcagtggtcacggtgctcaatttccctggggagctgacatactccacagtaggggagccagtctaaagaggtggatttctgtcaccttttattctctgacgaggaaagttctatctctgtaaacaggagcacctgaacctgacacagaacccaatgcttgcatccaccagagaccaaggaactcccagccctccccaccactcccagagctggccactactcacctatccttttgacacacaaacaagttaaaggcattttcagcccccagaaaattgtcatcatccaagatttccacagcactcatccagttgggattaaagtctcgagcaatcttaaaacagacaaggtgaaagaagaaagcataatcagcagtttgcacggaatccagttctgggacttgtgtttcctttattcaggagcaaggccccaccctgcagaagatatagcatggtgttcaacaagtgtcaccctagagggattctccccgacctctctgccaacgcagcccatttggttgccaactgcccagagatggagcctagtcagagtttgagttgggagtctctaaaaatacttaatcagggccgggcacagtggctcacgcctgtaatcccagcactttgggaggccgtggcgggccgattatgaggtcaggagatcgagaccatcctggctaacaaggtgaaaccccgtctctactaaaaataccaaaaattagccaggcgtgttggcaggtgcctgtagtcccagctactcgtagtcccagttacttgggagactgaggcaggagaatggcgtgaacctgggaggcagagcttgcagtaagccgagatcgcaccaccgcacttcagcctggacagagccagactgcgtctcaaaaaaaaaaaaaaaaaaaaaaaacttaatcaatgtagaatgtctgctccggggaaaacatttctgcccctaatactgggctggcttatccttccccaccagagacacttgcaggggcggtggctcaagcaagaagtctgctcgcatccccccaccagcatcacctcttcaaagtttccttccatgggcttgtaggcaagcagcagcactgagcgcataaggtcgcccaccaggatgaagtcgcccttggtcttcaggtagagggccatgatgttgttgtagtggttgcactcagtgcgcagctccttctctgttgtccactcatagagccgcacctgggaagggcattgtctctctcagccaaaggggccagagctctctcagaatgactccccccaactcttcgacccttcatctgcagcactacttctcaaagtgcaatgcgggacaggaaacggttttatgaggcactggggtgaacatttattatttcactattacatatttatgaaatatgaaaacacaatgaacacaccaaaccaggaatacaaaacttcccaagttttcctttacataaaaaaatgagtccacgtaaaggaaacagtaatgtgggtagtcgggcttggtggcgcacacctgtaatcccagctactcaggaggttgtggcacaagaattgcatgaacccaggagacagaggttgcagtgagctgagctgagatcatgccactgcatcccagcctaggcgacacagcgagactctgtctcaaaaaaaagaaagaaagaaagaaagaaaagtccaacagaaacattgacaaataactaaaggaacctgaagaacttgattctacagccaccctctaccaccccgcaagagggaaaaagaaactgtgcagccggccgcagtggctcacgcctgtaatcccagcactttgggaggccgagacgggcagatcatgaggtcaggagaacgagaccatcctggctaacacggtgaaaccccgtctctactaaaaatacaaaaaaaaaattagccaagcgtggtggcgggcacctgtagtcccagctactcggcaggctgaggcaggagaatggtgcgaatctgggaggcggagcttgcagtgagccaagatggggccactgcactccagcctgggggacagagtgagactccgcctaaaaaaaaaaaaaaaggaaaaaaaaagaaactgcttttttctgtctccaccacagtgcttcttcaattacaaccacatctccaaaagaatgaaaatgctttatcatcagtagacaaatggagagctacttggcacggcccagtgctaaagaagacagactcaacccatctgaactgacaagcctcccctggcagatccttcaggatccagataatccccatggcctctgcacatctagaaactcctgggcagaacatattaatcaaaccacaatttctcaagatttgtccaaagaaccctagctacacaggaatatattccaagaatcatttgtaataattacaatggttggcggggcgcagtggcttacgcctgtaatcccagcattttgggaggccaaggcaggcggatcacgaggtcaggagatcgagaccatcctggccaacgtggtgaaaccccatctctactaaaaatataaaaatcagctgggcattgtgacgtgtgcctgtaatcccagctactcgggaggctgaggcaggagaatctcttcaaccagggagtcggaggttgcagtgagccaagactgcgccattgcactccagcgtggcgacagagtgagactccatctcataaataaacacatacatacatactatggttaccacacctctatcacagggtaaaaggtacctccagagtgccccgtcttcaggtaagcccaccttgctgggcctccacacctccaacagaaagagtgaagcggggggcctcagagctccacatgttcctgccaacacctgccaccactctctctccacactctcaacctccccatcgccttggagagagtcaagactaaagccagacaccaccagaaggccaagactcccattctcttcccaaaaggctgtagacttccactgtccaatatggtagtcactagccacacatggctatgaaacacttgaaatgtgcctagtccatgttgagatgtgttctgactataaaatacacaccagattttgaattattagtatgaaaaactgtaaaatatcttaataagcatttttatactgattacatgtggaaatgctaatattttagatattgggttaaataaaataccttattcatttcacctgcttctttttgcatttgttaatgtggctactagaaaattcagaatgacatacatcgctcatataatatttctattggctggcaacagaacagatatgtcctcacctgacctcaaatgccaccctccaccctcctgatccctgtgcccactcactgcaccctctggaacacagtcattaaccatggacagccacttctctgggcaaacccttcacttcattctaactcatatccatggctctttcctaagggccttgtggccctcttaacttgtctgttttctcttccactgtccctcatagcactggaacaggaggtagcacagtctcccaagctcctcgtctgctctttcagacttgtcactccctcccctgaaacaccacagttttaaggctcacaccaccagaccacacaaccaccatcacccactaaagcagtcacctgaatccccaacccacccatcactctctcccacacaacctcctataagtcttgatgactataatattcacagagaaggtccttctaataccctcacctcttagcttttctgaccccttctttcccacttactttgtccattcttatgaccacctcttaaagcctggcattacaagtaactgcactcttcctgaatctcgtgtcctccgctctgcctcttctcagatgctcatagtccaccaccataatcacataataactgtcttgcagattccaacgccctgacccctctcccctttctcatgctcacctaacaaaactcgacttgtattaaattttcatcttccactccaggtaaggaaaaccaaccaacaggatgactgttcttttacattcaagacgactaactgaaagggggttcctaaacctctcagaaataatgcattttcctactcctctcactcttctggtcctaaaacaatgaattcatcccttttccactctactcaaattgccaatacctccttcccatcttctctctcagcaatttcacagagaacagagacacagccaaaagggcatttccatgaacttccacatctgttcccttctctgtcactcggtttgagatcccacctccttttgcctggccaagaacaatggctctctttctaacatcagtcccatcagcatagaaaacatgcagcagtgtttcccagcttgaaaaattaaaaacagaaaattcttatcctgaaatttcactgtccacatcactctgtcctttactgcaaaactccttgaggggttttctgtaccagcttcctttcctcctactctccgctgaggcgactgcaatcaggtttctagccccaccactcaaccaagagctctgatcaagtttaccactgacttccatgttactaatctttatgttacctgacctgccagcaacacttggagtttaccaattccctcctgcttcagataactttttctccatggcttccagaacactattctctcggttctcctcctacttcacaagtcaccctttgtttggctggatcttcaccctatctctgaaatgctggacagctcctagggctatcttcagatcctgtctctatgggctctcagcacatgggtggtcttaggtgatgtcatccagactttcagctttaactgccatgctagtatctccagtgtacctcttccctggattccatacctctctcattgttatctagtgaacatctccacttagataaccactgaaactgagtatatccagaacctctggtttccactccaaacctgctgcactatctttcccatcagtaaatggcaaagccaaaacccgaccctttattcctctgcctctcacatctcatcttcaatctatcaccaaagtccttcaatcctaccctcataacataagcagaatgtgactactcttattcctctcctccatcaccacctggtcccagcaaccaccgaatgcatccagattactacaagagcctcccctaactgacctcttataccgctgcttctacccctgctcccctacagtctttccagagaagcaacatgaccttttgaaaatacaagttcaatcatgttcaaacccttgctcaaaccctccagaggttgccatcatgctctgaataaaaccctgatatggcctaccaggctctgcacgttctggcccctggctgtcccttggactcatctctcaccagaacaccagctcagtccccacagacaccaggcccgcccactctcacctatgacctaccaccccttgcacttgtcttccccaagcacaggtagggttcttacctcccttcattttggaatctgctcaaatgccactgtgtatccacaagaccctcccgaccatgtgatatgaaacagcaaaccccacttcccacattcatcctggcattcctccagtcctgcaccccttttacttctcaccatttcacgtactatgtactttatttgctcataaactccaaaagggcagctcattgtccattttgtttgctgctatctccctactccaaaacatcaagttgtccattttcgatatacaaaatttttgtcaactatacctcaataaagatggaaaaaaactttttagcaagggaggaggtagggtcatggcataagcagtggaatatttcaaaggactagctttcaggaatgcactcaggatattctgatttggctcattttcttttggcatggaacatcctacgtgcagggaccataggtctcactcgtttctcaagtcccacagcactcaggatctgaaacacatgggggttcacgtaacctagtctaatgcgtggttcaacctcagtttccgagattctcaactcagagctctatcctccacacccgctactttgttctccttcagatctgacacacacgtggccccagacaacctaagagagacacattctgcagacaatgatgggcagcctaaagtaagtaccaagtggtccaggcctcaccgtgctattgatgctggctaacagcttcccgttaaattccaccatagagtacacggcccctttcacttccttttcagccacagtctgtagttttcctgggggtggaaaaaatatgtttgagtctctatgagcccacactttacctcatcaaaagaatcctctggttgcccctgtggtacaaattcttgccccccaaaaccactcatctaaaaaaacaacacagactcagtatctactggagttaatgaccacgtgaagtatgagccccaagataatgtgcagagaaatccagttggtatctaggatctgccccctcgccctgaaactctagatctctctctcaagatggaaaccagatcccatttcagctatctgatctgagatttccgggctgatagtctttagagccatcttgggtgggtgtaacgagaaaagatattaaaatataaacacagagttgaagctggaaagagcacctaaatgcctgagcaaccaagtggaaaacaaacctaagattctgaatttttatacctgttgtcactagattcccttacccatcgttcacttctcccacccctcccttttgttcttttggcctttcaaagagtagcaaagaaagaaatgtaagctaaattttactgtgtactgttcacatgctccaaaattcaatcaaataaagaagagaatagctctttacagcaatgaacccaacttcttctactgcttaactgaggctctctgaaacctcacaatggcctgctgactttctcagcatttcacatccctcagaaactggagactgcgcccacttaccatccgaatactgaaagaccacaatgcgaccctgcttgggctctgcctcttcaggatacaccattgctgtgcccacaatgaagtaagtgttggggtctttgcccagcttgcaggaaaccagactgagggcatattcattctgcagaaactggtgggcatgaagcactagagagtagagagatgactacgtgatgacaggttacccatatctgcacgcacacataaccccgtatttctgaggcctgtggcttaggcagtgacaaagcgtgtaccacctgctgtccctgtctcatcagattatccatcccccaccagcctaagctaaggagaggatgcccagccctccaaactcactgccatctcacagaattcccacccctcctttctgctcctcctaggacagtctgccacatctgtcaggctttgcaggtaccagagcccagaacagcctggattagggagggcgtagataaaaattatcgaaagagctcatgtgcaccttcaaaggtgtgttggtcaatgataagtaggttgtgcacctccacctcttctccaaaggaggtctcatgaggagcagtgctgctggagaacagcttgctggagcttacactgctggacagagcctgcaaacagagagaatgcacatcatccttctcaaacacagaagaagtgctgagacatcattgtgaagggacccgtcagatcaggacacaaaggctgcagctagccaagaactctgatggctggcagctcaaggagcctgaggagagtgtttcagaggaggcatgtagttgaaacatcaatcccaaacagtaaaaatctaagggtcattaaagacaaaacagtgatgcttcaagtcaatcaagcacagctaaaaaggaactcaggtgacctaatggggacagactccactaccctcaatgggaagaggaggggggcacttcaaataaaaacagaagccatgaagacttcaactctggactacggagggaggtcctatcgcagatatgtggaaacatgaaaggcagagaatacatggaagaaaatgaccagctggtatcaccactgagcctagtatgtgtagctccagactgttatctgcctcattctgcagataagaaaactgaagtttaggctttcccaaggtcacacagctagcaataaacctggaagccaggccaggcacagtggctcacgcttgtaattccagcacttcgggaggccgaggcaggcagatcacaagggcaagagttcgagaccaggctggccaacacagtgaaaccccatctgtactaaaaatacaaaaattagctgggcatggtggcacgcgcctgtaatcccaactactcaggaggctgggccaggagaatcgcttgaacctgggaggtagaggttgcagtgagccgagatcgtgccactgcactccagcctggacgacagggtgagactccgtctcaataacaaacataacataacataacataacataacataacataacataacataacataacataacataacacataacataacataacataacaaacataacacataacataacataaaacataacataaaacataacataacataacataacataaacccagtaggcacttttgaaaagctggtttctgtcttaaaaaaaaaacaaacaaacaaacctggaagcccgttctgtcggactccaaaccccatgttcctcctctattcgaccactctacaaaggacccaaactgatggtgacagatgctgcaaggccaccaagtaggaactgttttttaaaaataaacttttatagaagccagctatgctcacctgttgcctacagctgctttcaggctacgatggcaaagttgaacagtcagtggtaactgagaccacactgcctgcaaagccgaaagccttcactacctggcctgtacagaaagcttgctggcccctgctctaaggtcatctttctttgtccactgcccttacctgggtgctagcgctgggcctcaaggctgtcgtgcccccactcgtgtcttggacttcaatgcggctggagaggaccccgaaacactgggacacttcctggtagcagatcttcctgcagaacaagtacagaacaacagtgtcacttagaaagtcagaagcaccctacaccaacccccacttcccactctcccaccctgggcctcaccttggagactcatagaggggaactgtgcgaatgtgcagcttctggatctcatcgatggtgccaatggtgagggtgctattgttggccagcgccaggctggaaagaagggtctgggtttagactgaggagactcaaggaaggcaaagattctatgaggcaactccacagaggaagaaaaacaaggcaggattacaccagctttgactccatgctaaacatcacctggagagacagacaattctgattcctggtcccatccacaagatactcttatttcattggtctgggtgagcctaggctgagatttttaacagctttccatttaatgataatgtgcaaccagttaaaaaaatcaacgctccaggaatgtgactttcaaactactgcctgtgtcagagttggctggagggcttgtcaaaacagtctgctgggccccctcccagagtttctgattctgtgagtcagggtggggcttgagcatctgcatttctttcttttctttcctctctctctctctcttttttttttttttttttttgagacagagtctcagctctgttattcaggctggagtgcagcggtgaaatctaagctcactgcaacctccacctcccagtttctttttttttaagacagttttttttcttgtcaccaggctggagcgcaatggtgggatcttggctcactgaaaactctgcctcctgggttcaagtgattctcctgcctcagcctcctgagtagctgggattacaggtgcctgccaccacacccggctaacttttgtatttttagtagagatggggtttcgccatgtcggccagactggtctcgagctcctgacctccggtgatccacccacctcagcctcccaaagagctaggattacaggcatgagccactgcacccagcaaccttccaatttcaagggaatctcctgcctcagcctcccaagtagctgggattacaggcacacaccaccatacctggctaatttttgtatttttattagagacaaggtttcaccatgttggccaggctggtctcaaactcctgacttcaaatgatcctcctgcctcggcctcccaaagtgccgggactacaggtgtgagccaccatgcccagccagagaatctgcatttctaacaagttcccaagtaatgctgtagctgctggttggggacaccctttgagaattcctgctctagagggacacaaaatgatctctaaattagggattatgaaacagtcatctgaatcacctgataagttttctgaaaatacagattccagagctcaacctcagacccactgaggattccaaaaatcctgtagttttaaaaaacttcccaagtgtttctattgggtagccagttttgagaacctctgcactatacttcccatctcagttatgattttgacaccggaaaaaggctttgaggtaagggtttgaggaaaacatcatgaccccctcaatcaatagctctcattaaataaggaaaaagagactcacctgtcaggatagccatctgaattgaggggacacatgtagttcacttccttgaggttgacatttgagaagaccaatttgtggttgctgctatagatgacagtggggcggtcagaacaagcaaagacgttggtggtagaaagagaacgaaaagtcctcaatacggtgggctgggtgcccaaagtcaccttcttacggtcgctcaacagacctacagagagaatgacatcaggagaaaggaagaaagaaaacaggacaaaaagctggcctgtgaaagttcaaaagcagaaccctgggactaagaattctgtgtaattctaatactctatttttgaaagagtccctcactcaaaatactactctcacctgtctcaatgttgagcccaaagtagaaaagcgctccatctcccaaggcacaaaggaggtaatggctactctcaaaggtggtcatcaggatggagcgaggaatgatctctgtgagaaagggggacattatgttcttgttccacattttgactctgtcccaacccaggtccctaaatgacacatacctccacccagcatctccttgtgcagtagttcaaaagagggcaacttcaagatacgagccgagatgtccgtccagaggccaatggcacaaagaggggacagtccattgctgtctcctaatggggtgatgtccaagcaagccacttcatgttccatctctgtgtggctgaacaaagaagaatatggcagaggaaggaatccaaggctcaaagaagtcctagagaaaagaggaggaaagcgagcagacagaaaaacacacacacctgatctgccggagctcctgaggatggatctgcagatagtagagggccctgcctacagccaccaccacctggctgctattgcaggaggccacactgatgttcttggcctgaggctccttccattcactgaccagagctttgggttcttgagagaccaacctcaccgatgctgaagtgatctagataaacagcagatgaacaaatgtctccaagcatctgccagggtccacacaggagtggaaaggtggtaaatgcagccctaatagagccctacgaataagctacatgaggcttctatttcttattccccaaagtcctgctaatgattacaatagatgtcatttttgcatgaatgcctgaaggaggccagcttaaaagtagcttacagcttacaaacctacagctggtggggaaaaggcctatttcattctaattgagacttacttgggtaatacaaactgcatcctgtgggaagatatgaatagagtaagaccctgtgaccaccagttttttggcttttttttttttttttttttttttgggacagagtctctctctgttgcccaggctggagtgcagtggtgcaatctcagctcaccacaacctacgcctcccaggttcaagccattctcctgcctcagcctcccaagtagctgcgattacaggcgcatgccaccatgcctggttaacttttgttttttgagtagagatggggtttcaccatgttggccaggctgatcttgaactcctgacctcatgatccacctgccttggcctcccaaagtgctgggattacaggcgtgagccaccatgttgactgtgaccaccagtcttagcagtttttctcaacccccaaatcagacctctaaaatatctaagttctttactgtgtatgagccatttaaattatttaaagttccttagtaaagattacaaaattgtatagaaatatattgtataaatttatcactgaaataaaacaggaagtaggttggtgacactgttatctattcattcatcttacctagcacaattgagtttatatataaggatgaaagctctttaataataaataggtgagctggtgccagtcttcaggccaatagttagataacactgacaaagcaatgactcagtatctgggcacgtcccacacttggtctgcaaactgacagaactttccctccggttttaccaatctaccactgccaggtggctaaaaggaaaaccaggtggataaaaagacagagacagttcattaatccttaggcactccagtgccctacccaccaaaggcaagacagactctggccacagagtgaagaacagctcagaaggtaaggagagagtgctaaaagctgaaggatgtcagggtcactccaaacttcaaaaaattgctgaggggtggaagggtgtcagaaatgaggctctcgtggataacaatatgccagaaggctatctgcccccgtattgcagatagattgaaagtaaggatcagaatagggtaagcttcggttataattagtatgtggaaagggctgccaagagtcatattggatggtagcatcatgattttttctttttttgtgcattttggcattttctaattttataaataaggatgtatcactagtttaacaaagggaaaaaatttgagtgtctcggaagatataattagtgctaaaataggatccgaaactatatttttatgtttatatatataatgacccgagtctataaaagaaaatgtaaataaatacacagacatttgcagaagaaaaataaagctaaaaggagcaactctaaggttaagagttgtgatctctgagtagtggattatctgtaattttttccctagaatttttacattatttttggagccataaaaattggttgttttaaaatccagtggtgctctgtactgcatctaggtcaattcaagtatatggtaacacctgcccctttctcagttatcacctggataagctgctgatgagccacgttgccacagaagaaagtctgctgatcatccacgaaacccatcagttcggtttcttctacctcctctccatttaacatgagaactctgcagcagaatggagggcctgggtcagcctgggaccagcttccccacctcacaaccttctcaccagcacctacagctggcactagacccatccttaccttgtctggcccacaaaagagagcaccaaagtgtcatcagtctcacgattagggtcagaccgcagtggccataatcctggaacaaggaccaaggattcagatgcataggacagaccaacacttagcatgcatatctacggacagggcaggccaggggcagtggctcatgcctataatctcaacacttgggaaggcagaggcaggaggactgcttggaaccaggagttctagaccagcctgggcaaaatggagagaccttgtccctgctaaaaatacaaaagaacttgctaggtgtggtggcacaaaactatagtcccagctacatgggaggctgaggtggggggattgcttaagattaggagaaagaggctgcagctatgatcatgtcattgcactccagcctgggtgacacagcaagatcctgtctcaaaaaaaaaaaaaaaaaaaaaggatagatatatatatatatatatatatatatatatatatatatatatatatatatatagacatggcagcctgacaccactggaagggctggaacatggagtcctgagctggaaccccctctctgctccttcttggttttaaggctctaaaaagttaaatagttttgttttgtttgtttgcttgttttttttgagacggagtctcgctctgtcaccaggctggagtgcagtggcccgatctcagctcactgcaagctccacctcccgggttcacaccattctcctgcctcagcctcccgagtagctgggaaggcaggtgcccgccaccacacctggctaattttttgtatttttagtagagacagggtttcaccatgttagccaggatggtctcgatctcctgacctcgtgatccgccaccttggcctcccaaagtgctgggattacaggcgtgagccaccacgccgggccaaaagttagataattttaaagctgttttgagcctattttaaatttgggattggatatacatttccatgacccaaagtctaaatttatttatttatttatttacttatttatttgagacggagtcttgctctgtcacccagactggggtgcaatggcacgatctcggctcactacaacctccgcctcccgggttcaagcgattctcctgcctcagcctcctgagtagctgggactacaggtgcgtgtcaccacgcctggctaattttttctatttttagtagagacaggatttcaccgtgttagccaggatggtctcgatctcctgacctcatgatctgcccactcggtctcccaaagtactgggattacaggtgtgagccactgtacccagcctaaatttattttttaaaagtacacagaaaagtctcattcccatacctccctccaacccatcccccaaacaagtaatcaataaaggcatcttgtttagccttctggtaaagagatggggtgtgggaggatcttgctatgttgctccagtctggcctcgatctcctgggctcaagtgatcctcccacctcagcctcctgaacagtaaggactacaggcccactatgcaacactaagcttaattttttttactttaaggaaatagagtattacaaacaaatgcaaatataaaatagtctatcatgcactatttggcaccttgttctttcattgaacaatatatgcttgaagcccttatcagaacacagtatttaattgtgtaaatcatttatctataattattaaattatgcagattaacaaatcccttctcattatatttattcagtattttgctataacatacaatgccacaagaaataagcttgtatttttatgtcactttatacatataaaggtcaggtagaggctcagaactgggactactaagtaaatcgctaactgctgtctttgatattgcccaattcccttctatagaggatgcacaagcatgtttattttctcacagcccgaccaacataatgtgtggtcaaacttctggattttggtcatctagtagagtactgctgtttggtgttaatgtgcatttctcaggactgttgcctgtccattcatgtcctttgctagtttggggacagaaaatttagtgatctttctataaatatgttataaattaggaagactgggccttttgtctataagatgaactacagaatatttttatctggtttgtcatttcttctgacttacctaatagtgttttgttttgcttttgctatgaagtgttttatttttatatagttggaatttatcaatctttctttttggcttctgtactttgagtcatagttatggcttcatttttttacattaagtttttcaaccatttagattctagccaagtgtacatttggcaggcagtatgaacccaaacttgtcttttcccaaatgactatcaattatcccaaaaacaccatttattaggtcccaactttaggctaggctcagtggctcatgcctgtgattacagcacttcagaaggccaaggcgggaggaccgcttgagcctaggagtttgagaccagcctgggcaacatagggagaccctgtctctacctctaccaaacacaaacaaaattagccaggcgtggtggcgcatggttggagtcccagctactgggaggctgacatagagaagatctcttgaacccaggatattgaggctatggtaagccgtgatcatgccactgtaccccagcctgggtgacagagtgagaccctatctcaaaaaatgaatacaaataaaaatttaaaaagtcccaactttactcactgaactgagaagccaccactatcatacactgaatttccacatgtaattatgtcatttctggacttctgaatctgcccattagactctgcctattcatcagcaatactacacttctaattatagaggcttaacagtatgcttcagtatctggtagggctaacatgtctcactgctttctttttttttctttttttttttgagatggagtcttgctgtgacgccaggctggagtgcagtggcacgatctcggctcactgcaacctccgcctcctgggttcaagtgattcccctgcctcagcctcccgagtagctgggactacaggcacgcgccaccacccccggctaattttttgtattttagtagagatggggtttcaccatgctggccaggatgatctcgatctcctgaccttgtgatctgcccgcctcggcctcccaaagtgctgggattacaggcatgaggcattgcgcccggcctctcattgctctttttaaagttttcctggttatgcctgcttcttcctttttccatttggacttgtctaagtcaaggaaacattgtatacatattcaggtacattaaatataaagagagaacagctttataatactgatttgcagtacttggtgtgtctttttcgtttgatcaacttgttcttttcctccttcaggagtatctttaagttttccttgtataggttttgcacaattttgttaaatgtactccttggtacttaatcattttcttgttatggtaaattgccccctttcctctactatgctttctaattgactgtgtttacatgaaagctattaatttcagtacattacttttacatcctgctatcttagtgaatttgtattgtctatagtagttttttagttgattatcttgggtttgtagttatatgatctcttcctttgcaatttcatatacttctcttttctttttttctttttttttttgagatggagtctcactatgtggcccaggctgtagtgcagtggcgcagtctcagctcactgcaacctccgcctcccaggttcaagtgcctctcccgtctcagcctcccgagtagctgggattacaggcacccacaccatgcctggctaattttttgtatttttagtagagacagggtttcaccatgttggccaggctggtctcgaactcctggcctcaggtaatccacccacctcagcctcccaaagtgctgggattacaggtgtcaggcaacatgcctggccatacttctatttctttattgaccttttcccatactttttttttcatattctgaattactcctttttttaaattgagatgggatcctgctatgttgcccaggctggtctcaaactcctggactcaagcaatcctcctgcctcagcctcccaagtggctaggactacagtcacacgccactgcacctaccttcagaattactcttttaaagatgtgcctcctatatacaactttaaggtggttttgttttatgatttaatctgattatgctgtcctcaaacaggacatttacatttactgacatgacagctatgttccatatcaattctgtcatactgttttaggttacgcttatacattctaaatgtctttcactgtgtagcctctcttttttttttttttggtgacacaaggtctcattgtcgcccaaactagagtgcagtggcacaatcatggctctctacagcctcaacctcctgggctcaagtgatcttccacctaggctagaaccaagtaactgcaaccacaggcatgcaccatcacccctggctaatttttaattttttttatagagatgaggtctacgttgcctaggctggtctcaaactcctgggcttaagcaatccttccaccttggcctcccaaagtgctgtaatgacaggcatgagccacgccacctcgcctagcctctgatcttttttttattaaaattctcctggaatttaggaagatttatattttttatctagaaaccacatttatacttatatcttcataaaatatcctcagtctctcctttctttatgaattctatcggttgcctcatataaacaacattaattttaatttataatcttttaatcccctagtcctctattccactaccaattttgatcagtagtattttcttttttttttttttctaaagtttacttttatactttcagatatgtttaagcttctgatctgttgttacgactttcactcttcacttgatctgctttcctctggctcccaccaaaacgccttcacaacatgtaacaaggccaaagtccctcatgtaagatctacatcctatgcccaccaaaaaagctacctttgatgcctggtaagtcaatgctggcatgctcgtggattccaattccattccggatgatccgcaaagaaccttccttgaaagccccagagcaagtgaccagctgcaagcagagaaaacgtttctaaagaaccccctcaagatactgggccagtcatactgatgcccagaaagtaaacacggtatacctaaatccaagaacctttattgtggggctaggtttgaggatgcagacttggcagaggttgatttccaaagtctttcaaatttacagagcagacaggacatcctagtccaggaagcaaaaagcttctaccactgctcctagcaagcttgcttagatcgctgggacctagtttactagaatgagcacaggatctgttagatacacctgccacttattaagttaggtgactttggaaaaagttacttaatctttctcagccctaattttcctcacttctgagatggccaaatatccctatctagggtacttgtgtaattagagataatgtatataaagtgcctggcagaccaagataggcactcaataaacagtagttatccttatatcactgggattcatgagggggctcttaaaagtattttcagtgcaccctccccattctagataagcatagctaggaggacacagtttgagtgggcatataccaactatccactttcagaatggcccttacctgcccctgcccctgcctctccaggtccaccacgcacatatcgacaatgggtcctaagttggtaaaggtttccatggccactacataggagccttgttcattactgtcaacgttgagctaataagaaagaacaatgttatgttagtcctagaacaccctaacagacccacccaaaagagatggttattgtccaaaagaaactctcaataactagtttctagatctgccattctcatgttccaagggatgattccagaaggggactattgacgaaagaatatggttgtcccacaggtgacccattaatcagccaaggattgctgacctagagtccatggatggatttcagagaagtagtgaatgtttgaaaattaatgtaaaatgtttgcatgcatttttctgcagagaaggtccgaagttttcatattctagaagaagtccattacattaaactatgacctatttgaaggtaggagctgggtcttgttcatcaatgtatccacagcacctagcaccttgcctggcaaatttgctgaatgaaccacaaaggcaaagagctagtcaggggtaggatgttaaattaaccaagtagaaagctggatagtagggatgtggataaaatggagagattctgagaggtgccaaacataggagaaatttgatgaagaaacagtgagtacagcaaaaaagaaaccagaaacaagtgtcttctcaccttcacaagctgggagtcacccaggcgagacccgacaaacacaacaccattatcaaggtatgtcaagcactcagcaatagaggtctggaagaaagtcagcaacgtgaaagaaatgagaatggaccctacgtgggatccagatactacccacatctcagacatctgctgagaaaactcccaactgcagccataattcagaacagttctgtttcaaattcccaggtcacactaagcaaatgtttctaaatctctgaagtttttgattcttcatctattgcatccctacactcagaaaaatctataatttgtcttgcatattcctgctccaaaagatactgcctaagtattaatattaaactttttgggagcctcctcccagaactgaaatcagcaataatcttttttttttctttttttgagacagggtctcactgtcacccaggctggagtgcagtggtaccaccatggctcactgactgcaacatcgacctccccgggctaaggtgatcctcccacctcagcctcccgagtagctgggactacaggcacacaccaccatacccacctaatttttgtactttttgtagagatggggttttgccatattgcccaggctaatctcgaactcctggggctcacacaatctgcctgactcagtctcccaaagtgctgggatcacaggtgtgagccactgaaaccagctagattgatctttaattccagattatatccttttctgtttccctttcttttccttttctcacaggctgcttggatagattatcacaggatcctgtgagatgctccaatacctaactcattcaacagtcaacttccacagcaggaacaacagtttgttgttaggtgttaagtaacataattcccagagttgaggtgtgggaccacacatttggtgtctttaggaacctaaaagaacattgtagaggaacagggagaacaagctctacctctccaaggagttctacacggagatccttgagagtgacggtgccatccatctgttcctccttctccaaaagcagcatgaagagccggccttccatgtctcccagcaggtatcttgagccattagggtccactcgattgtggcacacaatcgtgctttgctgccaattggaaggaaacagtcattagagattcagcatcttctacaccagaaaacaaaccctactggaccactccctttaccaaacccagccattttaccagcagacaaatcgctcagataacattacatgaaaatgaggatagatcctattgcccattaatagaaaatggggagcttttttattttgaagataattttctgaggcgctccatcaatatatcttatatgtttactgatatgtcgtcattctgcaggaaaatagaaatacacagaataggaagctgctgccaaaatctactgaactatgcatgctactacaaatgttgttatttattcttaataccactaattaccccctaccactgtggcaatgctaccacagattttgttcttttttttaaagacagggtctttctatgtcacccaggctaaagtacggtggctattcacaggcatgatcacagtgcactgtagccttaaactcctggactcaagccatcctcccaagtggctagtactacaggaacttgccactgtagccagctagattttgttcttttttctcaaaaagaaagtaaaatgaaacttttaaggcttaatttttacaacttgatattctaagtccttgacatttttgactttcttagcctttataatttatcaatatattactttatatgacttgagccctgaaaacattacatgcaatagaaattgccaaaattacggctgggcacagtggctcatgcctgtaatcccggcactttgggaggctgaggcggatggatcacctgaggtcgggagttcaagaccagcctgaccaacatggagaaaccccatctctactaaaaatacaaaattagccgggcgtgatggcacatgcctgtaatcccagctactaaggaggctgaggcaggagaatcgcctgaacctgggaggcggaggttgcagtgagctgagatcgtgccactgcactccagcctgggcaacaagagcaaaactccgtctcaaaaaaaaaaaagaaactgccaaaattttcccctcttaaagttgccccatgtggtagttcatgcctgtaatcctagctacttgggaggttgagacaggaggatcacttgagcccaggagttcaaggctacagtgagctacgatcatgccactgcattctagctctccagcctgagcgacagagtaagaccctgtctctttgacaaaaaaagttgccccagtcaatgaaaaggggaagcctattttgattatcatttatctaagttagcaagcaagttctctgtaagcaaatccaggctaatctctctctgtattcccaatggccaacgcaataccttatatacatagtaaattgtgtaacaggcatctgtgaatctccttttgataaataagagaaagggaggagcaaggtgaggacaaggaaagaaaagatgaaaggaaaaaaaggtaggactgcgctcaccttgatgataggaggggcaatagccaggtatttgtcaccattgtgataggtgattgactcctgtccaatgatgatggcccccccaaagggctctgggactgcaggaaagacagcaaaattagaatgctcagcactctgggtctgccaaaccaggactggcaaaagtacaggtctagttagccccaaggcaaactttaaggtcatcattattttaaaaaggacatcaaagcccagggaacatgatagcctttacgagactcttagaatttgttaactggccattatctaatcctggtagtatttttactgccactcttctggtgttcgactattcctatgggtggggagtcttctccatgttcttccccatgcattctcccccatttttcttctcaacttctaatcctttccaagtaaaagcttttacttttttttcctggtttccactcttgttccttagcttaacttccccccattatcagggctaccactgagaagagccaattttctcttaagagttttaaaacttccctactgagtgagacaaacataatgtaggggcagacttaggacaaggagtgaagaggcctggattctagcccagactttgtcaatcatggacaggcatgggcaggtccctctggccctgtttcttcatctatgaggtaaagaaatcagataagctctattgctccctttcagttttttgttgttgtttttttttttaaagagatggggtctcattatgctgcccaggctgaactcaaactcctaggctcaagtgaacctcccacctcagcctcttgagtagctgggactatagatcctggcttcctttcagttttaaatgttatgcccagcaataaaataatgagactcatttccatatgccactgtgcaaatcaatctcaatgttttatagtcaatccctccacccaagtaaaagacaagttatacttttggggggagaagtgaaaaacagaaaatctcaaagacagaaaaaaacaaagcacaattagagaaagaaaacataaaggagtggtaaacaatgcacaccttcaataataccgagcgccaaaacgaagggcagagaaggtgagggagcgaacaagaacagggaactagcctagacccaggtggaggcacatttcctaaaccccctaccaacctgcgatcaccatggaagcttcagcttcgacattttcctgtttccaagggcccttattgaattccttttctcggagagacacctcataggtttttacgtgccgcccctgagggtcctgggggggaaaggtaaaatggttagcccttaggaagggtgagccttgggctagagagaggtgctgtaaggaataagccaccactacccagcatctgacagtcctgtcatgtcagccctcccacccttatccatcactatactgacaagcactagctgagcctgggatgaattcctaggtagactgcagcatctgagatctaccattcttaacaattcaaccaaccaagaaaggtttaaagaattagaaaaatgaacttgtcacactgcactaggtactataagagatactgtgtgccaggcacagtggctcacgcctgtaatcccagaactttggaaggctgaggtgggcagatcacctgaggtcaggaattcaagaccagcctagccaacacggcaaaaccccgtccctgctaaaaatacaaaaattagctggcatgggggcgcgtgcctacagtcccagctactcgggaggctgaggcaggagaatcacttgaacccaggaggcgaaggttgagctccagcctgggcgaccgagcaagactccatctcagaaaaaaaaaaaaaagagatacagtgtgtgtgcctgtgtgtgttccttagcctcgagaaacttacaaaacagctaagtgaaacacgcactgataagctacacctatgagattttttttaaattgatacaattcttaaaagcattctgatggaataatggtagagagaacacaattgattgctccgctaaagttgtcaaaactttcagtcctgccattgtcaacatcatcttcccctcctttttctgaattatgactcatgtcagtcctgggactgccaaggtcacctttaagatgctaaaaagcagggaccagaagaaagctacactcagccagtggaagacagcttcaacaaagaagttatggaaggaattcagcaatgtgtttcagggcagggatcacatcttagtcactgttacagctcctgaagcatgaatacctttcacatagcactaagtacctaaatatttgtcaaattgaatttctggcataaaacagaagatagtaatttttggctgatgaaaacattttcccatcaatgagtagggttatgacacaactttgcaaaaagttcaagtgtggatttgggcctctgagacacacatgcagaaatgaagatctgatcacagctggcagccctgaagcttagaacaaccagccttgaataatcaacaacatcaaagttttaatgacctaatattacaaaactaaagaacatagagaaattctaagtttttattttaactcatactaagtaagatcaaacaaaatctcctggtttcaaccttattcaattgggtcttattccaatagcttcagaactacagtaacactaagaaatatacaaaaatatatcagcacctccaacatataacaaggctatcaaactgtttatgtgccaacacactctatgtggaactggactatcatttccttccatcacttattcagccacatgcaaatgaaatgatcttatgctgcatggccctttgttaaagggctgagattttaccaagatactggcatgttagtctggtgctctaccaccccacccccgcttaacagatctggaccagagaacagctgcccaggatcagctctgctacagttttaggcagactaaaatagaagttaagagccagcaagttgccgagcacggtggctcacgtctgaaatctcagcactttgggaggccgaggcaggcggatcatgaggtcatgagtttgagacgattctggccaacatggtgaaaccacgtctctactaaaaatacaaaaattagctgggcgtggtggcatgcacctgtaattccagctactcaggaggctgaggcaggagaatcgcttgaaccaggaggcggaggttgcagtgagccaagatcaggccatcgcactccggcctgggcaacagagtgagactctgtctcaaaaaaaataataaaataaaattaaaataagccagcaagtcaccagtaagtgattactggacaaaatgtaaacctcttcttaaaaaacacatataaggcatcaccaagacaatttctctttgcttaatataaaggcaagatctagataatttcttgacaactaagttttaataatcccctagcactccagtaagagaatcaaagtataaactgggtcatcctatgaaatctcccaaggcccacaaccagagtgtaatctcaggattaaaacctgctacaagccccagagagcttgctgcctccacaataagtactactgcactcaagaagcaacgaaagtctgacccatattaattgtgttgttcaaaacatttcaggacaaacacattaaacacttctctctatcctaccaaacccagacatgccagttagcaaaaacaactcctatcacatcaacctcacagtttctcgctctctcttcctgatccagtacctggtagacaaagcaaatagtaggtgcttggcaaccatataggaacttgacatcaatgacatgcagctcctccaggcggatgttgaaggccttgagttctttattatcgcgatctagtggaataaccttgaaaaggccatcatagagacgcaggccaatcatccggcactcagggtcaatgatgccaataatgccggtctctgaggggcggccaatgcggtcctgagaaacaaaatcgggattagggaagaacctcaacatccacagagcaacagaggacgctgggcaccacttgtgcagaaaaattttaggagaggtattaaaactaatggatctatttgataggccaaatagttggagccccaatgtcagtgcatgcctttttcatgaaacactgaatctcaatgaattattaccctgtcccttgggtcttgagtgaactacaggagtcctttctccaaaaagctcaaacccatagtgtcttctccttatttctctgatcgaatagagagctgcccccagcactttaattttttccatgaatcatgacagccctacttagaaaactttcattggcctaaagcagccacctcacctggacattgccatgggctcgcgtaatgatgtcaatgctctcgccactctgtttatactccaggatgcaggcattgtacttcgctgtcaagataaacagcaggtccttgctctccccctggaaaccaatattatgctatcaaaagaggttctttttaaaacaggaacaacctgtccagtctttaagcacaccaaattctttaagaattttccaaattcttctctccctaaagagaaaatacatggtgagcttgtaacccacactaggtacacatacaccctaagggcatgtacaaaaagccagaactgaagctggtaaacatctagttctcactttcatgattctccatctctctgttctacaaacaaagtcttcatctatttcaatctcaagctaatctcaatcatcccattcaaattctgaaagatgaatgtaatgcctcctccactcctccccaagtatttgaagaaagaggaaaaaaaatgtgggaataacaacggaagctaaaatggatcaacaaagtcctacttatttaacacagactccaaaaaattgctgttttgttcaaagggttataattaaaattttgaacccactgctttcttgccagattcagttaagacaacataaagcaatgtggtggtgatttggatgaaaacatttgcgctaaaataatgaaaatactgatggtaattgttttttttgtttggtgtttttttttttggagatggagtctcgctctgtcaccgggcaatgggcgccatctccactcactgcaacctccgcctcctgagttcaagcaattcttgtgcctcagcctgccaagtagctgggattacaggcacgtgccaccacacccggctaacttttgtatttttagtagagatggggtttcaccatgttggccaggctggtctcgaactcctgacctcacgtgatccacccacctcggcctcccaaagtgctggggttacaggcgtgagccaccatgcccggcctggtaattgttaacataactgtaaatgcttgctatatgataggccctatgttactgaatcatttcatcgtcacaacaacccaggggatttgatctgaaaggtgccttaagtggcacctaaagtcagaattaacaagaaatgaagccaggactgccccactctgtagcctatcctctgaaacaaactgctttaatttctcccttctaaagaagtcaacttcataaatgtttccctaatgaatctctccttttacttctagaaagcttggtcaagagtacatactgaaatttgctatccaaagagagaaaaaagagaagagtttttctcctaaagcatattccacccatcccaagaattcgcaaaacaacctaacacagcccaagcacggtggcatgcctacaataccccagctactctactccagaggctaaagtggagggattgcttgagctcaggagttcaagacatcctgggcaacactgtgagacccccgtctcaaagaaaataaataaacaaacaaaaataacataaaacaacctacgaccaacagttccccctccactgcttgtcccaactgcaacacttaccttgggcctgaaaagctccatgaccgcaatcttcccatacatgcccacctctttgacgggccgaagcccctcggcggtgaccacatagatctctaatctcgtgtttttggcaatcaacaggtttaagtcttcggccgaagtaaagtgtcctgaaagaacagaccctctaacttttgaactcaggggaagggcctcccatcccttcaaaataatcctatcacttatgtctaaatacctccagaattctcatttacttcacatacttctccaactccctccagctactccccttcttgccaaatccggcacctcaaagagtctcagttcatgcattcaacaaagctacttccctaatcagactaagaaaactggactggacctaagagccgtgtgtcctccaaatgacaatgactgcgtaatcccttctcatgcctcttgcccctccaattttactctattacagttacagtggcaggctctaattgagaatgccggagaaagtgttcacttcttccagtcttcatctaaagtctcacaaaacttttatctgacagaccaagtcaaatgaagaagtcccagagctttatatgaaaacactgttttgtccacaccccctgccctcctggcagtctaccaatacctccatccacactcagctacctccaactctgaacaacagttttgttttggaatcatgattagggtgtatataaacatgcaagcttggggtctgcatattcagctgagaatgtgggttaagatgactcttcccgggttctgaacatcggtgtccttaacaatccaagcgcatcgtcaacaaggcaaacccagcactgggccaggcaaaccaaaccctcttctccagcagggccctcatgtaaacaacagccccaggcaaaggggttagcctgaagagggctcctctccctctgtgggataatgcgggcattcctcacatccctccacctcctgggccccccagacttccccacaggaaaatcttgaccccaaagtcgtcattaccacctccccttttcctggccacagaaagccaatctccgggcccaaacgacaccgcacaaccaactcacactcctctgtctcactgggcccgccctgttctcgaggccgaatgacctccccaggacgaaaggggaccctcgagagcggcttccaacccccaaaaagcgcgtacagggacgactctttcgaggtcgcggtgctgggggaggttcctcggccgccagcgccttccattcgccgggcccactcctgcccggccgcccccggggcggcgggcctccctaggccgcggctccccccaactccctcactcgccggggtctccggccccggcagcctcaccggtcacgcagccgttcacggcggtgggcttctgggccgttaccacgtagttgtacgacatgtcgaggcttggagcggcccgtcgggactcgagcgcgacactagaaagagggacacaagcgaaaagacaggtggcccccaacagcgcgcagcgaactccactgccgctgcctccgccccagagacacgttgcaggccagagcggccggggcgcggggcatcacgggacggcctcacctggcctcttggaggactcccgaagcccgaggccgccaaccgaaggaggccccgcccccggaggcacc

SEQ ID NO: 71 - DNA, 24277 bp, Homo Sapiens
ctccgagacgggtggggccggagctccaagctggtttgaacaagccctgggcatgtttggcgggaagttggcttagctcggctacctgtggccccgcagttttgtagtccccgccttgtttctccccagaggcctctcaatcctccctccatgatcttcgcatagagcacagtaccccttcacacggaggacgcgatggctcccaagaaacgcccagaaacccagaagacctccgagattgtattacgccccaggaacaagaggagcaggagtcccctggagctggagcccgaggccaagaagctctgtgcgaagggctccggtactgcctgtgcctgctgcttgaatatttccgccttttagggtgctcgcgcaggaggctgcagcgggggatgggtgctccgaggctcccgaggcccgcgcaggtcacgggtgcctccggctgtgcattctacctgcaggtcctttgacaccagagtgtttaggtttcaacacctctcccgctaggtaacaggaagcagatgagctccgtaacaacagacacacggacttgtcagattccttgttcgtatcagggttcttgcacagttaggacggcttcagagaatcctacctttcctggcgctgtgtgtgctggatttcatagtcacgcttgttagctgcacgtcctcggtggtcagttgtgagagcccccaattccttcctccttagaaagctcattctctgaggtttactggggcttgaacctggggctataaggagtttcgagacactcaaaaacgagctggggcttgttaatcaagtggtttttgtccatgagaagaaagaattggttgtcaagacgtcggacctatagtgattgggtcctcaaatacagtttggtgatcaggagttgttgctttattgctattctaatttcacttacctccccagaagtaacctagttaagagcatttccaggccttcctattccttcttttcctaaacggtgacttctgccatgctgccctaaaatctttttattgtgcattatatgtgatttataaaattgtgacccagtcccatctcgagttttgcagcccaaactgggaagagttctgcattgtactttatccttgtgtgtttctttggctggggtctcaggaaccctgcacgactgtatttactttcacttcagacttactgtttgtgggagtgttttggggaaggggccaaatcctcactcatttttttatttctggtgctcgttgagaccacacagacatggaaaggccgcaggaggtgatgagacagagattaaccgtgccgaatgaaacaaggcttcctttcggggaattcagcagaaaaacctttcgtgagattggagaggaaaatatgtctgttctgcttggcaggtcctagcagaagatgtgactcagactgcctctgggtggggctggctggcccacagatcctgccaccatgccgcagcatcgtcaggaccctccaccagcataagctgggcagagcttcctggccatctgtccagcaggtaaggcattttttgcctcaagtcctcaagggtttacacgtgcatttttactattgcatgctcccaaattagatgatggcttggttcaccagcttgtcagagtggtccgatcacccagactgtggtgactggcctactgggcactcagccaggtaaaaaatgtcttatgttgtaaaggtcccagctggaatgcactctgccccttttgctttccaagattattcgttcgtgtacattgcaaatattttcatgcacagggcaggcagttagctttcctttggtgggaggacttggatctagggctcatccatgaaggaggcagagattggcagtttacccagaacttgggttttaattcaacctaattcatttctctctgtggcaggggctccagcagtcctttttgcacactctggattcttaccggatattacaaaaggctgccccctttgacaggagggctacatccttggcgtggcacccaactcaccccagcaccgtggctgtgggttccaaagggggagatatcatgctctggaattttggcatcaaggacaaacccaccttcatcaaaggggtgagcagttccccatgccaggtcgtgctaaagaagtgtttgttggctgggtgcagtggttcgcacctgtaatcccagcactttgggaggccaaggtgggtggatcacctgaggtatggagtttgagaccagcctggccaacatggtgaaaccccgtctctactaaaaatacaaaaattagctgggtgtggtggcaggcgcctataatcccagctactcaggaggctgaggcaggagaattgcttgaacccgggaggcagaggttgcagtgagccaagattgcaccattacactccagcctgggcaacaagagtgaaactccatctcaaaataataataataataataataaaagaaaataaaaataaggagtgtttgttgaaggcatgaaaggaatattgatgtcatccagtaatcatcaggaagaggactgggatcaaaattaactgtgggcattttcaaatacgtaaatgatgatgatatatatttttctaatgcctgtccttaaaatactagaagatatagactattgatcacccatagaattgaagccccttctgggctgggcgcagtggctcaggcctgtaatcctagcactttgggaggccaaggtgggctgaccacgaggtcaagagatggagaccatcctggccaacatggtgaaaccccgtctctactaaagatacaaaaaattagctggatgtggtggtgtgcgcctgtagtcccagctacttgggacactgaggcaggagaatcgcttgaacccgggaggcgaaggttgcagtgagccgaaatcacgccactgcactccagcctgggcaacagagcgagactccatctcaaaaaaaaagaattgaagccccttcttaccacattgacctcatcttacgccattgtcttttctcacttctatgctgtagccacaccagctgtttctattcctgaaaccgggtctctgtaattgctgttccctttgactggagtgcttttcccccatggtcttctcatggctggcgtcttctctgcaggtctttgctgattctacctcttcaaagaggctttcgctggttgtccttactcataacgtagatcccactcctccaccgtcattccctgtatcattaccctgcttcatgtttcccccaagtgttgatgggtgtctgagatctgatgcttatttgtatgtttgcccactgatggcagggacctttcctttctggttcaccatcctattcccagtgcctggaacaaagtttggcctagagtagctgctttatatttgttgaatgagtgaggggcttgaagtgtaattgagcagatgggatgtatacatacgaggtaattaacaatacagatgccaagtgctacagaatgtgaaagaaggaagaaccccttgtgaattggagtcaataaagaagactccatggatgagcgaggaggagcagtattagataaatggagagaaaagaaggaaagacatagtgtgactgggtgaggtttggcacagagttcttgggaatggtctttgttgtgctagagtttatcatccattgctgaggggtgagtgtgtcgtcccctctaggacctttagccagcccagctggtggctgacattggagggctgtgctgtgaaaagtgacactgggtttagagcaggagtcacaaacttatagggctccagaagccagagtggaaaaaaaaaaaaaaagaatgtatggtggtagggtcaggggtaaactagagatgactgttgtgcaaaaatgtaggtcttttgatatcagatgtgatttttctcaaacaaagacacaaatcctcattttttaaatgtcatatatcttgagttttaaaaaaaattgtaaaatacacgtaacataaaatgtatcaccttaaccatttaaaagtgttttttttttgaggcggactctcgctctgtcacccaggctggagtgcagtggcgcaatcttggctcactgcaagctccgcctcccggattcatgccattctcctgcctcagcctccccagcagctgggactgcaggtgcatgctgccacgcctggctaatttttgtatttttagtagagatggggtttcaccgtgttagccacgatggtctctatctcctgaccttgtgatctgcctgcctcggcctcccaaagtgctgggattacaggcgtgagccaccgcccccagccaactttttaaaaaataatgataaaatacatataacatgaaatttactttcgtaaccattttaaagtgcacagttcaatggcgttgggtaaattgtgtaagcagtctccagaacttcattatttttttttatttttattttttgagtctcattctgtcacccaggctggagtgcagtgacacaaccatagctcactgcagcctccaccttcctgactcaaggaatcctccggcttcagcctcccatgtatcagggactacaggtacgcaccaccatgcctggctaatttttagagatgtggtctctctatattgcccaggctggtctcaaactactggcctcaagcaatccttctgtcttgtcttcccaaattgctcgggattacagggctgagccactgtgctgggcctctagaacgtcttaatattggcactgaatgaaactaaacacacgtctcagccgaattctgcttcagtccactatttttctagctctggtttaaaggtagacatgagggggaacccaggaggaggtctctttatttatttatttgtttatttttttgagatggagtctcactccgccgcccaggctggagtgcagtggcgcaatctcggctcactgcaagctccgcctcccaggttcacgcgattctcctgcctcagcctccgaagtagctgggactactggtgcccgccaccacacccggctactttttttatattttttagtggagatggggtttcaccgtgttagccatgatggtctcgatctcctgacctcgtgatccgcccgcctcgacctcccaaagtgctgggattacaggcgtgagccactgcacccagccagcaggaggtctcttaagtggagggatttggagagcagaccaccagaaaaggccaggttagacaggtgtgggagactggaattcaaagtgtgagatgggtgttcaaggaacaagtgccagaagcccccagaaaggcagtcagaggagtgccgcggacagagtggggtaggtttcctgcccagctaaagaggcaggtgaccgctaataaggcagcttgaagttgaagtcagaacccagagctcagacaggaagaaatttgttttcttgttttctccaggagtctaggacatgggaatagaggaatttagcttatgcctggagatgggaagaagcagtgtagggtattctaggggaagagcttcctgactaacaggataatgacaagtgctttgaacttgtgccagactgagattgctttttttctttgttgcatcaccttatgacatgcgtgtaaccttctttacagtgtaaactttctttacactgtaatgaagattggtctaggcattgaattttgtggcttgcatttgcagggagctaggttggagcagaggaagggtatggcagtctggaagagacctgtctggttttactcccagatgctgacagcagaatgctgatttgagaccagttactggaggagcaacagtgcctcattttgtcacttctttagtcatctgaccttggctgtgacctttacattcttcaggcccttggcaagggaacatgtattacagtttcacaatgaagatagcttaattttattcctattataaaaacaatgtatggggccaggcgcagtggcccacgcctgtaatcccagcactttgggaggccgaggcgggtggatcacctgaggtcaggagttccgagaccagcctgaccaacacatagtgaaaccctgtctctactaaaaatacaaaaattagccgggagtagtggtgcacgtctgtagttccagctactcaggaatctgaggcaggagaatcacttgaacctgggaggtggaggttgcagtgagctgagatggtgccactgcactccagcctgggcgacacagtgagactccatctctcaaaaaacaaaacagtgtattcttatcataaaatacagagaaaagtgtaaaaaataaattaaatatgatccaaaatccccattttcagcatccctctgtgcatgtgtacactatttttttttttttccaagtctgagtcttgctctgtcgctcaggctggagtgcagtggtgcgatctcacctcactgcaacctccgcctcctgggttcaagctattctccttcctcagcctcccgagtagctgggattacaggcatgcaccaccacaccagctaatttttgttttgttttgtttttttaagacagagtttcactctattgcccaggctggagtgcagtagcacgatctcggcccactgcaacctctgcctcctgagttgaaatgattctcctgcctcagcctcctgagtagctgggattacaggagcctaccaccatgcccagctaatttttgtatttttagtagagacggggtttcaccgtgttggccaggctcgtcttgaactcctggcctaaggtgatccacctgccttggcctcccaaagtgctggcattacaggtgtgagccaccgtgcccagcctgaattttatatttttggtagaaacagggtttcaccatattggccaggctggtctcgaactcctgacctcaagtgatccgcccgcctcggcctcccaaaatgctgggattacaggcacgagccactgcacccggcctgggtttttaaaattatatctttattgaggtatagtggacataaactgcagctatttcaagtgtacaatttggctattctcagcctatggggtagtcctactccagagaagcagtaagaaaaaaagaataaattgtacaattccatgagttttgacatatgtgtacaactgtgaagccatcaccacaattaaaataactcccatttccccaccctttgttgaatatttggagagtgatagatagatgagttatctatgcccctttgtaatccacccctctctacccaatatcttattcactgtaaactgctgatctattttttatttttagaaattaatttacattttctagaactatatataaatagaatcatagaatatatggtcttttatttttgttctagcttgtttcagtataattatttgaaatttatctacatttttatgtgtagttttttttttctttctgaataatggttcattgttttttgttttaagacagggtcttgctgtgtcacccagggatgatcatggttcagcatagcctcaacctcctcagctcaagcgattctcccacctcagcctcctgagtagctggcactacatgcacaggccaccatacctggctaattttaaaattttgttatagagacagaggtctcactgtgttgcacaggctggtttcaaactcctggcctcaagctatcctcctgccttagcctcccaaagtgccgggattataggcgtgagcccctgcacccagccacattgtactgatatgatacagtttattcatttacctgttcaaggacatttgaatttttttctagtttttgaatgcaacatataaagcgactgtgaacattcacgtacaagtatttgtgtggatatatgttttcatttttcttgggtaaatacttagcagtggaatggctggattatagagtaggaatgttttaaagatactttttaaatgagaaaaggtttttctatttgcccacatattgtcatttccagtgctttcattctttcatgtgatccagatttccttttggtaatattttctttctgcctgaagaaattcctttcatatttcttataatgcagattggtgataaatactttccactgttgtttatctagaaaagtattttgcctttattttgagggaggatgtttttgctaagtatagaattctaggttcacagtttttaaaattatttaacttttattttttaattggtaaattaaaattgtattttattgcatacaatatatttgttcacagttttctcctgtcagtactttaaagatgatgtctaggctgggcgctgtggcttacgcctgtaatcccagcattttggggggccaaggcaagtggatcatttgcgatcatgagttttagaccagcctggctaacatggtgaaaccccgcctctactaaaaatacaaaaattagctgggtgtggtggcgctcaccagtaatcccagctacccgggaggctgaggcatgagaatcttgaacctgggaggcagaggttgcagtgagccgagatggtgtcactgcactccattctgggtgacagagcaagactgtgtctcaaaaataaataaataaggctgggcgcggtggctgacacctgtaatcccagcgctttgggaggccgaggcaggcggatcacgagatcaagagattgagaccaccctggctaacacggtgaaaccctgtctgttctaaaaatacaaaaaaaattagccaggcgtggtggtgggcgcctgtagtcccagctacttgggaggctgaggcaggagaatggtgtgaacccaggaggcagagctggcagtgagccgagatcggccacttcactccagcctgggtgacagagcaagactccgtctaaaataaataaataaataaagaataaaaataaagatgatttctagttgggctcaatggttcatgcctgtaatctcaacactttgagaggctgaggctgggggacctcttgaggccaggactttaagaccagcctaggaaacacagcaagaccccatctctacaaaaaaatcttaaaaattagctagtggcttgaacttgtagttccagctgttcaggaggctgaggtgggagaattgcttaagcccagggggacaaggcttcagtgagctaggcaagcctgggtgacagagcaagatcctgtctcaattaaaaacaaaacaaaacaaaacatcctgatgagaagtctgctactatccttatgttcctgtctatgtaatttttcttctggtcgctttaaaaatgattatgatgtgcttgtggggggatcactaagcttctttgatttatggattttttttttcttttgagacaaagtctcactctgtcgcccaggctggtgtgcagtgccacaatctcggctcactgcaacctccacctccagggttcaagcgattctccctgcctcagcctcccgagtagctgggattacaggtgcccaccacctcacctggctaatttttgtatttatttatttttattttatttttttagtagagacagggtttcaccatgttggccaggctggtcttgaactcctgacctccagtgatccgcccaccttggcctcctgaagtgctgggattacaggcgtgagccaccttgcccagcccattatttcttacaaagagttcaaaatgaagaaaaagaacagttctttttttcttgggactgcgattacatatggtcctgcaggtggttgatgcactgttcatttttgtctttttccctgtttcattttgtgcagttgttcactgatctttacttctgtaatatctaaccttctgctgtcaatccctccctccctccctcccttcgttcctttctctctcttctcttcctcttccttttctcttctctttcttgcctgtgcagagcagggctgctccataggcaaagtagcccagcgtatttttcatttcagatactgtatatcccctctagaagtttaatttggattttttttcatgtcttccatttctctcctcatatttattatttcctcttctttcttttttgagatgaggtctcactctctcttccaggctggagtgcactggcatgagatctcagctcactgcaacctccacctcccaggttcaagcgacccttctgcctcagcctcctgagtagctgggattacaagtgtgcaccaccacgcccagctaatttttgtatttttagtagagaccaagtttcaccatattggccaggctggtctcagactcctaacctcaagttatccacccaccttggcctcccaaagtgctgggattacaggcttgagacactgctcctggcccgatcctgtgtctttaaaaaaaaaaaaaaaaactctaacaagtaatactgctttttttaaaaaaaattgtgggccaggctcagtggctcacgcctgtaatcccagcactttgggaagctgaggtggacggatcacaaggtcaggagatcgagaccatcctggccaacatggtgaaaccccgtctctactaaaaacacaaaaaattagctgggcatggtcgtgggcgcctgtaatcccagctactggggaggctgaggcaggagaatcacttgaacccgggaggcagaagttgcagtgacccgagattatgccactgcactccagcctgggcaacagagcgagactccatctctattttaaaaaaaaaaaacaaaaaactggtagaaaacacgtaaaacaatttacaatctttactatttttaagtgtacagtttagtaatgttaactatattcacattgttgtgcaacagatcactagaacttttttcttgtaaaactgaaactctatacccactgaacaagcctccacttctccctccccttagcccctggcaaccacagtactactttctgtttctgtgagtttgactactttagatatctcatctaagtggaatcatacagtatttgtctttttgtgacaggcttatttcacttaatgcagtgttttaagattcatccatgttgtagcatgtggcagaatttccttttttaaggctgaataatgttccattgtttgcgtgtaccaccttttgtttatctgtttattaattgacagacacttgggttgatttcatcttttggctattgtgaataatgctgcagtgaatgtggatgtgcaaatatccctttgagaccccgatttcagttctttggggcttatgccaataagtacgattgcttcatcaaatggtaattttgttgttcattttttgaggaaccgctatattgttttccatactggctataccatctcatgttcccatcagcagtgtacaaatgtcccaacttctctacttccccaccaacatttattttctttttttttttttttgagatgaagtctccctctgtcgcccaggctggaatgcagtggcacagcctcagcttactgcaacctctgcctcctgagttcaactgattctcctggctcagcctccagtagctgagattataggcgcacaccaccatgcccggctaatttttgtattttcagtagagacgggttttgccacgttggccaggctggtcttgaactcccgacctcaggtgattcatttgccttggcctcccaaattgctgggattacaagtgtgagccaccatgctcggccttttctgtttttttgatagtggccatcctaagggatgtgaggtgatagcagtgtagtttcatttgcatttctctaatgattagtgatattgagcatctttacgtgtgcttcttggccatttgtatattttctttgaaggaatgtctattcaagtcctttgcctttttttttttttttttttttttttgaaacagggtcttacttggtcacccaggctgcagtacagtggcacaatcatagctcactgcagcctcgaacttctgggctccagtgatcctgctgccttagccacccgagtaactgggactgcaggtgctcaccatcataccttgctaactttgttttgttttgtttttttcgctgtctcttacagaaaggacttactaagttaaaaaaaaatttttttttatagagattggatcttgctatgtctcccaggctggtcttgaactcctgtttgcctgttttttagttgggttatttgttgttgttttgtaggggttctttatatattctggatattaaccttttttttttttttttttttttttgagatggagttttgctcctgttgtacaggctggagtgtaatggctcaatctcggctcactgcagtctccacctcccgggttcaagcaattctcctgcttcagcctcctgagtagctgggattacaggcatgcgccaccatgcccggctaatttttgtgcttttagtagagacagggtttcaccatgttggccaggctggtcttgaactcctgacctcaggtgatctacccgcctcggcctcccaaagtgctgggattataggtgtgagacactgcgcccggccatgatattaacctcttatcagatctatgatttgaaaatatcttctcccacttcatagattgccttttcactttgtcgattgtttcttttgatgcctgaattttttttttttttttaattttgagatggagtttcactcttgtcacccaggctggagtgcaatggcgcaatcttggctcactgcaacctccacctcccgggttcaagcaattctcctgcctcagcctcccaagaagctggcacccaccaccacgcccagctggcccgattgatttttaatagttaaaccaactttgcattcttggaataagttcatcctggccataacatatttatcgtttttaaatattactggattgagctggcaaatattttaagatctttgcatttgtgttcatgtgtaaaattggccaaatccttgtcacatttgtgtatcaagattatgctgatttctggccaggcgtggtggatcacgcctgtaattccagcactttgggaggccgagggggtcggattatgaggtcaggagatggagaccatcctggccaacatggtgaaaccccgtctctactaaatatgcaaaaattagctgggcgtggtggcgcactcctgtcatcccagctacccgggaggttgaggcaagagaatcgtttgaacttgggaagtggaggttgcagtgaggtgagatcgtaccactgcactccagcctggcaacagagtgaggctctgtctcaaaaaaaaaaaaaaaaaaaaaagattatgctgatttctgtgaattgcttgagcccaggaggcagaggttgtagtaagctgagtgcaccactgcagtccagcctgagcgacagagcacaactctgtctcaaaaaaaaaaaaaattatgctgccctctttagcttgggaattattccctctttttctagtctgtggagacggagggtttaagatcaatatctggctgggtgcggtggctcactcctgtaatctcagcactttgggtggccaaggtgggcagatcacctgaggtcaggagttcaagaccagcctggccaacatggcaaaaccctgtctctactaaaaatacacaaaaattcgccaagcatggtagcaggtacctgtaatcccagctactcgggaggctgaggcaggagaattgcttgaacccaggaggcagaggttgcagtgagccaagattgtgccactgcactccagcctgggcaacagcatgggactctgtctcaaaaaaaaaaaaaaaaaaggaaggaaagatcaatatctcttcctcagccaggtccggtggctcatgactgttgggaggccgaggcaggcggatcacttgaagtcaggagttcgagaccagcctggccaacatgatgaaactccatctctcctaaaaatacataacttagctaagcgtggtggcgtgagcctgtaatcccaggtacttgggaagctgaggctggagaattgtttaaacccaggaggcggaggttgcagtgacctgagatggcaccattgcactccagcctgggctacagagtgagactccatctcaaaaaaaaaaaaaaaaagaaatatctatctatctatctatctatctatctatctatctatctatcttcctctttcttcatcttctttttcccttcctgaacagttcaaaccaaaagtcattaggtaggatcaagcaagatagatgtttacgtagtgggaaggctacagtgctggaagtgccagatgctggggcccctgaagctgaggtgaatgtcattacaggtggcaggtggcagctcagtacatagagactgggcccaaacaagatcagaagggcatccatgtaggcaggggtgaagagtagaggaggccgggcatggaatagtgaagtctgaagcggggttgaggatgctgaaccacagggaggcctagagtggggtggcggagtcaagtggggtgagcagggcttttgcatggagaggggcggccgtggcgcctgatgtgggcaaggaagttgtgtctgcatggttgagggagtggagagagggaagagggtgattgtgccctcgggagggtaaaagagtccaagcatcctaaggaagacgtgcatttggggagtgtgtggcagcaatagtggaagactggttacatacaaggagattaatcaaatatgtaagtatattgagtaaaatgggaaccacatttttcactgtcaaagaagggaattataaacatggaaagagagaaactcgaatcaactctgtggtgttgactttgaattgaagacattgatacaaatttaaggttttcagtatacaaagtaagacagttgtgaagcaatctgattgcagattccttttacatttttattaccttaatcttttataagtatctcaccctatgcttaatttgatggctcttctttttttttttttttttcttcttcctaatagagacagggtcttgctctgccacccaggctggaatgcagtggcaggatcatagctaactacagccttgaactcctgggctcaagtcaccatcccacctcagcctctcgaatagctatgagcacaggtgtgcaccatcactcccagctaatttttaataattttttatagaggctggacccagtgggtcatgcctgtaacagcactttgggacgttgaggtggaaggattgcttgagcccaggaatttgagactggcctgagttacatagtgagaccctgtctctaaaaaaaaaaaaaaaaaaaaattggtgacacacacctatagcctatagcaccagctacttgggaggctgaggcgggaggattgcttgagcccaggaggttggggctacgctgagccaggattgcaccactgcatcaaggttttgaactcctggccttaagcgattctcctgccccagcccctcaaaatactgggattatagatgtgagctactgtgcccagccaatagctattatttttgcaactcattatcaagttcttccaaagctttcaacacggcttttatagtagtaataatggcctttgtttttgcatgtatttcatcaatttacatgcttaattaaatttggtgttaattgcaataaaagatacaattggaataaacaggtttgagaacaactacaaccaacccttggtttggtaagcatagaactcaactggagggagccgaagattgtcatactaccagcaagcatttggcagaccatgagcattagaatgaccgtgaggttagaatgttttatagagggaagggaatgtgccagttagtatgttgtgatagctaagtggttgttgcatagaagaacttgtacaggtctgtgaggctgggatagctgcagcgtaaagaagaagtggaaaaggtggagaaaggcggacaagtggagaactttacatcttggggatgtaaagttcttaaaacagtgcctgactgggcgcagtggctcacgcctgtaatcccagcactttgggaagccgaggcaggccaatcacctgaggtcaggagttcgagaccagcctgaccaacatggtgaaacctgtctttactaaaaatacaaaaattagctgggtgtgatggtgtgggcatgtaatcccagctactcaggaggctgaggcaggaggatcactggaatccaggaggtggaggctgcagtgagctgaggttgtgccaccgcacttcagcctgggcgacagagcaagccttcatctcaaaaaaaaaaaaaaaaaaaaaaaaacacacaaagaaaatccccccaaaaaaccagcgcctagtacatagtaagcacttaataaggttaagccattgatattctcatgattattttcatcatcattttcatgaatgtttggaagaataggaaggggcacagatctgactcctgccctcctaactcagccactgctctgagctgaagctcttctaaagagagcactgtgggaataacaaattagggcacatccatgtaatggaatacctcagcaataaaatgagatgagctcttgatacagcaaactcagatgaatctcagaggcatgatgagtgaaatgaaacaagacagtctcaaaaggttgcatactgcctaattcatttacatgacattctatttttaattttattttattttatttttagagacagggtcttgctctgtcacccacgctagagtgcagtgattcgatcgcaactcactgcagcctcgacctccaggcttccgtcatcttcccacctcagccttctgagtagctagaaccacatgcacctaccaccatgtctaaattttttttgtgtgtgtagagatggggtctccctatattgcttaggctggtcttgaactcctggcctcaagcaatccccccgcctcagtctccccaggtgttgggattactgtgctcggtctataggacattctatgagggcaaaacaatagtgatggagaacagatcagccaggggctgggggcgaggggagggtgtgattacaatgggataccacgatggagtttttgggctgttgcaaatgttctgcatcctgatttgggtggtggttatttaagtctatacatatgttaaaattcagagaactttatatcccaaatttgctatatgttaattaaaaaaaaaagtaaaaataaagccttaagaaatgaagggaggcggggcacggtggctcacgcctgtaatcccagcactttgggaggccaagggtggcggattacctgagggcaggagttccagaccagcctggccaacatggtgaaaccctgtctctactaaaaatatacaatttagccatgcgtggtggtgggcacctgtaatcccagctgcttgggaggctgaggcaggagaatcgcttgaacctggaaggcagaggttgcagtgagccgaggtcgtgacagagcaggactccatctcaaaaacataaaaataaaaataaaaataaaaaaaagaaagaaatgaaggggccagacaaagcggctcatgcctgtaatcttagcactttgggaagccgtggcagggggatcgcttgagcttaggagttcaagaccagcttgggcaacgtgacaaaaccccatcttaaaaaaaaaaaatagaaaaattagctgggcatggtggcacgcacttgggaggctgaggtgggaggatcgcttgagcccaggagattgaggctgcagtgagccgtgtttgtgccactgcacttcagcctaagtgacagagaaagaccctatttcaaaggaaaagaaaaagaagtgaaggccctgtagagagcgtcctagtgtctaagctgacctggccccaagcgctgctcgaggggtgcttctgtgacggcgcagcatgtgtgcccaggcctggttcctcacggccaggcccatcatcactcactggctttttccttcctcgtgttagattggagctggagggagcatcactgggctgaagtttaaccctctcaataccaaccagttttacgcctcctcaatggagggaacaactaggctgcaagactttaaaggcaacattctacgagtttttgccagctcagacaccatcaagtgagtagtttaactagcaggggaaagggcttctaagcttaggtgtagttccggcaagagcatccagatcccatttccttaacccaacctggcccagggaagaaaggaaagatgtcagccactttccgcccttctttctctttctcaaactgctccttggctgccctcactttggtccaggtgggttactgctttgggaaggtgttctggagcctcagctcttctgtaagtcatacctgtattagactggaccttgaccctcactagataagccagcatggcgtggacccagaaagccacctagagaatggagcaacagctcagaacttgagactgaatgccctgcactcactgtggtgtaatgacctgacctgttcctgggtggaagcttatatggatggaatcttttccataaagtgctctggacttcccaagagaaagtggctggagaaattacagaatgcggccgggtgcagtggctcatgcttgaaatcccagcactttgggaggccaaggtgggtggatcacctgaggtcaggagttcgagaccagcctggccaacatggtgaaacccccatctctactaacaatacaaaaaattagctgggcgtggtggtaggcccctgtaattcccagctacttgggaggctgaagcaagagaatcgcttgaacccaggaggcagaggttgcagtgagccgagatggcgccattgcactccatcctgggcaacaagagcgaaaatctatctcaaaaaaaaaaaaaaaaaattacagaatactcgtcactttgatttccagctagagccgtgactctgactgctccctgaggaattaagtgagggtgctggggtgtaactagcattggattggatcctgggctgtcccgcagggatgaggagtgcatgcgcacgcaaatcagcaggcaattggatagacaaggctccaggctactcttccgcaagaaatcttcctgcttgaagatattcataggggatggcaaaaggcagtgtagcatggatttgagagtttgagagaaaaactgtgagctgagctcttctggctgaatagcaggatccctgaagcaccctcctagtcagcctcccagtccagtggtttgagggaccagaagagctcctggttgtgttttttcccccagtgttcagaagggggcagaagtgcttttctagccagctctgaggaacagggccaggcaatccctctttggcttgtgtctcctttggcctaaagggtgaagagtgaaaggagagagcagtaaaggaggcttgctcagaacccggggtgtggggggcaggcgtgcctcagggcttgctttatggtataagctttgtctgcttcagggacttttaggagctggggatcctgggcccagccataaccagacagatttctgagccccattatcccatcccctctgtctggacggtagagcagtctgaatgttcctcactaggaatccacggcaagacagttattcattcattcaacaaatatttattgaatgcccgctgtgggttagtcaccggagcggcaacagtgagtaaataggactatctctgtccccaagaatcttacaacacagtctctccctccagcatctggttttgtagcctggatgtgtctgctagtagccgaatggtggtcacaggagacaacgtggggaacgtgatcctgctgaacatggacggcaaagaggtgcgttctccgaggtcctgcctttccctccctcacccccacctcggttctgtgtccccacctgaaccgagctcttctctgcagctttggaatctcagaatgcacaaaaagaaagtgacgcatgtggccctgaacccatgctgtgattggttcctggccacagcctccgtagatcaaacagtgaaaatttgggacctgcgccaggttagagggaaagccagcttcctctactcgctgccgcacaggcatcctgtcaacgcaggtgtgatatcccagacctcatctctcctgcagaccctgcctgtctgaccactgctggggttttccctcagtgtggaagccactacgtcaaacctttacccctgatagcgtctgccaagctgatgtctgggaacctttgtggctgtggctgtccccatcagctgctgagtttccagaatttttttgttgttgttcacagcccagattcacctcttcctttccgctcctgtctagagaggagtgggagggagagtacccctgcaggagaaggcctgcaaggccaggaccacagagggcttgtggttccttcagctcaggggcttttcactttgccagcttgtttcagtcccgatggagcccggctcctgaccacggaccagaagagcgagatccgagtttactctgcttcccagtgggactgccccctgggcctgatcccgcaccctcaccgtcacttccagcacctcacacccatcaaggtgagtggcggtgggaaggagctcgcagaaggaggctgtgatcatgaggccggagcaggtctgcccacagtggggaagggctgatgtggtaagcctgccaccccagatcgctcctggcccgagcacagagcatctcttacccattggctctctctcttccttttatcccacttctgccatcccatatggttgagttttctgtctcgctgataagatatttttctgagttttttcagcccagctctgatctcactgtgagaattttctaagatcctgaccctctgttctgtcttctcagcttcagttacctgtgtacagttgacccacaaaccttcattttttatttttttattattttttttaaggcagggtctcgctctgtcacccaggtgggagtacagtggggcaagcatggttcattacagccttgatctcccaggctcaagcgatcctcctgcctcactttttttttttttgtagagacagggtattcttgtgttacccaggctgatcctttttttttttttttttttttttcttgaaacggtcttgctctgtcacccaggctggagtgcagtggcacaaacatagctcactgcagcctcaacctcctgggttcaagcaatccttccgccttagcctcggaagtagattggactacaggtatgcgccaccatacccagctaatttttttattttttatagagatggggttttgccatgttgcccaagctggtcttgaactcctaggttgaagccatcccccaaccttggcctcccaaagtgctaggattacaggcatgagccactgcgcctggcaactttgccttcttagtttgtcttgcaggtttcagtgcttctaataataaaaataagtcttttattttcccaccttttctcaggctcttgttaatagcttctctatcattagtccccaacactaatagctttcaagtcctttgatgcctttttgcctaagcccccatgcagactgagctctgctagttctgcattcttttccaaaactacagatcctcttcagatcttcaggttttatgcctatacttctctggtcagttcagaatagtggtggggagcgccagtttccagcagccagaccccccgggttagaatccttgggcaaattacttatattttggatctgtttcctcatctgcaaaaagggaatactagtctctaactgatagggttgttgtgaagatgagtcagtatacttaaagcacttggccccatgcccagcacctggtaagtactggtaagtattcaataaatgatgattgaatattgagtggcccccacgtacctcaatcacatccaagctcttaataaataatgtcaagaatccttccccagttggtgttcctgttaatccatcagtgttcccgataatccatctgtctgcatgtcccagtttgtatctagccaggtgtcgtaagtcattacagcttcctgtgtgtgatttgtgacttatttctaagccttcgcatgtactatttcttccttcctgctaaccatgtctttcttccttcaaaacttccttgagaagtttaggaaaatcccatccaattctgccattttaataactgccagatttgtttttagtggggtgatctggggaatgtgggtttccttctcttttttagccattagcaattttacactcagctcttagttattcgtgttgatggagacaggatgacagtggggctcctccagaactcaagtcctgttagggtttggtcaccagaggctttttctgctttgttgtaggcctcttaggtcagtatctgggtcaggctgatgttaaaacgtttaccagttggtatgatcttaggaaatgcaaatgagggagaaggcctgaaggtgccctaagggccagggaggccagctagggattaaaaatgtgcaatggcagaggcacacacaacctaaaaccattcttgtagttttctgtaagacttatctccattattaggttggcttgttactggcaaatactacttttttttttttttttttgagagtcttgctctgtcacctaggctggagtgcagtgacatgatcttcactcactgcaacctccgcctcccgggttcaagtgattcccctgcctcagcctcccaagtagctgggactacaggcatgtaccaccacgcccagctaattttttttttggtatttttagtagggacggggtttcaccatgttagccaggatggtctcgatctcctgacctcgtgatccgcctgcctcagcctcccaaagtgttgagattacaggtgtgagccactgcactcagcccaaagaatacttttgatgttcctctttgttcatatttgtttttgatgtcccccttgatcatgttctgtgtttaccctcatggccggcctctccatctcctaggcagcctggcatcctcgctacaacctcattgttgtgggccgatacccagatcctaatttcaaaagttgtaccccttatgaattgaggacgatcgacgtgttcgatggaaactcagggaagatgatgtgtcagctctatgacccagaatcttctggcatcagttcggtgaggcttgggtcctcaaataatgatgggaggaagcagggattcaacctaccttattgaccaaaagtgaccagaaatcaggtgtctctgctaataccttcaccctctcctcatgttgacactcttgtctctgcagcttaatgaattcaatcccatgggggacacgctggcctctgcaatgggtgagtaggaggagaatgtctctgacttgccaagtccgatcctacttcccaaggttcagtgcgggccagcctcagccccgccctgccacattcaccccagggcagtggcccacgaagaagatggctgggagacagtggtctctatagccaaggccctccattcctctggctttgtcttggtcatgcaatgcctggctactgtccagtttcctagtatttcttttttttttttgagacggagtctcgctctgtccccccgggctggagtgcagtggcgtgatcttggctcaatgcaagctccgcctcctgggttcacgccattctcctgcctcaacctctcgagtagctaggactacaggtgcccgctaccacgcccagctaattttttgtatttttagtagagacagggtttcaccgtgttagccaggatggtctcggtctcctgacctcgtgatccgcccacctcagcctcccaaagtgctgggattacagacttgagccaccgcgcccggccttcctagtatttctttaccaaattgtaggtttgcgggccagccccaggctctgagagattggtaacagaaagtgtaagtcagactggtctcactcttcctaggttaccacattctcatctggagccaggaggaagccaggacacggaagtgagagacactaaagaaggtgtgggccagacaaggccttggagcccacacatgggatcaagtcctgcaagcagaggtggcgatttgttaaagggccaaaagtatccaaggttagggttggagcaggggtgctgggacctggggcactgtgggactgggacacttttatgttaatgctctggacttgcctccagagactgctccagagttggtgacacagctgtcccaagggcccctctgtatctagcctggaaccaaggttatcttggaactaaatgacttttctcctctcagtgggtggtagcagagggatcaagcagttatttgatttgtgctcacttttgatatggccaataaaaccataccgactgag

SEQ ID NO: 72 - DNA, 69576 bp, Homo Sapiens
gggggcgggagcggtgcgcgcaacttctcgggccaataactgcgcagcgcgcgggacccgggtggggaagctggagctgttgcggggtccgcggggaagtcttggcggtggagccatggtcggccaactgagcgagggggccattgcggtgaggaggtgccgggggctgggccggcggtccggggtggctgcggccccgagcctcgcggagtagagagggggaggggagcccggggcgacgggggatgaacgcgaggggaggagatggcggggggcggtggggacccgccgggcgtccctctagtgtcatcgccccctcctcaaagcattctttcgatcgtctttaaaacatgctcacatttttcctacgtaagaacaaactaaataaacgcttgcctttctctgcatcttccacctgcggacactttctgtctcttctcctttccccacccacagccaaacttcttgtctggtttcagccacttcctttcctcgcctttcatcaactctttaacccactccagtcatccctttgatcgctgtagaaaaccctggctgaaggtaccagtggcctccaagttgctaaatccagcccttttccgttttcagcttacctgagttctcagcagcgtttgcgtttaagccctgcttgcttcaggtcacaccctcttccttggtttttagtggctcagcttggcaggtctatccccgtcttatttgtaagtccctctttgtaaatttttgttgaatcaaggctccctctaggccctcttgactcccgaggcaatttctttttttttctccagcctgggcgacactcactgtcgcccaggctggagtgcagaggcgcgatctcggctcactgcaacctccgtctcccgggtgcaagtgagtctcctgtctcagcctcccgagtagctgggactacatgtgtgcgccaccacactcggctactttttgtgtttttattagagactgggtttcatcatgttggccaggctgatctcgaacaccagacctcaagttatccgcccgcctcggcctcccaaaatgctggaattacaggcatgaaccaccgcgcctggccccaaggcaattccattgccatctattaatatatgtcagttgctcacaaatttctttgtacagagccacctttactctaaaagacaaacttccgtcatctgtctgcttattccatgcttcagagggttttaagttcagtatacgtatcccaaagcaaattctttatctttctaagtctgggcctcttgatccctatctccacggatggcaccattatctattcagttcagtgctaaccagaaattgagaaatcattcctcctatattgtccattacctgggcatccagtccctcacgaagtgaagtgtattttgcctctgcgtagatctatcaagcccactggcttctctccatccatactggcaccgtctttttttttgcctgagctgctgacttccactcagcatacgttcctgccaccattcccatccacagcatactctcagcctacctctccagtcacccccacatttttttttaaatttagatttctggtatattccatactcctaccttcttccatggggcctttgaacttttttttttttttttgagctggaatcttgctctgttgcccaggctggagggcagtggcgcgatctcggctcactgcaagctctgcctcctgggttcacgccattctcctgtctcagcctcccgaatagctgggactacaggtacccgccaccacgcccggctaattttttgtattttttagtagagacggggtttcaccgtgttagccaggatggtctcgatctcctgaccttgtgattcgcccgcctcggcctcccaaagtgttggggttacaggcgtgagccactgtgcccggccttttttttttttttttttttttttttgaggcagagtctcactctttctccccatacccccccactaccgccccaggctggagtgcggtggcgcaatctcggctcactgcaacctctgccttctgggttcaggcagttctcgtgcctctgcctccagagtagctgggattacaggcatgtaccaccacacctgcgtaattttttgtatttttagtagacacgggggtttcaccatgttgcccaggctggtcttgaactcccaaccttaggtgatccaccctcctcggcctcccaaagtgctgggattacagaagtgagccaccgcacccggccctgaacatttttttccctctgcccactgcctgggtggttcttcactcttccccacactggcaaacactatcttcgtatctcagctcatttgtgacttcccttactaggctaaatccctttgagaccccaattcctgttcattcacttattgaattatttattttttttctttttgagatggagtcttgctctgttgcccaggctggagtgcagtggcacgatcttgactcactgcaacctccgcctcctgggttcaagcaattctcctccctcagcctcccaggtagctgagaatacaggagactgccatgatgcccggctaatttttgtatttttagtagagatggggtttcaccatgttggccaggctggtctcgaactcctgacctcaagcaatccacctgcttcggcctcccagagtgctgggattacaggcgtgagccaccgcgcacgaccccattcacttattagatgcatgacttgaggcaagatactaaactgtttcttttctgtaaaatgagagcaatgatatctattgcataaggtaagtaggaggatggagtgagttattaaatttaaagtgcttagcacactgatacatagtaaatgctcagtgtttatgttacctattaataattgcagttttatgtttgttgatttatcagtttctttttaaaattttaaaattattgtgtttgtttgtttgtttgttttgagacagagtcttgctctgttgcccatgctggagtgcagtggcacattctcggctcactgcaacctctgcctcccgggttcaagcgattctcctgtcttagcctccctagaagctgggattacaggtgcccaccaccacaccctgctaatttttgtatttttagtagagacagggtttcgccatgtaggccaggctggtcttgaactcctggcctcgagatccacccaccttggcctcccagtatgctgggatcacaggcttgagccactgtgcctggcctaatactttgtgtaaattccatgaggcctgcaatcatgtctgggttattttactctgcattgtatccccaatacctggagaagtgctggcaagttttaggtgctgaataaatgcttgctagttgcatgaatgaatgaggcagtgggaagaaagggacaggtgaatggggaagaaaggcagcttgggggaaaaacaggaacaggaagaactattgttggactcaagtgaatatttaaataaattaggaatgtgtgaatgctgaaaccggggaagtgattttaaattgtagctttcatttactttatagctgctaccttgtgtctttaagacaaattaagaatgtttctaggccaggcgcagtggctcacgcctgtaatcccagcattttgggaagccaaggcaggcagatcacctgagattgggagtttgagaccagcttggccaacatggagaaactctgtctctattagaaatacaaaattagccaggtgtgggggcgcatgcctggaatcccagctacttgggaggctgaggcaggagaatctcttgaacccgggagatagaggttccggtaagccaagatcgcaccattgcactccagcaacaagagcaaaactccatctcaaaagaaaaaaagaaaagaatggttcttcacttttaaaaagactgatcatgggccaggcgcagtggctcatgcctgtaatctaagcactttaggaggccaaggcaggtggatcacttgaggtcaggagttcgagatcagcctggccaacatggggaaaccctggtctactaaaaatacaaaattagctgggtgtgttggcgtgtgcctgtaatccctgctgcttgagagcctgaggcaggataattgcttgaacccgtgaggcagaggttgcagtgagccgagattgcaccagtgcattccagactgggcgacagagtgagactgtctcaaaaaaaaataaagaatgatcatggagatatttaaataatttgataagtttttttattttttagagatggggtctcactctgttgcccatgctagtctcaaactcctgggcttaagcgatcctctcgcctcagcttcccaaagtgctgtgattatagatgtgagccactgcacctggccatgtttttatattcaaaattttataaacctatttccagcgtaggtgaagtattttgttcataaatgaagaatgaaagtttcacatgtgtttgtggtgatggaatgagttggagaacctttgctgactttcattatcagctaaagcaggtatcattttcgttcaaaagacacaggccacaaagggtacgcaaataccacacacatgtgaaggcgtttgggcaagagtcacatgataaaataagagatgatgcatagaactcttgtggtcaacagaatacatagcatttgtatcttaattatataacgaaaggggaagggaactaatgtttttgactatttctaatgtgacagatgctttagtagtcagtacttaagtaaccctagaagatagctattatactcccattttacagaggaaggaagtacagagaggttgaataatgtgtccatggggtgaagatttgaacacatgtgcccttgagtattacatttgttgctttatatacttactagggattttttttttaaagggtctcactctgttgcccaggctggggtgcagaagcacaatctcagctcactgcaaccttcacctcccaggttcaagtgattcttttgcctctgtctctcgattacagacgtgcgccaccacgcccagctaatttttgtatttttagtagagatgaggtttcgtcatgttgtccaggctggtcttgaacccctggcctcaagtgatctgccgcctcggcttccccaagtcctgggattacagacttgagccattgcacctggccgtaattttttttaaatgacagagtcttgttctttgtctctcaggctggagtgcagtggcatgatcatagctcactgcaacctccaactcctgggctcaagtgatccttccacctcaacctctccagtagctgggagtacaggtgcatgccaccatgcccagctaattttttttttttttaattttgtgtagagatggggtttcgccatcttgcctaagctggtctctaactcttggtctccaaacagttctcctgccttgcctcccaagtctttgggattataggcatgagccactgtgcctggccttgtcccttaaaatgagttacatttgtaaacagctgatttctttggagcatcgtccccatatacttttctttcataagtgatctcatccttcttccacccaaccttccccttgaatttgttgtttgttgttgtttccattttagcagaattcatgttgctctgataggggctcttttcaaactgatgtcttatccttcttagtacctcaaactaggtcttgttcagacatgttataacaagttagtatgagtttattttagtgcaaaaaaaatttttgaaatgcatgcatagttttttcataatgcacatttttcgtgtactttttgaatccccctcatacatgcacgtggttttaaaatcaaacggaacagaaaggtgttcatggccgggcatggtggctcacatgtgtactctcagcacttggggaggctaatgcaggaggatcccttgaggccaagaaagagtttgataccaggctgggcaacatagcaagatcctgtctctatttcatttagaaagaagaaagaaagaggtgtttaatgtaattactgacctcctgccttaccttgtccagtactgttccccagaataactgctttttagaaaaatcactgtcattgacattttgcttacgtatagtaaattgcaccttttttatttatttatttatttatttgaggcagagtttcctcctgtcaccctggagtgcagtggcgtgatctcagctcactgcaacctctgcctcccaggttcaagcagttctcatgcctcagtctccttagtaattggggttacaggtgcacgccaccacctggctaatttttgtatttttaatagtgatggggtttcactatgttggccaggctggtctcgaactcctgacctcagatgctcctcctgccttggccttccaaagtgctgggattacaggcataagccaccatgcccggccaaattgcacgtattttaaatgtacagcttgatgaactttgacaaatgtgcgcacccctgtaaccacattgcccctgtggagatatagaatacttccatcaacgcacaactcctcttgctccttccccacctccatcctcaccctaggcaaccagtgttctggtttctacctttgtaggttagttttgcctttcctaagacttcatataaatggaatcaaataatatctatccttttgtgtctggcttctttcagcagttttttttttttccccagaggtagggtctctgtcacccaggctggagtgcagcgacacagtcatggctcactccagccttgacctcctgaactcaagagatcctcgcacctcagcctcctgagtagctgggactacaagtgcatgccaccactcttggctaattaaaaaaaaatttttttttttttttttgagacacagtcttgctctgttgccagactggagtgcagtggcgcaatctcagctcactgcaacctctgcctcctgggttgaagcgattctcttccctcagcctcccgagtagctgggattacagccgcatgccaccatccccagctaatttttgtatttttagtagagacggggcttcaccacggtggtcaggatggtctcgatctcttgacctcgtgatccacccgcctcagcctcccaaagtgctgggattacaggtgtgagccaccacgcccggcctaaaaatattttttgtagcgatggagtcttggtgtgttgtccaggatgatcttgaactcctgggctcaagtgatcctcccaccttggcctcccaaagtgttggggttacaggcacaagccaccactgtggaccaaaatggtttttgagatttacccatgttaattcagtaatctgcacctttttatggctcagtagtattccattgtatgactataacaaaatttgtttatttacttattattgcacatttgggttattttcatcttttggctattataaatgaagatgctatgaccatttaagtacaactctttttgtggaaatatgttttcgtttctctgggataaatatctaggaatgtaattgctgggtcacaggtaactgaatgtgtaaaagaaatcgccaaccttttccagtgtgatcatgagaattctagttgctccatatccttgccagtcatcagtctttgatttcgagtattctagtgaatgtgtaatggtatctcactgtgcttttatttgtatttctctggtggctagtgacgttgagcatcttttcgtgggcttactggccatttgtatatcttcacgaaagaagtgtctgttcacatcttttgttcacctaaaaattgggttttgtgcttattaatgagttgtgagaattcttgattcttgctaggtcttttgttaaatataaatattacatatattttttcccaatctgtgacttgccttttcttttttgaaattttgttttttttgaagtgcacttttaaattttcatgaagtccaagttatcaggttgtgtttttttgtttgtttttgttttgttttttgcagagttgtgtttgtgtgtcctaagaaatctttgctaggctggatgtggtggctcatgcctgtaatcccagcactttgggaggctgaggcgggcggatcacctgaggtcgagagttcgagaccaacctggccaacatggagaaatcccgtctctactaaaaatacaaaattagctgggcgtggtggcaggcacctgtagtcccagctactcgggaggctgaggcgggagaatggcgtgaacccgggaggcggagcttgtagtgagccaagatcgcaccactgcactccagcctgggcaacagagcaaaactccgtctcaaaaaaataattaaataaataaaataaaaacagcagggtgcagtggctaacgcctgtaatcccagcactttgggaggcaaagccgggcagaacacctgaggtcaggagttcgagaccagcctgaccaacatggagaaatcccgtctctactaaaaatacaaaattagccgggcgtggtggcgcatgcctgtaacctcagctactcaggaggctgagtcaggagaattacttgaacccaggaggtggaggttgtggtgagccaagatcgcaccattgcacttcagcctgggcaacaagagtgaaactcagtctcaaaaaaaaaaaaaaaaaagaaatctttgcctacccgacccaaggtcacaaatcttttatgctgtgttttcttccagaagttttatagttttcgctttgccttgtggtctgtaatgcatttcaagtttactattttatctatgatatatagctcttttttaaatacagatattcagttgttccagccctgtttattgaaaacactatcccatttcattgagttacttagtcactttatttatttatttttttaattttttatttttgagatggagcctcgctctgtcacccaggctggagtgcagtggcacgatctcggctcactgcaagctccacctcccggattcacagcattctcctgcctcagcctcccgagtagctgggactacaggcacccgccaccatgcccggctaatttttttttgtatttttagtagagacggtatttcaccgtgttagccgggatggtcccaatctcctgacctcgtcgtgatccacctgcctcggcctcccaaagtgctgggattacaggcgtgagccactgcgcccggccccttagtcactttatataaaatcaatggactgtatatgtgtatctgtttctggaatgtcaattgatttctatgttggtgcttatgtcaataccacatcatcataaacattgaagatttatagtaaatcttgaaatctggcattgtaaattctccagcttcatttttattttttattttttattttttttgagatggagtctagctctgtcgccaggctggagtgcagtggtgagatctcggctcactgcaacctccacctctcgggttcaagcgattctcctacctcagcctcctgaatagctgggattacaggtgcccgccaccacacccagccaatttttatatttttagtagagacggggtttcactatgctggctgggctagtcttgatctcccaacctcatgtgatccacctgccttgggctcccaaaatgctgggagtacaggcgtgagccaccgtgcctggcctctagcttcatttttttttttttttgagacaggatctcacttagtcatccaagctggagtgcagtgacatacatgatcatagtttactgcagctttatctccctggctcaagtgatcctccctcctcaccctctgagtagctgggacgactgcgcccagctagtttttttttttttttttttttttttgagacagggctttactatcactcaggtagagtacagtggtgccatctcaccttactgcagcctctgcttcccagatgcaaacaatcctcctgcctcagcctctcgagtagctgggactataggcatgtgccaccacacccaactactttttgtattttttgtagagacggggtttcaccatgttggccaggttggtctcgaactcctgacctcaagcgatcctcctgtctcagcctcccaaagtgctgatccctttgcatacactgaagtatagagaaacaaagtacaataaaaaaaaagaaaaagaaaatgaaaacagacgtttgtttgtttgttttgagacagggtcatgctttgtcacccaggctggagtgcagtggtgcaatcacagctcactacagcctagacctcctgggctcgagtgattcttcctcagctttctgagtagctgggactacaggtgtgcaccacatacctggctaattttttttgagatggattctttctgtgctgcccaggttggagtgcagtggcgcgatctcagctcactgcaacctccgcctcccaggttcaagcaattctcctgcctcagcctcccaaatagctgggactacaggcacgtcccaccacgcccggttaattttttatatttttagcagagacagggtttcaccgtgttagccgggatggtctcaatctcctgacctcgtgatcctcccaccttggcctcccaaagtgctaggattacaggcgtgagccaccacctggctaattttttatagagacaggtctccttctgttgccccgactggtctcgaactcctgagctcaagcgatcctcctgcttccgtctccgaaatgctgggattataggcaagagccgccgtttgcagccttgttggtagttttcggtgtgcagttcttacatatgtatactgttaaatatatccctaaataatttacttttgaagcctggcacggtggctcacgcctgtaatcccagcactttttgggaggctgaggcgggcagatcaccagaggtcaggagtttgagaccagcctggccaacgtagtgaaaccctgtctctactaaaaatacaaaaattagccaggtgtggtggtgcatgcctgtaaccccagctacgcgggaggctgcagcaggagaattgcttgaacccgggcattagaggttgcagtgagctgagattgcaccaccacgctctagcacgacagagcgaaactccgtctcaaaaaaaataaaataaaataaagaaagttcttttgatggtgtttaagtggcatttttgaaaatttcattcttcagttgtttattgctagtatattgaaatacaagtgattattccacaccagccttgtgtcctgcaaacttgctaaatcaacttactagtttttatagataccttaggattttctatgtaaacgatcatattgtctacaaataaaggaagttttatctgttcctttttaatctttttattttttattttgagagggagcctcactctgtcgcccaggctggagtgcagtggtgcgatctcagctccctgcaacctccgcctcctgggttcaagcgattctcctgtctcagcctccccagcagctgggattacaggcatgcgccaccacgcccagctaatttttaaatttttgatggaaacagggtttcaccatgttggccaggctggtctcaaactcctgagctcaagtgatttgcccgccacagcctcccgaagtgctgggattacaagccaccttgcccagccagttcctttttaatctttatgactttttttcccttgccctattgcattagttagaacctctaataccacattgaataaaggtgttaagaggtatatccttgccttattcccaatcttagtagcatattattgtcttttactgttaagtgtgatggtaaccgtagattttttttgtagacgtcagctatcagtttaagcattacttctatgcctagtttgctgagactttataatgagtaagtgttgccttttccgtatctattcagttgatgatgatttttctctattctttgaatgtgacaaattacattgatttttcagatgttgagtaaaccttgccttccttggataaatcacacttggataatatgtcatgacatattatccattttatatagtgctggatttgatttgctattattttgttgaagattcttttttttaaacagagtctcgctatgttgcttaggctggtcttgaactcttgggctcaaagcagtcctcccacctcggcctcccaaagtgctaggattataggcatgaacctctgcatggggtggtctttgtttttttttctgtcgtagtaaacctaacatcataaaatgacttggaaagaaagtattgtcttttctattttctgaaataatttatgcaagtttttttgtttgtttgttcttaaatgttagataggattcaccaataaagccatctggacctagagggttctcttttggaatatttagaattataaattcaatttctttaatagacatagagctatatagattttcttttgtatcagttttgataatttgtattttttgagggatttatccactttatcttggttgtttaataaagttgttcctaatactcccttattatctctttaatgtatataggatttatttatctaattccctgttaatgagcactagagggaaatgaatggctgttaagaataacgagtacatatgggataccggtgctagagatgtgctaagtgtttccttgtaaaacacgtatctccctcttatcattttatgatttgtccagagtgataaactagatgcttcagctgacaggctctgaataggctcttttaacaatcttatctatatattccaaataccaactataaaaacatgtcattttcatcatgatttgagtgcgtatctcacacaaacctgtttttactccctcaggccatcatgcagaagggggatacaaacataaagcccatcctccaagtcatcgtaagtacctgcgtatgttatgttccatgtcaacttctttggagtcatcgaattacaagttacgtttgatgaaggacagacagatttgtccactttcggaaattcacccccagtcacaaaaaataggccagtctacattgtaaccctgagagagcagccaggctttttgaaaatgttactacgtgagctgctaagttctactgtctttggagattcagactgaaggctttgcctctctcttcctccccactgttgatagatgactgtggagctacttgcctttcctgcccttgggtttgtcttgttcacattggcctttcatatgacctccagaaatatatctagtatgaacttgtctcttttacattcttcagttaacacatcatttatttaaggggttctcaaacttcagtgggagttttgaaaaatagaagcagaatggtgggctcacccctgcaggttttcagtcggccggtctgatgggtctctctgctgcaccacacgcgccgtgggtcagcttggggctctgggtacaggtgtcacttgctttggaaacctgcctctgctctctctcaggtggggataaaggtcccggctctgccgcctgatcacggacacatcacttacgtctctctgcctccatctccaccccagttgttagctccttcaggacaaggattctttttattcattttgtatttttagcatgtttcctacacagcaccttgtgtatattgggtgcttcattattattattattattattattattattattattattttggtaattgatttttaaccatatttgagtcaggggtgagaacacaagagtataggcagctcgttttacttccctctctgttgtgtttaataatgttagtggagggaggttagtgggaaaatcatcaaatccagttttcttttacttggatttaagtgtcaagagaatgggcaaacagtttgtgttgaactaatggcaaacccactctcctgccacttcggtttacgtatccctggggacggggcagacaacctggctaatgaatcaagttttctgtcctagaacatccgtcccattactacggggaatagtccgccgcgttatcgactgctcatgagtgatggattgaacactctatcctgtgagtatggtgtatccatctagaaatgtgtgagtatttaaatagtagaagcacacctggtcctttggttgccataatttgggggcattcgtgaagtccgtacttgcttggctacgtacttcattcagacagaattgcagctgtcagagagcattctaacaatagactggaggtagtggaaagctgccacttggcttaattaattttccctaactggtgttctgtgttttctctgattaatttccctaaggatgatattgacatcgactgagtgcgaggggtcagctgccctatactttccttttctggggttttatttctgtgttggaagctgtaaaggggagaaaggagagaatttttaaatgattttggccactttaacaaattcacacatttaagagtagcagcaaatgtttaacaggcagcaaaatacacagtttttcactctgcagagtctgactagttttaatttcaggagcatatgtaaggcatttttctttgctagcacaggtatgagtagctctcagaggcttaagactgcaggattttggaggctaaagaaatctctgtggttttcagctttcatgttggcgacacagttgaaccctctcgtggaggaagaacaattgtccagcaactgtgtatgccagattcacagatttattgtgaacactctgaaagacggaaggtatgtgctgtgtttttttctgtcttattgtatcgtagaatgggaacaaatttaggaataaaaaaggcaatagtgagttttcagctaagaatctgcagcttttcagttaagaactcaggtagctaacacatggcacccaaggaggagaaacatggaaacaagttggaaatttcagagcagaagattaaagtagaatgcagaaatcttgttatttctaatttcttcagaagcagcatttttaggatttcccccaaaagaatcttatctcttttgtttgtttttggtagaaacggggttttgccatgttgcccaggctggtctcgaactcctgagatcaggcaatctgcccacctcagcctcccaaagtgctgggattacaggtgcgagccatcatgcccggcctcaaaagtatcttttaatgaaaagaggtactttattttacagcagaaaatgataattattttgtaatgctgctttgtgtgtgtgtgtgtgtgtgtgtgtgtgtgtgtacaatcttgaatcttttatattaaatgctatatttagccaatatagaatacattgaaccacatgtggtggctcatgcctgtaatcccagcgctttgtggtgctaaggtgggaggattgcttgaggccaggagtttgagaccagcctgggtgacatagccaggccctgtctctacaaaaaaaaaaaagttaaattagtgaggtgtggcggcacacgctacagtcctagctacatgggaggctgaagtgggaggattccctaaccccaggagtttgagactgcagtgagctgtgattgcaccgccgcacttcagcctgggcagcacagcaagaggccatctctaaaaaaataaatttaaaaaaagaatgtgttgtacacggacaagttactgcatgctagagatacagtgatgaacagaactgttactctcattgctaaaacatgactgatttcaggcaaggtgcagtggctcacacctgtcatgccaacactttgggagaccaggtagggaggatcacttgagcccaggagtttgcaaccagcctggacaatatggtgagaccttgtctctacgaaaaaaaggaaaagttagctgggcgttatgacatgtgcctgtggtcccagctactcggaaggctgaggagagagagtggcctgagccctgagaggtgaaggttgcagtgagctgagatcacgccactgcactccaggctgggcaggagagtaagaccctgtctcaaaaaagaccaaaacaacaacaacaaaaaccgagataaaaaatgataacaatactaagaggtttaagtaattagttttttaaattctgttatactgattttaggactcttacattttctccagctgttcttttttcctacctctttatctctgtgttggttggatttcactcaataacttttttctggactggctctttagtgccgtcttccccattatcagcctgttggtctttatgctagaatgaccacttgcctggctgtctattgttaggttatgtggctttaccctcagaattttgtcttctggcattgaatgttgatctggagaagtcttaaggccagcctggtttgatttcttcccttgtaggaagctttgctttttttttttttttttttttttctcctgaggcctcactctggttgcccaggcgggagtgcagtggcaccatcagggctcactgtagccttgacctcccgggctcaggtgattctcccacctcagcctcccgagtagctgggactacaggcgcccaccaccacgcctggctaattttgttttgtatttttagtagagacggggtttcaccatgttagccaggatggtctcgatctcctgacctcgtgatccacctgcctcagcctcccaaagtgctgggattacaggcgtgagccaccgtggccggccgtccatattcttttttcttctggtatgtggtatgcttgttcagtctgccgattcagttcttttcaacgaagtttttctgtgtgttattccttaatgttgttttctatttcacttattgagttccagttttttacatacgttgtagataactttgatctccgcataggtctttactttaaccttttttctgatggatgcattggcttgcttcgaggttttccaacgtaatagtacagtttttagttttctctcttctactcctcaatctttataaattattagatgtataatagtattgattttgttctgtttttttcttagctgttcaagctcccttttcttcttagtctcttgttttagctcatcttttgactgttaatttgttggattcatatagtcgtacttattttgccaatcgcttttgggaagtgtcactccttttcttggcttgtactttcttccagagtgggttctttaatcggctttgcctccctgttgctttcccttttatgcattgttgtgtattgtattgttgctttgtcatcatccctttttattttgttcatgcttaatgtggacagtcctgtccagacttggtatttgctctgacatagtctaggctaggtacatgttgccaaccttctcacttgggaccttttatcttccactccaggctatcttggagcgcttaagtggtgttttgcagccacttttctgtcctccagggcatggttgtgggagagggtggaagtgttgctgggattgagtgcagtccttgctgggaaacttcacagcccactctctccagtcacggagacagctccactcccctgggctttgcctgatggcactgcctcagcttgcaggcttgcctcatattcttttgtacctctgctgagagcctgtgtgtgcggctgggtttatttactccttgcttttttggtgatcattcaggtttattctaaacaggacttgagcagtcatccttgtactttatcttaacgtgtttatgcttttatttctgaataacagatcattagaatttgtattgtggggtcaacggacatctgtggaaagtatactaattatactcataaatgttatataagagtatctattggccaggcacagtggctcaggcctgtaatcccagcactttgagaggctgaggcggggcagatcacaaggacaggagatcgaaaccagcctggccaacatggtgaaaccccatctctactaaaaatacacaaattagctgggcgtggtggcgggtgcggcctgtaatctcagctactcaggaggctgaggcaggagaatcgcttgaacccaagaggcggaggttgcagtgagccgagactccagcctcggttacagagcaagaccccatctccaaaaaaaaaaagcgtatctctgaatagacaaatccatagaaacaaattcaatgactggttctcaggggtggtagagtgtggagtgactgtcattgtacacatggtttcttttgctgatgacaacagtgttctaaagtgaggtagtggtgatgcttgcataactgcaaaatgcaaaacccataggattatccactctggaagggtgagttcattatggtacgtgaatgatatctcaataaacatgttatttaaaaagaagtgtttgccattaagcttgtcaacatactgtgtattagtcatattttaaagaataattatcagccaggcacggtggctcatgcctgtaatcccagcactttgggaggctgaggcaggcagatcacctgaggtcaggagtttgagaccagcctggtcaacatggtgaaacccgtctctactaaaaatacaaaaatcagccgggcatggtggcacatgcctgtaatcccagctactcgggaggctgaggcaggagaattgcttcaacccgggaggcagaagttgcagtgagtcaagattgcgccattgtactccatcctgggtgacaagtttttcttgcccaggctggagtgcaatggtgccatctcggctcactacaacctctgcctcccgagttcaagcaattctctgcctcagcctcctgggtagctgggattacagatgtgcaccaccatgcctggctaatttttttgtatttttagtagagacggggtttcaccatcttggccaggctggccttaaactcctgaccttgtgatccacccacctcggcctcccaaagtcctaggattacaggtgtgagccaccgcacccagcctgttcctttttatggcagaataatactctgttgtctagatacatcacattttgtgtatctattcgttagttgatgggcattcggattatttctgcctgcttgctattactaataattctatgaacatttgtgtacaagttttttgtggacagacgtttccatttcttttatagataatctgtctaggaaaggaattgctaggctaaatggtcattttatggttaactttttgaggctattgttcaaagtgtgtacaccagtttacctccctgccaacagcgcgtgagtgtggagtttctccccgttcttgccagtacttcaaattacactccatagagtttcagttaaacttctctgtagactatttagtagtttatagacaaggtctttctttactttttccctccaaatttttgttggctgttctttttttttttttttttttttgagacggagtctcgctctgtctctcaggctggagtgcagtggtgcgatctcggctcactgcaagctccgcctcccgggttcacgccattctcctgcctcagcctccccagtagctgggactacaggtgcccaccgccacgcccggctaattttttgtatttttagtatagacggggtttcactgtgttagccaggatgatctcgatctcctgacctcatgatctgcccacctcggcctcccaaagtgctgggattacaggcgtgagccaccgcacccggcattccttattctcatatttgtcattttgttttttttttttttaattttactgtattgacagcgctgtcaaaactttgttggacgatggtaatgtcagcagttgcctgattttcatggaaatgcttttggtttcactgttcaatgcagtgttgatcgtggaaaaacgcgcagtttaccaggtgcaggttttattttttaagtcctcaggatttcatcagaaatggctcgtaaattctttcaaagcttttactacatcttgatatgatcatatttaatgaactattttaatagattatctaggctggacgtggtggctcatgcctgtaatctcaacactttaggaggccgaggtgggtggatcacttgaggtcaggagttcgagaccagcctggccaacatggtgaaaccctgtctctactgaaaatacaaaaattagccaggcgtggtggcacatgcctatagtcccagctactcgggggactgaggcaggagaatcacttgaacccgggagatggaggttgcagtgagttgagatcgccccactgcactctagcctgggcgacagggcaagactccatctcaaaaaaaaaaaaagattacctaatattcaactcttgtttcattcttgcgataaatcctgccttaaaaaaataatcctagggctaggctggtggctcacgcctgtaatcccagcaccttgggaggccaatgcaggtggatcacctgaggtggggagttcaagaccagcctggctggccaacatggtgaaacaccatctctactgaaaatacaaaaattagccaggcatggaggcacacacctaatagtcccagctactcgggaggctgaggcaagagaatcacttgaaaccaggaggcggaggttgcagtgagttgagattgccccactgtactctagcctgggtgacagagcaagactccgtctcaaaaaaaaaaaaggattgcctaataattcaactcttgtttcattcttgcaataaatcctgccttaaaaaaaaatcctaggctgtgctggtggctcatgcttgtaatcccagcactttgggaggctgaggcaggtggatcacctgagatggggagttcgagaccagcctggccaacatggtgaaaccctgtctctactaaaaatacaaaaattaggtgtggtggcgggtgcctgtaatcccagctactcaagaggccgaggcaggaaaattgcttgaacctgggaggcggaggttgcagtgagctgagattgtgccactgcgctccagcctgggtgacagagtgagactctctctctcaaaaaaaaaaataagaattatcttagcttgctaattttctctttttatttttaaaaatcttttttctggaaaactttaaacatctacaaacatagacagaatacacagtagtctgatgaatccccatatagcccatcattcagctccaaattgtcatctgttgtccagttttgctctagctccatcctttcaacgtccactatcctctgtaattttgaggtaaatctcagacatcatattatttcatccataaatattttagtatgtatttttgaaagataaaaactcttaaaaagacactatcccatttcacacctaaaaaaataccgtccgtgttgtatttccatcttgttgtatatgtgcgtgtgtatgtgcgtgtgcgtgtgtgtgtgtgtgcccacacaatctatatgaatcagaatccaaaataagtttcctgtgacggtagattgatggtctgttaagtctctctgaatctgtaggctctgcgtctgccttttttctcctttactgtttatttgctgaagaaaccaggtcatttatccttcaccttgtgcagtttcccccagtctggatttggctgattgcatccctgtaaagtcacttaatgtgtccttgtcatctgtattctctgtaagttgatattagtgtattcttttaatatgctgctaggttcatcttgctgatattttatttaggatttatgggatattgcaggatgaaattagttttggttttgtgtgtgtgttttgtcttaggttttagtattagagtcatactaaatgattcataggccttctatttttatatgttctggagtgatttgtataatttggaaagtagttaaatatctgccactaagtatcagatagttattacagggaatctagataccattttcaggaacagataatttcaggcttatcttattgaaactctgatgtgaaacctgataagggtagcacacactgattgattgtatgtaaaaatccaaattatagcagtcagaccatttaaaacaaacgattgattgtatgtaaaaatccaaaaacagcagtcagaccatttaaagtctaaaacgtgatgaatttgggtagattattgcttaaatattgccctaggcctgtttcttcagctcccttgccactaacctcattcaggcctctgtcattttgtctcttctcttggtctccctgcctccagtcatgttcccattaaattccttctttttaaaatgcagacattgtgatatgctcatcaagtatgtattgagcaacaactgtgggccatttgcttcattaagcactgagggatacctgtctttattgacagtacagtctagtaggagcgagagagaataataaaataatcactaatgaacatataattaagacggagcagagtgttctgaaggaaagaaatcaaggctgtaggaaagactagaacaaagcaacctgatctcaactagagattaaggaagtgtctcttgaagtgatgtttgagacgagagctaaaaaatgagtattagatgaggcaaaatgagaaggaacacaacaccgcaatctcagagcatcacggacaaaggccttgtggcaagagggactgtcccatgtggtggaactgaaagaaaacaggaaggccagagggcagagggcagagggcaggcagcggcacgggaggggggttagcaaggccaggccaggcaagccatggcccaggtttttctttgtggcctaaggtcattgggaagttatcacaacgttttaattagagttaaaaagcaaaagaactgtaagttcttaaaaatgggtcattattacattttttaaaatatctattgtcataattggttttcactgggaaaaagtcattgttgagataagtatgtgtttctgaaaacagttcatctctttttatgccatatattcttgtgtttagtaatctaaattcttaccatgtcggttggctccttgaagatacggtgcgtagcgagaacactgcattttaattaaggaactagttgggaactgaaaaccctgcaatcacttgataatgatgcggcgaaagatgaagagaaatatttatgtaaacagatgacaaatggaaaatagttcatcacaatgatcatcggggaaagcattttgagtagcttatcatttgaacagaatttgtttttctaacctgtttctgtttgtctgcttttgcaggagagtagttatcttgatggaattagaagttttgaagtcagctgaagcagttggagtgaagattggcaatccagtgccctataatgaaggtaaaatgctttggcgtaggttgtagcactcaaatgaatacctctttatatattcggagttctaccttttggattcagtttgacttgttagtgttaataaaatgatagtgattctgaggtctaggaaccaggctattctgtcaggctttttcagttctaaagaaatgatgtatgaagaaagggcacaattagaaagcaatggacaaacgggttgggtgcacggtggctcacacctgtaatcccagcactttgggaggccaaagcaggtagatcacttgacgtcaggagttcgagaccagtctggccagcatggcaaaactccgtctctactaaaaatacaaaaagtagctaggcatagaggcctgcgcctgtaatcctagctactcagaaggctgaggcagggaaatcgcttgaacccaggagacagaggtttcagtgagccgagatcgtgccactgcactccagcctgggcaacagagtgagactctgtctcaaaaaaaagtaagaaagtaatggacaaagattcagttatactagactaaaaaaaaatctaggatatcacagtaatataggatactacaggatatctgtaatattaatgagaaacgtgttttcctaagacttatgtacacttttgtttttaaaaagtgtgaagcatgcagtctatactcctgtgataacactcactgcactggtagcttttagaattatctctatttactgctaagccatgagtaaactgtgtgaaggtagagatcatgtttgttctagtgcctaacttgaggctggcgtttagtaagtatttgttgaaacaagttgaatatataacgttgttttactgtgattatctcttgatggtgaaattactaatgatttaattttctcatgaaaatgtatagaaaagcacattgaaataaaaaaagtccattttttctttgcatcctaaaagaagctgaaaaaaaagtcattacttcagacaattctagagaaaggcgaaaagaatcttcaaatcactggccccattaaaggaaaggattgtttgcccttacaccaagtcaaaacataaaagcctcatttgacaccaaaataaatttgagatgtatttttttcaagttagaaaatgaaaccatcaaaaatcaagaggaagaggctgcacaaatagattggaataattcacaatgaatatttgattacattgaaattttaaaattacatattaaaaataggaaaccaggtacggtacctcacacctgtaatccctgcactttaggaggctgaggtggaagaactgctttgagtgcaggaggacgagaccagcctgggtaacacaggaagaccccatctctgcaataattttttaaaaacttagccaggtgtggtggctcacacctgtagtctcagctacttgggaggatgaggtggggggattacttgagcctgggaggttgaggctgcagtcagctgtgatggcaccactgccctccagcctgggaacacagcaagtgtccgctattccccactgcaaaaaattaaaagtgtgtaaactaggataaaatatttgcaactcataggattgacaaagggttactatctttactatttattgaatttttttacatattaaggaataaagtacttcattagcaaagcaggcattggagaaaaatagatggttcactatagaaggaaaacaaatggctaatacattagaaaacatctccagcctggctcgttatctttgtcttgttcctgatctcagggagaaagcgttcagactttcaccattaaatgtcatgttaactgtagggttttcttagagtctttttatcagaagtaaagaagtttatttctgttcctagttggtgagggctttcatcagaaatggatggtgagttttgtcaaatgcattttctgtgcttgctgatgatctgatgatcatatggttttctttgttagttaatatggtgagttacattgattgatttttttttttgagacagtctcattgcatgacccaggctggagtgcagtggtgccttctaggctcactgcaacctccgcctcccgggttcaagtgattctcgtgcctcagcctcagagtagctgggattacaggtgtatgacaccacacccggctaaaattgtgtgtgtgtgtgtgtgtgtgtgtgtgtgtgtgtttagtagagacagggttttgccatgttggccaggctggtctcgaactcctgacctcaagtggtccacccgcctgggcctcccaaagtgctgggattacattgcgctcagccacgttgattggtttttgagcgctaaaccaatctgggatctctgggataagtctatgtcatgatgtattattctttttacatattgttggatttgatttgctatatccctttgatctgatttactttgtttagaattgttgtatcggtattcacgagagatatttttctttagttttcttctattgttacatctctgattttgatacctgagtaaccctggccttatggaataagttgggaagtgtgttccgttcttaaattttctgcagcagtttatgtagacttggtacttcttccttagatgttcagttgaattcaccagtgaagtcatctgggcctgattttttttttttaatggaaaagtcttaaactgtaagttcagtttctttaatagagagatacagggttattcaagcacccttcttgagtagactttggtagattatgtgcttcaaggaatttaatttcatttaagttcttgaatttattagtctatagaaatataaatattctaaacaccccaattattagaaattatcagatggatttaaaaaatatatttccagctgggtgcagtggctcacacttgtaatcccaacaccttgggagaacgaggcaagccgatcgcttgcgcttgggagttcaagaccagcctgcgcaacatgataaaacccagtctctaccaaaaatacaaaaaattagctggatgtggtggcgctcctgcacctgtggtcccagctacctgagcccgggaggtggaggttgcagtaagccgagatggcaccagtgcactctagcctgggtgacagagtgagaccccataaaaaaaaaaaaaaatgccaggtgctgtggctcacgcccataatcccaaaacttttggggaagctgaggcgggcggatcacgaggtcaggagttggagaccagcctggccaatatggtgaaaccttgtctctactgaaaaaatacaaagattatctaggcgtggtggcacgcacctgtagtcccagccactcgtgaggctgaggcaggagaatcacttgaacccgggaggcgaaggttgcagtgagctgagatcatgccacgggcactccagctgggccgacagaatgagactctgtctcaaaacaaaacaaaacgaaactatatatagtttttatttatttatttaatttttatttttatttaatttttacttttttaatttactttttttatttaattttttatatttttagtagagacaggattttgccatgttggccaggctggtctcgaactcctgccctcaagtgatctgcctgcctcagcctcccaaagtgctggaattatagcatatatatatattatataacatacatatatgtttccttgttatcctttgagtgtctgtagaatttgagagtttcatcaatcttattgatctcaaaggagcaacttttggttttattgattttctcttatgttttgtattctattgatttatgctttttatctttattttcttctacttacttcgggttttgtatatttttttctcgtttcttaaggtggaagctgagttcattgacttgagatctttttttctaacataggcatgtagcattataaatctgcccttagctactgctttaaaagtatccagcaaatttggatatgttatattctcattcatattcaattcataatactttcttatttccctttcaatttcatcattaacattctgttatttagaaatgtgtttagtttttaaatgtggggattttctctttttttctttttctttttcttttttttttttcaaagataaaatgagtatttaattcagtttcagaaaaaaagggtacattacttcgatgagaaagcataaaattaagaggcttttctggaaatccaagaaaaagaaataaccattaatatgttcaatgataattttctggatcttcctcgtgtccaaagctatatattttctcctcaaaagcagctgctccaagaactaactagccctctttatctccctctagctgggacagactaattcccctccacccccacctctcttctttcaataacactgtgtaggtgttaatggcctgggctctcaccaatgaagagaattgtcctttaagccagcaacccacaggtagtggcacccaaagcctcaccaacccaccccccacccggcccgtccccagggcagaagccacagagctggcattgtttccactgtctcaggaagaaggagccaaaagctgaccctcagcacaaatcaaagcccaatatggagagagaataactgcttctaggccgagagtaggcaagctgtgggcaaaaaaggggagtttttgcagccacctcatctttagaaacaaggggaaaactagaccgttttccactattaaggtctaccaggtactctactgctccaaggagatctgaaaatacaaaaggatctaaacaaataaggagaacttttcccaggctggagataagaatgacaaacagaaagatgggtgaatgtaataatgtgtaggaagatgatgctgggagcctcctttcttcacatggctgccagccccatagaggacaacacagtaagaaccaggacaaccactccagactggtatagctggggaatcttcaggccttttcctaggttccacatcaagtgtcggatcccattccaggtatgatacatgagagggaagacgagtgcaaacttagctgtgtggatcagtgctggccccagacacagggacttcacaagttccaaataagactcaaagttcccagggagtaacacggccgacatgccaaaaagagagacccctgcactcaaagcaataccagtgccacggtggcagatggacatcgccatgggaagagaccaatttctgatacagagctgagggctaaagtgggctcggaggcaatgacgaccaacgtgtctcagcaacagcgcagccatcttgggttctggtctctctttttctttttttttttgagacagagtcttgctctgtcacccaggctagagtgcagtggcacaatctcggctcactgcagcctccgcctcccgggttcaagcgatcctcccacatcagcctcctgagtagctgggactattggtgtgtgccaccatgcctggctaattttttatatttttagtagagacgcggttttgccatgttggccaggctggtcttgaactcctgccctcaagtgatctgcgtgcctcagcctcccaaagtgctggaattacagacatgagccatcgtgccagccaaatgtgggtattttctagagatcttgttcttgatatctaatttaattctagtatgatcaaacaacatactttgtatgacttgaatcctgttaaatgtattgtcttattttgttttattttatttatttatttttattttattttttttttttttttgagacagagactcactctttcacccaggctggagtgcagtggcatgatcttggctcactgcaatctccacctcccaggttcaagcgattctcctatctcagcctcccaggtagctaggactacaggtgcctgccaccatgcctggctaatttttgtatttttagtaaagacagggttttgccgtgttagccaggctggtgtcaaactcctgacctcggatgatctgcctgccttggcctcccaaagtgctgggattacaggagtgacccaccttccccagccttgagtcttattttatgtccagattatggtctctcttggtaaattctgtgtgtacttgaaaagaatgtgtattctgttgttgggcagagtcttacaaatgtcaattaggtcgagtcggtaaattgtgttattcagtttttctatatctttactgtttttctgtttacttgttctgtcatttactgagagggatattgaaatctctaactgtaataattgtaagtttctctgtctctctgcagttctattagtttttgcttcatgtatttcaaagctgtattattaaatatctatataatttagaattcttgtgtccacttgatgagttgactcttattattatgaaatgattttatccctgggaaattctgtgctttgaagtctgctttgatattagcatagccactttggcgttttttttgttttgttttgttttttctctcctagagacaacatcttgctctgttgcccaggctggagtacagtggtacattcacggctcagtgcagcctcaacaccttgggctcaagcaatcctcccacctccgcctcctgagtagctgggactacaggcatgtgccaccacgcccagctaattttattttgttttttatttatttatttatttttgagacgaagtctcactctgttgccaggctggagtgcagtggcgtgatctcggctcactgcaacctccgcctcccaggttcaagcgattctcctgcctcagcctcctgagtagctagggctacaggcacgcatcaccatgctcagctgatttttgtatttttagtagagatagggtttcaccatgttggccaggatggtctccatctcttgacgtcatgatctgcccgcctcagcctcccaaagtgctggggttaaaggcgtgagccaccataattggcctaattttattttttgtggacatggagtcctgccatgttgcccacactggtcttgaattcctggcctccagcaatcctcctgcctcagcctcccaagtagttgggactgcaggctgcacctgtagtctgggaggtggagtgccgggcctgcctgtggactgcctggactggggctgggacggcagtgccaccacgcccggctcatttcttttctttttatttgtaggggcggggtctcactttgttgcccaggctggtctcaaactcctggcctcaatcctcctgccttagcctctcaaaaggctgaattacaggcataagctactgtgcctggccattgtgtatactttctattgctagccgttcaagttcactaatggtttctcaggcagtgcctaatctgctgttaatcccattgagtgtatttttcttctcagatagtatagtttttatccctagaagcttgattttgggtctttaaaaactcatctacatctctgcttaatttttgggacatacagagcacaatgacagtatttgttgtaaggtccttgtctgtggattctggtgtctgtgttaggtccggatttgtttccgtcagttgatcccggcctctccgatcatggatcatattttcctgctgcttttcatgcctggccctcggaccgaatgccagacattgggattcgtacctcgttgggtgctagaaacttttgtaatcctgtaattattcttgagcttttttcagggatacagttaacttggagacagtttgatcttttggtgtgttgcttttaagatttattagagaatcagagagctgcatttagtctaggtgtagttattcccaatactgaatcgagacctgacagactgttctacctcgtgccccatgaatatgaatttttcccatctgactggtagaaacaggtactatttcaagcttgctgtaaacacaggcatggttccctctggccttctcagatgattctcaccctggcctcagatcgtgtccacacacacacacgggccaaccaggactctgctgactacccaggaaacctgccacccatttctggagttctctgtgtacagccctctcttctctgctactctgtccggccagctagacggcgatctccccagactctcggcccccatttctgcacctcgggttctggcaggccccctaagcccttgaggcactgagctggtgcagacccactcgctcgctttcctgtgcacagcaggcgctacccctcattgaaaaccatgcgtctcacgtattttctccctttctggtggggggagggggttatgttaggtgttagggtgaacctggtctctgttgctccatttgtccggtacgtagttttaaaagttgaatatttttgcgaggtgtgtccttaaaaacaaaacagcattctcctgcctcacttttctttggcctctgactcctgtctagagacagtctgtttcaaatctcacagctgtttcttctctgtttgtctccatatttctaaataacacatttgtgctgctcttcgttaattttttcagttgaaacatttgtttattaacttcacgctatgggagattagaatgtggtgctctctcttttttttttttcttttttaagagtctcacactgtcacccaggctggagtccagtggcgtgatcttggctcactgcaacctccgcctcctggactcaagcaatcctccttgcctcagcctcctcagtagctgggattacaggcgtgcaccactgcaccctgctaatttttgtttttatttttttattttttgagacggagtctcactgtgtcgcccaggctggagtgcagtggcgcggtctcggttgactgcaagctccacctcccggattcacgccattctcctgcttgagtagctgggactacaggcacccaccaccatgcccgggtgattttttttgtattttcagtagagacggggtttcactgtgttagccaggatggtctccatctcctgacctcgtgatctgcccgcctcagcctcccaaagtgctgggattacaggcgtgagccaccgcccccaaccgtatttttttttttttttttttttttttgtagcgatggagtctatgttgtccaggctggtcttgaactcctgggctcaagcaatccgcccacctgagcctcccaaagtgccaggattacaggtgtgagccacagcgcccagcttagaatgtagctctcttatacctctcttgtccctgctgtccacatggaagaagtagatgttaatatcgattagctcaatatttatttatttatttatttatttgagatggagtctcactttgttgcccaggctggagtgcagttgcatgatcttggctcactgcaacctccacctcccagttcaagctatcctcatgcctcagcctcaccagtagctgggattacaggcacacaccaccatgcccagctaatttttgtatttttagtagagatggggtttcaccatgttggccaggttggtctcgatcccctgacctcaagtgatccgcccaccttgacctcctaaagtgctaagattattggcgtgagtcactgtgcccagcttttttttttttttttttttttgagatgaagttttgctttgttgcccaggctggagtgcactggaacgatctccgctcactgcaacctcccccgggttcaagtgattctcctgcctcaggctcccaagtagctgggattacaagtgcccgccaccacgcccagctaatttttgtatttttagtagagacgaagtttcaccatgttggccaggctagtctcgaactgctgacctcaggtgatctgcctgcctcagcctcccaaagtgttgggattacaggcgtgagccaccgtgcccggccaagatttatttatttagttatttggagacaggttcttgctttgccatccaggctggagtgcagtggctcaaaaagggcttactgtagcctcaacctcccaggctcaagtgatcttcccacctcagctttcccagtagctgggagcgtgaaccaccacgcccaactaatttattttattttattttattttattttattttattttatttttttgagacgagtctcactctgtcacccaggctggagtgcaatggcacaatctcggctcactgcaacctccacctcccgggctcaagcgattctcctgcctcagcctcccgagtagctgggattacaggtgcccgccaccacactcagctaattttttttatttttagtagagacggcgtttcaccacgttggccaggctggtctcgaactcctgacctcaggtgatccacccaccttggcctcccaaagtgttgggattacaggtgtgagccaccgtgcctggccccaactactttttatatttttttgtagaaacagagttttgccatgttgtccaggctggtcttgagctcctgagttcaggtaatccacctgcctcggtctcccaatgtgctgggattacgaacgtgagcccctgcagggggccgacatcaaaatttaaatggccagtcagattgaagtttttctatgaaacatatcttgctttattaaaaatttaaagttttcaaaacatacttgtagaaggcaattttcaaatggttgttatgttttcagatatttttagtaatcagaacaacataattttattgttttactaatcagccaatttttgaactaaatctgaagtcactaagagatgatggtcaatcatgaatatttggaaaaaaatttgtgatataatttatagaaaagaaatgttcagagtgtattgaataattttaataacatataactaattaagtacatatattaactaattataactgtgacattgaaaatataaaatcgactttaagctggtcagcatcaagaagctggaagatgttcatgtggcttatttgaaatcttccgctgtgtatctcctccttcccaaatgatttctcagtaggaagctatgtttgaactcagagaaggagctgtttcttaaaaattaaactgtctctgctgctcccaatagacaaaggtgcttagctggttcccactgaagtacactaattcactgtcttaatttaaatttaccaatatatgcggggcatagtggcccatgcctgtaatcccagcactttgggaggctgaggtgggcgaatcacctgaggtcaggagtttgagaccagcctggccaacatggtgaaacctcgtctctactaaaaatacaaaaaaattagctgggcatagtggcacgcgcctgtattcccagctactagggaggctgaggcaggagaatcgcttgaacctgggaatcggaggttgcagtgagctgagattgcaccattgtactccagcctggacaacaagagtgaaactctgtctcaaaaataaataaataaaaataactttaacaacatagttcttcaattagtccataactaacttttactattagtagggttttcacttaagggtaagtggaattgaacccagtaattcttaggctggaccttaggtggatcacctgaggtcaggagttcaagaccagcctggccaacatggtgaaacgccgtctctactaaaaataaaaaaaattagccgagtgtggtggcgggcacctgtaatcccagctactcgggaggctgaggcaggagaatcacttgagcccgggaggtggaagttgcagtgagccgagattgtgccattgcactccagcctgggcgacagagtgagacttgtctcaaaaaaataaaataaaaacaaattagttgggcgtggtggttcacgctcccagctactgggaaagctgaggtgggaagtaattcttgcatcctgtcttcgttttcctacctggaactgagtcctggcctttgcctaagtgagataatggaaaggaaaggaaagttggagaatctcaggtctggaccttagcagtgaattcagcacaatcgcagaatgttgaggtagaggaaactgttgtagagatcagttgatcagtttttaatcattaaataaaaacgtgaatgaggcagtgaagtaacttccccaaggtcacacaatgggttgctacaagaaatgagaatgagcatttgtcatttcccagtgagaacagtttccattgtgcccggaccttcaaagattaaccttcataccaaagtttttgcctacttgaaaattgtatttaagtacatagatcgtgtgagtgagtctactgcgggaatgttatatacataattaaaattatctctatttcacatttatatatttgtccattaaaacttgcataattaaataaatgtaaaatataactgagataatcagacatctgttttctttaataaacattaatcttgaatagataatatggttaaatgatttcaaaaagataatgtagttacatgatttaaagttatagctaccgaattgtgtgtgcagagaaatcttactcctacccttgccgcccctgccacccactgctgccctctagaggtaaagttttcgtggtttctttttatccttcaggcgtttcttcatgagaatgtaaccaaatacaaatatatattctcgttccgtactccactttgcctacacaaaaggcagcatactgtgtacactatcgtgtctttttctcctgcttttacttatttattattattttaatagagatgagacctcactatgctgttcaggctggtctcaaactcctgggctcaagcgattctcccacttcagtctcccaaagtgctaggattacaggcgtgagcgctgcgcccagccatatcctgtttttttaaagttttctggccaggtgtggtggcccccgcctgtaatcccgacactttgggaggccaagcttggcagatcgcttgagctcaggagtttaagaccagcctgggcaacatgacgaaaccctgtctctaccaaaaatacagaaaattagccaggcgtggtggtgtacacctgcagtcctagccacccgggaggctgaggtgagaggatcacttgagcctgggagaaagaggctgcagtgagccagggctgtgccactacactccagcctgggtgacagagtgagactccatctcaaaaaacaacaaaaaaatttttttttggcctagagataatcccatatacttgtatatgcttagagatcttttttttttcttttttctttttttgagacggagtctctctgtcacccagggtggagtgcaatggcgcaatctcggctcagtgcaacctctgcctcttgggttcaagcagttctcctgtctcagcttgcctagtagctgggaccacaggagcccaccaccacgcccggctaaattttttatatttttagtagagatggggttttaccatgttggccaggctggtctcgaactcctgacttcaagtgatctgcccacctctgcctcccgaagtgctgggattataggcgtgggccactgcgcccggccaccggctaatttttttatatttttaatagatatggggttttaccatgttggccaggctggtctcaaactcctgacttcaggtgatctgcccacctctgcctcccgaagtgctgggattacaggcggggaccgctgtgcccggccaccgttttagtttttacactgaaattattcatgctgcttctgtcttatactgttgtgggttcttgatttatggtgtttcgggcttcattttcacacaacttggaatgtgcgggttttctctgttccctggtttcactgaagatgtcgtttctaatgagagatgtgtatacgtctgtgtgcacgtgcatgtatgtgtatgcagttggcattcattcctgttgctctgtattggtttttagagtgggaagatgtggggctaggccatcattatgctctttctagaactggaacctactagatattaatttttatttacacaaattgtaatttgatgctttaaattggagagggaatcgggtaaattattcggctaaattattaaattgacacatcacttttttttgcagtagtaacgttttgttaaaatgagcgaatttgttatcacattctcagctttcaggaaggtgagctgagacaaagcaatgcttagcatttttctgaaacctttggatgcagtcaggacaagagagaggtgattgtgcccagctttatcacctctggccaggtttctagtgtttgtgtgtgtgtgtgtgtgttgtatttaattgaatgattgctttggacattttctgttttgggggcaaaagtgtttatagtgaagatgggctgggctcagtggctcataccttcagtcccaacactttgggaggctgaggcaggaggatcgctggagaccaggaattcaagattggcctgggcaacatagtgagaccctgtctctacagaaaacaaacaaaaaaattatccaggcctgatagcacactcctctagtcctggctactcgggaagtcgaggtgggaggatcacttgagcccaggaggtcaaggctgcagtgatctgtaatcacaccagtgcactccagcctgggtgacagatcaagaccctgtctcaaaaaaaaaattaaaaagaaaaagaagatggagatgatgaaaggattgaaggatacttattgcttagtcagaaatacagggctatgggccgggtgccatggctgacacctgtaatcgcagcactttgggaggtcgaggcaggaggatcagttgcgcccaggagttaaagatcagcctgggtagctgtagagacaaaagtagtctctacaaaaaaaaatacaaaaaataatccaggcgtgatctcgtgtaactagttccacctgccggggaggccgagtcgggggattgcttgaggccaggaggtcaaggcctgcagtgagctatgatcatgccgctgtactccaacctgggcattggagcaataccctgtctcaagggggaaaaaaaaagaaaataaacatagggctatggaaaaatattcctttatttcagtacccagctccactgggcctttcctttctccagtgtctgttaaagctcagggggataagattgctgttcaggattacttactctcgaatttcgttgtaaccagatcagtgagccagtgcggaaatagctttcttatagtgacttctacctcacggggcatttcaccgcagtgctttctcctctgttgggaaaggacgcacactctgtgctagcgggtggagaactaaagttcattttgtatcctcccagcacctaatccagaacttgtgccatgtgaggtgaccagtacaattaagtctagcccacaaataggcaggaattccaaaatgtgcgttgaaattgtcttggcggggcacggtggctcactcctgtaatgccagcactttgggaagccgaggcgggtggatcatttgagatcaggagttcgagaccagcctggcatacatggtgaaaccctatctctattaaaaatagaaaaattagccaggcgtgatggcgggtacctgtaatcccagctacttgggagactgaggttgcagtgagttgagatcgcgccactgccctccagcttgggcaacacagcgagaccccgtctcaggaaaagaaaaaagaaattgtctgatatttatagaattttcaaagtgtgagaaataaaacttcagacataattcgtgcttcatactatattgaattagatgattttaaagtctcccgtatttaccactgtatttttgtctgcgtatataagttccatgcacctatactatggctaacaatattttactttgactaaaatttgttacacaatacttaattattagtgttacttattattgaaagacattagttgaaatttctttcagcctgatttcatccattttctgccaagaggcaattgtaaattattggattgactcttctacatattgtttgtagttgttaagaaagtacttactggtagaagttgaattttttgttgcccttattctccattgtctgtttagcgaatttttctctgcgatggctcacttaaccattataatgataaaaatgataggtgtgagtgcaaataatttgaggtgctaagagtctgctctgaaatatcctgtttcggccgggcatggtggcttatgcctgtaatcccagcactttgggagattgaggtgggcgggtcacctgaggtcaggagtttgagaccagcctggccaacatggtgaaaccctgtctctactaaaaatcacaaaaattagctgggtgtggtggccagcgcctgtaatcctagctactcgggaggctgaggcaggagaatctcttgaaatcgggaggcggaggttgcagtgagccgagatggcgccgttgcactccagcctgggtaacaagagcgagactacgtctcaaaaaaaaaaaaaaatcctattttccccctaggtcaaagccagtgatatgtaaagctagcatagagcaaaagagtctgagaaccatgatgttgacctgtcttattagaatggtttgatttgcaggtgacacaaagcagaagatgtgtcagaagttaagtctctgcattactgctttggggtgtaatttaatttttagaaggatttttacttagctgtagactgatttttctggggtctcgtggccccttgccattcacaacatgcactgcaacatgttgctatgtagaatgcaccggattcttgccgtccatttggctccgggctgtctctcgtctcttgtgccagatttgcacatctggtccagagcaggagttaaggattgctctagtaagtggattagtagcttttcctaattaccagatctcacaactagagttgcggctgccagaattggtcgttcacagttaacaattacctagatgatgatgaagtacatggatctagtcataaaagcctcggttcaagcagatgtcctgcttcccagctgtgtgatttgagccagttacgtggttcctctaacccagcgttctcacctgttaaagggtatgataatagtgtctacatcctagggctggcaggcactgtagcaatgcacgtacctgcactctcctgaatgcagtacctgaagcagggtgagcactcaagaaagggtagctgtaattcatacgtattacagggcttgattgttaaatattctgtgcttcatggactctcagaatccggggatcacaagactgtactgttacattatgtactgctaaaaggaagtgatggtaagacattaatttacatgttaaaatgtgaaaaaaatgtggatcttagaataggtaaactaaggtaagtcacatttttaaaaattgtggtaaaatactacctaacatgaaatttacatttgagcagttttaagcatacagttcagtgacattaagtccattaacgttggcgtaagccatcatcaccatccatcttcagaactttttcatcatcccaaaccgaaactcttgagcctattaaacactactccattccccactcccgccattctctggtgacccctcttctactttctgtccctgggaatttgtctgttaggtacctcttaagatttagctacatttttatagaaattgaatctatgtgatcagcaagatcagatgaccacatccttttcaacaaagttcttaagcagatatgatctcagcaggggattttctagtttagtggttttggagatgatagaagagagggaggaagtcggagggagtgtagcaggggcttatgtatttttatggtactcttctgtttttgaatgtttacatctttattctcttgaataatataattcatgaagcaggtaaagatacagcttttgttctatttctttccagccacttagccccaatactatttcctgagcaactcatctttttctattgattttaaaaaaggtccactgcagaattttagactgttccttcacaagatgcattgtcagagatgagcagttttcctttgctattttgtgtgacgctttgtaaattcagagataatggaaaagccaaaatgtaaacacaaaaatttcactgtcaataatctggctctttttctatgtaaataaggtctctcaatttttctctccataggaagaactaaacagttctatttaacctttttaattttatgctaaatttattttactctaatggcacaaccacctctcatttagttgtgccagttaagagtaatattggcagaagtaaattaaatcagtgtgtaatgtgcccgtttgagttaggaccttggaaaacgcagcaggaatgcgaactcagcagttggagaaggcagagacagggtggcaggtgggaagccctcccagccgtgggtaccatttttgttctcagggcactctaggaaagttttttgagttgcctttgtgtgctgcaagtacccttggtgagctgcccacatgaggttgacttctgccttttagagccaatcactaaggcaaagtcaaattccataaatctgttatttcacaaaatgaggcatattttacagttttaacattcttcagctccatcaacatttgtgtaaagagtgatggcaaatacatgctcttatggtggcatttcttattttctgcttgagacacgctcatttccccccctttacttttaatcttcctgtttccttgacacacctgcttccgaaccccattgtcatctctccccgctgtgacagttcaccagcacttcatggtactggagactctttcaacttgccttttccaccaactgtcagttgcaaaataaggttgctttgtttgggagggagagggtggaatcctttctgaatgtctcctgttcctttgaagcaggagcacttcagagacaactgaactgcttttaggtttttcttaccacccagctttttcttctgattgatcctgccgtgaacacacggttctgttgatgacatcgatttgttgctatggaaatagtggtaatgtcacagattcaacccagtgactttactgcaggttgttgcaggagaaatgggcaaggctttaggggagaacctcattaacactgaaggctatcaattctaagcaggtgaaaggtagatggagccaaccttttgtgtaatgaaaacaaaaagtgaacccctagcaaattcaccgagtgccatggaatgcctcagcacgaattctaatccatgggagtctttgacaaaataaaaaatttacactttcccagagcattccttctacccaagtttaaatctcttaacccaaatcctttgcactaaaacggggtttcccttttgatcttcaggactcgggcagccgcaagtagctcctccagcgccagcagccagcccagcagcaagcagcaggccccagccgcagaatggaagctcgggaatgggtgagatgcctcacggggcgtgcgctgaccaggggtgtcagacttcggaatcatgttttgaagttgaatctgggactaaagggagttttccaaatgccattcattacagggttgtgtcttggaaagaataattctgattcatattttagagtatgtgattgaaaaaataattaaagattgtctttttttttttttttttttttggaagtagggtcttgctctgtcagcggggctggagtgcagtggaagcatcacagctcgttgcagccttaacctcccaagtagctggtactatgggcgcatgccaccatgcctggctaatttttttgtagaaatggtgtcttactatgttgccctggctggtctcaaactgccctggcctcaagcagtcctccgtccttggcctcccaaagtgctgggattataagtgtgagccagggtgtccagccaaagataatcttaaagatacttaacagccagacttttaaaaaagatcaaattgatacattcttctctgttagtagttgaccaagtagtttcttcgtttcccacatcatcaggttttacaccctctgactttgcattccttttaagttcttgccttttaactatccaggacccacttactaagtttggctcatctctctccgagtttcctattttgggcctcgtgggtgtttatcgtttgcttgaagacagtattacttatattggtcataggttctccttctcaatttcatggatgagaaatggtttcttcatttacttttctctgcagcaggtcctaagaggcattaatggaatcattttgtttactttctggcctttactttaggaacctcttgatctgggaagtcaccgttgaaaatttggatttgtagaatgtggttggatttatttttagaggtccttttttctgtcacggcttcacatacacctcctctcctcccctcaactattagtttctatttttcagtgctaagattctgagaaaagcaaggttaagatgtcactgatgtttctgtgaaactctcaggactttcccccttgccctttgttgtttttaatctaccttgcacgatccgtctacctctctcgctcttgcacgttctctctcttgctctgtctctccttttataagaggatctatttatacacaactcaaaaattacatgctgttggccaggcttggtggctcacgcttataatcccagcactctgggaggccgaggtggacggatcacttgaggtcaggagttcgagactagctagcctggccaacatggtgaaaacccatctctactaaaagtacaaaaattaatcgggcatggtggtgtgcacctgtagtcccagctactcgagaggctgaggcatgagaatcatttgaacccaggaggcgtaggttgcagtgagccaagtttgcgccagtgccctctagcctggacaacaaagtgagactctgtctcaaaaaaaaaaaaaaaaaaaaatatatatatatatatatatacacacacacacacacacacacacacacacacttttgaagagagtggtgaaatagactctctaaagtggtaaataatcatttccttaggcttatatacaaatagtacgttattcctctccctccctccacagaattatttttctggttgtctatctttgccttatgttaaaatatatttttaaaaatctgggctgggcacagtggctcacacctgtaatcccagcactttgggaggccagggcaggaggattgcttgagcccagcagtttgacaccagccaaacatagtgagacccgatccctctaaaaaaatctttttaagaatcagctgggcgtggtggtgcacacctatagtcccagctactcaagaagctgaagtgggaggatcgtttgagctcaggagtttgaggctgcagcgagctaagatcgtgccacctgcactccagcctgggggacagagcaagaccttgtctcaaaaaaatgaaaatcagttaatgttccctaaactatgtagtgaaaggaaatgaactggatgtgtactgaggagaagctacccagcatgaaatagattggatgaatggatgcttgtgtgtgttttataaaattatatattatgtatgggtatacacatgtattctacaaagtacctgtgtgtccttacacgatcttgaggtaattactattgtgtgtgtattgatctctctcgactccccagttagaaaatttcaacacagaaacactcctatgtatattttttactaattactacgaatgcctagaagggtgtggcacatgccgtggaaacccagtaaataaatactggatagatggtgtattgatatttttagccaaattctattctgaagaaatgttttgatgtagagggtatgaaatcactgaactaaattatattttctgaatttggacgttgagttttgcagatacgtggtgcgtataaaagaactcacctgattccctgttctttcccagcgcagggcagctgcttaggtttggattaaggaggcggaagggtcttagtggtcacccacttaacatatcttgaccaaaaactgattcctgccctttgcacccgacgaaactcattcttacagacttcattctagacttgctagtccttcagacgcattgagatctgggagttgtctggggatttggaggcgatctatttgtgataggtcccttacatcctgtctttcttcatgtgactagtgccttgccatcagttttaccagttacaaaagttgattttctttttctcacccattatcttgcccgttgaggcaagagaagtgtttaagagggcggccttcagaaacagcagtgtctggattcgtcaccattattactttgacctcggggctgacatcagcaaacatagcagtgagctgctgtgtgcgcagccttcatcctagattgcttttgtagcctccagcctcagtctctatttgatctgcgtatctcttgcatataaaaaggaaaagctttgcctctcatgttatatgatttcactagtggcacctccaaaatttagagttattgtaaagcttactataaaaaagctaagtagaatagtaataactccttttcgtttgcgtttgtttttaaaggttctactgtttctaaggcttatggtgcttcaaagacatttggaaaagctgcaggtcccagcctgtcacacacttctgggggaacacagtccaaagtggtgcccattgccagcctcactccttaccagtccaagtgagttgttgcatagagtaagttcagagtgtacttatgaaatcggagaagctattatggactcttgagttatttatgcgtgaacttcagggtcaccaccaaataccaccaaatagaatgggtttactcttttttttttttttttttgctgaggaggaaaggggtacaaattgtggcaaacttttaactcttgttggaaaatatagtaacaatagcaatctgccatagcctgtggggtttcattcattttgaaagaatttgaaattaaaaatacttaatgcttaatcagttgatagtcttatgagtaaaaataaatatttctgataattcaaaaggcatttaatcttctcctataaacaggtgacttcgtctttggtttagttggctaaaataatctgcactatttgtattaaacacatgaacataccctgaacataaatttcttttatatgacttttttccaccaaaaattaatttgaagccgggcgcggtggctcatgcccgtaatccccgcactttaggaggctgaggcgggtggatcacctgaggtcgggagtttgagaccagcctggccaacatggtgaaaccgtgtctctactaaaaatacaaaaattagccaggtgttgtggagcacgcctgtaatccccgctactcaggaggctgaggcagaagaatcgcttgaacccaggaggcggaggttgcagtgagccaagattgtgccactgccttccagcctgagtaacagagtgagattccgtctctcaagataaataaacaaaataaagtaatttgaatagttaaaaattagagttcttttttcagaatccttccagatatgtttatatttattcttcaatactctgtaacgtaggaaagatatttttccctgtgaaattataagtggggtacctaatgtgccctgtgcctcctttttccatgcttctctctaaggtcatgctgcttcagtgtgttcttcctgatggtccaccaacatcgtgtattctattcagggtgtgttacgaatgagacagaagtgtaacaccagttatatcagttcccataattgaaaactgtggcaaaatataattgctggtgttactgtattttccagcttagaacctttcattaaggggatatggttgccttggtgatgctttttggagaagggagagagtttataaatttacttatttgacaggagaatgagttagtattaaatcactttgcatgttttactatttgcttattctgtaaactgtcaaacccatgtgtcatcttggggttttaattagctggattaaaatacaggttggaaaacggaatatgcgtaagacgagaaaggctgtaggaagatgatttcttacttgatcttttccaaggaagaccccatacactaatatgatcgatttggtttgtaggtggaccatttgtgctcgtgttaccaacaaaagtcagatccgtacctggagcaactcccgaggggaagggaagcttttctccctagaactggttgacgaaagtgtgagtgtttgtcatgctggggagtgagggcagtgggctcgccgggaaacagaaggctcagctctgcggagggcagtgggctcgctgggaaacagaaggctcagctctgcggagggcagtgggctcgccgagaaacagaaggctcagctctgcgggcctatgaggtgaagaataatagtaggccagagagaagcatgattgttattgtgcttttccctctgtcatagtcttttgatgctgtctggagtagagggttaaggtcataaataaaatctttgatcttaaatgacagcgtttgtagcagtagaaagtagttttctaaatatataagtagcctcctgggcaggagaagctggaaacagtctgatttgctggcaggtgtactggaagcactgggaggtgatgcctgcttgtgagcgccgtggagctttgggacacagcagaaggcacacagttgtgacctcgatatgggagtggttttgtgggaaatgggttctgactgtgcagattctctatttgctttatttaaactaaacaaaaccatgacgatgagacaaaattcctatgccatggaagtacgacagtcttgatagctgttaatcagtccattcgttttgctaataattcctgaaattgccgggtgtggtggctcacgcctgtaatcccaacactttgggaggccagggtgcacagatcacttgaggtcaggagttcgagaccagcctggccaacatagtgaaaccccgtttatactaaaaatacaaaaattagctgggtatggtggcaggtgcctgtagtcccagctacttgggaggctgaggcaggagaatcaatcgcctgaaccaaggaggtggaggttggagccagccaagattgcaccactgcactccagcctgggcgacagagtgagactccatctcaaaaataataataattcctaaaatgtacttcagcattcttttcaaagtgctgcagatttcctgtttgttcagactcccaaatagggagaaaaaaatagatgttttttttggaagttgatataacacccaaaatgtttgtgtgatggcagaatcaatattagaacctaatttttttttagaaattattgctctaatgtatggtggttggctaaaatttcttgtccacttgtaaattttggctgacagaaaagcaaaagtgaaaatcagatcacaagcaacttgcaaacatgacttactctgacatttttggcaatggctccgaatgtgaagtggtttgtcactgagagggcactgtggagggagccggtgaatcaccccgtggcagcaccttcctcgtgggctctgggcgtgtccctcagtattcaactttttttgtttttattgtcagaataaattaaactcgtcattgccgttttgttctgttctgtttctcagttgaggctaatgcagcatgattatgggatcggctagctgaaattctcattcttcagcggggccagtgacttcagtgtgtgactgtaaaatgcgggttcctgggatgtccgtagccctctctggaccctgtttgtgcaagggccactgctctcaagatgtcactttggtgctagggtggcctgtgttctatcccagtgtcacttgggtgctggggtggcctgtgttcaatcccgcagccctaacctgcccacgtgcttctgcagggtgaaatccgagctacagctttcaatgagcaagtggacaagttctttcctcttattgaagtgaacaaggtatggccgtgctgactttagaactgacaccgcctgggggtggagtgcggatgaaaagacgctggcccaggggaggggtgtgtggtggcagactaggggtttctgtccgatttgatggtagtctcaggttctgtggcttggcctccttcgcaggtgtattatttctcgaaaggcaccctgaagattgctaacaagcagttcacagctgttaaaaatgactacgagatgaccttcaataacgagacttccgtcatgccctgtgaggacgaccatcatttacctacggttcagtttgatttcacggggattgatgacctcgagaacaagtcgaaagactcacttgtaggtaagctcgtgtatgagaaggaagagcagggatgactagctttctttgcagtgtacggggtggtgtcaggcttcagtgcttgccgttcatcatttgctggcgtcggaatgggagtcttgaccacctcctgctaacacgtgcatgtgttttagacatcatcgggatctgcaagagctatgaagacgccactaaaatcacagtgaggtctaacaacagagaagttgccaagaggaatatctacttgatggacacatccgggaaggtggtgactgctacactgtggggggaagatgtaagtgctgggatggggtcttcaacacgcacaggacctcctggggttggggcgtggtcttgtcctataggatggggccttcagcacacacaggaggagctcctggagttgggggagggagtggtcttatcctataggatggggccttcagcacacacaggaggagctccaggagttggcggagggggcatcttgtcctataggatggggccttcagcacacacaggaggagctcctggagttgagggagggaggggtcttgtcctataggatggggccttcagcacacacaggaggagctcctggagctggcggagggggcgtctgttcctataggatggggccttcagcacacacaggaggagctcctggggttgggggagggaggggtcttgtcctataggatggggccttcagcacacacaggaggagctcctggggttggcggagggggcgtcttgtcctataggatggggctgttagcacacacaggaggagctcctcgtgggggcggttttgtcctatgagttgggggctttcaccatgtagatgggaaggattgtgctgtctggtaagtatttaaaatcctttatcttacttctgtgagatttgctgtgattcaagctttacgcggggaaatgctctttcccctaactctaggaaagcagtgatagttttgatgtgtctctgagtagattctcatgtgtgaggtctgtcttgtatggattccatgtacgctgattacattcactctactattgaatgtttgccttgttttctataaaaatcttctgtgttcttcctgctagtgacacttgtatatgtctggtgtttcttttacaggctgataaatttgatggttctagacagcccgtgttggctatcaaaggagcccgagtctctgatttcggtggacggagcctctccgtgctgtcttcaagcactatcattgcgaatcctgacatcccagaggcctataagcttcgtggatggtaggttttgtggggctaaacaaagggttacttgaggctgggctttgagaaaagctggttacaatcagcatgggagctttctgccaagcagaagccttcgtccctgagtggtgcagcttccgtgtttcttgaaggcattatgccttctgtgaggagggctttaaagcccttaaacggacaaacctgtaatcccaggacaaacctagagagtcggaggaggcaattagcatgtaagtgctgcctgctgacctcgatcctgccaaaggaggggacggccaggcttcagcagcggtgtgctgaaggcgcctttctttccagggtttaggctctgggcctctgtggcgtgggggaacacatgctttctttctctgtcaagtctttggtgccgatcacatcttctagtgtgtattcactagactctgatcaagtgtggtgagaacaatgggctttttgttaggattagattgttattcccaaagcactcaagggatgaggagagcctgttaaaatctcctcactgtatctagctttttaggacattcaaactctgtcttaaaagagtacttcaaactgagacacaggatgcaagaattgatgtggtcagggaaaacactttcacccaagcttcaataattcccatagctgtagtctatgggggggaagtgtgtcagtttccagctgtgtcttaggatttaagcagctaaagaatgagctcattttacatactcctcctttgttttgagtcatttaaaccaatggcactggtgtttgaccagtttcatgaagcatcttctggaatgttcatgtcactgagccatcctcatgagtagtacggtccacacgtatctgccgaactgcagggcccgttcatagtctgaccagaactagccacagatttgcttttttcttattgcttgattttcttttaggctctggagttcgactccaggttaattgcattcccacattaaaatcgcattcccacattaaaattgcattcccacattaatgtcttcatcttttacttgtcaataatcatgatcccagtcaacataaaaagcacggctgtccccagaataaaataacttggcattgatcaaagacaagctcagtgcatacatgatacctggacaaggattagagatgtttagatcttggctataacaatgcagagtttttattgtaagaagggccgccttgactcctgacgagtgatctttggtggcaaatgtctccttggagcttttgaaaccgtgaacttgtgtagctagtagtggtgaaacagatggatgggccttgctgtgcccctgtgagggatttagccgcttacctgacaggagaaggcagctgtctgcagctcagggtaacatccattctgttagatggtctctgtttaaggaacctgttctttgtgtggttacccaccttgggatggtatttggcctttcatctccggccagctcctctccgccaccactgtgttcccgagccactttctccttggccccttttccttcatatcaattgatgtgtgatcaagaagtacaatcagttttcataataatttaatacaaattaatttagcttcgatattagcaaaagtaaaatttcactaagaaggtaaatctacaagaaaaaagataatgccttctgataagttgctctggtttataaaatcttttgggccaggcacggtggctcataccttaattccagcactttgggaggccgaggtggacaattgcttgaggccaggagttcaagaccagcctggccaacatggtgaaacctcgtctctacaaaaaatacaaaaatcagccgggcctgtagtcccagctactcggtgcgtgcctgtagtcccagctactcgggaggctgaggcacgagaatcacttgccaggaggtggaggttgcagcgagccaagttggtaccaccacactccatcctgggtgacaaagcaagactctgtctcaaaacaaaaaaaccacttttggcttctgtatcaggcataggaggccttttatggaaacacttttgctaccacggtatattggctgtccgtttccacactggtacatttcggtgatgatcaccacgcagctgctgcctgagaatgagcattagcagattaaaggactaccccagacggccactttatagcttacgggttgttgactttcccagtttctgattttaggcctggggtggtctggccactgccaatatgcaaggctagtttaagaaaagattctttggtactttggcactgattctcttcaccactggggggcatcaaagcaactgagattcaaagaaaggtcattccgtttcttcagtagactttgggccaggagcagtgcctcacgccctgtaatcccagcactttgggaggccgagggaggaggattgtctgagtccaggagtttgagatcagcctggccaacagagcaagaccccatctcttaaaaaaatttttttttcgagacggagtttcggtcttgttgcccaggctggagtgcaatggcgccatctcggctcactgcaacctccgcctcctgagaattgcctacaagtgattctcctgcctcagcctcccgagtagctgggattacaggcacccaccaccacgcccggctaattttgtatttttagtagagacggggtttcaccatgttggccaggatagtcttgatctcttgacctcgtgatccgcccgcctcatcctcccaaaatgctggggttacaggcatgagccactgcgcccagcctaaaaaaaatttttttaatgggcctgggcatggaagtcccagttacttagcagggcaaaggtgggaggatcactgagctcagggggtcaaagctgccttgagccatgattgcatcattgcactccagcctgggtgacagagtgaaactctgacacaattttttttaatttaaatattataaaaaatatataattacgaagataccagcttcagccgacatgaccgtgacctgtgtgaaagctgggcgggtggtgggaaacctgtgtctgtcgcgtagcagcaagttgcatgtggagaagcagaagcatgtcacatcaagcgctcgtcatcgttattcgttcacgttttcaggtttgacgcagaaggacaagccttagatggtgtttccatctctgatctaaagagcggcggagtcggagggagtaacaccaactggaaaaccttgtatgaggtcaaatccgagaacctgggccaaggcgacaaggtacccagcattcctaaccaccttcacaaagggctgtaaagtgtgcagaaggatggatttagaaacttggtttccagcaccagctgtcagagccgtaattcttacccggggctgtgacctgagcgtggcatgggggttgagaatcactggcagagggaagcagccaggtgtgctcatgggaatatgtgttacccctcaggggactggaggcaggagagtctgaagaactcttagagtcaattcctagagggatcttggagcaggggtgacagtcaagctttgtggtataatatcacctgctttcgggtccacgtttctttcctgtgatccttcctgcaaatttaagcgcccacatatcaaaaagatgttttttgagatgagcgttagtccgcctcaggtcagacatgaggcagtttcacgggtgctgttcctggctgtagaatagtgtattaacctcataggctgagagctgccggcattcccggacaaggattggccctgacatttgacttttagttgcagctttttcctttcagtgtttgtatttaatgaccctcctcccatcttgatctaagcctgtgttctgccagcagtttagtatttagatcatttatttctcctttacgcctgctcttttattttcatcatatacagtgtaggtttcattcctcctgtctcatttcactgtatacccttatccatcattgtcaacagcagctcttaagtgctcttatagaacatctcaagaattaaacactggacagatcctcgttgtcctgtcatgggacacccactctttcggttctctgtaatcccagctacccaggaggctgaggcaggtggattacatgagcccaggagttcgactgagcaacatggaagaccccttctcttgaaacaaaaactttattgctgaaaaatgctgacaatcatctgagtcgtaatcttcttgctggtgggggtttgtttcagggttgatggctgagcagtcacggcgatggttgctgaacatcggcgtgtctttggcagtttcttaaaataagacagcagtgaagtgtgccacattggttgactcttcctttcacaaaagctttctccatagccggcgatgctgtttgacagcattttacccacaggagaactttttcaaactggagtctctccctctcaggtcctgtcactgctttatcagccaagcttatgcaaattctaaatcctttgtcgtcatttcaacaatgctcacagcgttctcaccacaagagatttcatctcaagaaagcactttccttgcccatcgtaaggagcagctccttatccgttcaagtttgatcgtgagattacagcagttcaggcccattttcaggctccatttgtaattctagttctctcgttattttcgtcacatctacagatccctcctccaccaaagtcttgaagcctcagtgtctaccttgagggttggaatcaacttgttccaaactcccgttgatgttgggattttgatctcctcccatgaatcatgaatgttccttttttttttaacttgagacagggtctcattctgtcactcaggctggagtgcactggcttgatcacagctcactgcagtctcaacctccccaggctcccaagctgggactacaggtgctgccacacctggctaattgtattttttgtagagactgagttgtgtcatgttgcccaggctgctctcaaactcctgggctcaagggatctccctgcctcaacctctcaaagtgccaggagttacaggtgtgagcgactgtgcccagccaactgttcttaatagcatctagaatggtgaatccttttcaggttttcaatttactttccccagatccatcagaggaatcactgtggcaactatcgcctcatgaaatatgtctcttagacttaaaaagtcaaaattactccttgatttgcatgggctgcagaatagatgttgttatcaagcatgaaaacaatattaatctccttgttctgtgcatctccattgagccctcgggtgaacaggtgcattgtcaatatattaatctccttgtactgtgtgtctccattgagcccttgggtgaacaggtgcattgtcaatatattaatctccttgtactgtgtgtctccattgagctcttgtgtgaacaggtgcattgtcaatatattaatctcctcgtactgtgtgtctccattgagctctcgggtgaacaggtgcattgtcaatgagcagtcatatttttaaaggagtctctttttctgagtagtaggtctcaacagtgggcttaaaatattcaataaactacactataaatagatatgctgtcatccaagctttgatattctatttataaagcagaggcaaagtagatttagcatagttcttatgagccctaagatttttgacatggtcaatgagcactggcttcaccttatagtccccagctgcattcgcgcctaacaggagagtcagcctttcctttgaagctttgaagccaggcattgatttctactctctaggacgaatgttcttgatggcatcttcttccagaaggctattctgtctacgttgaaaatctgttgttgagtgcagccaccttcattggtggtcctagctagatcttctggataacttgctgcagcttctccatcagcacttgctgcttcaccttgcacttttgttatggtgacggcttatttccttaaacctcatgaaccaacatctgctggctgccatcttttcttctgcagctttttttttttttttttttgagacagagtctcactctgtcacccaggctggagtgcagtggtgcaatcacagctcacctcagcctctggagtagctgggactacaggtgcacaccaccgtgccctgacagatttttgtagagactaggtctcactatgttgcctggctggtatcgaactccttggcttaggcaatcatgttgcctctgcctcccaaagtgctgggattacaggtgtgagccactgcacctggcctcttctgcagcttcctgacctctctcagccttcacagaattgaagaaaggtgaggccttgctctgggttaggctttggcttaagagaatgttgtggcttgcttgatattctatctagaccactacagcttactccatatcagcagtaaggctgtttgctttcttatttgtgtattcaaagaagagagacaggaatacttgattggaggatcagtcagcatacatacaacattcatcaatataagttccccatcttatatgggtgtagttggtggcaccccagaacaactacaatagtgacgttaaagatcactgtaggccaggcgcggtggctcattcctgtaatcccagcactttgggaggctgaggcaggcggatcacctgaagtcaggagatcgagaccatcctgaccaacgtggttaaaaccccgtctctactaaaaatacaaaaattagctgggcgtagtggtgcatgcctgtagtcccagcttctcgggaggctgaggcaggagaatcgtttgaccctgggaggcggagatttcagtgagctgagatcatgccactgcactccagcctggtgacagagcgagactccgtctcagaaaaaaaaaaaaaatcaccataacagatatgataataatgaaaaagggccaggcatggtggcttactcctataatcctagcacttcgggaggccaaggtgggtggatcacttgaggtttggagttcgagaccagcctacccaacatggcaaaaccccatctctactaaaaaatacaaaaattagccaggcgtggtagtgcacgcctgtagtcccagctacttgggtggctgaggcaggagaatcacttgaacctgggaggtggaggctgcagtgatcagagattacaccactcactgcaccccagcctgggcgacagagcgagactctgtctcaaaaaatacatatataatgaaaaagtttgaaatcttgcaagaattactgtctttatgtgacacagagacataaagtgagcacctgctattgggaaaatagtgcatttacttgacccaggggtgccacaagtcttcaatctgtaaaaaatgccgtatctgtcaagtgcagtaaagcaaagcacaataaagtgaggtgtgtctgtagttgcagcagagactgtgaccaaatggctgctaaggcctgaaatatttactgtttggctttttacagaagcagcttgctgatccctggcctaaacaaggaaaaggtgaatctaggcctagacacgactgccgtgttttgagcgcgggagggatggttgatcgttgctgcactgggtgtttgtggtccgcattctgtatttcctagatctgtggcctttggagggtcagaggatcgggaggaacaaatctttgtctttcatacagtgttcaagcaaacaggaaaacaatttcacttttaattaacttagtgtaatttaggattaactcttttattgtgaaggaattatctgcctcagaacttggcttattagaacttggcttattaccttcatgggttttgtactcggcacatgtgatttctaaaactacagaatgaatgattccctgtgatcatgtgtaatcttgaggatgtagaaacacttaccacctaaacgtaagggcaggctttgagctgcctctcggtccgatcctgggcgggctcgcgactccgtgcctcatgctgttcttttctcccgaagccggactactttagttctgtggccacagtggtgtatcttcgcaaagagaactgcatgtaccaagcctgcccgactcaggactgcaataagaaagtgattgatcaacagaatggattgtaccgctgtgagaagtgcgacaccgaatttcccaatttcaagtaccgcatgatcctgtcagtaagtagcctcggtagatgagaaccacggttgtgttcacggaggccctcccgtgtgccaggcactgtggtcacaacagtagagacaaagcattcctggtaggaagcccgcagatgagtaggtgtggaagagcttatccatccgctttttcatgccagaaagtggtgttgagataccccagctgattcagtctttcatgcacgtcatacagccatagcgtcagtgacacttgcctgctaactgctatgaagataaattaatttgaaaacggcatttatagacagcactaattgtacttacacagccaatgcccgtatttagtcactttcatgtggataatctattctctagctttagtatagctgacttcagaggaatgtgacggtgtgctgatgtgagattgttgcttttttgcattttaagaattgtttctttctgttttaaaaacctttttaaaaaagttgtaaagttgggtttaaaaaaatttttttttttttttaagaaacaggggtctcactctgttgcccagaatagagtgcaatggtatcatcacagctcatggtggccccaacctcccgggcttaagcagtccttccaccttggcctcccaagtagctgcaactacagctgtgcaccaccacacccagctaatttttaaaattattttattgtagagacagggtctcgctctgctgttcaggttggtctcaagttcctggcctcatgtcatcctcccacctcagccttccaaagtgctggcattacaagcctgagccactgcacccggccttaagatttttattttgttttgttttgttttcaatgatagaactaggcgataatagcagtttaagaaaacagtttaaggccgggcacagtggctcacttttgtaatcccagcactttgggaggccgaggcgggtgcgtcacctgagatcaggagtttgagaccagcctggccaacatggtgaaaccctgtctctactaaaaatacaaaaattagccgggcgtggtggcgggtgcctgtagtcccagctactcgggaggctgaggcaggagaatcgcttgaacccgggaggcagaggttgcagtgagccgagatcacaccactgcactccagcccgggcgacaagagcaaaactccatctcaagaaaagagaaaaagaaaacagtttcacatttttccaaaggatgatttggcagtaatatatcagaagcctgaaaaatgttcatattggccaggcgcagtgacttgtgcctgtaaccccagcactttggaaggctgaggcaggatgattgcttgaggctgggagttcgatatcagcctgggcaacatggcaagaccctgtctctacaaaaagtaaaattagctggctgtggtggtatgcacttgtcccagctactcatgaggctgaggtaggaggatcgcttgagcccgagaggtcaaggctgcagtgagccatgatcgtggcactgcactccagcctgggtgacagagtcagaccctgtctttaaaaaataaataaataggccgggcacggtggctcacgcctgtaatcccagcactttgggaggctgaggcaggcggatcacgaggtcaggagatcgagatcatcttggctaacacagtgaaaccctgtctctactaaaagtacaaaaaaattagccaggcgtggtggcgggcacctgcagtcccagctactagggaggctgaggccggggaatggcatgaacccgggaggtggagtttgcagtgagccacgatcgcgccactgcattccagcctgggtgacagagcaagactccatctcaataaataaataaattaaattaataaatgataaataaaatgaaatgttagcttagcaggacagttctacgtttaggctcattttttgtaaactataaacttttcattgaactaagatgaagaaaatttgttttagtttgtggaaacatcagcctttctgttaaactccacagcgcaatctcccgcacacttgtttgatttgatatttatcacacgtgtgcgtcattgtagttcttgccctgtgtgatgagatgctctttgcttcttagaaggatagcgtgggttaaaggaagtgtgagcccagggtgtgataccgttgctgtgtattgagagcgcttttcacttttaactggtttcgtcaccttatttttcgtcataacattctctctattaaaagccttgtacccatgcaaaatgaagatgtaaaatcgtcaaaatgatgccttaaagaaaaaccactcgtgtttctacaaaggcttttacttcagcaagtggattctttgagatctgctttcttccttgactttgccctgtttaatgttacaccacagcccagtgggagacatttgattgctcatttcctttgccaggtcaatttggtgactgacagaggctcacgggcaggctcttcagttgtctgggtgcccagcagtgacagagccgtctcatggaactcctcctaggaactacagagtgggcaattgaaaatgcagagaactcccccgattcactcaaaacccttcatccaaagccagctgcacctcgacaggaactaatctgatgggcctctctctgtcacccaggctggagtgcagtggctcgatctcagctcgctgcaacctccgcctcccgggttcaagtgattctcccgcctcagcctcctgagtagctgggattacaggcacccgccaccatgcctggctaatttttgtatttttcgtagagacggagtttcaccatgttggccaggctggtttcaaactcctggcctcaagtgttccacccgccttggcctcccaaagtgctgggatgacaggcatgagcccactgcacctggccctctctggaaattattttaataagtggaaaaagaacattaacctctccccatcttctcagtgtgtctttttattatttctttgctgaaataatgtagaattgtgttttttaggtaaatattgcagattttcaagagaatcagtgggtgacttgtttccaggagtctgctgaagctatccttggacaaaatgctgcttatcttggggaattaaaagacaaggtcagccacatattttattataacttctataacttttaatggttctcattctataacactgaccccacacatttttttttttttgagatggagtcttgccctgtttcctaggctggagtgcagtggcgcgatctcagctcaccgcagtctccgcctcccgggttcaagtgattctcctgccccagcctcctgagtagctgggatgacaggcacccgccacgatgcccggctagtttttgtatttttagtagagacggggttttaccatgttggccaggctggtctcgaactcctgacctcatgatctgcccgcttcagccacccgaaatgctgggattacaggtgtgagccaccacaccttgcccaacactggccctctttttgctgtttaatattttttagtttgtttctttttggtattgtttgtatacagtttctcagcctgataattatttaagagctcatctgatgttatctaatcttgtccatttgggatgtgcttaacagtgaaataatgtatataaaagtactttaaaaccaaagcactttctaaatcgaagccacccgtttctcctgttcctattagcacatcagagctagtgtgcctgagatgacttaggtcgggaggtgtccctgaaacaacctgaattattacaggcatgcttttttaacatagtaaataccttccagaaaagttgagtcagatcctggttaaaatgcacgtatgtcaagttcctgggtctgtcctataaaacaataataataaatgcacatataaggtgcctgccatttcagcccatcagatgcaattcttatgcggtgactttcttccgtaaggtaactttgtccatttcatttttataagtttgcattttcacatattaggtttatttaatgtacagaatagattgctaataatgctgaatttaggaaaggtagttgctcaggtaaaacataaggaagaccaataaaagctatgttttctgggccacataaatgggcacctttctgtagatggcttttcccccgatttcctccaaattggttggaatacttgtaaaggccacaaagatgaaaggctttgccatttgttctggtgtgtttttctttttcttcctgtccccagttctgtctgtttgggctctgccctgactctttttttaaattgtccatgagagctctcaaaatagtctcaacaaatcctgttacagaaataactagaattgactttaaagtgtgatagtatcttttgtctgtttttacctggtcttcaattttcgtatcagattttaaggcccgagtaagcctttcaggatttttatgagcttattatatttgactgttttttctgccggtgaatgaggacatatagaaacttccccgaggaaccgtgagatcctggagttcgcactccacgcccctcatcttggaagcataatggcagccggtgtaattttctcaagctttaacccattgttttattttcatatctgaaagtccatttggtttgggtttgggttttgatcaagtaacctttacagaaaagagttctgtatagcaaagctgctttcacgccgtgcgtgacttgcaaaaaacactaggttggtgtgaactattaattagtttttctttttttttgtcaaaggtctcaatcaactctgttaatatagttattacacatttatttatgcatctttatacaaactatattctctaattcttgtctgtttaccagacttttttttttttaataaacttaaattgcatttgaggagtgagagagggaaaaggattgtttttaggccttccctagcctttgcgcacctcaacagtcttctctgcttgcacaccaaatcagtagctataaatacagaggctgaaatcacgaattatattgaactttcttctgagtgtttttcctttttttcttttttttgagacaaggtcttgcctcatcacccatgttggagcgccgtggtgtgcgatcatggctcactgcagcttcaaactcttgggctcagacagtcctgccacctcagtctcctgagtagctgggactactggtacacgccaccatacctggcttaagtttttttttttttttttttggtagagatggggttttgctatgttccccaggctattcttgaactcctggcctcaagcagtcctcccacctcggtctcccaaaacattgggattatagtcacgcgccaccatacctgacctcctaattttttttttttttgagagtctcgctccatagcccatgctggagtgcagtagtgcagtctcagctcactgtagcctccgcctctcaggtcgaagcaattcttctgcctcagcctccctagtacctgggattacaggcacctgccactatgcccagctaatttttgtgtttttagtagagatggggtttcaccgtgttggccaggctggtcttgaactcccaacctcaagtgatccacccgcttccgcttcccaaagcgctgggatgacaggtatgagccaccgtgcccagccttaaagtcttagaaacttcctaagagcgtttttaattttttgtgtctagtaaagcatacataaccaaatttgcctttgtaaccatttttacgtgtacagtttagtggcgttaggtacattcacattactgtgcccctgtcaccaccatccttttccagtacttttttaaataggcaaattcatagagacagacgacagccttgtgttttccaaggatggagggaaggggagaatggagacacactgttcatgggtggcgatttgaaactctgcacattaagcaatagctccttttccaaaaccctcttctccctggccctgacaactgccattctaccttctatgaatgtgattagtgttttaattttcaataagattctacttaaaacagtttcatgtaatgttacctgtagatgagtcattcctaagtaatttgaaactacccaggagatgcattttcagaagtctttttaaaagtcttatcagtatttgcaagttgtccagtggtttccatgtgtcaagttttatgtttgtttttgcagaatgaacaggcatttgaagaagttttccagaatgccaacttccgatctttcatattcagagtcagggtcaaagtggagacctacaacgtaagtaagggcctgggcagcagggttggtggtggggaggtgctgtttgtcacctacggcagtgtcgtgacactccctggcagggagttactgtactcactgccagaccccggtgctgactttgcccaacacaggtgctgttatgatccccattttcagatgaggaaggagagagagcttaagtgtcttgtcgaaacaatggcgggggggtggggaatacaatatggatttttttgtttgtttattttttttatttttattttttttcagttaaatcctaggattttttcgtctgtgttctgacaaaaaaattataacgcatgcagtagagtcatatctttgacaaatttagattgtagaaaagtatattaagtatatgagccgggcgtggtggtgtgtgcctgtggtcccagctacttgggagactgaggcagcagttcaaggccagcctgggtaacatagtgaaaccccgtttctaagtcagtcagtcagtatatgaaacaaaggccacgtgtggttaaaactaccttgaaaattcctgaaattgcccataataccatatagtatttatttatttatttatttatttatttatttatttatttatttgagacagagtctctgtcacccaggctggagtgcagtgggacgatcttggctcaccacaacctccgcctcccgggttcaagtgattctcctgccttagcccctcgagtagctgggattacaggcgcccgccaccatgcccggctaatttttgtatttttagtagagacggagttttcaccatgttggccaggctggtctcgaactcctgacctcagatgatccacccgcctcagcctcccaaagtgccaggattacaggcatgagccaccgcgcccagcttagttatagttataatcaaacagtattgagcatggtctgccaggtaactgttctacatcctttacgtggaacatctcacttgagcctagtaaccctatatgtagaaactgtggttaccctattttgccactgaaggaattacatacagagagacacgggcattcagagaacaagtcacttgcctaagttgtatgctagcaagtggtcgagctaacgtccaacccaggcagcctgacttcagagctttgcttttgatcatgcttacgagtatcacgggatttagtaccgaccaagcacacagcagtgtgacagccccgagctcgcctgtgcagccttcctgggtatcactccgttctgcccggaaaggcaccattcaggccgtgagtgtaaacgtacgagtgggcagggggagtggtagaaacgcccctgctgattgcagggtttactcacgtatttaccttaacgcccgttcttctgcgactactataaacattaaatgagataggggatcagatgtcaccgtgaaacaatgtcagggagtggggtggggctgggggggatttttggggccattcagccccatcgtgtctggacagggaaggtgaagtgaagagaggctgcctccccagagctgagacaggacagactcggtcctctccctctgctgcaggtgctcttcctttcaccactcagcttttcttgaaatgaaagtttgaaagtttagctttcagaactagctgtgtggctttgtgcaagtcacatgtcctctctgggctgtatcccctgcagtagggagaataaatgaaactagagaaaccctctaaagtccatctcactaggattctaggcttctgggtgtttgggagcttgggtaaagaatcagaagggcctgtgctggagaaaggacctgttcactcgcccagccccagacattcaggaggaggctgtcactcactggaatgactgaactctgaacccgtgcgtctgttccctcccgctgggctcactgaaaccactgaagcaaaaggggtttcactgctccacaccacactttcactgctcacaaactacttctccctttttgaaggacgagtctcgaattaaggccactgtgatggacgtgaagcccgtggactacagagagtatggccgaaggctggtcatgagcatcaggagaagtgcattgatgtgagaggagcagtgccaatcgggcagaagtttgcaaataggcagaatggaatcgatttcctcccacctccgtgtgacgatcccatgttagctacacagtgcagaggctcttgatggtggactaagcaatttcccccctcgtgcgcatctcagaacccatcggtaggcaaaggaaaatacgctcaggtggttgtggtgtagactgtgtcaggcctacggagtcagccagtggctagcgcaagaccagtcactccctctgccttcaggcttctgtcaatttcattatcatcaagcaggaattatgtcgtaagtcactgaccctaactgcagaccatgaagtaaattatgtaactaggtttttgcttctccagtggtgaccacccccccccatccccgctcacaacttgggttcttctcagcggggcgagctgagaagcggtcatgagcacctggggattttagtaagtgtgtcttcctagaattcgaaggctctctctttctagaggtgctacatagttggtaatgcttggaatggcaatagggtagaatgattaatcaaaggcatatcttctatatctgaagagtatccttccttcagggtttaatagactgagtcagatgggtctgatattaatcaaaattgtctcttctgaggaccgctgataagcattgacttgccgtcccctaaggaaatccgagcggctacaaagcgtttctttacttctcacttcaattaatgctgcgcttcgcttggtgagtgcgtactttttctacctgtacacattcctgcattcatgtattttgttttttttgactaaagctatgttacatggaaaggattttgaagccttttgtttcccttgctttgttttaataaacagtatattctttggttgtgaatcctactttctttgaatgcaaagagttcctataactggaaagcaattaattagccttcataataaatgttcacttgggggggatgttaactcattataaacccgaagattagtccaaggcatggagatccttcttcctagtgtttgcagccctgaaatgcatctttcaaagcatgaaaacactaaaaacaaaaagccattttgcctgaggatgctgatgatctggcacttgggattttattgatgtttacgcagcagtctaacaccaaccacgctttgaaatgtgtacagacagtgagctggtaagaaaacagtaattatgctagtgggcctttcagtcagcaaaagcatgctcgctctgtgtgttcctaatcatattaattatctatccggtggctgcaacacaccgcctgccattggccgcacatctcgccgtcgtaccccggcagtgcggcggtcactctgcagccagaggacctgctgttcatcactgcacatgccgcctgcggaggcttttggatatggggagtgatggtgtcctgtctgtctcccccctcggtgtctgccgttgacataggggccagccagccctagacgggatgacttccgttcctgaggacagacacagagggactcctgctcagcctcactaattgtttagacacattccttcctacccttctctagtctcaggagatggtaactgggtcgcatttcagtctctgactgaggcctcagccatttttacggaagttcttttctgtctgaccttgcttataaagcatcgacgagaaaattacagtcttcaaccctcttctggattgacaaattgtggctgggaagtggcgatctagctttcagcccagtaaccagtctttcatgcctactactcccagcattccctcctctccccacgtgtctgtccacacagtgaagaggcctgaccagccgtggtaccaggacaggacgtgtccagggaacgctgacacctgtcctcgcgccttctcagtggccagcgtgatgaaaccagcacgtctccgtggatgtgattgggaacccaggggcagtgccagggggagggctccctcgaggaggctgtttctaacagatttccccactcaaagatcagatcaccagcagaggagcatcagaaactggctccactgttgggcttttcagagattttggtccctgcgggttgcctaaatagattctggcccacagtttacctcgaaaggctgttgatgttgttctgtttctcctctttcacttagagatcaatgttgattttgcgtacaccatgacatcagcgttaggcaattaggagaaaaaaatctaatcatttcgcctttatttcaagtggttcttgaattccctccagtctcattgtgaaaggggcagggaaaaaaataaaagggtaataatctgatttctgtccatatttccagtgttttatgctttccattaaaaccttgctaatctct

SEQ ID NO: 73 - DNA, 23274 bp, Homo Sapiens
tttttacaagttactacaatagaactgttttattaaacatatgactgtatttattttgtacaaaatgcagtaacacttcttcttttcctctgcccctggaggcactaccgcagaacttcatgttcacagaaacacacgtcatggcaagtgtgtcaaaaagtcatgacaagcaggaaagtgcaattctgaaagtaatgccacacaaccaaagtgggaaatgaaaacaggcagaggccagcaggtttctcggctagggctctgcctataacgccctggtcctgctcatctttcagcagtaaacattttaagaagagaaactcctgagcactatgtaagtactctcctggtagcatccttccaattccatctatcttgatgttgtaacaagcttatttgtaacttcctcaagaaatcccaccctggattgcatccctgtcaattgcccatctccctctgagcttcaaacaaaacaaaataaaacagaagagcagtaagtttcaaaaggaagtcagaggagacatttgatagatgaaacctacttcctagaagccccctggccagacatatgcagagctggagacaacagattgtgaaactaggtccagctgtaaaatatctcaggtacccagttagatccagttattctgcatctgtggatttaaaatggtcatcatccacagtagaatagatgtgcccctcattgctcagaaaatccacagcttgcctagaaagaaagaagaaaaaaaaaaggtcattttcaggccaattcagaaggaaactgccttttggatatggccaaatatgcaaacttcgcttatctcccaactttctaccttagctaagaattcacaagtattctgcacatagaaagctctcacagggagaaatgccagtaaaatagcaaaacagagcttattcatggagacaatggctattagggctgtcttggatccctctcccaaattgtgcaaaggaaagacaacagggcctcacttaaatacagtctaagcaggaaaacaaggatctaaagctgtagtcacacttgcacacaaaatctcctagtagaaaccactgtctttaaaagtcccccttttccagccacacactgaaaccccgttggtccctctcagggaagtaaagttgtgggaagcaaaggaaacactctgaaaccttcaaacccttcaaggtcctcagggttagtgtcagtaacgtatttaatagccacaatctacagagcacctaagtaacagcagttctctacctcatcagcacgcaactctgagataggaattattatcctaattttacaggacaggaaatggaatcagccctgagcatttcttatctatctaggcctggcaggtcaattgatttatagtaacaaataactatcacaagcaccataagtcagtttgtttgattggtttactacactggaatcaggaggctgcttgtctaagatggaatcaggacaagggtgttggaaggactgattgtttaataaggtacagatagcctaatacactcatgtccacaatggggacagtaacagcaacaggactgtacacctgacgaccaggagctaaggacttccttcctccagtctaaatcccataatgaaatcaggtcaactttttgctcagaattattatatatccctcacatatagtggtccttagtgcttgctgaatgagtgatgtgatgggtagcaccattttggcccatagtctttttcctatttttccatagctgaacgatttccattctgccaacagggttgcagttaagttttttttgtgtgtgtgacagtctcactctgtcatccaggatggagtgcagtggcacaatgatggctcactgcagccttgactttctgggctcaagcgatcctcccacctcagcctcctgggtagctgggactacagacatgcgccactgtgcccggctaatttgtttttattgtttttgtagagacaagcgtttcgccacgttgcccaggctggtcttgaactcctgagttcaagcaatctgcccacctcagcctcccaaagtgctaggactacaggcatgagctaatgcctggcgaacttttacttttttttgagatggaatctcgctctgtcacccaggctggagtgcagtggtgtgatggtggctcactgcaacctccgcctcctggattcatgcgattctcttgccttagcctccggagtggccgggattacagttgcgtgccaccatgcccggctaatttttgtatttttagtagaaacggggttttcaccatgtttgccaggctggtctcgaactcctgacctcaggtgatccacctgcctcggcctcccaaagtgctgagattacaggcgtgagccaccatgcccggctgccaagttttactttttaaacccacttctcactatcaggaaacccttgtgaggtgaaataggtacaatgccagagcctgagctcatgaaaatcaaatacttacttgattgaggatacagacatgtgtttcagctggttcttgagatcctgaaagttcaacccttcaggtcttggacaagccttaatcaaattcaacacctgaagattcaaatcagaaagattttagcaattattttggatcagcctcccctttgcaaacctgagtccctttatagaaaagaaatgaaccaggtacttaaacagtcgtagctcattaaggaagtaacaaaatttaagactatctgtgttttgtatttctgaagccactctggtggaggttacctggttttgggccacagtgaggccatttgctggcatgaagctattcccaccaaagttccctgcttcactcattcctggattgctgataggtgctctccctgctgagggctgaattaagaaataagttagcaatattagaaaatccatcaagttaaacagtctttactacttaaaatagctcgttaagcagcttacaaaaaacaatttataaacagtttcccagtttataacactgcttacattggagtggacagctattatctaatgagtatttcacaggaagataaagtaactccccgaagcacataaatatcaaaaagagaaagatactcttggctccttttgtttgtgatgtcagacgaaccagagaagagtagcagcaagaagaaaattacccagagtctgctattttggtatccatggagcccaatcattcaagcattcactgagtgtcaataggcatgaagcaccacaggcagagaaaaggagacacagtccctatcgtcctctctttctttctttttttttaaccaccaaattcttaaaatgctctgcaatcactattttcatttcctttctccccagtcactcctcagcccaccatatttgggttgtcccccagtacacctctgaaactgttttcaccaaagtcaccaaagacttttcaaccaattatccaaaagtctctttcagtcctcctaatacttgacctctcggaagcagacactgctgaccacactcctcttgaaatgtattcctccctgggcttcttgacaccacattcttctggttctccatctgcctctcaaactgaaccttctcagtatccctcattagcctcttctatctgtctcccaaaaagctgacagtgtccccaggatctcatcccagaccgcctcctaggccacaaatcctcattgccagccggactgctaaccggatgccaacatggtgaaaccccgcctgtattaaaaatacaaaaattagctgggtatggtggtgcgtacctgtaatcccagatactggcgaggctgaggcaggagaattgcttgaacccgagaggcggaggctgcagtgagccgagatcacgccattgcactccagcctgagtgacagagtgagacactgtctcgaaaaaaagggccaagcgtggtggctcatgcctgtaatcccagcactttgaaaggaggctgagacgggcagatcacgaggtcaggagatcgagatcatcctggctaacacggtgaaaccccttctctactaaaaatacaaaaaattagccgggtgtggtggcagccgggtgtggtggtgggcgcctgtggtcccagctactcgggaggctgaggcaggagaatggcgtgaacccgggaggcggagcttgcagtgagccgagatcgcaccactgcactccagcctgggcgaaagagcgagactctgtctcaaaaaaaacaaaaacaaaaacaaaaaacccaaataaacaaaattttaaaaatttgagtaaaggtaatccttaccatggcctccaaagccccatataatctgggccctgcctccttgcctacaaccctctccctctcccctgtcattcacttcactccagacactggccttgctggtttcagagatgtcatgcttactccacactcctggctcttgcacatcctagtccctctggtttagaatgttcctcatctaaaattgtaccattcttgttccctccatcagcctcttctcctgttttatttacttcagagcacctatataactacctaaaattatacatatatttttgtttattacttgtttctcccaagaatgtaagtatatagtgttcactgctatactcgaatgccgactagaatgattgggactatcaaatcaaagtaggcgcaataaatatttttctttttctttatttttttttgagacaaggttgctctgttgcccaggctgcagtgagtggcacgatcacagctcaatgcagccttgacctcctgggcttaagtgatctcccaacctcagccttccaagtagcccatctaattctttaattttttttgtagagacagggtctccctatgttgcccagcgtggtgtcttgaactgggctcaagtgatgcccccacaccagcctcccaaagtgctgagatttcaggccatgaaccaccacaccttgccctgagggctttctaatactacagtcaactctagttttgcatggtcctagatggacttgtcaaagtgaattcacacaatggaaaatactagggagaaatttcaatatgaaccaagaaatataatttcagggaaaaaataataatacataatttttcctacttagccagtaagttggaaggaagacagcaaaatgctgtcctgaaggggactactctctgagtatgcactgacaatcctggagctaagagctatataagagctaagagcctataattacatgtctacacctgagggttgtcacaggcctcagctgtccaggccagtggagtcagaggaactcctaattctgagagaaacatgagtgtttcatctggaataaaatacaatgacaaagctaatggagaaagtgttctgaggacttagtgatgtctttctctggctcggccttcaaaatatcaaggaaatcaaagctggaacacaaaagtagcctgtgttcttccagggaagagaaaaagctaggaaagcgagactactcacctggctgttggctttgcttagtaccatgtgtgcattgatcacttccagaatatgtgtggtgaactcattcatatcctccaggggcatgatcttaaaggctaccaggctctttttgttctattaaaatgaaggaaaaaaatgtgaataaaatatgaacatacattaatttcaggtcaacactgtggctctttccttggttataatattaatatttcaccaatatgagaaaaatgttatatactctcagaggtattccaaatatggtcaaacatgaggagaaaaaaaactaaaactaatagctaagggacattaataattttcccaagattgcataaccaagcaaaatctagactcctgactccgaatctagtgttctcctttctccaactaatgaacgccacagatagcaattgtagaaggagattctgttctttctttaccattctgttaatttcatgttaaggttaaaaaaaaaaaaaagaaaagttatttccttttgaagagagtaagaaataacttcccattaaacagggagacttaagtattttaactatccaaaagccatgacatgaatctagaaactgcttcatgcaaaaacactttaactgttattttattctgactttacctgaaaagatctcaggtggcctgccactttcacatatgtttctggaggaaccacagtgttttcactgctggtgtcctaacataaaatacaaacatgtcattaaagttttagtgatgctggtaaaagcctctttaacgtttctatattatgtatagaaagagaaagttacgaagtagaagagttaaaggatcctaaaatggcattaagtagtttgccctgccttttacaacttattttgtaaaaccaggaattagaataaaaatatctctaaaggtaattatcagttccaaagttctgtagcacatcataaaaaagcaaacaattgtgacactctcgttcaagctcttaggcacacaattttcttttttctttttttgagagggagtctcgctctgtcacccaggctggagtgcagtggcacgatcttggctcgctgcaacctccgcctcccaagggagggtttgagtaattctcctgcctcaacttccccagtagctgggattacaggcgcccgccaccacgcccggcaggcacacaattttctggtggatatacttattggcaaagcaattctacttttaggaatttaaggaagtaattaagaacatgcattaagatttagatttatcatagtatagaatattaaaaattttaaaacaacctaaatatccaacataaagtacacatttctatataataggatactccacactgttgcaaatgataacatagaattctatttactgcctggaaaaacaagtcatgatacatggaaaaaagctgatttcccatttgggacaatacacactaaactgtttataatggttgactaagataattaaaaacgattttaatacttatcagtttcctagaatatgcacacattatttataagaaaaatacattagctgatttttttttttttttttgagacgaagtgtcttgctctgtcacccagactggagtggagcggcatgatctcggctcattgcaacctctgcctcacaagtttaagtgattctcctgcctcagcctcccaaatagctgggactataggcgcctgccaccacacctggttaatttttttgtattttttttgtatctttagtagagacggggtttccccatgttggccaggatggtctcgatctcctgacctcatgatccacccgtcgcggcctcccaaagtgctgggattacaggcttgagccatcgtgtccggcccattagctgatttttaaagttcttttctgactacataaaatgtattactttaaaaaaaattgaaaatatatcggggtatatggactcacacctgttatcctagcactttaggaggacaaggcaggaggatccttcgagctcaggagtttgaaaccagcctgggcaacatagtgagacctcgtctctaaaaacaaacaaaaaactagaaaatatatgcttaaaaataaaaactctggccaggtgcagtgactcatgcctgtaatcctagcattttgggaggccaaggcgagcaagtcacttgaggttaggagttcgagaccagcctggccaacgtggtgaaaccctgcctctgttaataatacaaaaaaaagggtgggcacagtggctcacgcctgtaatcccagctctttgggaggctgaggcgggcggatcacgaggtcaggagttcgagaccagcctggctaacagggaaaccctgtctctactaaaaatgcaaagattagccaggtgtggtggtgggtgcctgtagtcccagctactcgggaggctgaggcaggagaatcacttgaacccaggaggcagaggttgcagtgagagactgtgccactgcactccaggctgggcaacagagcaggactctatctcaaaaaaaaaaagaaaaaaaaaaaaaaaaaaccacacaaacaaaacaattgtattcccatatacaacattttgaatccacttgagaaaagatctctacctcaactccttttatcaaaatatattccatgtagatcataggtttaattataataaaagaaaccatagaaataatatgaacaatttttttctttttttttgagacagagtctcgctctgtcgcccaggctggagtgcagtggtgggatctcagctcactgcaagctccgccttatgggttcacaccattctcctgcctcagcctccctagtagctgggactacaggcgcccgccaccacgcccggctaattttttgtatttttagtagagacaaggtttcaccctgttaaccaggatggtctcgatctcctgacctcgtgatccgcccgcctcggcctcccaaagtgctgggattacaggcgtgagccacggtgcccggcttttgtatttttaatagacagggttttgccacattgaccaggctagtcttgaactcctgacttcaggtgatccacccgcctccgcctcccaaagtgttgggattacaggcgtcagccaccgaacccagctgagatttatttatttggttttttgataaggtctcgttttatcatccaggacggattacaatggtgggatctcggctcactgcagcctgtgcctcccgggttcaagtgattctcctgcctcagcctcctgagtagctgggattacaggcatgcaccactgtgcccggctagtttttgcatttttagtagagacggggttttaccttattggccaggctggtgtcaaactcctggcctcaagtgatccacctgcctcagtctcccaaagtgctgagattacacgcatgagccaccgcacctggccaacagctcttttttaatctgaagtatatattgggtggctgcttaagattttttttttttttttgagataaggtctcgctctgtcacccaggctggagtgcaatggcacaatctgggctcactgctacctccaccttcagtggggcaagtaacagcagatgtggtggaaatagcaggagaactggaattagaaatggagcttaaagatataactgaattgctgtaactttatggtaaaacttgagtggatgaggagttgcttccttttttttgagactgagcctcactctgttacccaggctggagggcagtggcacaattttggctcactgcaacctccatctctcaggttcaagtgattctcctgcctcaccctcccgagtagccaggattacaggcatgtaccaccatgcccagctaaattttttatttttagtagagacgaggtttcaccatgctggccagggtggtctcaaactcctgacctcaaatgatctatctggccgcctgggcctctcaaaggagttgcttctcatggatgagcaaataaactggtttcttgagatggaatctcctcctagtgaagatgctgtgaacattgttaaaacgacaataaaggatttagactactccataagtttagttgagaaagcagtagcagggtttgagattgaatccaattttgaaagaagttatactgtaagtaaaatgctatcaaacagcatgatataatatcgagaaattttatgtgaaaaggagactcagttactcaggcaaactttgttgtcttatttcaagaaattgccacagccagctcaaccttcagccaactaccaccctcctcagtcagcagccatcaacagtgaggcaagaatgtccactagcaaaaacattatgaattgctgagggttcggataactgattattacaatttgttagccataaagtttttttttttcttctttttttgagagacagtttcgctcctgttgcccaggctggagtgcaatggcgcgatctcagctcactgcaacctccacctcctgggttcaagcgattctcctgcctcagcctcccaagtagctggcattacaggtgcccacaaccacacctggctaatttttgtatttttagtagacagggcttcaccacattggccaggctggtcttgaactcctgacctcaggtgaccctcccgcctcggcctcccaaagtgctgggattatagacgtgagccaccgcgcccagccaccataaagtattttttaactaaaacaaacaaacaaaaaaaacaaactttgggactagtagaagcttccgaaaggtaaactagaaaaaactgcacaatttatttttcaaaattatttctttttgagatagggtcttcccatgctgcccaggctggtcttgaaattctggcctcaagtgatcttcctgcctaagtctcctgaagtgctaaagttacaggtgtgagccactgtgcctggcctcattataagaggtcactataatcattttcaagttcttgcaaacaaaaacactgttaggggaaggggaatcaaagagaaaatttacaaaaaccccacaaattgacattaaacatagtaaaaaaaaaaatacatatatatggctaaaaccaaagaaatacacataaaaaaatgacaaaattttcactgaaaagactatttttttctgagatggaatattgctctgatgcccaggctagagggcagtgacgcaatcttgactcactgcaacctccatctcccaggctcaagcaattctcctgcctcagcctcccgaatagctgggactacaggcacgtgctaccatgccctgctaattttttaattttttttattatttttacgtatacttttttttttttttgagacagtcttgctctgttgcccaggctggagtgcactggtgtgaagatctccgcttactgtaacctctgcctcctgggttcaagcgagtcttgtgcctcagcctcccgagtagctgggactacaggcgtgcaccaccatgccagactaatttttttatttttagtagagactgggttataccatgttggccaggctggtctcaaactcctgacctcaggtgatccactcatcttggcctccccaaagtcctgggattacaggcatgagccaccgcacctagtcaaaaagactattttttaaaacaactatcacactggcaaaaatttaagacaaaaacccattgttataaagggtatggaggataggcacagaggctcacacctgtaatcccagcactttgggaggctgaggtgggaggattgcttaaacccaggagtttgagaccagcctatttcttaaaaaaaaaaatgttaagggtatggaaactaactgggcactctcatgcatgactgaagcgtaaactggtacctttagagaagacagtacaaaaatgcaaaaactaagatgttaaaaaaatgtcaaatgtgtatttccccccagaaaacctacttttaggaatacatcttatgattattttatttttttgagatggagttttgctcttgttgcccaggctgaatgcaatggcacgatcttggctcactgcagtctctgcctcccagcttcaactgattctcctgactcagcctcccgagtagctggtattataggtgtgtgccaccacgcccagctaattttgtatttttagtagagatggggtttcaccatgttggcggtgccggtcttgaactcctgacatcaggtgatccacctgccttggcctcccaaagtgctggaattacaggcgtgagccacgacgcctggccttacgattattttataatcatgaagaaatgtatgcaaagatactcactggagcattgtatataatagcaaacgactgaaaagaagttaaatgttgttccctgactgggtccactgttaagtaagggatgatgtattcttataatggaatcggtggtcatttaaaatgatagatgtaaatctttacagataacattaaaaaatcagttcttggctgggccatggtggctcaagcctgtaatcccagcactttgggaggctgaggcaggatcacctgaggtcaaaagttcgagaccagcctggccaacatgttgaaaccccgtctctactaaaaatacaaaaatcagttgggtgtggtggtgcacgcctatagtcccaactactcgagaggctgaggcaggagaatcgcttgaacccgagaagcagaggttgcagcgagccaagattgcaccaatgcactccagcccggataacacgagtgaagctcagtctcaaaaaaaaaaaaaaaaatcagctcctcaccaggcacggtggcatcagcctatagttccagctacttgggaggttaaggccaaaggatcacttgagcccaggtttgaggccagcctaggcagcaagccaagaccctgtctctatttaaaaaaaaaaaaaaaaaaaaaaaaggccaatggctcatgcctataatcccagcactttgggaggccaaggcaggtggatcacctgaggttgggagttcgagaccaccctgaccaatacagagaaaccctgtctctaataaaaatacaaaattaaccaggtgtggtggcacatgcctgtaatcccagctactctggaggctgaggcaggagaattgcttgaacctgggaggcggaggttgtggtgagctggagatcgcgccattgcactccagcctgggcaacaagagcacagctccatctcaaaaaaaaaaaaaaaaatcagttccacaacataattttgagtgaaaagagcaaattacttagcagttgcatagcatattatcccttctacagtaaaagaggtatgtggacacctgtatgtacatatatgcagagacagatgtctgaaagggtattttccaaaatgtgtcgtaatagtagttctttaagagacatgagatgtcaggtgattttttaaatggtttataagcaagcatagtgcattttatatgaacaagtagtattaggtatccatagtatctacctccctgcttgatggcagggactgtgtctacctcattctttttatacctggaaccaagcacagtctagttcagaattggtactccaacaataactgctgaatgaattatcctttatttttctgagaaggaaaaaatttaaaaattacataactaccaagttatttctctatagataacttgtggtttttgaaggagaaccgcatttttttttttgagtcagtcttgctctgttgcccagagcaacagagcagtgcgcaatctgctggagtgcagtggcgcaatcttggctcactgcaacctctgtctcctaggttcaatcaatttttctgtctcagcttctgggtagctgggattacaggcacccagctcatttttgtatcattagtagagatggagtttcatcacgttggccaggctggtttcaaacttctgacttcaggtgacccgccagcattggcctcccaaagtgctgggattacgggcgtgagtcaccatgcccagcctaaaacagtctttattatccaaattttctgtaatgaatgtatttcaaaaacaaaatacaaaacaccaagaggccttctgcacaattgaaaaataaaaggataaaaagtatatactgtatttcagtctattttatccatgtttataaagacacttatatatatgctgctttgtaaaaattgggtcaaatcctgcataccacattgtaatatgcttttctcaacaatttatggcaaacacttctttgtggcaatacacgcttttctgtatcatttgtagtatgttataaatgtgtcatggtttacttaataatcctttattgctagtattttgagattgctttatttttatttattcattttgagacagagtcttgctctgtcgcccaggctggagtgcagtggcatgatctcggctcactgcaacctctgcctcccaggttcaagcaattctcctgcctcagcctcctgagtagctgggattataggtgcgcagaaccacgcccggctaatttttgtatttttaggagacggagtttcacctgttggccaggctggattcgaactcctgacctcaggtgatctgcctgccttggcttcctaaagtgttgcgattacaggcgtgagccacttcactggcctaaatctttgtacctgtctttaattctttccttgatgtaaactcctaagctgtggagttctgctaggtcaccactgtttgtctttttttgttttgaggcgcaatcttggctcactgcaagctccgcctcccagcttcatgccattctcctgcctcagcctcccgaggagctgggactacaggcgcctgccaccacacccggctaatgttttgtatttttagtagagacagggttttaccgtgttagccaggatggtcttgatctcctgacctcgtgatccgcccacctcggcctcccaaagtgctgggattacaggcgtgagccaccatgccaagccaaaaaggagctttatattaattaaaaatttaaatgtttgtaatatgttgcaaatattttccacattcatttaaacaatacttattccaggaccactatgtgactagcactgctctaggtgctaaggctacagcggtgaccaagataaaaatctttgttctaggccgggcgtgagggctcatgcctgtaatccaatcactttgagaggctgaggagggtggatcacctgaggtcaggagtttgagactagcctggccaacatggcaaaaccccatctctactaaaaatacaaaaaattaggtgtggtggcgggtgcctgtaatcccagctacttgggaggctgaggcaggagaactgcttgaacctggggcccagaggctgcaatgagctgagattgcgccattgcactccagcctgggtgacagcacaagattctgtctcaaaaaaaaaaaccaaacaaacaaacaaacaaaaaagcaggggctgggtgtggtggctcaagcctgtaataatcccagcactttgggaggccaaggtaggtggatcacaaggtcaggagttcaagaccagcctgaccaagatggtgaaaccccatctctagtaaaaatacaaaaattagccgggcgtggtggcaggtgcctgtaatcccagctacttgggaggctgaggcacaggatcgcttgagcccgggatgcggacgttgtagtgagccgagattccaccactgcactgcctgggcgacagagtgagactctgtctcaaaaaaaactttgttctaatggaacttaacattctactgtctcctgtcatttgacttttaattctgtttttggtatattgggaaggtatatagtcaaatctactaaccttttactttagagtatctgtctttgatgtctttttgtattatttttataagaaaaaactttaaaaagactaaaaaagttcaacatctccacagttccaaagtaaccccatcatgattcaaaaacagccacttacatctgtgtcaacccactggcgaacgtccatgggtgcagctgtcatgtcatctattttgtaaacaatgttggttggagccttctctgcatgtctgatgatccccacaatagtgacctaggttagaagaaacaaagaaaaaaaaaaaaggtctggttccccctgaaaccaaggctacatttttgtattttttaatgaagtcttatttcattctttattatgagtaagtgattctttcacaaattatttgacatacctgtgaaatctcaacattcccaattctgaacacttcatcaaccaaagtggcagaaagcagctgagatatagtacagggcacaatgtgctgggctcgggctctctgaaaagaaaaaacatgcaaaattcaattaagaaagtaataactaccactcattcaacacctgccatgtgccaagtactttaaatatattagaacattgaatttcaaaacaaatctcattatccttgcttcagagagatggaaaccaaggtcatatagcaaaccaataccacacttttagaatccaaacccaggtttgtctaactccagagctcctgctgaatagatacacatgttgctctgagaattcaccaaaatgaataggtcagagtgggggacaggataaggaagaatgacctgctgctgccagaacagaccttcaagaggaaaccccagctttagggtgtagacaggctggtgctgctgttcaggtcactgacaaaatgagatggtattgggaaaaggtttgagaaatgactaatggagacaggactttggaattgcttgtaggtcttgtgatgaactgtaaaaggtagaagaatagcttcttgtaggacagattttttgactatcaaatggagctcctggggaaatggagtaagagcttggccatgttggacatctttttaaattttttttctttgagacagagtttcgctcctgttgtccaggctggcatgcaatggcgtgatctcagctcactgcaacctccgtctcccgggctcaagcgattctcctggctcagcctcctgagtagctgggactatatgtgccagcattttgcatttttagtagagatggggtttcaccatgttggccaggctggtctggaactcttgacctcaggtgatctgcccacctcagcctcccaaagtgctgggattacaggtgtgaaccactgccctcggccaaattttgttttgagatggggtcttgttctgtcactcaggctggagtgcagtggcattacagctcactgcagcctcaaactcatgggctcaagcaatcttcctgctatagtctcctgagtagctgggactacaggcacaccaccacatccagtcaattaaaaaaacatttttttttttgtagagatggggttttgctatgttgcccaggctggtcttaaactcttggtctcaagtgatcctccgaccttagcctcccagtgttaggatgacacacataaaccactgtgctggactcatgttggacgtcttagggggaagaggcaggatagggtaggcagaacagtatctagtgagcacactcaaattatatctttttttttgagatggagtctcactctgttgcctaggctggagtgtggtggcgcgatctcagctcactacaacctcaatctcctgggttcaagcaattctcctgtctcagcccccccgagtagctgggattataggtgcacgccaccatgcccagctaatttttctatttttttctagagatggggttttgccatgttagccaggctggtctcgaacacctgacctcaggcaatctgcccacctcggcctctcaaagtgttgggattataggcgtgagccaccgcgccaggcccaaatcatatcttaaagcagccagacaacagtgtaaacttatttttgcctaccagtggcaagaggtagtctgggtaacatgaagatgaatatgatgggacaggatttaccctcaacatattcctaatctaggggaggtacaaaggtaaacaataaacctgatcttgatacactgtaaaatgaaacatgccatgtgggacctcagaaaagcttactggcaaaagagggaggctttaggctgaactctgaagcacgagaatttcaacagcgaaaaagtagcaggtaacaggctgagggcaagtatgtactcccagtctcctagagggaatatgtacaaggcacaaaaacgatgagagctcttcctgtcagaagccaagaggaagtggaccaatacctgtactacatggaagacttagaacacagtagactcttggccttcatggatttagcagtcgcaactctgacctgaacatccacgacactgccaatatttcattttgctgaagcatgattgtgaatggtgagtattgccacaacaggataaagcaagctcagtcaaccgctggcacatatgccacaaaaggcagcagccaagcttgagggttaagattgtggctctattctcaagagcagctgcttggccaggcgtggtgggtaacgcctgtaatcccaaggccgaggcgggcagatcatttgaggtcaggagtttgagatcaagcctggccaacatggcgaaaccccatttctactaaaaatttaaaaaaaaaattagccaggtgtggtggcgcatgcctgtaatcccagctactggggaggctgaggcaggagaatcacttgaactcgggaggcggaggttgcagtgagccgagatcataccattgcactccagcctgggcaacagagactctcctcaaaaagagaaaaaaaaaaaagagcggtcgctcttggtcacatgtattaactcatttgtacctcggtttcctcatctgcaaaactaggaatgatattataaaaattacatggtaaaggactcagaatactacccagcacaaagcactcaataacaaattttagctattattatattagctattgttcctcattctttacatttgcaatagcttttaataacaacgttgacaggatcaactttttcaattttactttatggtattttataggtaaagttacatgctatgttaatatttatagtcttaaaatttgcaggggtcccaggatttacctctcacaaactactatatttctgtttttacctatcacagctgagattttcattgtatcttcagcataagaaaacttaagaaccagtaaggtaaagtggcaagaacatgaggtttggagccagagagtcctgtagacccatgctcaaatcccagctccaaagtcctggacacatgaccaccttttctgaaaactggggatatacacctcttaagttgtaaatgagacacataacatatatgaagtgctaataccaatctctacatgtagtagatgtttgacaaatattattacctctcaggtaaaaatgttacatataggtaacagttgagatgttaacaatgccttcaaattcatctcaaatcaagtatttattttttattgagcatatattttatgtaggaattgatcacaaggaattcctagtctgctccaaagaggttcacaaagtgtcaataaaaatatgcttaattttggaaaaacaaaaacaaaaacactttcaaactaaaaaaattttcatagctgactatgaaccacagactactctgacagtacttcaggaaagtaccattattacagattaaaattgggtcgctatttgaaacttcacatggttcaatcatattgaacaaatacataatcaacaggaaacattttggatagagttctttatcacccagggatggtgctgcacacctgtaatcctagctacttgggaggctgagatgggaggatcccttgacccctggagttaagagtctgtggtaagctatgactgcaccactgcactccagcgggggtgaaagtgagacggtctcaattttaaaagaaaaaaagaatagggcgtttacctaacttttaactgtggaaaatactagatttaaaaacaaaacaaggccaggcgcagtggctcatacctgtaatcccaacactttgggaggccaagaagagcagatcgcctgacgtcaggagtttgagaccagcctgaccaacgtggcaaaaccccgtctccactgaaaatacaaaaattggccaggaatggtggcatgcgcctgtagtcacagctactcgggaggctgaggcaggagaatcgcttgaacccaggaggtggaggttgcagtgagctgagattgttccactgcactctggcctgggcaacagagagactgtctcaaaaaaaaaataaaaataaaaacaaaaagactgtccgggtgtggtggctcatgcctgtaataccagcaccacgggaggcaagggtgggaggactgctttagcccaagagtttgagaccagcctgggcaacatagtgacaccctgtctccacaaaaagaaaaaaaaattcagagactgggattgagtctccaacttacaagcattattctctgaaaagctatcttaatacccagcttttaggaattctgagataaaaattataataaccagaatggagaaaaatagttaagcttgggaagaaaagatgagaaccaatcatctaccttgttttctccttcacaacctcaagaaaatcagaatagagaattaaagtcccttgagatcttctaggaaagagaaaactacaacagggagaagttgctgctcatcagatgttggatttgttcagcatcatgtgcgtactgtctgattctagttccttactagctatgtaagcttaggcagtcccttaatatacctgagtctctgttagtatgctggaataaacaataaattccttacagaattacataaaataatttatatgaaagttataaagcggccgggcacggtggctcacacctgtaatcccagcactttgggaggccgaggcgggcagatcacgaggtcaggagatcaagaccatcttggccaacatggtacaaccctgtctctactaaaaaaatacaaaaaactagccgggtgtggtggcgggcgcctgtagtcccagttactcgggaggctgaggcaggagaatggcgtgaagccgggaggcagaggttgcagtgagcccagattgtgtcactacactccagcctgggcgacagagtgagactctgtctcaaaaaaaaaaagaaagaaagttataaagcaatgtccaaatataccagaatatcattgagttttttaacttgcttacactgaatcttaacatatctgagtgattcctaaagagaagtcaaattaacctcacatttataaaatgaaattgcagttgttaaatgcaaactcagctgggaatggtggctcacacctgtaatctcagcactttgggaggctgaggtgggtggattgcttgaggctaggagcctgagaccagcctagccaacatggccaaatgccacctctaaaaaaaaaaaaaaacacaaaaattagcctgacaccgcagtgaacataggtagtaccagctgctagagaggctgaggtgggaatgatcacttgaggcatggaggtccaagctgcagtgagctgtgatcacacaccactgctctccagcctggcagagaccctgtctcaaaaaaaaaggcaaactcatttcagagtgactaaacatttagacagctttctatagattgttttcctacacattgccttactcatcaattctcagaaccaccccgtgacatgagtactaccagtatcatcagatgagaaaaaccaagggccacagccttcaagatgctttcctgaagtcacaatgccagttaaaaggcaagatggattctggagcccccatgttctggctccatagcctgtattctttgtatataatattaagtctcacaatgacattttaaggtatgttagcccctcttcacaggggcaaaactgactcccaagccagttaagaaatgtgtccagtgacaccctataagtaaagcagcacggcaacggcagaacacacgtctatgacttcaaagaccacatttctttttttgagacagtctgctcttgctctatcacccaggctggagtgcagtggcatcatcttggctcactgcaatctctgtctccagagttcaagcgattcccctgcttcagcctccctagtagctgggattacaggtgcctgccaccacgcctggctaatttttgtatttttagtagagacgaggtttcaccatgttggccaggctggtcaggaactcctgatctcaggtgatccacccgcctcagcctcccaaagtgctgggattacgggcgtgagccaccgcggctggcccaaaaaccacactcctgatgtcgcctcatcccatttaatttaaaagcgactttgggccgggctccgtggctcacgcctgtaatcccaacactttgggaggctgaggcgggtggattacctgagttcgggagttggagaccagcctgaccaacatggagaaaccctgtctctactaaaaacacaaaattagccgggcgtggtggcacatgcctgtaatcccagctactcgggacgctgaagcaggagaatcgcttgaacctgggaggcggaggttgcggggagccgagatcgcgccattgcactccagcctgggcaacagagtgaggttccatctcaaaaaaaaaaaaaaaagaatgtaaaagagactattaatataagttcaggccaggagcagtggctcacacctgttaccccagcactttgagaggccgaggtgggaggatcgcttgagctcaggagtcggagaccagcctgggcaacatagtgagaccccatctctattttaaaaaataaaaataaatttaaaaaccaagttgagggcgttcacacaagactgattcattagctacactgatcaatttcaaaataaggccaacgacgggaaaagccagggaaacaggaggtggaaaatttggcaagatttcatttctgaaacttacagcacttaattataagagatgcagataataatagatcattatcgcatcagttcacgttgaaatcttccttcaaagcataaagtttctgtcatagatgactcagggacttcaggacaggataaaacaaaactaaatactcctttcaacctactgatttcttttcggcttgagaaggtgcgggcgatccaaagccccccggggactgcgtgtagccgccggctcccccgtatgaggagctgccatagctttcgaatccacctgttttgaacaacaggattagtgcctgtgccacgtcccacgcctccgagaaacccgcaggctcccggaggcttcgccccttcaaacactgcccgagtctccctaaccttcctcgccgccttcctgcgggtgacccccaaacgccccagctccgctcccgcccttcctctcccgctaccacacgcctctcggaccctaggctcgccctcttgctaaaacctcctgcgattctcttcctcctccaccccgcacccccatcattactgttccacatcttggtcacgattctccgcaaagaggccgagaaggtgcgggtctgggggaatagcggaaaaccacagaacgcggccgccactgcgccgctctggctacttttctctggcaccacaaacgccttcccgcgaatggcggagccagtcagctcccggggtgctcgcttcagccaatcggtgctcacggatgctacgcttgttcctgtctcctctgcccatgctccagaaaacgcgtactgcgctcccagttggctccaaaagcctccgcggccatctttacgaagggcaaaaccctccgcactagcggaagcaaggggctggcagagcggtatcgcaagaaatcaaccaatcagaac

SEQ ID NO: 74 - DNA, 82045 bp, Homo Sapiens
tatcaaggtatagtttgggaaaaggtgagcaaatccttaacacagctggcccaaggttttatttggtaggtctaaatcttgaccttatggctatgaaatttcaagtttgtgcttgaatacatgattaaaagaatgaaaatgaaatgaccgatagtacgtaccattttagtttttattaataaaatagaaacttagactcggacaactgctttattcttgcatctaatctgaccatatattggagtagcaattctttataaaaggacttcggtgagaactgtcaatatatcagttccatcaaaaactctaggttggaatatcttaaaaacagcaaattaaatatgagaaagcacagaaatctctccctcaaacaagaagggcttcctttaatagactttaatatagctcatttacaatcgtatgaaaatccatcaagatcaatcatgttgcacaatccctaaaggataaaactgagggaagtcatggataattttcacagcttcattgtaaagtccaagatctgaaagaaacatttaagcaaacatttaatctacaatggaaagttgtaacatcaattattatctaagatatttttacctatttcctttttctcacccttttggaagtgagtttctaaaaatggagatatggattatggattcttgtatttaactgtggcaccaaaaaaaagacatgggagtaccatccattttgatgttcattatacaggcagtttctgcctggtagtgttttgggtgttatgcattattcaattccttcaattcagatattacaacaaaaaaactaatactatttttgttatatttaaaaaaattatctttcaacaaacattaattaatctttactgagtttcttacatatataagcactacttaaaagcaggccaaaacaaaatgtacccccatttgcctttacgatcacaaaattctatagaaattgaaaatgtggcagtactaaaactctagaccaatatatatcaaactaaaaataaaactgttttcctgtatgtttatgttatgtaattgtatgtaatacatacaattttgtatgtaatacaaaatgtatgttaaaacatagttatataaaactgtatgttatgtaattacatacagttatataaaactgtatgttatgtaattacatacagttatataaaactgtatgttatgtaattacatacagttatataaaactgtatgttatgtaattacatacagttatataaaactgtatgttatgtaattacataaaaccagtcaatactagaatgctttatttaccaaaaggatggctatcttctttaaactggacataagatgtacacaagatggtggccttggcggttactcttccaaccacttccacaattccagagatttcttcatcaagctaagacacagaacaagacatcgatttggtgatatcacattttcagttgacaattattttggaaaactgttatacaggttactaatctatcacttcaagtaacaaagtaattttaagaattaccagtgtaaaagttaaaatgtaacttgttaacaaatgtttgagtacttaactgtcagcatgttaaaattcctgctacctttagcagtagcttcaagtccaaagctacaattcaagttaaagacaaaatcactattgaaaacgtccagcatttctataagcagtaatatcctatgagaggaatcttctataatctgtatttcacaatgtgttctgtatacattaaccaaacagcatatggatttgtcttcacaaaataccaaaaaaagttttaagtatgttaaacataaaatgcaaacataaataagtaaaaactggaaatatatgaacaaaaatagaaaataaaataaaatcgaaaactcttgaggggctggtcgaggcaggaggattgcttgagaccgagagttcaagaccagcctgaggaacatagggagatgccatctttacaaaaaacaaaacaaaacaaaacaaaacaaaacaaaacaaaaattagccaggcatggttaagcatgcctgtagtcccagctactggggaggctgacatgggagcaacttgatcttgggaggctaaggctgcagtgcgccatgatggtgccactgcattccacccggggtaacagagtgagaccctgtctcaaaacaaaaaaacaaaaacgaaacaaaaaacctcttgaggaagaaaaaagcaacgtaaatttttcttatgtgattttatggtctttcataaggaatgagaattgttatccaacatttatgggatatgttcaaaaatcatgacgcccaaaaaatcattggttaaaaatgtaaaaggaaatataatgagagaatagtacaagaattaaattttacagccagggacgttttaccagctcatcctttttaaatccattgcaaaaattagaaacatcggcaacaaaccaaatcaagatgaagaattaactataatatataagagacttattaacacttaaacatacgggttccatcaactcgatggttccattttttccttctccatctgaaagaataaacatttttccggtgggatgaatctaaaaacgaaacatataattaaaatctcactaaaacaacaacaaagtttgactaaagatgagtacattgatccttagttgagcacaaatcaactgtttcttgaacagtttattcattcagtttattcaacttattggatcaaattataatcttatgttatcaaatctgttcatggaacacacagttaatttctgaatttcagataaacaaggattttttttgtagtgttaagtaggttctgtatttgctaaatatggcaaccctattctgataacaaattaaaggatgcccaccctaaaagtgaaatctgctggcactcatgatttagacagtacatatcccacggagggtatgttttaaaaaacaggcatgatgaagtaaaaggagaactggttgctagaatatctgggtcctactcctgggaagcagctgtaaagagcgctgtcagattgcgtttgaatgccagctttgccatttgccgagtttctgagcattttagtcaaccacctaccactcctactcagtttccctacttgggaagtcagagcaacactcatttaaggaagaggatgtgtggatgaaatgagctactaaataagtctttatataatagttttcttttcctcagcttttcaggtcactgattccaagactttgggcctgtttctcgcctgtagaatgagggaacttcactttaatactggggttaaataactcgttactacgggacccaaagcggacaaccaaggcatgttttacagagaagcgatcacaacgaggaaacgaggtttgcaaaaataagtaatttcagaagagaaggaaaccagcagattagttttgtctgcgtccgtcacgtctgagtaaactaagaaatctgaaggtagatgtgggagtggtgtttataatttcccttacgtaagcacggctagaacggaggcgacgggcactggaatttagaactcagcatttgaaaacactttgtttccgtgccataaaagagcgccaaaatggggctacaacggctaaagaatttccaaaaagttccttgtgcaaaataaaggagtcgggggcgcagtgatcggaggctttccgtcctttttcatcccccgttatccaggcggggtccctccctccagctacggacttgggagcccatgattgcgaacccgcacaccttttccagcctccctacgaagcagacaggcttgtcgatgaattgagctagcatgccggcgttgatgcgcgacctgggcaagtccatcatgtccaccatgattatggtccaagactgcggctggcgggaaacccacggacgactgaaactgtgcgccccgcgggtgtctatggggcagatttctcggcaccaatcagcgaagactagcgctccagcttcgccaattaaatgcgcggaaacctaaatcgcaatcgcgctgtctctgaaaggggtggagaaggggctggatgagtccggaagtggagattggctgcttagtgacgcgcggcgtcccggaagttgacagatacagggcgagaggcagtggaggcgggacttggataggggcggaacctgagactacctttctgcgatcacaggattcccggcggtgacttgaccccggaagtggggtgtgaagctccggtgctggtgcggcgggggactgcggggccagcctcaggtacctcgtctcgcgggaggcgccgcaaccttactgtttccccattcttcccgcgaacagagtcaaaagagctaggcgggagtcggcactagctgctgccgcggtgctgtgggtgctgcgtaccagctgttcactgctgtctcgccttccctcttgccagttctgcgtgggaggcgcgggagttttgcggaatgatacgtggtgtggcgtcggggttgtgatacccgcccccttggagatgggcagcggggtcatcagtgatcttgatcactttcttcaggcttttgccacttgttggctgagggtcgatttactcccttagctgcgtcactctactttctccactttctccacctgtaagaagagagattgatccgattacttctaagacgttttttagcccaacctggccacactgcggaggcgccggttctttcaccccgctaacccctccgtgttggcagccaatagaagcacttaaggatgggtaacggggaagaaccactggccagtactaggggagacaagcttaaatcgttgttagaccccgagctagggttccccgagctagggttctcccttctgaggcgtgttttccccatctgcaaaacgaagggttaggcggaatgatttgcaaggtcccagttgactctgacttttggccatatgtttgactcaacagtttaaaccccctcagcagtctttctgtcgttgccctccacactgcgagactctggagggcgatctggaggtctggaagataaccgattcctgggagatttgggggtagtctccaatctgtccctggctcatcttgtgacccgaagccggcggccttgccaggagtattctagaatgagtgcacataaaaataccttcaaacggtacggtggaaattggacagaagttttaattgggtattataacgttgtggaaactgagtctgtgaattggcccaaagctacagaattgtcatcgttcaaattcccttaagcaaaaaagatccgatttgagacttcacgtggcaatttaagattggaatctcatgtacgataattaaatgatagtctcccttagtgtttccttagcacttaataggtttgtcttagttttactcactaacggtactttaaaggatttcattaaacagatgtagaatgtgtgtcagtggtgtataaaaaagttgtggttgtattggtgcaagtcagtaaagtctattttatattacagctttaagtcttttgtactttagcattgttttgcaaagcaagttgatgtgcattatataggggagagtacacacatcaatgtctttaatagcatttttttttgaggcaagatctctctctgtcacccagactggagtgcagtagcatgcacatagctcactgcagcctttaactcgtaggcttaagcgatcctctcacctcagcctgccaagtagctgggactataagcacataccaccacacccagctaataaagattttttttttgttgtttgtttttttttgttcagatggggcctcgccatgttgaccaggcttatctcaaactcctgggctcaggcgatccctccctcccccgtctccctcccaaagtactggaattacaggtgtgagccttggtgcgtaccctgtaatagtgattttttttttttttaaagagcactcctgtgagtaccagatgttaatgtcgttgtttacctgcagttagaaagaccacttttaagcaaaggctttcttttaaaacagggagatgagcaggaagataatttaaaacagctttttcgtgtatttttgagtcacttaaaatattataaaatacatgatgtacagaaaaaagtatagctagccgatttgcatagttttgagagaaatgaaatgaatccatggggcctgtcattcagctgaagaaatggaactttaccagttaccagtaaattttaccagtttgcacttccccaatgaagccctccttgctacagccataagtaaacactatcttgaaatttgtgttaagcttcctaagcttttctaggtggttttatcacacatgcaggcgttgctaaatggtatgttgtttaatattgccagtctttgacctttatataaacagaaacgtatgtatcttctgacttcttttgtttgtttttgagattcatctatgttgacgaatgtacgtagatcatatttttttttctgttacaggtaggcatgagtgggacagtagtgggctctcccccaacccactagaaatgttgggggatggtttggcaattaccgaatttgcttctctaaaaatgataattctgcagcgccagggagaggccatttcctgatggtccacacctgttatcaaaatgttaattgaatgtagacccgagggagaaacagcttcctgggcatgcatattaagagacaaaaatggtaaagtatgatcttccaggtacactccaccggaaaaaggaaggaagcctcagatgggcgtgcatgtaactccctaaaaacacttcccaaggctaaggagggctctgtgcctgccggcagcctatcctaaggaaagaatcatgggaaatagacaagcttgtaaaagtcctaggatcagggccgggcgcggtggctcacgcctgtaatcccagcactttgggaggctgaagcgggtggatcacctcagatcagaagttcaagaccaccctggtcaacatggtgaaaccctgtctctactaaatatacaaaaaagtatccaggcgcgatggcgggggcctgtagtcccagctactcgggaggctgaggcaggagaatggcgtgaacccgagaggcggagcttgcagtgagccgagatcgcgccacttcactccaacctgggccacagagcgagactccctctcaaaaaaaaaaaaaacaaacaaacgaaaaaaaaaggatcaacggttaaatcggacacttgacctactctctttaaccttcacattcccgcttgggtctctaacaagcacaccttcctttcttcctgttttaaggccttttaaagtaaacttccattcctgctctggaacttgcctgggtctctgtttctgctttatgcccctcagtcaaattttttcgtctgaggaggcaaggactgaagttgctactgacccgtgaggataggccaccggtaacttggggtaacttggatctctgccactagtaaaaaaatgatttccccaaatggtggtaccagtttactctcttacctggagtataagacagtttacagttattgtatattcttggcaactcttggagttttttcccccaatttgatggatatgaagtgtttttttgtcgtgaccctaatttgcactccctgattactgaaaagtttgaacattttttcagatttttattggttatttatgtttatctttttttccttgatttttctttttcttactgacttttaagagctttttattagtgagatattgtaatggtacaagtgttgtctgtttttggcctatctttccgtttccttccttcattccatcctttttttttttttattaggaagacctcttttaatatagttaaacattttcccccttaagtttaatgtaggagaaaagtccattaaaatctcatttatgaattctttgatacatcgtactcttaaaggtattctatttttcctaaaatgtttagagttttgcctttcatatttaatagtccgtcatctagaattcactcttcatgtatgttgtcagataagtctccaatctctgttttgttttaatttcagttgtcctaatgtgatttgactgtatcacctttttgccaccttcacttgtcaccttaagtttacagatatgtgtggagtcaattctattctatggatctatttttctatccctgaaccactacctattttctttaatagtgtagcttatcataacttttgatgtctggggctgtgttctcgggaatgtcttggttatttttgtctctttgctcttctgtatagaatgtagcttatgaatttccaggaaaaactgtgttggaattttgatcaaaattgcactgtatccttggatgtatttcaggaaaagtaacacctgaatgtcaactcttactatccttgagccattttggtcctcttaaaatctttccaaaaggtctcatacttttctacataaaagttttgacttttagcttagatttattcctagataccttgtttttgttgctattatgaatggtatcattttttaaattaaagattttaactgattgttttggtatatagaaatgccattttaagaattttctatcagttttttttggaattttctattcatatttgaataattatagttttgtttcttaagaattcttacatattttatttatctttcttaccttttgcctaggatagagccttcagtaccattttgaatagaaatagtgtttaagtcaagatggggtttagctgcataaacaaaagtatctttaatgcacaaacgcttattctcacatgtgaaagaagtccacagctgtgcaacttagtacttatgtggtagtgcactaagactcagggccccaggttctttctgtctttctgtagttctacattcaatatctagttccatatttatggttatctcataggccaggtaagtgatggagcttcagctatcaagtaaatccacgttctatgtggcagagaagtggacccgcattcagcttcctttaaggagtattccccgaagtccttcccaacttgaatttctgtttattagattaaggaattttccttctattcctagtttgataagcattttaattgaattgttacggaatttgatcaaatgcattttttgccttaattgagatgattgaaatgagtatgtatttttcagtgtttgaaccaagctcacattcttggaagcttggttatgatatattgtcttttatatatattcctggatttgatttgctgttgtttttgtttaggatttttttttttttaatctatgttcatgagtgagattggtctgtaattttccttttttgtatagtccttgtcaaaatttggcattatggttataagacaggagaattccctggacccctttgtgggacttggaaccagggtgtggctcgtttgctcggctgccgtgtactcaaaccccttacgggagagggagcatgcaggtgagcaggtgcaggagttggggtgagtgatttgggcctccagccccatggcagtgtctaggggcgttacagtgctcttttagccctgccgtctgggaatggcttaagtgttaaatagctcagtagagtcagtgtgacagcctttttgggttcccacacccagtgcatcctgaattcttgtctagcatcgaggaggaatcaggttacatgggcttgaaagatggtgaatgtgggcattttattgagtgatggaggtggctctcagtgggatggtgatacggtttggctgtgccccactcaaatctcatcttgaattgtagctcccataattcccatgtgttgtgggagggacccgatgagagataactgaatcatggggacagtttcccccatactgttctcgtggtagtgaataagtctcacgagatctgatggctttataaggggaaacccctttcgctggatttttttttttttttttttttttttaattctctcgtctgacaccatgtaagacgtaccttttgctttccgccatgattgtgaggtctccccagccacgtggaactgtgagtccattaaacccctttttctttataaattacccagtctcaggggtgtctttatcagcagtatgaaaatgaactaatacagatggggagctggagaggggatggagtgggaagatgatcttcccttggagttcggctgtcccatggccaatctcctctctgaccgtccccagccaaactcccctcgacactcagatgcttcctctcttctctcctctgctgcaccattctgctgctctgccactcttctgctcatggagcctggggtttggggtttatatgggcacagaataggggtgacatattgggccaaaaggcaacatttgggtgcaaaaacagcctgttcacatttagggctatgggtccaggcttaagggtggagccctcgccagggaccccacccttctgccgcttgtccgtatcagttacactagttttgtgaaattagtgtggagtgtttcttttatttattctccaagattgtacataaaactgaaattatctattgagtgtttggtagtgttcacctataaaaccttttagatcactatagttatctttgactagagctttagacatttcccacaagtttttataagcaggtgtacattaagttctaggtattttctagttttcagcatatttcttttttgacccatgcattatttttgtttcaaaatgtataggttttattaaagttattttgataattcccagtgaaactgcattataatctgagggtatggtttgtctaattctttgcaattatatgagactaattctttgaaattatgtgaggcttgctttaaggcttattaggaacatggacaatttttcatgtgtgcttggcaaaaaaatgtattttccagttgttggatccagtgtgtaaattgcactgttcacataattctgttttctttttgtctgcttaatatctcaattatcgataaatatgtgacatagcctatagatggtagcattgtcaaatttctccttgaagccctgatgacttttgctatatatatacatttctttaagagacagggtcttcctctgttgctgaggctggactgcagtggcgtgattgtggtgcaatgcagccttgaactcctgagctcaaggctcagctttctgagtagctgggactgcaggcacgtgccatcacacccagctaatttaaaataaaatctttcttttgtagagacgggttctttctttgttgcccaggctggtccataactgctaggctcaagcaagcctccctccttggcctctcagagtgctaggattacaggtgtgagtcactgtgcctggcttggctttaaagtttttgttgttgttgtttgctactattatagacgtgccagctgtgttttggttagaatttatttgtcttatcgttttccatcctatatctcacctaggggagacaagacccatgggcttgaatgctcattttctcatttcttttgtagcttagctgacagctggcctgggaggtctcagctgaaggtaaaaacaggctgataccagccagtgggctccagtggcctccttcttcttaaagaagtcatttcgttctaaatcaggagatttccattaggacttaattgcctagatgtatgggggatggattcctttctaagagagcactagcgtttgacagatcatgagtgatttgctgtttctctgcttaagttttctccgcttaagttttctccagtaaaccatagactttatactgtgtggcccttctgttatttgtgtttgtgttggcctgacagctttaactttttttgtattcttatgttccaggtgtgtctgtcttgtaaatagtgcatatagctggcgattcattttttctctcttttgtccatttatattgattgtggctactgatgtattatgatttgtcttagtctatgtagtgttgctattacagaataccacagactgggtaatttataaagaaaataaaattggcaggggaattggctcactcctgtaatcccagcactttgggaggccgaggcaggtagatcccttgaattcaggagttcgagacaagcctgggcaacatggtgaaagcccatctctacaaaaaatacaaaaattagctggccatggtggtgtgtgtgcctgtggtcctagctacttgggaggctgaggtgggaggatggcttgagttcaggaggtggaggttgcagtgagctaagatcgtgtcactgtgttccagcctgggcgacagagtgagaccctgtctcaaaaaagaaagaaagaaaaaaaaaggccgggcgcggtcgctcacacttgtaatcccagcactttgggaggccgaggtgggtggatcacctgaggtcaggagttgagaccagcctggccaacatggcaaaaccctgtctctactaaaagtacaaaaattagccaggcatggtggcggatgcctgtaatcccagctactcaggaggctgaggcaggagaatcgcttgaacccaggaagtggagattgcagtaagccaagattgtgccactgcactccagcccgtgcgacaagagcgagactccatctcaaaaaaaaaaaaaaaaaaaaagaaaagaaaagaataaaaaaggaaaggaaatgatgtcttatagttctagaggcttggatgtccaaggtccagggacccacatctggcaggggcttgttatgaggaagacagaaaggcaagagaccatgagagaaatgtaagggaaggggactaactaatgctttttttcaggaaactactcccccaataacttaacccactctagcaataatggcattaatccatttatgaggtcagagctctcataacctggttaccttttataggtcccagctctcaacactgttgcattggcaattaagtttctaacacatgaactttggggaacatattcaaaccacagcaggattaatttccacgtcagttttttgcttcctatgtgttctgttttgttgttattttttcctttcttgccttcttttgcattgatttttttgttacttttttcttctttaatgttatcagtctgtgttaatttgaatgttatacattctgtattcttgttggtgggggggcccaccctacaaattttaacctgctgccatggtccgaatgtttgtctctctccccccacccaattcatatgctgaaatcctaacccctaaggtgatggcatatagtattaggaggtaaggcctttgagagggcacatgaattggattcatgcccttataaaagagtcagagagatcccttgctccttcaaccatatgaaattatagtgaaaagatggctgtctgtgaaccagaaagtgggcattcatcagacactgaatatactggagctttgatcttacactttccagcctctaggactgtgagaagtaaatttctgtttataagttacctaattcatggtattttgttatagcagcatggacagattaagaagcatgcatattaatcttgaagtcgaaagttactttgggtcaagacagaacctgtaattccatttaccttttcccaatttttatgctgttgtctagagatttagttctgttttgatttcttgtaatcccacaatttacgttcttgtaactctgcctagacattattattgctttatgcagttaatatttgcttgaaattacccatatatttatcattttctttacttaatatttttacagcttcatcagttcatgtttgtttttctgagtgtttatttcattcgagttctcaaagcatagttttattatctttctgtggtatagaattctaagtggatggttaatttcttccaaaactaatgtaatgataatattttactcttgtaatgtctgctttgttttaaattgtgattttgctgtaggcttacatgtctcattatttgcttgatcctcagttgtaacaggatggtagtgatggctgcaggacagtgtgaatgtacctaatgccactaaaccgtacacttaaaaattgtttaaatgataaattttatgtagtatgtttattaccacagttaataagtaaaacaaagtttaagctggttaaagtggcaatgttacttgtgccaaacgcaccttgatttactaatccagccattctgcatcctgaacccagaatggtccacctaaaatatcagactgatcactctccatccagtgatttcctccggcatcactgttaagtccaaactccttggcatggcatataagaaagacattccaggttctggccatggcttacctttacctttaatgctgtccctccccaacactttattataaccttcactgagatcttggttaatgtatagtcagatttgttgtactcaggaaccagcagaatccccatatttgctctcttaaaagagcatttgtggtacaaaaagccaggtgcatgacctttgagcaacccctctgtagccaaagagaaagcccaaagcaataccagagcacatttttctggtaatatagcaaatcagacattcagagaaatcactccctgtacagtccatctaaaaaagttggattaaatatttttaaaaatatatggctaaatcaataaaagatttcaaaaattacatagaaaccagaaaggacaaggatctacaaatccacaaaagtatatgttagtactagagctaatgttggagagttccctgaacctccttgcaggacttgtgacaagggtgggcttggcttgtcttttggctggggtttggggtttataagggtacaggatggagggtgtggcaggccaaaaggcaacatttgggtatggaaacaggaatgcctgttcccatttagggctgtaggttttcaggcttgaggctggggcctttgccagggaactgtcctcttctgtctcgtattttcctgcctcctgtccatattattttccctatggccattgctttgggtacgtatttttccatcctcatgttgatctcattctggtgatctctaattgaaggagagactgtgtcagattactttagtctccctcacttaactttttattgctggcagcttcttgtttctgagtctggtcctgaaagtcagagggatgtacacatttcctggttcactcaattcccaaaggctaacaggcattcatcatatgtgactctgctgggtggaaattgggtcttccgagactcagattttaaaaggtctgtgagtgagttgaagaattaggagcagtttacagttctttgaacttgaaattcaaccttctttctttcttctgctcagagtttttcctgtcttgtactctgttttacagagtcctccttgggcagttacacaccattcaaaccactgccctcctgactcctccctctctccccttgcaagagctgtgacttctgaatggaagtgggagaagatcttgtcagggaggggtagaaggaagggaggaaatctagtcctgtaagactttggggtctccatgcagtgggatgtctggcagtctttttttctggtagatatagctcttgtattttataattaagctcaggcagtggggatggacaaagtattttccacatcttctttgtggttcatgctcctgttttacattgctcgtttgctcacttggccatttattcattcctttgataggatttccgagtaaagcagtatactcttggtcgattgtacttcttggtcaatacccattgatcatgcagttcgtggaagtttgactcagactttgagatatggtctctgattttcagttgatatagttattaccaatttttttagtgtgtttctttacatacattttgttgtaaaacagctggctgtcttgtttactcagcagtctgaagcaagtcattagacagctagcaatatttttgactagactagaatgtgagtaacattttgcatggttaatgcatggttgatgctggttttatacaggacttagcaccttgctttgtgcccattgacattgtgagaggtggtagagaagtaggataaagaggcaggaagtagattggttaattccgtgaatttggagaaagtgacttgtctaattttgtttgtctagggcctaccacagtgcctggccaattttgggccctcaaaagatgttggttgaatgaattaaatagtgaacaaacaaatgactgagtgttaaaagaagtttgttcttcaatggggaggaagtagtaagccttctgatgatgcagtcaggctatattgaaagtcaaataatttttagttggcagtttagggagtgattctttctggatgttgaatgtgatggcttctattttgtgtaaacattaaaatgagcgagcaaatagaatattttaaagacccatactgaataatgttttatttatttttacatttattcttgctccccagtgctctagagagttgtaaagaggtgtgacctcacatcccatgacttaattctcccttaggacattatttagatgtgttttatgatatttgttttatgtggagagatgctttttgttagagttgtctgaattcttttgcagggtgttttttcattttcaaaatgcaacaccaaatgaagttgcttcagaaattcttcttgtacagtagtgttatttacactcaaatcaaaatggtttgtggcagttatgcagttatatttgtaactttcctaaaacatataaatgtgtcactgtatcattaatttagatgactcaagatgacactaaaggctgtaaattgccttctttgtcagtgattgagatccaaatgataaattcttagtgcagtttgtttataagctctcaaaaaggcagtaatcttatcttctaaaccttatcttctaaggatgctagttagcatccttctttaggaaaaaaactgtggttttcacatgtatagcattacaaaaaaaacctcttgaaattaagatgttttctgactgaagtgcatcacgcactaggtgatcatacccattcacagaggagttacaacacattttttattattcactgtcattgttcacactgaagaaaagggcagtattctgagagttctcaggtgaagtctgacgctcccagacctaggggaatgtctttacctagagagtgctgctgagtggttaatgttgaaaaagaagtccctttcttgtaatgtcttggttctccaccaggggcggttttgtcccctaggagacattttgcaatgtctgcaggcatttttggttgtcacagctgggggataggaaggcacttagtgggttaaagccagagatggtgctaaacatgatacagtgctaaggacagcctcccacaacaaagaattacctgatcccaaatgcttagagtggagagattgagaaaccttggtccaatgtaatatgagatttcccccctaaattagtagattgaggggagactttattattccgttctgtttttcatattgtgaataagaagcagtagagaaaaaagcagtcatttcttatcactgctaggctacccttcttgattctgaaaaccataggaccatagggcattcaattaaaaagaaaacaaacacagatccttaaatccatcaacaacaaaaccaaaaccttccctgactattctctagtagatactttgaggctcaaatttatttacaaagtaatggaggagagtaaaattgtttgacgtctgttttacccaagtgaggccatctgtattcagtgatggaaataggatctgacaagaggggaggttctgttctaaaattttcttaggtgaagttgttagttttcaagatgactttatcatatggatatgggaagtgattctgtagagacagtacagttatccttcggtatccctaggggattggttccaggacttcctgctgatacccaaatccacagatgctcaagtgccttttattaaatggtatagtatttgtatatagcctttgtacatcctcccatatgctttatccctaaattccttagaatatctaactctgtgtaaatagttatattttaaaatttgggctgggtgcggtggctcatgcttgtaatcccagcactttgggagcacaaggtgggctgatcacttgaggctaggagttcgagaccagcctggccaatatggtgaaaccccatctctactaaaaaatacaaaaattagccaggtgtggtggcgggtgcctgtaatcccagctactctggaggctgaggcaggagaatcgcttgaacctggaggcagagattgcagtgagccaagattgtgcccctgtaacccagcctgagtgacagagtaagactctgtctcaaaaaaaaaaaaaaaatttgtgatatttttaattgttgtactgttttttatttttttgactatttttgcttcatagtaggattgcaggacctatggatctggtgggcccactctattctagaaaattagtaattctggattatgtaatgcttgctatgctagcaggatttactgttatagtaacagcaatgattccagacagttcctggtagtagatatcttacatgctaatgatgagtagctggcagttgagattatcaaatgatgcctctggcctgctctccatggcagacagagccagccattaaaagtcatccagtcgtgggaataaactagactgccccttcccccagtactcttttcacctaggatttcctgtattgcgtttaaggatttcatgtttgaaatccacgtgtctcatttggaaaaagcttttcctgcctttaatttagtataaagtaaaataagaaaatgattgaaattatgaggatcaagaaaaaataaaataaattaaatgaaaagtttcagtttggctcctgttgaaccctatacagtgaagttctctggaaccctctgcattcctccagagtcctccctggcttgatgctctataattgatttgtagctcaccatcttccaacttcctaagtattttagctgtgctgttttggctaaaagtaataacatttaaattctcagttggctgaaagcatctataaggttatattagagaagttttattaactcatataacttccctttttaatggatgctatatatgtgtatgatgtgacattacatttaggggacgaatgaaaagattaggagtgttaaattagaggacaggctcttttttatgtattttaatttaaaaaatatttttgtaggtatatagtaagtgtatatatttaggacagtctctctctctctctctctttgtttttgtttttgagacagagtttcgctcttgttccccaggctggaatgccatggtgtgatcttggctcactgcaacctccacctcctgggttccagcgattctcctgcctcagccttccgagtagctgggattacaggcatgcgccatcatgcctggctaattttgtatttttagtagagacggggtttctccatgttggtcaggctggtctcaaactctcaacctcaggtgatccgcctgcctctgcctcccaaagtactgagattacaggcatgagccactgcgcctggccaggacaggctctcttaaaagtgaggttaccgccactacttttattcttctgtatacaccattgtaaaagctgcgtggttctgagggtggaagtggagtggaaatacgagttgaaggagaaaaaagaacaatgtaaagtctcttgctgttagtaaagaacttgttcatgtatttaaaaaaattttttttttgttttattatacttaaagttctggagtacatgtacagaacgtgcaggtttgtttcataggtatacacgtgccatggtggtttgctgcatccatcaatctgtcatctacattaggtatttcttctaatgctattcctcccctagccttccaccccatgacaggccccagtgtgtgatgttcccctccctgtgtccatgtgttctcattgctcaactcccacttataagtgaaaacatgtggtgtttggttttctgttcttgtgtttgtttgctgagaatgatggtttccagcttcatccatgtccctgcaaaggatatgaactcattcttttttatggctgtatactattccatggtgtatatgtgccacattttctttatccagtctatcattgatcggcatttggtttggttccaagtctgctgttgtgaacagtgctgcaataaacatacgtgcgcatgtgtctttatggtagaatgatttataatcctttgggtatatacccagtaatgggattgctgggtcaaatggtatttctgtttctagatccttgaggaatcaccacactgacttccacaatggttgaactaatttacacttccaccaacagtgttaaaagccttcctatttctacacatcctctccagcatctgttgtttcctgactttttaatgatcaccattctaactggcgtgagaatgtatctcattgtggttttgatttgcatttctctaatgaccagtgatgatgagctttttttcatatgtttgttgtctgcataaatgtcttcttttgagaagtgtcagttcatatcttctgcccactttttgatggggttgtttttttcttgtaaatttgtttaaattctttctagagtctgggtattagccctttgtcagatggatagatcacaaaaattttctccctttctgtaggttgccagttcactctgatgatagtttcttttgctgtgcagaagctctttagcttaattagatcccatttgtcaattttggcttttgttgccgttgcttttggtgttttagtcatgaagtctttgcccatgcctatgtcctgaatggtattgcctaggttttcttctagggtttttatgattttacgtcttacgtttaggtctttaatccatcttgagttaatttttgtataaggtgtaagggagcagtccagtttcagttttctgtatatggctagtcagttttcccaacagcatttattacatagggagtcccttccccatgcttgtttttttcaggtatgtcaaagatcagatggttgtagatgtgtggtattatttctgagggctctgttctgttccattggtgtatatctctgttttggtacccataccatgctgttttggttactgtagtcttgtagtatagtttgaagtcaggtagtgtgatgcctccagctttgttctttttgcttatgattatcttggctatgtgggctctattttggttctatgtgaaatttaaagtagttttttctaattctgtgaagaaagtcaatggtagcttgatggggatagcattgaatctgtaaattactttgggcagtatggccattttcatgatattgattcttcctatccatgagcatggaatgtttttccatttgtttgtgtcctctcctatttccttgagcagtggtttataattcttcttgaagaggtccttcatgtcccttgtaagttggattcctaggtattttattctctgtagcaattgtgaatgggagttcactcatgctttggctctctgtttgtctattattggtgtataggaatgcttgtgatttttgcacattgattttgtatcctgagaatttgctgaagttgcttatcagcttaaggagattttgggctgagacgatggggttttctaaatatacaatcatgtcatctgcaaacagagacaatttggcttcctcttttcctattcgaataccccttatttctttctcttgcctgatggccctggccagaacttctaatactgtgttgaataggagtggtgagagagggcatccttgccttgtgccagttttcaaagggaatgcttccagtttttgcccattcagtatgatattggctgtgggtttgtcataaatagctcttattattttgagatacattccatcaatacctagttttttgagagtttttagtatgaagggctgttgaattttatcgaaggccttttctgcatctattgagatagtcatgtggtttttgtcattgactctgtttatatgctggattacgtttattgatttgtgtatgttgaaccagccttgcatcccattgatgaagctgatttgattgtggtggataagctatttgatgtgctgttggattcagtttgccagtatcttattgagtatttttgcatcgatattcatcaggaatgttggcctgaaattttctttttttgttgtatctctgcctggtgtcgggatgatgctggcctcataaaatgagttagggaggagcccctttttttctattgtttggaatagtttcagaaggaatggtaccagctcctgtttgtacctctggtagaatttggctgtgaatccatctgttcctggactttttttggttggtaggctattaattactgcctcaatttcagaacttgttattggtctattcagggattcgacttcttcctggtttagacttgggaaggtgtatgtgtccaggaatttatccatttcttctagattttctagtttatttgcgtagcttgtttatagtattctctgatggtagtttgtattgctgtgggatcaatggtgatatcccctttatcattttttattgcatctatttgattcttctctcttttcttctttattggtcttgctagcagtctttttattttgttgatcttttaaaaaagccagctcctggattcattgatttttcgaagggtttttcatgtctctatctccttcatttttgctctgatcttagttatttcttgtcttctgctagcttttgaatttgtttgctcttgcttctctagttcttttaattatgacgttagggtgtcgattttagatctttcccactttctcttgttggcatttagtgctataaattttcctctaaacactgctttagatgtgtcccagggattctggtaccttatatttttgttctcattggtttcaaagaacatctttatttctgccttaatttcgttatttacccagtagtcatacaggagcaggttgttcagtttccatgtagttgtgcagttttgagtgagtttcttaatcctgtgctctcatttgattgcactgtggtctgagagactgttatgatttccgttcttttgcatttcctgaggagtgttttacttccaattatgtggtcaattttagaataagtatgatgtggtgctgagaagaatgcatattctgttaatttggggtggagtgttctgtagatgtttattaggtctgcttggtccagagccaagttcaagtcctgaatatccttgttaattttctgtctcgttgatgtatctaatattgactgtgagttgtcaaagtctcccactattattgtgttggagtctaagtctctttgtaagtctctaagaacttgctgtatgaatctgggtgatcctgtattggaggcatatatatttaggatagttagctcttcttgttgcattgatccctttaccattatgtaatgctctttttgtctcttttgatctttgttggtttaaagtctgttttatcagagactacgattgcaaaccctgctgttttttgctttccatttgcttggtaaatattctttcatccctttattttgagcctatgtgtgtctttgcacatgagatgggtctcctgaatacaacatactgatggatcttgactctttatccaatttgccagtctgtgtcttttaattgggggcatttagcccatttacatttcaggttaataatgttatgtgtgaatttgatcctgccattattatgccagctggttatttttccagttagttgatgcagtttcttcatagtgttgatggtctttacaatttggtatgtttttgcagtggctggtacctgttgttcctttccatgtttagtgtttccttcaggagttcttgtaaggcaggcctcatggtgacaaaatctctcagcatttgcttgtttgtaaaggattttatttctcatttgcttatgaagcttagtttggctggatatgaaattctgtgttgaaacttcttttctttaagaatgttgactattggccccactctcttctggcctgtagggtttctgcagagagatccactgttagtctgatggacttccctttgtgggtaacccagcctttctctctggctgcccttaacattttttccttcatttcaaccttggtgaatctggcaattatgtgtcttgaggttgctcttatcgaggattatctttgtggtgttctctgtatttcctgaatttgaatgttggcctgtcttgctaggttggagaagttctcctggataatatcctgaagagtgttttccaacttggttctattctccctgtcactttcgggtacgccaatcaaatgtagatttggtcttttcacatagtcccatatttcttggaggctttgttcattccttttgattgttttttttttgttttgttttctaatcttgtcttcatgctttatttcattaagttgatctttaatctctgatatcctttcttccacttgattgattcggctattgatacttgtgtatgcttcaggaagttcttgtgctgtgtttttcagctccagcaggtcatttatgttcttctctaaactggtaattctagttagcaattcatctaacctttttttccaaggttcttagcttccttgcgttgggttagaacatgctcctttagctcagaggagtttgttattacccatctctgaagcctccttctttcaatttgtcaaactcaccatttttgttcccttgctgctgaggagttatgatcctttggaggagaaggggcattctggtttttggaattttccgcctttttgcgctggtttgtccctatctttgtggattcatctacctttggcctttgatgctggtgacctttcagtggggtttctgagtggacatcattttgttgatgttgatgctcctcctttctgtttgttagttttccttctgacaggcccgtgtgctgcaggtctgctgaagtttgctggaggtccagtcgagaccctgtttgcctagggatcatcagcagaggctgcagaacagcaaagattgttgcccgttccttcctctggaagctttgtcccagaggggcacccaccagatgccagccagagctctcctctatgaggtgtctgtcggcccctgctgggaggtgtctcccagtcaggagacatgggtgtcagggacccacttgaggaggcagtctgacccttagcagagtttgaatgctgtgctgggagatgtactgctttcttcagagctggcaggcagggacgtttaattctgctgaagctgcacccacagctgccccttcccccgaggtgctctgtccctgggagatgggagttttgtttataagcccctgactggggctgctgcctttctttcagagatgccctacacagagaggaggaatctagagaggcagtctggctacagcggctttgctgagctgtggagggctgtgcccagttggatctttcccggcatctttgtttacactgtgaggggaaaacggcccactcaagcctcagtaatggcagatgcccttccccccaccaagctcgagtgtcccaggtcagcttcaggttgctgtgctggcagcgataatttcaagccagtggatcttagcttgctgagctccatggggttgggatccactgagctagaccacttggctccctggcttcagccccctttccagggcagtgaatggttctgttttgctggcgttctaggggccagtggggtatgaaaaaagaaaacactcctgcagctagctcgatgtctgcctaaatggccgcccagttttgtgcttaaaacccaggtccgtggtggcataggcaccggcgggaatctcctggtctgtgggttgcgaagaccgtgggaaaagcgtagtatccggaccggagtgcactgttcctcaccgcacagtccctcaaggcttcccttggctaggggagggagtttcccaaccccttatgcctcctgggtgaggcgacaccccaccctgtttctgttcgccctccttgggctgcacccactgtctaaccagtcccaatgagatgagccgggtacctcagttggaaattcagaaatctcccgccttctgtgttgatctcactgggaactgcagatggagctgttgctattcggccatcttgccagcaacccctcttcatgtatttttaaaatggttaatggtgagtgttaaaatgttgtggtgtttagattttgttgaataaatttaaaagaaagatataatgattttgtttcaacatgtaaatatttatagtatgctagaaactatgtcctttataattttcaatggaaagttttagatgtgaaattaaaaagtacataattttctcaaaaaaatttaaagaagtgtgtgagtgctttgaaaaagccttttttgcctgtagcccaaactagaaaatagatttcttattataacccagcacaggcacccaaatgcgaaagtttataaagcattagttaccatgtataatgctctcaatctttttgccttctttccctcttcccctactttttttttcttcctatttcattccattaaaaaaaaaaagtctggtcttgacctgctaaattgtttacttccactcaagggttggaacttgcagtttgaagcaaacacctaaatctaagatagttttttctttctttgtttttctttcattttttaaaagtctgagcataaataagagaggtggaagtaaaatttatgttaatcaatttaattaattagtttccaagctgttctgtggagctgaaaagtgacatcagtttaaatgtcttctcttgcttatcctctcaggcatctgtacctcttccccattacaccaatatcaaaaactacaaaataaaaaacctaggtgggacggaaaaacagggggagagtctttatgtaatactaattagtagtctaactgatactaaaggataaattttaaaagaggattaaatcaggtctctactatgaatctaaaatctgttaaatactgaacttgttaattaaggagagaactagtgagatactgcaactggttcaaaagagaactcaaagcctcatcacacactgataggcaaataaggaatgtaaaatttataaatggatgcaaaattggttagtatccccggggcaataacgaatgcattttaccagaagcatttttatggataggaattacatgcatgactatcagttttatacaactgatctcctattcctacagatttataaaatagcctagtcaaaacaagcaaaggtgggaataacctgaatgggtgagctagccaggaaatctactgaattctaaagtattaaacaatttttccttctactgattagatttaggctattaattcctaacctaggtctaaaacactttgccacctgaaggccaagtccagttttagaggatttctaccatctgcacagtatttgtaaacatcgtgaatttcttgctattatttaaaacctagatttttacataatagctggatttccagtttgtcttggaaaatcagattgaaatggaatttactattattttcttctcttaagataaagtcccctacttttccttttcttattcataataccacttttccatatcatttctgtacatcccttcttttctcattcaaacttcacccatcttaatccagtcccgtttcagtacaactgtcttaacttcttggctccaggctcttctcagtctctctagcatgctattttacatttaatctctcttaaatactttgctcaagactccagactgcccagtaatgtccaacaaatcctgttttgccactctgaatatgctgacactttcctgacgcttacaactcttcagtaatttatttcttcccttcttttgcagtcttgatttctgttgcttatctacatggttccttcctctagtgaggttaatctctttgctttcctctatacccactatgctttttgttcatgttgatccttcctacaggaaaggccttccttctcttctttgtttatacacatcagatgaagttaaactcaaggctacctagtctgcgcagcctaccagagttctaattcacattgatctttctggaatgttttatgctttctagcgttgttttaggttgtgtattcttatcactcaagattaaagctaccaaaagcatggcctaccttcctctgtactgtattggtatctctgaggagaaattagtaaacttgttgtctaaatttttatatttgcataatcatgcatttcactgtacaaaaggaggaaggttaaacatcgttcaggattttaatttttcagcactgtgaaatttacatatttattgtatttggaataaaatgtgtgtgggtgatatatagatatatatatatacacacacacacacattcatacacatgtatttacattattctgtctatagacagtagctgcatcaatcacacaggaattttagtctatttgatatatttacattaactagtagtctgttgaaattcaaaggagataatcaaattgagaaaaccatgttgcctaatccttttgtcatggataatattacttaaaagggaagccttggagtaataggaaaaaagaaatatattctagtgctctcctacctctattctgaacaataggatctgccctgctaagcaattaggcaggcccttttatacgcagtctgtgtataccattaaaagtcaatacagtgtccttttattttctagttttgtgtgatgcatgcagaaaagaaacattttgctttttatataaagactgtccctgtaacacaaagtgggttaagagatttgagacaattttcccaataattgtgaactaaaacttacatgtgacatctaattgtgtcaataaatttttaaagaactttattgagattggatcagtaacacattgaaaatatacaatttgatgagttttgatgtgtgcttatactgctgaaacagtcactgctgtcaagataatgaacatacccatcacttccaagagtttcctgctactcccttgtcatccctccttcctttgttccctctgtgttcctcccctccccaggcaacctctgatatactttctttcactgtacactagtttgtatttttgagaagcttatataaatggaatcatatagtatgaacttttatattgtctggcttctttccatcagctttttttttttttgagatcgttgcatgttgtagcatgtatcactattttgtttcccttttactaccgaatgggatgcatatggcagtttttaaaaatccatttacctgttattggacatttgggttgtttccattttttggttattaaaaaaaaagttgttacaacatttgtatacaagtgtggacctacgttttcatttcctaagggctaagttatatggtggatatatgtttatgtttttaagaaactgccaaactgttgtccacagtggctgtaccatattacccttctaccacaagtgtacaagagttccagttgctccatatctttgccctttgccaacacttgggaaagtgttttttgtttgtttgtttgtttgtttgtttgtttttgtagatagggtctcatagccctgtcacccaggctggagtgcagtggcatgatcttgcctcattgcatgctcgacatcctggtctcaagcaatcctcccatttcagcctgccgaatagctgggacctcaggcacacgccaccacacctggctgatttttgtatttttttgtagtagagatggggttttgccacgttgcccaggctggtcatgagctcctggcctcaagtgatctgcctacctcagcctcccaaagtactggaattacagatgtgagcccctgtacctgaccggggcaaatctttttaattttaaatattttaataggtatataatggtatctcattgagattctaatttacttttccttgttgactgatgatatgggtcattttccttgtggtggtttgctgttcatgtatcttgctaggtgaagtggctgttcatattttttgcccggtttttattgagctgttttttcattattgagttttaagagttctttatatatcctttatatacattatttatcaaatatgtgatttccaggaattttctcccatttttgtggtttggacagatgaatttatttatttatttattgtttgagacgaagtttcactcttgttgcccaggctggagtgcaatggtggggtctcagctcactgcaacctccgcctcccaagttcaagtaattctcctgcctctcagcctcctgagtagctgggattgcaggcgtgcgccaccacatccagctaatttttatattattagtagagatggggtttcaccttgttggctaggccaggtctctaactcctaacctcaggtgatccacccgccttggccccgcaaagtgctgggattacaggcgtcagccactgcgcccggctgacaggtgaattctttatcccccacctgtatagaggtagctccaggatccctgagtattaagatgcattataggttgggttctagctcagataggtaagttgccactagctaataatgggtttttgagaataaaatttggtatgtttcctgtttataaatgtaaaatttgctcattgtagacaattgaaaaaaatactgaaaactacagagaaggaaatgagactggagtattcttgggaactccaggcggaagtccagctgtcaaggccatgcatatcagaagcaagagtgcttagagcttaccgcatactaggcttggggcagcaggattatacaggtcccttccacttaaattactcttaattctgctaaggattgcctcagaaatatgatgggcagaggttgcagttttttttccctaaatgtaagttcactgctacacctacagttttggatcattgtctggcctatccacttaatgaatgtttatattataaaagtatgaagtaagtgaaggtcttcatagatgttgtgcaggtagtaaatgtcttcacagcatagagctgagcaaggcttgggaaagtagggactgacaaagacagaaatggaattaatcaaatgtatttgactaacattgagaaatattatattaaagaaagtccaacacagacgtcctaagtgttaagtgtttctggtctctgctgctttactgatgaaaagcattcagttttggtgccaatagaatttggtttaagattgtgctctactctactagctatgtaaacttggaccaatacttaacctagtttttcacttcagttcttttttgttcatttaacacagggtcttgctctgtcacccaggctgcagtgcagtggctcactttcacccccgccttctgggctcaagcagtcctccaacctcagcctcccgattagctgggaccacaggcacacaccaccacagctggctaatttttttttttgtagagacacgatttcgtcatgttgcccaggctggtctcaactcttgggctcaagcaatttgcctgcctcggtctcccaaagtgctgggattacaggtgtaagccaccatgcctggtcctactttacttcttttacttacacaatgtgaataattgtgtatacctgtggggctactgtaaggattataggagatagagcatacagtagtcccccttcttatctatggttttgatttttttactgtttcagttacttatggcaactaagtaaaaaaatttatgagtacagtactataaggttttaagagagggagagagagggggaccatattcacataacttttattactatatattgttatagttctattttattattagttattgctaatctcttagtgtgcctaatttataaattaaactttatcatagatgtgtacatacagtaagttctcacttagcatcatggatgggttcttagaaactgactttaagtgaaacaacatgtaatgaaaccagttttaccataggctaattgatataagcaagagttcatttcttatggcatatttctggtcctaaaaacatcaccaacttctaaataaagataaaaacttttctaatgttaaacattgaaatgaatgttagtgatacatacatttaagaaatattaataaaacaagtaagataattatttacccaattattctagttaagtgctacagctggccagaggctcttctggcagcttaagccctcaaggcctcaggaggaaccagctctggacaggaaaccactctattgcagggcactcacacacccacccacactcactcagaaaggaaccatgtagacatgccagtccacctaatggacatagctttgggatgtgggaagaaactggagtactggggagaaaacccacacagacgtagggagaatgggccaactctacacatatatagacagtggccccagctgggaatcaagtttttttttttttctcatcagtattaaaatgaagcaacattacttgggggaaccttttgtataggaaaaaacatactgtatatagggtttagtactattgttggtttcaggtgtctacttgggatcttggaacatgtcccccatggataaggaggaaacgattgtatacggtattttgatatagggtctgacacactgtaggaactcagtaaatgttagtggcatttgtagttattccccttcgcctttccagttactagtcttaggcagggtaactaaatcttgctgtacccctcatagaggggagatctaagaatggtatttgccagtccttttctccactgtaggttacgtttttataccactgtgtgtttttgagtgatatgaaaagaatatcatgggattaagataagctgatggcagattttagtgctttagcatatgttcttttcaggcatggaggggattactcaagatacatggttagactgaccttaggtacctagtggcatgagtctttagcatcagcagcagtattgatcatacaagggaatcccaagactcttattgtaaactaggaagcatgttcccacagaacaacatcttgaggtggactgtagtaggggaaggagttaagttggtggtcagattggtggagtgatagacacgagggtgactgatgcctttgtaataatttcggaactgtctgaaattatccaaagcaaatctttgttgccattctcagttcttttctatagtctctgcctcctttgccttattcctgacctgtttttttccatgcctacacgtttcttgacttttggagcctaaattatccctccttctataatatatttgggatattataatgttctgatgtttggaagtgacagattataatgttatgctttgccagtaagtcatgctatgtaacagactgctgcagccagtgtgtttaaatttgatgttttaggtcattaaaaattttaacgtttcacttaattacttgttataaattccatacacaatacttgggttaaaaacaggttgtttgttttcttatactacacttgagtttagtctggcttttataacaacttaaacttttggggttggagaatgacttattaaaactacttttgtgatatccgtgtttgttccatttctgacttgtggccagacatcaaaaggcattggaaatttgagtccttctgttaaaagactgttattcatatgttagaagaggagccacttcgtaaagggtctctctatatatacaaaagttcttgtagcactctaatggcatgtggcacagtgaacaaggcaagtcacatggccacatctaactccagggagggaagagaaaactgtcctattatgtctccataaaacagagctggtaaacagccctaacgattcggtggttctcatttgtgttcaccatatattcagatctgtctctctactactataggcaaagtaactcacccctccccaaggcagtctgtctcattgccccattcagatatagcatcatgctcaaagttcagtgcctctggctgatacacaagagtctgttcatcatgttcagatgtggtactcttggtctggagacttcatgaactaaaaagacaagtaatctgcccctcctttacccttacaccctggtggaactggtaagcataattgccaaaaccactcccatttacaaaggcgaacaaagggagagagagaacagtcaaaagttgtagcaattctgcaattccacagtagaattttgggggacccctatcttgggcccaagaatgttccttaattatgtccagattctgcttcctgggagaggctcctccatccattgtcttccatgccattggcttcaccctgttggaattttttccttttcggtaacttccttggctacaacggaaatgggcactgggcctccttgggggctgaacagttttctctggcagcttcttatctgtagaaaattggtgtctaagggttgttttaagcattcaataatcatattactctttgaattgagaccagattatttttgcagtacaactctcaaaaattttgttggtttcttatctacttaactttagtcagcttcgtgtgtcaatagccagacctaaaatttttgctagatgtaattcttagatttcctgtatttcttatctttttcacctctgtgcatgcccccctcttctctttatttatttgaggatatcttggctccacaaggcttcagttggagacccacacccttagtctcttttttctgaaccgttttatcccaagagaaagaatttactgagtgccacattagtctacactgaggttttaatatcagctatataccctttatttgatccttagctgaggctgagttttaattagctgttgttccttaaaggccttctcagttttgtttttaactgttcgaggttgaaaagtagttgccttttccaattgtgtaagtcgtttaatttgaaatctattgtcttacatttctgcttgcaaaccaattcttttctgacctcattttttccttgtgggggtttccctttatcttattcagttactttttttcatttgattccttgtcttttcatccttttcttttgctttttcatctaatcttgtttttcaccagtttcattagaggccatctctccttgctctctatagagagtgccaaactgttttcaaacttttcttttgtatctattactatatccagtaagcactttctttaaggatttcagaagctgttccttttttctaattagaatgttttcttcttcacatgacttgtgtttttcttctccattttgaattccttttttaaaagtgaaatctgccagatatgttttctagcaaccaatagattccttttaccattcacttatgttggggttcatatccttctctgatctacaactcaggtcaggccaaccagcacaaatcccagtataattttcagttgctagaaggctttcactcacattaaatcctcaccctcccttcttggttttctgctatgggtgaaatatatgaaaactaaaacttggagcacttgctgccaccaggattattctttgctttctcttttatttttttggcttgtaaggaactgtcctcagaatcctatgtgtccttgcaagtacccttcaactttctccccagttgttttctagaaattgttggcctacttgaatgtataacaatgggaatagtaggaaaagagggttgtgtatgtgtgcttgtatttgtgtgcgtgtgagcatgtgtgtatgagggatggtcacaataatctcaccaacgcaaggatttgcactgatgggaatttaaagttggctgcaattttataatgggtactgatatggtttggttctttgtccccacccaaatctcactttgaattgtattaatgcccatgtgtcgagggcaggaccaggtgtagataattaaatcatgggagccatttcatgttgttctcgtgatagtgagtgagttctcatgagatctgatggttttataaggggcttggcactcattctctccctgtcgtcctgtgaggaggtgacttcccctatgcttttaagtttcctgaggcctccccagccatgtgaaactgtgagtcaattaaatctcctttctttataaatcactcagtcgaggatatttcttcatagcagtgtgagaatggactaatacaggtacagtgcttgagtgtctcaattaggtaaccatcagtaggggatgtttgatgtgttttcttttctccagtggccttagtcttatgaggcttaaggtagtcacaacatgacaagaaacctggacaggtctgtttattttattttttcctatcacccaaaccagtgtctgttttatggttagcaagatccttccagattctcgtgttatctgttgatttgagttttgtatgtagggatttcctgggttattttctgaatcttcagaacttgagagaggttgcactgtgaacttcaaaggatacaggagtttaaattggaagatcattttctagctttgtcggctgacatctagagaaggctcatggttttacatgtggccatagaattcctaagagtaactattgttatatcgttatgctgaactttttgctaaaaagggtaagagttttacagttgcatctgaatttgacattgtgtaatgtttctatttcaggtagcagcagcagcagcagcagcagcagcagcagcagcagcagcagcagcagcagcagcagcaatgtttcacttcttcagaaagcctccggaatctaaaaagccctcagtaccagagacagaagcagatggattcgtccttttaggtgagtctttttaagaaacaaaataattagatgaattatgttctctttaaaaaattacttgaaaattatatgattgattttaaattatttcttataatttcagaattaatttatgtgtttaatttttaaagcgtaaaatctgtaaagatgaaagtcatcaattacttggaatagtgtcatcaagtgagacttttcttccgtgttgatttggctgtgttctccaagttaaatgtgtaaaatcacttctttttccccccctttttttttttaactgtggaaaatctaaagtcttcaagaatccttgatgaattcaagttctgtcttataaatagtactaaccttgtttcataaattagcatctgaaattaaattaggcatccaataaatatttgctgaatgaagtagactttaaaatctaaatatgttaaatagtgtttcctgtttaagactattttctattataaaattaatacctgcaaattttaaaggttttagtgtctttaaaaaatatttcttacaatcaaatacagtgttcttcaccaggggagttctgaaaagtaaaatttcctccatgtcatgtcacatttcttcccctgaggaaaagttttgcacaacatctttgtatgctcttcccagaaattctctttccaaagtatggtgtggggtagtcaaacccagtgtttccttgtggttctcatccttttccatgctggacctcctcccaccaaattcctactccttctctgagaagatttgcattaactcatatggtcttcactccctggaatgtttctctgggtctccttttccagatactggtttcctacctcttacttcctttatcttggccccatcagactggcatctgctagcatcagccaatgctctgtaggctttgagaaataagggatgtttcccttagatttaagggtaatctctgtgagaccagaatagagtttttctcgtggataaactttactatagaattttccatcatttctacagccatgttctggcaggcctgttgtttttgagaacctgtcttgtatgtccagggacaggagcagtagctgggaggttgctcagaattgttttcttcagaccagatcccttatacctgaggtaaaaatagtggggcttagtctttgaccagggctgatgatttttctgggtagccttctgactgggataaggtagggtgcagtggacttaattgctaatatgacccttccttcatagtgtgtcaggaatttatgccttggcttccaagtcagaactgactctgttaactccgattttagttccttgaaagctgccagtgttacttttttcacacttcttgaattagcctcgctaacagaaaacttcaggggtacatcaggcctcctgtgaagtttctctttttcaggagtttcacaataaattcttctctcagaattttttccaaaaaactcttgttttccactctgttatatattcctgattttaaaatacctctgaagtcttaacacatatacagggaactctgcttttttctgttgtttttattatatatgtatttaaaattttttttaaaattatttttaaagaaaatagagatggggtcttgccatgttgcccaggttggtcttgaactcctggcctcaagcaatcttcctgcctcggccccccaaagtgttgggattacaggcatgagccaccacgtccagcctcttttctgttgtctttatgattagaaattgacattattctttttgttatcaaatagccatttagaggctgtaagttgggtgtactggcatctttgaaagcacatagaattcctaatgctggaccttaaactttttattcatctactttatccctacttctctgccactttgtaggatttctgagacaaattttaaccaccactgcagtggctcctggtgctgctaagatctcctccaatttctggtagcatgtagtcctgatgagacattccattgcatgtcttgtagctatctcagtagaagcccagtttccagggccttctgcctccgagtattatctactatggatctcctttccctttccaggaaagactagtttaagaagtagtctttctttaactgagcctcagaaggcacacaaacttccaaatttcgtattttaagaaggaatttccgggacctaattactctaatatgctctcagtaccagctgctccatctgagggaattttcccaggaccatcttggactagcataattggtgtcgtacccagcaccatatgtctagcagttgaacagtcatggtgaggaatcacttccgtcgtagttccaggatagcagtttaatttgcagtgcagctggtgctgtacctggttcaaatgacccaaacaaatcaggtccgccagatgttggctgaggcctcgttgcccttcagctcctctgtctgctgatgcttgtctctgtttagcctcatttccccccaggtgcaaagctccaccccttcaccattttcataaaatcctctgtacatagtcttctgtgggtaccattactctcctgaagttttgatggtatcagtcagcatcatgtctcagctcttacttcctctgtcttcgttctcttttcatcattcatcccctcttccttcttccgcagaagcatctcagaggctctccagtgacgtgctgttaaaagtgctgaccctgggtcagaccctttgggttggcttcgtggctccacgacttactctctacccttggcaggttagttacccttcccagtaccacttagcatatctaggaaatgagcacgatatcggtacctaccccatgaagttattgaggggaataaatgagttaatgtgtgtaaaatgtttagaaaaaccctgtgagtgaggtagtactattatatcaccatacacaggctaggatttaatgtttccaagtttctccagttagtatgtagcagatctggaattagcccaggcaatctgacttcagaacctatcctctaaaccactgaactatccatctttttgtaaaaaaagttatatcatcagttttaattctaagacattattgacatcctaacctctttgttttttaaaaaaagttgtattctctacaattgaaaagagaaagtgctgttttttatttgttttaataaaagaaggttggtggttgtaatactgttcataaagtttggcttttattttggctaacccaaactttttactatttaatagtttaaatgtttttaaaatattttaaaatatttcagaaaactccttgatgaagttgaaattggaagttggtatatatggtttaattagtgaaaacatccttcagtggtgaagaacttaactgaattgacagataaagatcttgacagattattaggaatatagttaattgtctttaaagttatagttaattatcaggtaaactcttttttaaaaaattgatttgctctgctaggtttctctttttattatatcattctatactgacatatataatatctactttagtctcagagcatactgtataaaatattctggaaaaagtcaagtagatcaaatggtaaatagaaaatgcttttaatgcttttattaacatggacacatacttgcacacatctgttttgttttaaattttttatttttaatcattatgggtccgtaatagttgtatatatttacagggtacatgtgatgttttgacacaggcatataatgtgtagtgatcaaatcagggtaattaggatatctatcacttcaagcaattatttctttgtgttagcaacattcaatttccactcttttagttatttaaaaatatacaataaattattgttaactatagtcaccctattgtgctaccaaatactagatcttattccttctatctaactgtatttttgtacccatcatccatccccattttatttccctctttctgctacccttccttgcctttggtaaccatcattctattctctatctccatgagttcaatttgaaaaaaactgagctccctcatatgagtgagaaaatgtgaaatttgtctttttgtgcctgctttatttcactttacatgatctcctctagtaccatctatgttgttgcaaaggacaggatttcattctttttttatggctaaatagtattccattgtgtatatgtaccacattttctttatctattcatctgtttttttgtttttttttttttttttttttttttttgagacggagtctcgctctgtcgcccaggctggagtgcagtggcgggatctcggctcactgcaagctctgcctcccaggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggcctatctattcatctgttgatggagacacttaggttgattctatatgttggctattgtgaatagtactgcaataaacatgggaatgtggacgtctctttgatatgctgatttcttcttttgggtatgtacccagcaatagaattgctgtatcatatagtagttctgtttttagtttttttgaggaatctccatactggtcttcatactggctgtactaatttacattcctgccaccagggtatgaggtcccttttctacacatccttgccagcatttgttattgcttatcttttggattaaagccattttaactgggttgagatgatatctcattttgattttgatttgcatttctctgatgatcaacaatattgaacgtttttttaatatgcctattggtcattttgtatgtcttgagaaatagctattcagatatataaaaaaatatatttatatattatttaatatatatttaattttatataataaatatatatttatatatttaatttatagataatatatatttatatatttaatatagataaatatatttatatacttaatttatagataaatatatatttatatacttaatttatagataaatatatatttatatacttaatttatagataaatatatatttatatacttaatttatagataaatatatatttatatatttagtttataaatatatatttatatatttagtttataaatatatatttatatatttagtttataaatatatatttatatatttagtttataaatatatatttatatatttagtttataaatatatttatatatttagtttataaatatatttatatatttagtttataaacatatatttatatatttagtttataaacatatatttatatatttagtttataaacatatatttatatatttagtttataaacatatatttatatatttagtttataaacatatatttatatatttagtttataaacatatatttatatatttagtttataaacatatatttatatatttagtttataaacatatatttatatatttagtttataaacatatatttatatatttagtttataaacatatatttatatatttagtttataaacatatatttatatatttagtttatagataaatatatatttatatatttagtttatagataaatatatatttatatatttagtttatagataaatatatatttatatatttagtttatagataaatatatatttatatatttagtttatagataaatatatatttatatatttagtttatagataaatatatatttatatatttagtttatagataaatatatatttatatatttagtttatagataatatatatttatatatttagtttatagataatatatatttatatatttaatttatagataatatatatttatatatttaatttatagataaatatatatttatatatttaatttatagataaatatatatttatatttaatttatagataaatatatatttatatatttaatttatagataaatatatatttatatatttaatttatagataaatatatatttatatatttaatttatagataaatatatatttatatatttaatttatagataaatatatatttatatatttaatttatagataaatatatatttatatatttaatttatagataaatatatatttatatatttaatttatagataaatatatatatatatatatatacacacacacatattaagaggcaataactcactatgttactcaggccactttcgaactcttaggctcaagccatcttcctgcctctgcctcccaaagtgctgggattacaggcgtgagctgctatgcctggcctgcccattttaaaattggattattttattttttcctgttgagttgtttgagttccttatatatactgattgttcatccattgtcagatgagtagtttgcaaatattttctcccattctgtgggttgtctctttactgttgattaatcatttcttttgttgtgcagaagccttttaacttgatgtaatcccatttgtccatttttgctttggttgcctgtgcttgtggggtattactcaagaaatctttgttcagattactgtcctgtagcatttgcccaatgctttcttctagtagtttcgtagtttcaggtcttagatttacgtattttatccattttgatttgatttttgtatgtggcgagagataggggtctagttttattcttctgcatatagatatccagttttcccagcaccactgattcaagacttccttttcccaatgtatatccttggcacccttgttgaaaatgagttcattgtaaatgtgtgaatttattcctgggttctgtatttggttccattcgtccatgtgtctgtttttatgccggtactgtgctattttagttactatagctttttagtataatttgaagtcaggtagtgtgattcgtctaattttgttgtttttgcttagaacagttttggcttctctgggtcttttgtgattctatataaatgttaggattattttttccatttctgtgaagaatgtctttggtattttgatagtgattgcattgaatctgtagattgttttgggtagtatggacattttaacaatactgattcttccaatccataaatttggaatatctttccatttttttttatgtgtgttctctttggttgctttcatcagtattttataatttttattttagagatctttcactttggttatatttattcctaagtattttattttactggtagctttataaatgggattactttcttggtttctttttcaaattgtttgctgttggcatataaaaatgctattgatttttgtatgttgattttgtatgccgtaaccttactgaatttatttattagttctgatagtttttttagttgcatacacatgtatcatggttagcatatatccacataactttttttgtggcatcgtgtgcaatacgtacattacagaaaaataaatatattttgttggtttgtgtgtttgttgatgtctaaatgataaagctaagtaaaaacttataaacatgattatatttgtagcaacaactttttatcaatatggacaccacagaatttgttagattatctccttatgtggcctttataacccatttctagaaaggtcagagtaaattatgttgtttaagctataaattatctatttttttccacttgagaataccttttcccctaggcaagcatttctgcttaacacaaataggttttaggtcacaattattagatggcattgcagagttgatggaatcaacacatcatgacttgaaattcaggtctgggcagagtctagacacttgttttggtaataggaatatctgggctgttcatatacagttagctcacatttggacagaaaacctttctccgcattaagatttcgaaagcttttagcctctgtaaaatgtctagtggtgccgaataagaataagggaaaaaagttcttgtagaaaaacatcctttcccttgtaaccagttcctattcacgtaagaaggtaatagctattccttcattcagtaatgaagttgaagtaatcctccagggtactcattttacacaaaaacaaattgcagttttcatttgcatcactgggtggcgatttttcatagccttatactactatttaaaaatccagcaagcatggcactattcgtaattaccagggttttctcctgttatgacatgtttaattgtacttttaagacattatctttaagttgattacaaatttactagtgtagtggcaagctcatagttattttaagttaggaaaagggatattgcgtaaatgttaggatataattccttccaaaactaagacaaaagcatgaattagcttattatgttatagcaaaaagaaggaaaaataacaacaaaaagtaataggatataaatgaaaaggaacaatttagatattgttgttggttcactaatattgttgaccaaatattgaatataactttgaagcaggcagaatgaaattgggcaaacactattgtagagattaaaggaattgggttacagtacaagggaaatgcatcatggttttcagaatatgcaggtgcttcttcaagtagggcataagaacttctagtttccattaagctaattattttgtaacacttgctgaatttagaaccagaatttaataattcacagcagcttggatttcaccttttaaaatacttaaaacacattgaaatatgtaatttagtctcaccttctgttttccagtctcaatgatcagtcagatattgaaaataagtgagttatttttaagattatctcctatggaattcctcattctgggaaccaaaccacatatacatacttcatttaaactatcatatttttatatggaacttttaaaggtagtctcttcatcgctgtgttgtttcctttatttaaaagtggaaatttagctgtatacataaaaatttacattctaaggaatgagggacagtaagtcactttgattctgtctagggttgaaggctttaattaaaacagtgacaaaaactaaacaggttttcaacatgtgcttcctatttttattgcctgttcttacaaaaaatgtataccagatctttaaaaaattagagtgtttatggattaaaaagtaacttaccctatcgctgtctccttacccacgtatcgggatatccagaaaaactcgatttacatttaatttacttagcagtttttgtgtttttacttttgacctttaaattgcaaagcaagtatgccaggatttttcaactaacttcatgatgtagatgcttgtttttctattaagaaatgtggagttgtgtgtctaatggatagaattaacagtattttcagtcactgttacctgattctggtttacctgttaatctagcagcgtttcagtttcagtttttcggaggtgaaaaagttaggttaggccatccccgtgtggggtacaccacccttccttaactccttgaatgtacagtgaaaggcaattgcatgaaggaagaggagaggtgccaactgtactcagaggcagaactgagccttctgtttggcacagttaattgtgggaaagtcattcatttttttcggggactcagtggatttagttgactcaaacgtaaattagggatctatctctctgtgattctaacccttctgtgcattaggggatacttagaaaaaaatactggtgctgggacccattcctagattctgattaaaaggtcctgggattaggcccaggaattgattttttccccccagagttctccagatgattctagagttcatgcaaggctgagaagcactacagttcactctctaataattgtatgtcatcaaataatgtgttgagacactttgaaaaagacttcataaaatataaagttacagtttcttttttagttgagccataaacaaaaagcaaataaaaccacagaatttctgggtaattacatttccttcaatatattaaatcattaaatagaaaaagagcagaaagcttcatacatgatcctatgaaatgaaatttgttttcttttccttttcttttttttagacggagtttttgctcttgttgcccaggctggagtgcagtggcatggtctctgttcactgcaatctccgcctcctgggttcaagtgattctcctgcctcagcctcccaagtagctgggattacaggcatgcaccaccacacctgcctaatttttgtattttggatagagacagggtttcaccatgttggccaggccggtctcaaactcctgacctcaggtgatccgcctgccttggcctcccaaacagctgggattataggcgtgagccactgcttccagccaaaattcattttctatgagtaatatacagttttcccttggtatctgtgggaaattggttccaagacccccgctcataccaaaatccattgacgctcaacgctctgatataaaagagcatagtttttgcatgtgacctacatacatcctcccatatactttaaatcatccctagattactaaaatacctaatgcaatgtaaatgctatgtaaacagttgttttactgtattgtttgaggaataatgacaagaaaagaagcctgtacatgtttagcacagatgcaattttttttttttttgagacagtgtctcactccatcacccaggctggtggcagtggcacaatcttgactcactccaacctctgcctcccgcgttcaagcaattctcatgcctcagagtcccaagtaattgggattacaggcgtgtgccaccattcccggctaattttttttttttgtatttttagtagaaatggggtttcaccatgttggccaggctggtcttgaacttctggccttgagtgatccacccctttcggcctcccaaagtgttgggattactggcctgagccaccacgcttggcaaccacaagcaatttttttttctgaataattttgatccactgttggttgaatccacccatgaggaactcatggatacggagggctgacagtttttgaaaccttagatgttttttgaaaaatcagtggaacaactgggaagcattttattaaattaattatacaatgtgaattccaactgatctatgactctttctggctttagccatagtacaactatgaatttatgtgaaattatttgacagattaacacccgtaaacttttcaaaccaacatctgaggtaccttttaaaaatcagactaacgcattcaagcagccatgttttaatacaactatttgggggtagttgactgtttcactatggtactatttccttgaagggtgcttattccatacaacatctgtagggaaaacattgtaagtatgcataccatgttatgtacatggaatttctcctactgtttccttacaggctttactaatgctgtaacttcacattttgtcagatttaactcaaaaattatgatgagtggctttcatatttatttaaactttattatttcattatattaaagatatagataatgaggatgagactctaagtaaaatgtacagtatgaatattctaccttgtatgagtaattcatatagggttggaagacctgaatgtctttctggtaatcttagtactacaatattcttttatacttaagtaattatcatattgagcatctgttttttttattcattgcatgcaaccaatgcatattatgaagggaagaattattattgggtttacacattgatcttttttttttttttgagacggagtcttgctctgtctccaggctggagtgcagtggtgccatctcagctcactgcaacctctgcctcatgggttcaagcgattctcctgcctcagccttccgagtagctgggactacaggtgtgcgccaccacgcccaccaagttttgtatttttagtagagaaggagtttcaccactttggccaggatggtctccatatcctgacctcgtgatccgcccgcccctgtaatcccaaagtgctgggattataggcgtgagccaccgtgcccggccacattaatctttataaatgtgaatttctaaaaaatttaagtgttggcccacttggtttctcaagttgcctgcctgaccctcttcgaagttgtacttttcttcttttctttcctttccgtactattctaaagctttttaataaactttcactcctgatctgaaaaagaaaaaaatttaagtgttttcttccttcattatatcatgatagaattatggtcttaccttggaagaatagtatctcataaaataagtaagaagaatgtggtaaattagtgtcgtatctttttttgattgtagtaatcagtaagtgaacattcttgagcactttctctatcccaggtgctctcctgcttggttagggatgctccagattcctgggccttgcccacacctagtgaaacagaattttgggagctatagccagagaatcagcattttaagcaagcaatgcatttagtatagctacttgggaagagttgactgttttactctacagtatttttatgcatactgatgtctgagaattgctggaataattatttttataaggtatggtagaggagcaaaactattctaggtggtggggcagattgtgtaaagttatatagcttcagaagaatctgatacataggcagggccagtattcttggctgaatagagagggtgtatcagggccactattgggaagtgtgtccagaaacatggtttgtgggccttgtgtggccttctcaaatgttagaatgttatcccattggcagtaaggaactatcagaccattttaaagcagtaaagttatgggttttgtttttttgtattttttatcagaaatttattgacaattttttaaaaatgtagataatttttatagtttcagcaagattgagaattatcttttaatgaaaaaactaattgcagcatcatgtcctgaatgcattactgagaaggcatgcacgtatactcatacgaggttgacagagtaagtcagagaaaccacaacaacaaattaataaactttccagaaccatcatgctgcaaagttatttttctgaacacctgataatttaaccttttaaatcttctttagcttcactgtgatatggggcagacactactagtccctcaatatctgtttccccctttatctttccatgtggccgttttccagttaggtgtgaagattatgatgaagtttctggccaatgggatataagaagaaatgttgtgttgcagattctaggaaatcttttaaaaacacactgctgtgtaccttccttactcctctcccctgcccccacttcccttatcctggaatgtggatatgatgattatgtagaattctagccagcatctaagaccatgagaactagggtacgttgtaaggatagctgaagagtgaagtcaaagagttgtgaagttgccataccagtcctttgaactttcctttgaacttcctttatgtgagacacaaagttctgttctgtttgagcaactattttattatgtgatttgcggatgaaccaagccctaagtaatacaggtactgaactggaaataatagtatttggattctatttaagttctgtcatttacttgctgtgtgattttgagcaggctacttaccatttcagcctcattttccttttgtgtgaaatgttaatgatatcatggtgtcttcattacattgttgcaggagatgaagcaaaaggaaactgtacacagatctgcactgacaaaagggagtacaaagaacttgtaattcttttgctgaccctgggcagttcagtgaaatgcttgggagaatgattctgaggtagcacttagtttagctggagagaatttggggatcactaatgatgtatgttgtaggcaaaggaatggtgtgcaccctgccagggccacatataggccttccctcaactcagactggaaggccgatctatgcttatatgatcagtccaccagaaagtctattcacacccactaaaagctgaagtgtttaaagtgtgcattaactagcagaacattattaaagagaattgctgccaaactctggttgtcagttaaatttgaaaaggattcacttcctacaaccggtatttccatcaaaaatgatatgtacttttatgactatacatacacacacatatttttaatgataagtattaaatacatgatattcaaggtttacactatagtgttactgatttaaaggagtaattgctctgaaaattttaagtattctaagtcaaataactaagctgtaaatttatggaacgacttatttttatttctggcatccatcatttcctgatgcaccagctgaaaatatgcttggcagcaccaaaggaaaactgtaacccctgaaatagcttgttgatggatggcttgaagaagttgataactgagataagcagccattgtccctgttgctgttgctatgttaggggttcttaacccatgttgagtttggagggctgcatgcagtggtctggaaacttctgacactacatgtaaaattttaggtttgtatttttggggggagaacattccctgcattacatcagattctcaaagatctgtaacccccaaaatattaagaattacttttttagatgttgctttggtttactagctccttgggctgtgatttcttaggatatttttatcttaatggtaaaggtgggagagttgttgtcaggtggggcatatctcattgggtacctttactagtttggcgtcagaaagtagaatgtgagaacctttttacttgttatcttaaaaaggaaaacttacttataattagtagtgattatttgctcatggtttgccttttcactgattatccgaatccaaggtgtttttctgctgccttgccctcagccccgtgtttcctcatgcagagtgcccagcttgtttcattttgtctgtgtcgtgttcagtgtcaagatctcagatgaaatctgtctcgaggcttcctcagtttctagatagctctctttttgatctcatgttgtaaatcttctatcatttatttgcttcttaatcacatggtattttgtagcagctcctatattattgttttgtaatgttatttacgcctttatttttgtatgtcttgccaattatgttgtaacctcctaaaggacatctaacccgctgcgtattttataaaattgtaagcacatgactatcaaaaagctgatcctcagtctgtatattgttaatagcttttgtaatgacttgtaaaccatttaatatttggttagaaaacttggtaatatcttctattaaggtattttctccaatgaaaataagtctttgttaacttatctattacttggatttaaattatacttactttatttagttatataaatgcaaattagtaagcattcagactaagcctgccttactctggggaggaggggcttcctttacttccctacctctgcttgaccatgcgttttaggagagccaaccttattcccagccccagaaagtcagtgctcatttgcctaagccagtcacggtagtctaattcaccttgccagtgattggcttaggaatgggcacccatcacatttctgactgcgacatgaaggaagatcaactgagagactcatgggcagatacagacagaagagactgccacctcttctcgtggcagttatttgatctggatgaaatggctgatgatgttttatctatcattgccaactttgcttaggagagctagcttgagacagaggtcacatgtcgaagatggcagagtaaaaggaggaagcaaccatgatgacattgttgaactgacatattcactaatttgggagctgtttacctctggactttttaggtgagataataaattcccgcattaaagtttaagccacttttagctaggtttatgttacttgcagctgaaaatgtctgcaccgatgtttgacagatgtgcttataatgctatctccctggataatcttttcttggtagagcccctgtttttcatgcccagacttcatggaaatgtatttatatgtatatctcagtaaagctcttcagtctgtgtctatatagaagacatttatatttatgtctttctaaactcaaaacaattggaaatagtctggagttcaattttaaatgaaattaatagattgtcagagtcataagtaaacattttgaatggtatactcactgccatcagaaatgttgtgcattttggatattgctggtaccaagggagaccatattactgctacaaagcagctagtgattaacaaccatagtaattggtgatcaggaaacaagttaaacatgctcacataatagtttgctacttatatataggtgtttttactgtgttttagttatgtcttaagaaattggttgagggttttagatgatatattccacattgtaatttttcccatctaaagtgatgggaaataagcttgccattatattttcccacccatttgattttcaggaacgtattactgatattaggcagggattcctttactaatctggaccagctatgttattaagtcagcaattctgctgatgataatgtagtctttaactagcaactcacctgtatccctcacatattttaaatgttacatatttggaaatgtatttccaaaacgctgaaggcaataaatgaaaccataattttttttttaagcatggaagttcaggagaaaaattgaagtgtatatgtttccttttaccatcccaaatttctagttacaaaatcactttataaagtttaaaaccaagtatatattatgtttttactggagttgaacattaatcatgcccagtatgtcagatgtgaaagaagagttttaaaggtaatgaaaaatattgtattaatcttatttttaaatgtttacttttttattataaattgagctgcagttttttaatattttgcaattataaggtgggggtgatgccgcacctaagttttagagctaaaaggacatcttagggataattctaaacagccacatatgtaaatatttctgtttgatagttatatattgagaatactttaatatatctaaattcttttgtttttgctaaggagagaaaggaaggtaaatatagtattgagctaccttatatgagttgccaaattatggtatgaaccaattatagtgaaagcattcccttcacatataaatgcttttctagcctgtaggcatcttttcattgctaaagttgggttaaattttcaccacagaaattcaattatgacttatacctgttatgaaaatatgtaaatacatcaaatatattttaatgttttaggtccagatatatttaaatgttttttatcccctaaaggagtgcagtttctttctgctccttctaggtctccaaagttacaggaccttgaagcatgtagagctcagcatggtacaaacctgtatttttcaatttgtgctccatgtgacccttcctggaactgagcagaagtgttatgctgccaacattgaataatggtggtcttttcacagtttgtaggggaaaaaagctgatggaattttaggtttttcattccaaaattttccttaaattctagaaagagccaccattaattttcaagcaagtattaggcaggtaaaatgtatgtatgaggaaaaaatggttattcaaggaaaaaaacttgtaaacaactgataatatctacttttataactgttctttagatatttgtagtcgtcatcattattttatattcaattaaaataaaccaaacattaatagcaatttaaacttagaattactaaatacataatttcatctaaaatgatagtttgtatgatagaatttaaaatatcagtatttactactgtcctgcaaagagcattttgacttcaagccttgcatgacattcactatatgaagagattacatttcgaaggagaagatgggaactctgctgcttattttctttctcatcttacgcatttcagatcattttgctggggcatagattctctatccagtgactgaggaagtaaattggatttttatctctaaagttttcttagaaagagctttacattttagtgacccttttttgttctatgtatttaaagagactgacaaatccctaatttattctaatctttatcgaattaaaatttgatggtattgaagtgttttctgatacatggagttctttctcaggagggaaaaaggtggttcaccagctgccaaacaaaagtcatgaagattttttagttaaaattttatctggctagtagctcagtttagccttgactaatcttgtattaaaatactcatgcaaatgtggaaggaaaaattttataactgttccaaaacttaggaatgacagtttaatgctagaaactgaggtgaagttagattgagaaaaaactaagcttctacacatagtacagtatgttgataactgcagttattaacagctattcctctttacccctggggttccattctgtaaatgaaacagagtacttcgccccctttttctgcactctcgcacacatatcaccatcttcccttactctggaaagcagctagtcagcaggtagagaagggactggtggtggtggtggtggagggtgatggggaggtatagtctagtcctcaccaggaaaataatgtgggcaggaatagagacaaaaattggtgctgctagtagtcatgaggagaattataacttttttcttgtactcctgcagaccacgtggtagaaataggaggagaaagacattccaagagagaagaatgacactgaatgaaagcccagagaaaataggcaaatggattgaatgctatgggcacccacctgcctctaagctggtggaaatttatattcatacagtctttgtggaagacaaattgtcaatatgtatcagaagctttaacaaggtagatcgattccctttgccttagaaattccacttttagtaatttatcatcaaaacacaagcaaatgcattttttgtttgtttgtttgtttgagatggagtcttgctgtgttgccaggctggagtgcagtagcgtgatctcagctcactgcaacctccacctcctgggttcaagtgattctcctgcctcagcctcccgagtagttgggactacaggcctgcgccaccatgcccagctaattttcgtatttttagtagagacggggttcaccatgttggtcaggatggtcttgatctcttgacctcgtgatctgcctgcctcggcttcccacagggctgggattacaggcatgagccaccgtgcctggccaaaatgtggcttttaaaatggtatatttcatgtgaacctttttgttatgtatattttatgtgtctaaaatagctgtaggaggaaaaacatttacctaaggaccatatgattacaggtaatttaatcttttttcttcctgttgattacttatatctacttcattattctgtaatgaacaagtattacttgtataactccaaagtcaaaaggaaccccaaaggtatatatatgtccctgaattcttgaatctctcagggagctgtagttcttctaaaagcagaagtacattttactattactactgaaattgtactgtgcttcttgtttccagtatacaattcaccaaacatttactaagtaaatatgaatagttactcttaaaatatctttatctatctatctatctatctatctatctatctatctatctacattatttcggtagacttaaggccaatgtataatataggaaaatctcatctgaaactttcccttcattctgcaatagcttagtaatgtatagactttccaaggggaaaagatgttttgggggaagaagttaaccaaatttttatttgggtttctctctcatgttttcctggatgtcgatagttcttttattctcaaaagagcttcatgaaactagaacttccagtgtatcaggaggcatcctttaaacattaaggtctattttaaggtgaaattctactatattttaaaaattgtttatttaaattctataacttttagtggattgcacaaatttatgccttgtttattttataatgactttattacaattttaataatttagcaatattatatgaacgtgaagttttatatccttctttaaatattttgtaagatgtttatgtgatattttaagtttaaacttataaactctaatcatattaacactacttaccatgagtgtatgtaataatttttcctctgtggtgggtttttatattgttaataaagttatatttcatattatcttaaaatggcaattattaaaaagaagagctttccctctgaggactgagatctctctttttgttgccattattgtcagttgttctggaatactaatgctttgttgatataaggcaactgagtttttttcaactgagtcattagacacttgaacaagagcaaagctttagatttttctccatacctatagaggggcactatgaagtagttggaaatttgtctgtgtgagtcatatttgagcattccaaagaaggaatgaagcatgttttctttttctcctcatgactagtgataattgagtatcttttcttgtacttattggtaactttttatttttaatttttatgagtatatagtaggtatatatatttatgggttatatgagattttgatacaggcatacacatataataatcacatcagggtaaatgggatatccatcacgtcaagcatttatcatttttttgtgatacaggcactccaattgtaccccctcagttattctaaaatgtataacaaattattgcagactgtagtcaccctgttgtgctatcaaatgccagatcttacttattgtatcaaactatgtatttttgtacccattaaccatctccattccccaccccacccccaccactgtccttcccagactctggtaaccatcattctactctctatctctctgagttcaattattttaatttttagttcccacaaatgagtgagaatatgtgaagtttatctctctctgcctgacttatttcacttaacataatatcttttttccatctatgttgttgtaaatgacaggatctcattcttctttatggctgaatagtactccattgtgcatacgtaccacgttttcttcatccattcatcttttgatagatacttaggttgattccaaatcttagctattgtgaatagtgctgcaataaacatgtgagtacagctatatctttgttatcctgatttccttccttttggggatacacctagcagtgggattgttggatcatacggtagttctatttttagttttttgaggaacctccctactgttctccatagtggttgtactaatttacattcccaccaacagtgtttgagagttccccttttgccatatccttgccagtgtttgtcattacctttcttttggataaaagccattttaactggggtgagatgatatcttgttgtaattatgatttgctttctctgatgatcagtaatgttgagcaccttttcatatacctgtttgccatttgtacgtcttcttttgagaagctcgctgtttccaagtagagaaaatcactgttgctgccaaccaagtagccgtgcaataatttgtttacttgctgtcaacattttccccaccacagtttatctcatagagaattctcaagcccagccaactttaagatttcatttgtaacacagaatgattatgttatattagataagaaaggctgtagagagagaaaaatctcctaaccttgtctttctgtcttttctagacataatacgttgattttttttactctgattctgtccatttaatttttattacatgtttctcaaccatggtctttccttgttactttcaggcatagaacttcctaaatgtttagtctcagagcaagaacactcaagcttttcatgttctttggcactagcagccgtaacacattgaatttctggcagtggaatttctactcacaggatctgacccctcacaccatggccctgaattaaaaaagacattgcttctgagcatatgcaactcagcaaggatcctcaacaacttgtgtcctatgtagacctagcatctttaatatctatgtatgttgggaattatctgtcaatgtgtcacctttaggttctttatttttctacatctgtcttctgtggtcataaatgctgattataagttaagcagcagtgtgcacactacatcttatgcactaatggttggatttagtatccaaccatggcaggagtgtgaaacagtgagatggatcattgacctttgtctataggaggctcttttaaaccctactgtgtatatctccgttttttttttttttttctgataaacttaccagtgtaatttttttttgagatggagtctctgttgcccaggctggattacagtggtgtgatcacagctcactgcagcctctacctcctgggttcaagcgatcctcccattgcagcctcctgagtagctgggactacaggcatgcaccaccatgcccagctaatttttttattttttgtagagatgggggttttgccatgttgcccaggctaccagtgtaatttgttttctccttgaactcatacaagactcactcttttagccaaagttggtaagaattattaggtagattaaaaaaaaaaacaccccaaaacaaatgtggtctgatggtgaagtatcacgataaagacaatttgtaaaaactgtgaaatcatattagatcttagtataaaattctaattttctataaaaaaatacttcttagaagtcctgagcttagccactggaactggccacaagacctgatttgggaagaggtaacctgttatatgaatttagttagtaaaattgtagaaattcagatgtcatttgatcccagggaagtgtatttctccccagctattaaccagtgtcaactgtctgaaatttattgatccgaaggctcttcctcatttgttgccagtagctctccctcatacagaacaaatgactcacatgctcaagctaaataaagcactccgtaaagatttttctgcctctagaactgctcaaagtcagctctcaatagtgggcactgattcttgccaactggtttacccttattaactctataggtagggccctgtgaaaccacactaacatgtagatgttctctctttttctttcttcttctttttttttttaaaggctgcccttttcagacattccttctgaaatctgttaagaataacataagactagtcacagatttattgatttttcctgggcatttgactatgtgaagtggaaccagctatgacctaagcttagcaagctcagtaaacaccctctctttgctccaaggtctgtataacttctgtcttagtacacatgccaagcagtcagcaggaacggtcttgtggtagatgagatgattttcagtcaggataagtcagattgttttgcttttctttttatttaaaaaattattttttcaccctttaaagtcttgatgatcataatccacttcttgatggaatgtgtacctgacactttgatacactttgcaacagtcctgattggctttctgaacagattccttattatctaggaatgatatcttctatctaattattttcccaaataactgcttagtgtttattgctttaatatcagaatcctctattctgccagacaagttgcagcatttaatttgttttcttctaaaacacctatgaaacagataaattatccattttatttcatttcctgtaagttattttcttaaaacaggtatcttatgggtacatactggaaactttaaaaaatggctaatgtaaaattcattttgaaatatgattgtggcttccttttgtggcagtcctgctcaaaattttccaagtatctcaggaaggaagaagcacgaatatgtacctgctaaagcccttggggtgggcacctaactttaaagatatttttatttttttaagctgatattatcacattcatgtgacattggcacccagtgtgtaatagagctgtggttattttaacataaaatgctttaaattatggatcatcaggtagtaaactggaggatatgagatttactgtattttttccttgtcattatgcctcttttcacatggtgcatgtactcttgggtatccatcttccaatttgagacgtataaatcagagtttttcagttgcttaaatgactctctgtttgagaccagaagtgttttcagaggaaaattttgatattccctcagctcaccttcatgagggctgtgaaataaaaactttggggagttgcctggattggattccttagcaagctgaccccactactcatttgattgttagaatgtgcatttcttttaattagaaatagagaatttctgcacttcacgttctggctagacaatatgttatctgaatcaaatacttactaaatgcccatgagttagacactgtgctgacaggcactaagaataaacaggtagttctatatctgatgtgatattatttattttgaattgctatatgcttcattagtgtttttggatgaaatttagtaagatatagacagggcagatttatttctgtgagaagattgcaaaatataacagttcccattcttgaagtaactagagaaaatttttttagtgctttttaaaataaggtttatataatggtgcgtttcctgctgcatctctgccatcaatttcaaccaaactggtagaagttttgattgagaagtagctgtaagttgactttcagtgtttttacagcttagccttttccttagaagtcacttctagaaccagatccacctgatttaacaaaatgtgtttgaggttgaatcattgcaggctttattctgtctaaatgtttttttcttttctttttttttgtagtatttcgtagaactggagatcctgtttaggcagttgattccacagttttgactatcaagtaacccagttgtaatgtgggtgctacagcctcagcttcttaaatttggtttggagcatcctttcaaccttctttctccagctcttaataattacctgctccacttctttaatgactatttagtggtaaggtaaataggaatcttgtcttaagatgaattcatctcaaagtgatttggagccaaaaaccagaccatgacatttctggctgtggatttcgtttccaccaactcaccctcttgtcttttttttttttttttttgagacagtctcaccctgttgcccaggtctgataacagctcactgaagtctcgacttccctgggctcagtgattctcccacttcagccccccaagtatctgggactacaggagtgcaccatcatgcccagttaatttttatatagtttgtgtgtgtgtgtgtggggggggggtagataccaggtttgctatgttgcccaggctgatctttgcctgccttggcttccaaagtgctagcattataggtgtgagccaccgtgcctggctgggttcccccaactctcaaggggtgctgagttgactgattatgggaatgccagaacagaattctgagaatgcatttgtgtttttccttcttatcagactcattttaataatataacagatttaatttttagttttcattgactctttatccaactgatttaaaatttaaatatatttatgctttaatcactcataaacttggacctcaagttaaaaatttaatatccttagttccttagaattttgtaagaatttttgaattagaagtacaattttgtttagtttttacttacactaaaataggaaaatcattaagctgtttaaaaatagtggcaccagactgaactaaacaggagcagtggaaagtttcactttagaaactgctagagaactgaatccctagggtggtccctggatgtgatggtccaatctgtaaggtcatcttggaaatagatttagttctaagtttaggaccagaaaagactacttccttcctccaggcttttcacatttatccctaaagctatattgagtgagggcagatatatttttcaattccacaactgctggtgcaccacaacttgtaaggttctgtaatcttagtgctcatataatgccttacacatattaagtttttagtaaatatttgttgggggagaatgagtagatgaattggcatggtaagaactctaaactgagctctgggttataagtaatactgtttatataagtggaaatacgtgttttgtttattcatagattatagccagaaaactacacttaaaaataaattcctgaagtgaaagtaaaaattaatgttttcttctcatgaagtaagtgtggtgatacttacaagttattcaaatatttagagatgctcagtaaataactacttctgtggagggtgtcttagtcagtctgggctcctttaacaaagtgtcatagattggtggcttgtaaacaatagaaatgtatttctcagagttctggagactgggaagtccaagatcaaggcattggcaaataggcagtctggtgagggccttctttctgttcatagatggcactttctccctgctccccacatgttggaagggtcagggtggctttctgaggattattttattccattcatgtgtacttcaccctcaataccaaagtacctcccaaaggtctcctaataccatcactatgaggggtaggatttcatttcatgaattttgagggaacacaaatattcagtgtagagaaaacacctgaagtccaaaaatttatattaagaaaaagtcaggctgggtgcagtggctcatgcctgtaatcccagtttgtgggaggccaatgtgggaagatcgcttgaggccataagttctagaccatactgggtaacatagtgagacccccatctctacaaaataaaaacaacaaacaaacaaacaaacaaaaacaccaaagggccgggcgcggtggctcacgcctgtaatcctagtactttgggaggcctaggtgagcagatcacccaaggtcaggagttcaagaccagcctggccaacatggcaaaaccctgtctctactaaaaatataaaaattagccaggcatggtggtgggtgcctgtaatcaaagctactcgggaggctgaggcagtagaatcacttgagcccaggaagtggaggttgcagtgagctgagaatgtgccactgaactctggcctgggtaacaagagcgagactccatcttaaaaaaaaacaaaatgccaggcatggtggtgcatacctgtagtcccacctacatggaagactgaggcaagagaattgcttgagcccaggagtttgaggctacagtgagctatgatcacggtactacactccagcatgggcaacagagggagaccttgtctcttaagaaaaagaaaaagtcatacaagtataattcacacttggatctctatcgccatttggttaatattccagttgtgtattagacatttaataaacatgttctgtattcttgtagaggaagatgtgtgaggaggaatggaatctatcatacctatttaaggaatgaactgtatcatttcctctctaactgtggggcttagagccctaaaacctcatgtaaagataaatttgtggctgagaaagttaaaattttaaggggaaactaggttaggggaccttaaattgaaggtatgtgacagtttttgcatttgctagaagaaaacaaagcacactacagacaatctatgtgacattttatatatcttaaattagtaatactggaactgtcctgctcaacttcatttgccatccgttgtttgctagagactttctcagtgctcactcttacatgcttgtaaatctgtgctgctttgtgaagatgagagatgtatgaagtagtatttttctgaaccttcccctctatttaaatgctctgtgtctgtgcttttctgattcagagttgaccttatgggtcttgcttataaggtcctatatttcatagtgaaatatgattaggaggctgattaggatgattaagagaatgacagggtatttacttatgtttgcctcctatctgtttatcagttccccttcattctattcaggtttctgcagctgtgggtcctcccatggttatttcatgacaagccatttacccatgtctcggatgactgtctgccctctgaggatgcctgggtgtatttgctttcttcagtctccatttatctttcctaataattcactgcaaccatttctgccatctctctgccatcagctatacctcccttttctgtttctgacctcttttctcttcttaacgaattttccaaataagagtggctcatgatttgtaaaaagtagaactgaaattcatattgaaattcagatagagaaggtatacagaaatatattcacatatagttgaatttaatgtaagggatgtcaaggtagggaagtgattactatgtagatgttttctattgtgtttgtgattgcaaggaggattttatatgatagtcatagcttgtctttaaaagtttggtatgtgataatatcagaacagtaaaaggctatttcacattttaaaactaaatctttattaaataattatttcacaagttagtaattattgatattcttcttcagggactagagttcctatgcttcctaaactgacttttaaggaaagatgagactatattcagtgcagttttaatatgacatattttattatctcttattttttaaattgatattttatgaaggagtctatggactataatacgaaaattctggttggggaggcaggaaacctggctttcaagtacactccaatagcttttatataaaattcaggtgttctttttctctaatacttgaaatagctattttcattttcatgtcattttctgtacttttcctgatacttttaaacattgttttattttcaaatgaacagccctcaaagatgaaaataaaaagcaaaagtttcttaatgtcttaaatgcttttgtgtatattaagtgactttctttaaattgaatcttacttttccactgacatctatgatgatttctgaaatgtgctccggtgagtaaaatttgacaagccactccatctgccagtggcctgggtttttgttgttgttgttgttgttgtttttggtttgccttttgtaaaaaatgcttagagacaagtcaaccagtttgtttgctgatgaacagttattgcttcacccacctgtacaacttcattgtcctagctacaggggaaaatcatttatttttcacttgcgtcattctccagtcctgttgtcgtgtaaacttatcatgtgctccttgaagccatgcgagcaggcagagcagaatttcaggagaatgccttcagctagtcttctagttagtactacactgagtttactgcctgctttttagaacttccttgccaaaccttcactgaatgactcttcatataattgaatacagctgtagtttattttatttgccgaaaataattactggtgcccactaaaatggtgattaaaatccacttgatgtttgtactcttttttgctgagattttaaaaatgtgcttacagtgaggcttctataataaaaataatgtagtttcctgaattatggaattcgtgtgttctcatttaaggttgcagtttaaattgatcttttatcaaaatttagactgaagaagagattttccatctaatttatttacctatagaatttttaactttttagtatgaagtaccattttgtgagtgctctaatttcttatttattaaataaaaagaaaactaaattttattcattgtgtggatatagcacatacacataattttataaacatctttttgtaacctatattgaatcccagaggtcctgactcaggtttcagacaagctcaaaatacaggcacttacaacacaggtgctaacaacaatttgtcctaatcagttcagggccaaagttcagttccttcttctctggccaataggatgttttaattatgaaacgcagacatctcagcactttgggaagccgagactggcagatcgcttgagcccaggagtttgagatcagcctgggcaacgtggcgaaaccccgtttctacaaataatgcaaaattagccaggtaatgtggtggcgtgcccctgtagtcccagctatttgggaggctgaggtaggaggattgcttgagcctgggaggttgaggttgcagtgagccatgactgtgtcactgcagtgaagcctgggcgacagataacctgtctcttaacaaaggaaagaaagaaggaaggaagggaaggagggaagggaaggaaggaaagaaaagaaaagaaacatagacataccttagagcaacagttctcaaggagatactttgatggaatcccagacatcttccttttccaactaagtatctgtgtgtgaggctgtgttttctttattgtatttcaactaaacaacacatcatgatagtctgaatgcagaagagaaaggccaactgttttctgttgagctagaaattaaggatatttgtaaaattataaggctactctttttactacctttctttttgttttggaaaatatagtcatttttcatagaaacattcatgtaaatatgtaaaacagttaacttaataaatatatttaaaatttgttttgaagttttgatttctaatatgaaaaatattaacagatataactgacgtaagagtcctttgggtcctcagtaatttttgagagcataaagaggtcttggagatcacagagtttaacaactgctgccataaagaattgcttctgggccgggcgcggtggctcatgcctgtaatcccagcactttgggaagccgaggtgggcggatcacaaagtcaggagttcaagactagcctggccaatatggtgaaaccctgtctctactaaaatagaaaaaaaaaaaaaaaaaaaattagctgggcatggtcatgcacgtctgtagtcccagccattcagaaagctgagggtgagaatcacttgaacccagggggtggaggttgcagtgagctgagatcgcaccactgtactccagcctgggtgacagagcgagactccatctcaaaaaaaaaaaaaaaaaaaaaaaaaaagacttgcttctgtacttaaatgccagtttaacttatagattgtctttaatcacaaaagggtcatcaattgaaaaaaaacgatgtgttttatttgggtaaagtaaaataggcctagaagatgggcagattctaaacagtattcatcatctgaatgaaaagaagattctggataaactcagcatgcctttacagatacagaagaggaagggcgctgattgtgaaccatggtgcttcttggcatctgtaacacaggactactgacattctttctggcattgttattattctgaattgaagggagctcctgttctgacatgttgtaaaccagtctttgtttttgaactttttatgcaatgatgagaagagatctcaacttaggaatcttgttgacatgcatggaataggaagtggcatataaacttccaagatgattgtaacgaagttcgtatagttgatgcactgtgatttagttttgtcattaagattctgttttggaaaaatatctgacttataaaaaaatagaatcttaaaaatgtttaatcataataaccacctacattattagagtgctttggagtttaaaaagtaattttacatgttctaaaaatgtaagcacgataaaataactatgtaggtttaagttaatgtaattggtttgggtcactgctctgtacagcctgcacccagtgtttatattcagtgtgttattacaaaatgcttaatacatattgtatgtaatcatctggctctaagtactatgcttgtgtaatccattgttttcataatcatattagtatttctattatagggataatgaattagagttcaagatgaaacagtcgaacttatttataaacagagaactgaatgtttttaggatttttagggtagtgaaactactcttatgttaatatattggtgggtacatgtcattataaatttgtccaaactcatagaatataaaataaaaagactgaaccctaatgtaaaatatggactttggtgatagcgatgtgtcagtgtatgttcatcaattgtaataaacattcctttctggtggggaggttgtaaatgggggagggtgtgcatgtgtaggggcaggagttatatgggaattctctgtaccttctgttcaattttgctatgaacctaaaactgctctaaaaaataacctctgctttaaaaaggtatgtgtactctataatcttttattagaaatctttgttgctatttttacatggaaaaatacaggatgaagtcattattccctagaataaattatggaagtcaccattcaaagttatgatggagtcaggatgctacaaagaaagtagattatctcaatagtgttgtgtatgttgactgatttggggaagagagagtaattagtgaaaatatgtgaagtccatgttgagtcagaacaaaacggataatcaccttctgagatgaaaaaaatcatcaaaaagagtctaaaaattatctgttggtacagattttgggaaaatctagaagaggtggaagtagtgaggctgctcatgttatcaccctagtctgggtttgctggttagagcatgtatgattggaagagagagagagaagttcaggaaataccaacagagcatgggaactgtactaggttcagtgattccaaaaccaaaaatgaaacctatataacaatgctaacaatatatgtaatatttccagagtttccaaagcctcatttaaattgtgcctgaaaatgttagatatcattttttaaaattggaaaaaatgaggaatacaaaacttaagtaacccatccaaaggcacatactagtaggtaataatgaagataactaataataactcatttacataagaactctaagaacttagtactattatttctaactcacagatgggaaaacaaagtgtcgatgaggttgactaacttgcgtaagagtgcgtggttagtaagtgacagctgggattttaaactagattgtctgagtctgtgctcttaatccgtatgttctacatcctatctgttggttttgttattttttggatagagcatcttgacttacttagatttaaaataaaatccattgcagcacaaacatttgcaggggtggctaagatcctaacagaggcccagggagatgacagcaaatctttcctaatgccaggcttatattcttgtctcattcttgtctttgaagtcaaaacatttttagtcagtctctagaaacagaaacatgactgtgtcaggacactaattaattagcattgaggagttgttttctgattataaatatataactattgtactaccattccctggttggtaggattgctgtttgtgcacattatttgaggagatggaataaacaggcaaaatcagtttttacaaccctgtgtgaatactggtctgtacagcaaagattatattcattatggttataaactccttgtctgcctacaatattaatatggaatgaatgttatcaccaagttactgtaactcagaagacttcagaaaatatcctctaggtatcaaattaaatttgtaactacggtactttttgcttgccttgaatgactttccctggaagccagaagccttgtgttcagtttctagcaccatcagcaatgttaccttgggtaaatcatttaaacatgttgaacgtatgttccatttggcagtgggaatgccatatgctctcaaattgcttcagtgtgattttgtaaaagtgaaattgattttaaaatatgaatatataaagtgatttcactacttattaagtagaatgcattgtatacttcataaagctaacaaataataaaagactaaatgatattttggaatttaaaaaagacctctttagttttctgtgatccaaaatctggcttaattttgccttaaagctattcttagtgttaatatataatgctttttaaaaatcggccaaggtatctttgggcatttgtagtccttttctgttcagaaatgtcattaacttgaaatataaagatgctttctaaggaaactggtttgcctagccagatcttttaatgtagttattttgctatgtgagctgtaaaacccaaacattgaggctgctttccacaatgccttgttgcccagacagtgatgtcatgttttaagcatgtttagtttgcaaaggtcctgcttttgatcctttagttgtcacttttttaatgcggctcctcctgaatcacaaaggtactgaaagtaatttgcttcattaaggtctgttgctgacactgttgtatttcagtcgtcattcttctcttagcctccttcattaagaccttattcaaatttggatcatggttctgctgcgacatccacgccattatcatctaaatagcaattacatattcaaacacaacagcttctccttaactgtctgtaacttaacattttacatagattcaagtgggaattaagaataaaatgaatcttttcttcgtgatttacaaccctccctttcacccttggtttactagttaatgttgaataagctacttgtagacgaaggaagacaaaattattgattgctcagctttagttttgtagagagatatatattataaattgtttctgtattaaacagttacccaagtgtcagtgacccttattcaatcacccatgtatttattagacagcatttaccattttggatataaggggatcaggtctaacactctgttaagaaattaataggatcttttacaaaagcagcagtgctttataacttgaaacattgaaaggaaacctttaaaaataagtcaacatatttgtccttttgggacagacctcaaaaatagaagcaaattccattaaagtagtaatatacttttcctactacttcgttttggccatcttaaaattatattttataattagtaaataagctgatttgactgaaacgagcaactatgtttattggagacagacccagcttttcaacagatagaatgttaggactttttttgcccattaatatgtggtttaaagggaagttataacaagacaccaaatgcatatgtatatatacaaatacaggcagttgtatgtttttaagaagtttttaaccagcaaggggtgtgtgtttgtgtttgtgtgtctgtgtgtgtgtgagagagagagagggagagagagagaaagggagaggaagggagaaagtgtgggaggaaaagaggagaggaggagaagacagaagaggaaaacagtcctaactattaaaaataccaattaactacttaataacacatctttcagtgtcttgcataataatttcttagatattttgcaaaattcggcatggttaagggattttgtaatggttaaataattttattagttgtttgaaattgactgtctttgttttcctatctgtgtgctgagatttatctcaattatatgtgtgaataatgttatgcatggggttacttttaatatggatttaactgagattctagactatattctttgtaaatatgaacattagaaacttgttcaattgtgggtcgtcattaattcaagtcaggaaggctcaccctttgtcctcacaccatctcttaagaagataagtcctgtggataagctggagaggtcagatgttggtgttgacttaaagcattgccacccgaggagggcagaatgctgtaaaacaaagcagaaggaactgtgtggagagaaggtgaatgactgggggacttgaagttgaaagaaaagtcaggcgctgagcctgcaagggcaaaatgaggcttgtgggataagaatggtttgtcagaagtcacctgtttgctcagaagtcatctttccctaacaagggtctgtttggtatgttcctgtattacaatttataataactgtttttttacctgctgagggtaagatctttaaagtgacatcttaccagctattattcttagctcttgcttatgcaaatctcaatttgaaaaataaccttttaaagtttttttttttaaataatgagaacatattcagaatgacaatgtgatgaacacctgtgtacccaccaattggtttaagaaatataatttcttgttaaccttgaagttctctaagtcttctccttactcccacctcagaggtaaattccactctttaaattctgcttttttggggtctctttttaaatagtgttaacatatttttcatatgtgtagttttgtatgttttacaaccatatataaatcgagtcactcacaatgtatgtacaatatgttcttcagcaatttgcctctctcactcagtatcatgtatctggtctcatctatattgctctatgtatctttagttctttcatttttatttgacattccattgatgaatataccacaatttatatatctgttctgatgatgaacatttggggttttgttttgttttcctaaaaacagtgctgttactgaacattagtaggcagaagaaaaaacaaaacaccttgatctgtgtctcacactttatgcaaaaattgcccaaaatgaaaggactagtccctagaataagtacttgcaaaactcagcagtaaaaaacaaaaaacaaaaaaacataaaaccaaattagaaaatgggcaaaagacatgaagagacatttcactgaagaggatatacatatggcaaataagcacatgaataagtgtcattagccataatgcaaattaaaaccataatgataggtctctacaaacctgtatcagaatagctaaaataaatagtaataacaccaaatgctggtaaggatgaagagaatctggatcacttattgatgataggaatgtaaaatggtacaattactctggaaaatagacagtttctgaaaagctgaatatgcagttactatacgactcagcaattacactttgggcatttatcccagagaaattgaagacgtatatgtgcataaaactgagtatttatagcaattttattcataatagacccaaactggatacacaccaaatatccttcaacaggtgaatggttaaatctatggtatatctatatcatggaataatactcagcaagaagaagtaacaaactgttgatatatacaacaacctggatgaatctccagagaattatgctgagtgaaaagagccaatccctaaaggtaacgtactgtatgacttcatttatgtagcattcttgaaatgaccaaactgtacacaaaaaatagagaaatcattggtcgccggtgggtaaggatggggtgaaagttagaggcaagtgtgtgtggctatagaaggataacactggggattctggtggttatggagatgttctgtatctggtctgtgtgaatgaaatatcctggttgtggtattgaactatagttttgcaagatgttgccattgtggtaaaccaggtagaagctacatgggatatttccatataatttctccaatctgcctgtgaatctagaattatctgaaaaagttcaattaaaagacaacatgatgctgttacaaacatccttgtacatgtctcctggtgcacatatgtgagctttcctctagattttatttccgggaggaattacaggctatgcacatgttaactttagtaaatcatggcaaatttttttcccaagtggtatatgaaaattctatccttttcatattatactctatcctttttaaggatattgtacttcaaggatattatactctatcctttttaacatgtaatactgtgagacttaaatttttatcagtctgttggttagaaaatggtatcttgtgtttttaatttacattttcttgtttataatggaattggacatttttatttatgtttaatagtcatatgtggtttttttgctcagtaaaatcactattgatctcttttccctgctgtattgtctgtcatttaaaaagttgattctaaggggatctagttacaaattttgttgcattttaatgacttatgtttttctttttatctgttaatgaagagacattttgatgtgacagttttaaaatatataaaacttttccttaactttcatatttcagtctgatttaaaaagtcccttcttggagatcagaaagtcatcttcctatagcatcttcttatagctctatggttaactttggttatagtgtggtatagcgatccgattttaatttttttttgtagggataacctattttcttagtactattttggattaattcatcttcttttcttcacgtatcttccaagcttactcttacatatatagtatctttggttctcctactttatgaggctatttttctctctcttagccaatgtcataaagctcattatattaccatcctttaaaaccatctcaaccttcctttgttctctgcttttctatataatgaagcatcagttgatcttatgccaaataaataaaaaatgaataacagatggataatcactcaaacctacccactctgatgtgatttttgttgaaattttattgaacatatagattaatttaggggagaattgctatatttacaatatttagtcttcttcagaaatatatttctgtccatttgcttaggtttccttaatacatttttgtaaaattgccatgcatttttcataaaaatcacatttctgcttttgtcagatttattcttagagtgcttttttgttttattattatagtaaatatttttaaagttgtattttctgtttgttgccagcatagaaacatgtagctgatacttgtagcaaccatcttgataaaatatttacttcccataattcatctttagattcttttgaattttctaagtacgtaattataacctctgtgaatagtgagttttgtttcattcaaatccttgtggtttcattttatcttttggtcttactgcatggtctaggacctctagtatgttgaagagaagtgtcaaagaaaacatcttttccccacttttgattgtaaaaagaatgcttataatgtttgcaattgtgaactactacatacaatacattttgtttttttgggttgctcctggttggctaaaggcttattgtagaaacataataggcatagagtgttgttagaattggtataagatttgattttaatagaattcacctgtaaaaattatcttggcctcgtgtttctttagtgggtagcttttatgtaccgaatgaatttgttgataattgcagactagcctattgtgtcaatttggtaagatatttttctaggtgattgctcattcaaaaaatattctagggccgcgcgcggtggctcacacctataatcccagcacattgggaggctaaggcaggcagatcacaaggtcaggagattgagaccagcctgaccaacatggtgaaaccctgtttctactaaaaatacaaaaaaaaaaaattagctgggcatggtggcgtgcacctgtagtcccagctactcaggaggctgaggcaggagaatcacttgaacccaggaggcggaggttgtggtgagctgagattgcgccactgcactccagcctgggtgacagagtgagactccatctcaaaacaaaacaaaacaaaaacaaacaaacaaacaaatctaagtttatagacagagttttttttttttttaaatgatatcttcttaccattttttaatctctgggattttcattatgttctgctcctcccccccatggcaatattgtttatttattgctttactatttattttcttagtgttttcaaaagaccagttttaggatgtattgttcctcttttgcattttattttctgtttcatcatttcttgctcttaccttaattatttcctttttcattttctttggagtttattttgttagtttcattttgactttttaagttggttgtttgtccttggatcatcatttttaagcttttaaaaattctaatatgttcattaataatgccctgtatttccctttaaatgctattgagcagcttccaaattttaatttgtattatttccattcgtttgtcattttgcacatttttctcttttcaaaaaattaaaaaaattttttctagaggcagggtctcactctgtcacccaggctggagtgcagtggtgtgaccacagacagctcactgcagcctcgacctcctagtctcaagtgatcttcctgccttggcctcctgagtagctgggactacaggcatgtgccaccacacctgccccacacgtttttcatcgtcaatacttctttgttgagttatttttaaatgttttaagatttccaaaaattgagtttttttgtgtgttatctttttgatgaagatttttaatttaatgtcctgtggtcagagagggtggtacaaatgatagaaattcctgaaatgtgttgagacttgattcatggccttttctcaaagaaaagcatatcagtcttaactgacctccacttatatgactttgcatattgaccagcatttccaacttttctataaatccttggatgttgacagcatctagtttattctctgatgagcagactttctttggctgctccagcagagtgctgctgaagtgtcaagctgtttgctcctaaatgtatgtacttgtttattataattgcatgatttaattaaaatatgaattaagaggttgtacttaaacatgaataaagagggagtacttatagctacgaaactttgttaaatgctttagaaataatctatatagtttaattgctaaaataaaaaaggagctgtcaatttaggtgtgggtgagatgacttaggatctaggaatcagtggtagattgatttgtaaatatctttaaattctcatttgctttaaaacagttggaggttgtgtacaatgtattatatgttggacttacataagaaagacttagaactccatcaggtgtccctaactgcaaataaaggcctcagctgaaaaccttcctgggggaaggttaaagcaagtaacaggttggaagctgggagaaagtcaggatttagggtgttgggcacttgtgtagagtaatttttttatttcctcatgaactggttgttcaaaaatttttctttttttttttttttttttagttgatagtaacacttgcagacctgttgtaccatgtggttgaactaagcagaacaggggcactagaattaaacaacaacaacaacaacaacaaaaaactacagaggaattacagttgccataggcagcaatgaaactagaactaaccaactgcagttttttgttgtaggcaaatccacaaatcttagaacttaaaaaaaatacttttttttagtgttttacgagatgaactctgaattatagaatatctcaccattaatatgcaccttcagcatagaaacagttaaagaaaataaacttacctgaaactattgtattccctgtgcattgtcttcacatcctttttctgagtacctgagacaaagtgaactacaagtaggataagaactgaaaagttttcaccagatttatgaatacagtttcatcaatgatcttggtgaatagtagtagcagaagagttgaccatagaccttatagctagctgttagaatagctaatttaatgaattttttcccaaatctgaaactcaaagctactgataaccaaagctagttccctgataagtaacttagggaagtgcactcttatttcaataattaatgcttccatgaaattatataaacattcatgcattccgacaatatctgaatatttctgtgtgctaggtgctgtgctgggtgttgggtatgccattatgaacaatacaaagaagagctctgttttcattcaaatgaggataaagtttttcaatagcaattatttttaaaaatgaaaataaagatccacaaatttccagaaaaaaatgacctaaaagtcatagttttaccattgaatgtaatatccttcctgtaatccatgaatcagagtatgtaaagagatgtaaaagatgtaagaaagagttttgagttttaatttgggaaaagaagtataagacagtagtagcagtcatataaaatagaatagcatcaaacatttaaaaaatagtatcgtgatagcatagagcaaaatttacattttaaccatttactaaactttggtgaaaactatcacttaaaaaatccttaattacaaggagatagtataaaacatagtttgttgctgttgtatatttgtttttaagtatctcagacaaatcgaataattttttaaattagaaactaatatatgtcaggcatatggctacagttaaaattttttttgaaaatgaaattatggatgcagaaagcaaacaagctgtggcagaaaaggatggatctaaatatgaagaggaggaggagataagagcaatccagctgcaaaaattactcatgccataggtagttttagatgccctagaaatagttctatgttgtattgaataacagcttgaatcaggattcgatattattacaacatgggaaggaacaatgccaagaaaaattgtatttattcttataacttcaaagtgatacaggagctcgaaagaaatttaggcagttagtgaggctaagagagtccttggcaaggtttccttttaaataaaaagcagcccccaaatcatttcttttctaacaaaagagcagcctgaaagatcgagctgcagacatagataagcaagctggaagcttgcacaggtgaatgctggtagctgtgccaatagtaaagggccacttggaagccaggtatgttcaacatggaggctccaccttcccttttctttgtcaccacgtgcacagtaaagaggcaggcaacatggtgctggccaggtagcaaacccatctgcctagtaaaagattagggtggaggccggcgcggccggcgcggtggctcacgcctgtcatcccagcactttgggaggccgaggcaggcggatcacgaggtcaggagatcgagaccatcctggctaacacggtgaaaccccgtctctactaaaagcacaaaaaaattaggcgggcatggtggcgggcgcccataatcccagctactcgggagcctgaggcaggagaatggcgtgaacctgggaggcggagcatgctatgtaaatggcacacctggtctgatcaatctctcgtgccctatgtaaatcagacaccgcctcctataaaaccaacctcttcttgccctgaacccggaaacccgttcgggaccccttcctctgcacgagggagctttcctctttctttttcctttttctttctttctttttttcttttttttttttttgagacggagtcttggtctgttgcccaggctggagtgcaatggcatgatcttggctcactgcaacctccgtctcccgggttcaagcgattctctcacctctgcctcccgcgtagctgggactaccggtatgcgccaccacgcccagctaattttcgtatttttggtagagactgggtttcaccacgttggcctggctggtctcgaactcctgaccccaagtgatccgcctgcctcagcatcccaaagtgctggaattacaggcataagccacctcgcccagcctcctgtttctttcatctattaaaactccactcttaaactcactccttgtgtgtcctcgtccttcagtttctttggcgtgagacgataacctcaggtatttacctcagacaactctgctacttcagaagtatttactttattaaatgaatatgatttattgttttgaagtaaaatgtttaaggtatgcatgtattttttatgatttcccactttaactgatttttttattaaatgaagaaatggtctcaatcacattggctaacatggcctctatttatttaattcatctgtttttcccactttggggcatcaacagcatggagtatttggaaaactacttgtatttgtaaagagtaaaatgcagtttaacaaagaagttagtttgtcattgtatagttcaggaactctggcctggatgagagcatgagtttgaaattttgtcctcaagattttgtttttatcttaccatcaccttttatgcttaagtttatgattggccataattatcaaattgacacattatgtcatgtgaaaatctgtttaccaaacttttctattaataaacttgatgtttaattgtaatattaagagtcacagagtgctgtagattctgtttgtcatagttgtgtagcttttagagtttagggaaatctagtttttagaattgacacaatgatttttaattttagcagtgtgttgaataacctgtgatataccattcacttattaacttcacattgttgtataataagttataaattttagatcagataagaaagtaaaactggtattaatttgggaagaagaaattgcagaacttgagtgatttttccaaataatgtgtcagctgtaacttgaatgtgttatttttatccccaagggtattttgaaatatacttatgtgaatttcttatagtttattttaaccataaaactattttgatatttttataatgccatcgatgatactgtatgcatagtgagggcatgggttgtctgttcttaccaccatattcccagcactagcatggaacaaatgaataagaacggagtaaaaatgcataatctaaacttgactatgtgtgtcttcaaaataatacctttaagttattttgaaggaaaaaactatgtatccaacaaattcaaacagatacttacaaaattaagacgattgtaaatgtgtgttgtcctccttctcattgtttttcacatccaaaaatgtcctcttggagcctcttatctgagtagctt

SEQ ID NO: 75 - DNA, 36887 bp, Homo Sapiens
actggttcaatggtccattctgtttattcagaacggtaacataaatacaccttaaatattaacattttttatatacagaaatgaccccactccccaaaaagtttgaaaaaatattgtctcctcctcctttataaaaccctagatgacctatgaaggcacagccaagcccttgatgcatcttcctcagcacaatttggccaacgctggagggaaggtcaaagaggtggaaggaaaatgttatgctgaaaatccctttccaacaagggtgccaagcgccggtcttgaacgaagtaccctgcctaagcatcatttcctaaagcgcttgaagagcgggtgtacatgtttgctgggcgccttgctccgcgatgagtggtactccatgtacacagtgtcgtcggccccagacatagaactcatggtgccaaagcgccgagatgcctgccgggaagggggaaccagcccatgttagtctccagaagaaaagatactccttttataatacttataatcacagcaaattttataagacttacataaatttaatacatcatttttaataatgtttacagatcgcttactgtctcaggcattgttctaagcattttacatgcattatctcctctaatcctcaaaactactataatccacacctgaaagaagaggaaactgagacacagagagattaactaacctatccaagatcacatagctcttaaggagatgggatttgaacacccaggtagcctggcttcagactgttcttaaccataatgccacactacctcacttaataacaacttctgaacaaactttttttttttaagagagaaacagggtctcgatatgttgaccatgctggtctcaaactcctggactcaactgatcctcccgcctaggcctcccaaagtgctgggattacagacatgagccaccatgcctggcctgaacagaattttttaacagttagggcaaaagttccttaaaatctcctgagacaccaccataaggctttgaatcaagtggaaggacagaaagccctgggcttgactcttggctcctcctgtccctgagtaaccctgaggcaagtaattaatgtctgcacctcaatgacctcatctgtaaaatggggataaccacatcagtgctgacattgctatcctgtgaggagaatgaaccaggcacctccttaaaaccagtgagagcaatgagagcactctcctgggttcccatggagagtgccccctgggtcgggggaggaaagccttaggctggagggagggcagccccttcccagggacagctgtttccttcttgccttggtccagcagttgctcaccttccggctctaatggcaactgaatttcaaacgcacctgactgaagtgcacttctccccttggacaggcctgctaattctccataatgatgctctcactaattagaccatatatttacttggcctagagcaggcatatttgtagaataaatgaaaggttgagtattttcacagaactctacatttttcaaagttaagtatcgaagctaccacaagagttgatcctcagagcagtcttaggggctagagggctcagctttatcactgaggaggaaccagaggagaactgtgtggccacagccagggatggcagccctgtgtgtgggaactacgtacccccagcccatcatgctccctccagtcaccaccaaggtgagctggggtcacctgcttgccatcctgggcttcaacatcaagatttaacaaatactcgtgtgagcaaagcaggagaccagtcacagccactgtgagctcagctgtgtgcaacagtacaaggggcacacaccaaaagggcaacaaggattgtttctgttcatctcttccgtgttttccaacatttccaaaaaaatcccatgggcccatccaggcaggactacatgtctgtgtctgtgtctacaaacgctgccctgtgagagcactgacacctggaacctcctcacccatttactcacctggctggatctggagccaaattccccagccaccacctcctcctcggcatccaggtcagtggctgccaggactttctgtaagagctgctgttgctcttcttttgtcgaaaacgccaagtcttcctcctccatgccagcgagtttcgtgatcacctgcaaagcccaagccagcagacatgcccctttctgctctctctccccagccctcctctgccttctcctgggtccacctgctttggtcacttccctccccaggcccagccaccctggtggccaacaatggagagctcctccctagcattccagagaccagcatcaggagccgcctttaacagggagcttgactaatgatctcaagaccagagggatgcaggaatttcagagaaatctgcccccagcacacagcatctaaatgatcatgtatggaagatcaacaggaagaatcttagtgattttaaaaggctccttcgggtagccttcacatcttggagcagacaaaggaagggacaagtgactggaaggcacaggctgtggccctttgtgaaggtccctggcatctgctgtgctccgcaactggggcttccagcaggaatgagcacgtgaaaatgaaaatgataggatatcaggaagattatttatagagcttctctgagagagtaagaacagcatggtggagactgggttttcatttctatggggataacttactacaagggctccctatccctgcagaaaacttgggttgattctgtaaagggaattctccttccctccaattctcataatgttcattaaatgaaaattcctagaagtaaggatctgagtccttctgggccagggatccagagtacagacgatgtgcacatctgcccaggcccagccactccacgtcatgactctgggaactccaaccactgctcctcaacaggcagcaccgaagacacagctccaaccaacacaaactactacggcatggcattgtgcctttttgtcgaggtcacctttcaaagaattgctctttctgacctggtgctcctcttaccctcacagctcggcaggaatcaggaggtaggaatgctattaccaacagggattttcatggatggataaaaaggtcatgatgcaaatcctccaaaaaactgggctcaaaacccaagcatcttgtcctctaggccagcatgagaggtctgaagtgtcactgcctctagctaaaagagggaaggtcagacaaccctgtcctcctaaggccaataatgggaactctcaccaatgcataaagagacacattaaaaacgtatctcaaaaggcagcctggattgcagtcttttgcaatcaagaacctgggagtctaatgttctagggatgtccttttagtggaccatagggggaatttaattcccctacttctagaaccctccatctatccccaaaatataaagccctctggacaccaaatactgacataaacgtaatatttgtgtaacaggaaagaaagcaaatgcctcagccagtgaaagttagccaaagctttagaatttcccaattattaaaatacctgatttgtagtacaggatagctctgatgtctgggaggcaaactgaggcaaactaaggcctggagcttaccagctgatgaaaggaagagctctcctagctacctagagaggcatccctgagaaagcagccctgcggggctcagattcacacagtgctggtcatagtgccatggcacctcagtcctgccaggacggcacactttccaccaacagctgccctcagagattcatgcagagataaagggagtttgaggcaaggcctctaatctcctaatgcttggtgcctgcctgctgacagtggccctcgcttctcctggaggccagggtatcaagaaggccttggtcctagtctaaccagaagccaaatggatatgtaccttgaagctataaccttgatctaccaagaatctctgccgcttggttgagtaagccatttcctgtgtgtcctgggataccagtgagtagaaaaaggcattgtactcttctgcaaccatccctgcaggaaaaaatgagaaacggcaataaagaagacaacattagccattagaatgccaagagctaagggtcccaggctcaaaagcaagcactggagtggaaaagccctgcactcggggttaccacctgaacttggcatgggattgcatcaaaatttggaagtcttttgtgcttccaaggacaccatcaagtgaaaaaacaatcctcagaataaaaaaatgtggaaagcatatatctgataagggatttgtatctaggttatacaaagaactgttgaaactcaacaacaagacaaattaattataaatgagagaagaatatgaacagattacttctccaaaaacaatataaaaatagccagtaagcacatgaaatgatgctccacaccattaatcaccagggaaatgcaactcaaaagcacaatgagattatcacctcacgcccctctccgaggatggctacaatcaaaaaagcagataactgccactgttgtcaaggatgtggaaaaactagaacccgcatgcattgctgttgagaatgtaaatgatgcggctgctttggaaaacagtctggcagttcatcaaaatgttaaacacactgttataaccacatgacctggcaattccacttccaggcataaatccaagagaaatgaaactatatccacacaaaaatttgtacatgaatttcatagcagaattcttctaagagccaaaaagtggaaacagcccaaatgtccatcaacagatgtgtggataaataaaatgtggtatgtccatggaatcgaatattatttagcaataaaaaagaatgaagtactgacagatgctacaatatagataatctttttgaaaacattatgctgccgggtgtggtgacccagtcctgtaatcccagccctttgggaggctgaggtgggcgtggatcactcaaggtcaggagtttgagaccagcctggccaacatggtgaaactccatctctactaaaaatagaaaaattagccaggcgtggtggctcatgcctgtaattccagctacgcgggaggctgaggcaggagaatcccttgaacctgcgaggcagtggttgcagtgagccaagatcgccccactgtactccagcctgggcgatagagcgagattccatctccaaaaaacaaacaaacaaaacattatgctaagtgaaaagaaaccagtcacagaaggccccaagtggtctgactgcatttacatgaaatgtccagaaaaggcctacagacatcaaagtagattaggggctgcctagagctgggggttgggaacaagaggaaattaggagtggctgtgcatggatgagggtttcttttgggagctgatgagaatattctaaacatgaattgtgttgatagttgcacaactttgtgaatattgtatttcctaggttttcttcgaggatccttatagtttgaggtcttacatttacatctttaatccattatgagttgatttttgtatgtggtgataggcaggggtctggtttcatccttctgcatacagttagccagtttccccagcaccatttattgaatagggagtactttccccactgcatatttttgccaattttgttgaacatcagttggctgcaggtacatggcattatttctgagctctctattctgctccattggtctatgtgcctgttctgtaccagtaccatgctgttttggttactgtaagccctgtagcatagtttgaagttggatactgtgaggcctttggctttgttccttttgcttaggattgctttggctattcaggtgcttttgtggttccagatgaattttataagttttttttctaattctgtgaaaaatgatgttggcaatttgatagaatagtgttgaatctgtagattgttttgggcagtttggcaattttaatgatattgcttcttccaatcctcaagcacagaatgtttttccatttgtttctgtcacctatgatttatttcaggagtgttctgtagttattcctaggttttgtcttttgtttttacagctattataaattggattgtgttcttgatttggctctcagcttgaatgttactggtgtatagaaatgctactgatttttgtacattgattttgaattccgaaactttactcaagttgcctatcaggtctaggagccttttggtggagtctttagggttttctaggtatagaatcacatcattagggaagacagataatttaacttccttttttcctatctggatgccttttatttctttatcttgctagactggtctgagtagaactttcagtactatgtggaataggtgtggtgagggtgggctctttgtcttgttccagttcttttttttttttttttctgggggacggagtctcgctctgtcgcccaggctggagtgcagtggcgtgatctcggctcactgcaagctccgcctcccaggttcatgccattctcctgcttcagcctcccaagtagctgggactacaggtgcctgccaccacgcccggctaattttttgtacttttagtagggatggggtttcaccatgttagccagaatgacctagatctcctgaccttgttgtgatccgcccacctcggcctcccaaagtgctcggattacaggcaagagccaccgtgcccggctgtcttgttccagttcttaaagggaatgcttccagcttttgcttacttagtatgatgttggctgtgagtttgtcatagatggcttttattattgtgagatatgttccttcgatgccatttgttgagggtttttatcatgaaggaatgttgaattttatcaaaagctctttctgggctgggcgcagtggctcacacctataatcccagcactttgggaggccaaggtgggtggatcacctgaggtcaggccttcaagaccagcactgccaacatggcgaaaccctgtctctactaaaaatacaaaaaaattagctgggcatggtggtgcgtgcctgtagtcccagctacttgggaggctgaggcaggagaatagtttgaatctgggaagcagaggttgcagtgagccaagattgcaccattgcactccagcctgggcaacaagagcaagactctgcctcaaaaaaacaaaaaacctttttctgtgtctattaggataattatatgcttttcatttttaattatgtggtgaatcatatttattgatttccacatgttgaaccaactttgcatcccagaagtaaagcctatttgattgtggtgaattaactttttgatatgctgctggatttgctttgtcctcattttgttacagatttttgcgtctgtgttcatcaggaatactagcctgtagttttttcatcgtgtctttgccagattttggtatcaggatgatagtggtttcgtagtatgagttaggaagaagtctctcctcctcaatttttttgaatagtttcagtagaactgaatacatctggtccaggacttttttagttggtagatttttttttttttttttggaggcggagtctcactctgtcacccaggctggagtgcagtggcacgatctcagctcactgcaacctccacctccagggtttaagcaattctcctgcctcagccttccacgtggatggaattacaggcacacgccaccaagcccacctagttttgtatttttagtagagacgaggtttcaccatgttggtcaggctggtctggaactcctgacctcaggtgatccacctgcctcagccttccaaagtgctgggattagaggtgtgagccaccatgcctggggccatattttttttttaaattactgattcaatttctccttattgatctgttcagggtttcaattaatttctgattcaatcttgggaagttgtatgtttccaggaatttatctatttcctctagatttactagtttgtgtgcacagaggtatttttaagtctctgagaatcttttgtatttctggggatcagctgtgatgtcacctttgtcatttctgattctgcttatttggatcttctcttttctgttaatctaactagcagtccatcaatcttatttatctttttttttgagacggagtctcgctctgtcacccaggctggagtgcagaggtgcgatctcggctcactgcagcctctgcctcctgggttcacgcaattctcctgcctcagcctcctgagtagctgggattacaagcatgcgccaccacattcgactaatttttgtatttttagtagagacggggtttctccatgttggtcaggctggtcttgaactcttgaccttgtaatccgcccacctcggcctcccaaagttccaggattacaggcatgagccactgcgactggccttatctatcttttcaaagaaccagctttttatttcattgatcctttgtattgtttttgagtctgaatttcatttagttctgctctgattttagttatttcttttcttcagctagttttgggattagcttgttcttatttttctagttccttcaggtgaaatctcaaattgttaatttgaaatctgtcttctcgatgtaggtgttcagtgctataaactttcctaacaatacctttgctgtaccccagagatttagtatgttgtatctgttttcatttgtttcaaataatttttgattcctgccttaatttgtttatccaaaagtcattcaggagcaagttgtttagtttctatgtaattgtgtgggtttttttttttcttttttcttttatttagcgatgaggtctcgctatgttgcccagaatggtcttgaactcctgagttcaaatgatcctcccactttggcctcccaaagtgctgcggttacaggcatgagccactgtgcctggccaattgtgtggttttgagagttcttcctggtactgatttctacttttattccactgtgacccaagaaaatgcttggtatgatttcgacttttttgaatttattgagtcttttttttttttttttttttttgagagagtctcgctctgttgcccaggctggagtgcagtggcgcgatctcggctcactgcaagctccgcctcccaggttcacgccattctcctgcctcagcctcccgagtagctgagactacaggcaactgccaccacacacccggctaattttttgtatttttagtagagacggggtttcactgtgttagccaggatggtctcgatctcctgacctcgtgatccacccgccttggcttcccaaagtgctgggattatcggcgtaagccaccacaccctgccgaatttattgagactttaataaagtcgagcataaagtctcacattgctttatggccaaacacatgatcaattattttttttttttttttttttttttgtgacagagtcctgctctgttccccaggctggagtgcagtggcatgatcttggctcactgcaacctctgcctcccggcttcaagtcagttctcctgcctcaggctcccgagtagctgggactacaggcgcatgccgccacactcagctaatttttgtattttagtagagacggggtttcaccgtgttgcccaggctggttgcaaactcccgagctcaggcaatctgccggcctcagcctcccaaagtgctgggattacaggtgtgagccacggcaccaggcccatgtgatcaatcttaagagtatattctgggggcagatgagaatatatattctgtggttgttgcgtagagaattatgtagatgcctattaggtccaattggtcaagtgttgaattttaagtacagaatttctttgttagttttctgcctctataatctgtctcatgctgtcagtggggtgtcaaaatctcctaccattgttgtgtggctgtctaagccttttcctagctctaaaagtacttggtttatgaatctaggtgctccaatgttgggcgcatatatatttaggatagttaagtcttcttgttgaattgaaccatttatcatcgtgtaatgacctttttgtccttttttactgtggctggtttaaagtctcttttatctgatgcaagaatagtgaccccctgccccactctttttttttttttatttgtgtgatagatttttttccctatccctttactttgaacctatgagtcctgttacatgtgagagaggtctcttgaagacagcagaaggctgggtcttgtttttaatccaatttgccactccaagtcttttaggtggggtgtttaggttgtttacattcaaggttaatattgagacatgaggctttattcctaacatggtgtcattagctggttgctctgtagtttggattgtgtagttgctttacagggtctgtgggctatgtgcttatgtgtatttttgtggtagcaggtgtcaccattctttcatttccatgtttagaactctcaagactctcttgtagggccagtctggtgataacaaattcttttagcagttgcttgtctgggaaagattttatttcttctttgctcatgtagcttagtttggcaggatatggaattcttggttaggatttttcttttttattttttttcttaaagagactgggtctcactatggttttttggtttttgtttttttgttttgagacagagtcttgctgttgttgcccaggctggagtgcaatggtgcaatctcggctcactgaaacctctgcctcctgggttccagcaatactcctgcctcagcctcctgagtagctgagattataggcacctgccaccacgcccggctaatttttgtatttttagtggagatggggtttcaccatgttggccaggctggtctggaactcctgacctcaggtgatccactcacctcagcctcccaaagtgctaggattacaggtgtgagccaccgcgcctggcctgtttttttgtttgtttttgttttaaacaggatcttgttctgttgcccaaggtggaataccgtggtgagatgtcagatcactgcaacctctgcctcccagactaaagcgattctcttgcctcagcctccggagtggctgggactacaggcgcacaccaccacacccagctagctaattgttgtattttttgtaggaacagggtttcatcatgttgcccagactggtctcaaactcctgagttcaagcaatctgcctaccttggcctcccaaagtgctgggattacaggtgtgagccgccgtgcccagccaggatttcttttcttttctttaagaatgctaaaaacagtcccccaatctcttctgacttgtaaagtttctgctgagaagtctgctgttagcatgatgagttatatgaccctttctctagctgtctttaagattctttcttttgtattgaccttggaaagtctgacggctatgtgctctggggatgatcatcttgtacagcaggaagagtcattctcaccctcgatcttagcaaccttagcatatgatttttattcccttgcttaaattaataacttttaccttttcgctttaagaaagcactttacagcttctctggcatatctgaattgctagcatcattacacttgtgctttggggccattagtaagataaaggttacttgaaaacaagcactgagatacagtgacagtccgtgacaactgagatggctactaagtgactaatgggtggggagaatttaagcatgaatatgccgcacaaagcaagaattcacatcatggatgctactcagaatagtgtgtaatttaaaacttatgaattgtttatttctggaattttccatttaatatttttagactacagctgaccatgcgtaattgaatgtggaaaggaaaattgcagatatggggggactactgtattaaaaaactaggacagaaaattctgtggcctgaaagacttgatccttcaggaaaatctgaacatctttgctttgtagttcaaatgtcagtaggttaagcatactgcccttgaatgtaattgtttctcaaatcttacaagagctcagagatgcaaagaaaggagccaagtgtcatgttaaacagtgttttgagtaagaaaacaattctattcacttttttttttttttttttttttgagatggagtcttgctctgttgcccaggctggaatgcagtggcgcaatctcggctcactgtaagctctgcctcccgggttcacgccattctcctgcctcagcctcccgagtagctgggactacaggcacccgccaccacgcccagctaattttttgtatttttagtagagacggggtttcaccatgttagccaggatggtctcaatctcctgacctcatgatctgcctgcctgggcctcccaaagtgctgggattacaggcgtgagccaccgcgcctggccttctattcacatttaagggagtttttaaggctaggcacagtggctcacacctgtaatcccagcactttgggaggccaaggtgggtggatcactagagacgagcctggccaaaatggtgaaaccccgtctttactaaaaatacaaaaaaaattagctggacgtggtggtgcacgcctgtagtccgggtactcgggaggctgaggcaggtgaatcacacttgaccccagtagatggaggttgcagtgagccgagattgtgccactgcactccagcctgggtgacagaataagactctatctcaatcaatcaatcaatcaatcaatcaataaaggagttttcaaattagagtaaggaataagtaatgaattatattcacatttgctagcagatcatagtcctgtcagtttataaaagctactgtctcagcctcccaagtagctggaaccacaggtacacaccaccacgcccagctagttttattttttgtagagatggggtctcactacattgcccaagatggtctcaaactcctgggctcaagctatcctcctgccttggcctcccaaagtgctgggattataggtgtaagccactgtgcccagccagccgactacattttatgacttataagctgaatcctcacagcagtcttggcaagacaggattgtcacccccactttggatgggaaaaccaagtctcagaggagaaaataatttgccaaaggtgacacagctggcttggtgcctgagtccatgctatttctagtccatgctatctgcctcatctccattttaaatacaagctactagacgcttcttaaacacatctgaacgcagtacagttccaacagatgcccactaatcttgtcattttcaaacattctagcagtccagatgcctccttgaataagcagactccttgaggatagggcttgtgtccttgtctcaggatgtgccctggtcccagtaagacagacacggccatctcttagcaagagtgtcagtccctgccatgtccacaatggcagtctgggcccttttaccgcagtaagcaagcacaggggtgccacgcctcctcagaaaaagcctttgcaatgaggattctcacctcctcactcactgagcttgccctgcccctgctgcaagctgccaccagggcggcactctgcacaggttatgaatgacgtgcccattgtgtgtctgcccaagctgctcctaccaaacctttccctgcctcctgatcaagttccagaagcagcttccagctcctccacttacactggtggcccagctctgttttctcccttccatgtctaccccataagcactgccttgccctggctccctctcaccatctaccaacacagctgcacagtgtacagagcacatctgtgtggattccgtgacactgtcatggaaaacacctgcatattcacccccaaggtatgagaaataatgatgggccataaggatctaggtctttgctttgggattctctccctccagagtctatttagccccagggcacatggcagctctcacccctatcgtcttcctaactaaagtggtttaagaggagtgacctcctgcaacagaagatgaaaggccactttaccttttttagctcgaagcacccgccctagcctttgggcttcctgacgcctggagccaccatgggatgagatctgaatgaggacatttgcttccggcagatcaaacgaagtgtcacctacctacagaaacaagttggaaggtttttatatatgaggaaaaaaaaaaagtcaactgatccagaatttaaataagttctgtagataattttgaaacataatcactcttttctcctctttataccagggtctatctgatgcaggcagagagaggtgaagcaataaacctcagaaaggcatctctgggtctccaggaccttgtgtgagttctgctaagagtcatcctgaagaattaataccaggcatcagtgacattcagtgctgggtgccaggagcccagagatgagagggcccttgaacagagactgactttgagtcattcatttttttggctacagaaatatgtctccacaaaaccatccatactcttacctgttggccactgacaccagcagcacacgtgggatgtgacctgggaggaacaactgccccatatggaattctgactgtaggtggattcctcagctctggggctccaaacatcgaggttcccagccacagacatgaaggtttggtgcttataagcgcccagccacaatcacataaaatctcatttcttttttttttttttttttttttttttttgagacggagtctcgctcttgttgcctaggctggagtgcaacggcacaatctcagctccactgcaacctccacctcccgggttcaagtgactgaaccctgctgcctcagcctcctgagtagttgggattacaggcgtctgccaccacacccagctaatttttgtatttttagtagagacagggtttctccatgttggccaggctggtctcgaactcctgacctccggtgatccacccgcctcagcctcccaaagtgctgggattacagatgtgagccaccgcgcccggttgtaaaatctcatttcttttgggctttgggtctgtcttaatctgaatgactattctaaactgtggggctacagcttctgattgcagagtaaaccatccctgagctgggcctgcggaagtctgtgctgacatccaccacccatcatcaagggacaccaggaaccaggacaaaggctgccgcgacacacaggatctccaacttgtaaagagaacttcatctaaatgcctacttttgccagagtaggaaatgaactttttttccttttataaataaggaaatacaacttaaaacttctacatccccaaaagaactggaaaaacctcaaatagcctttatagattatccatgatgcatgcaaatcctcagtctgctccttccactaaccccaggcagtgccccctatccctggacatgtcggaaatgaaaacatgcaggagaagttccttcagcagacatgaattcactgtccaggaatcatagtgtaccccccaggtccccagagtgctaggggcctcacctccaccccatatgccacacaaaccttggatatgaagatggtgttaattttggggttgtgcttgaaattctggagaatttgcatcctttccccctgagacgtaggtccgtagatatagggtctagagaagaatgaagctgtgttagaccacagaataatgcctcagttatcttgaaaacacatcagagggaaaaaggagctcaggctagctcttctcaagtagaaagccctcgtcatgtaggaatatcgttacacccaaaaaaatgactggctacagatgcacctcccagccttccccactgattctaggtttaggcccaccattctcttcgggattccctcctttccatttttcgttttctttttggactatgctttttcctgcttcaacatctcttactctcagcacagagtctatacaaggagcatctccacatttcatgaagcccaaagagaggtgcaaagaaaccactgctatttccaaaaaaaggctggaagcaactgtttgccaagacacaggcatgctccaagagatgagcagaaaggagaaaagtgcccttcagccattattgtgctgatttcccataacactaagttttaaaaacttctctttaatttctagctccctgccaggcgcggtggttcacgcctgtaatcccagcactttgggatgccgaggcgggtggatcacctgaggttgggaattcacgaccagcctgaccaacatgaagaaaccccgtctctaccaaaaatacaaaattagccgagtgtggtggcgcatgtgtgtaatcccagctactcgggaggctgaggcaggagaatcacttgaaccggggaggcagaggttgtggtgagccgagatcgcgccattgcactccaccctgggaaacaagagtgaaactctgtctcaaaaaaaaaaaaaaaaaaaaaaaaaaattttccagctccctgccaaagggtacaaccctatcaatgaactcaatggttatcatcccatagcattgggaatgtcacactccttccctctgtcttggaatgtgacggtggacagtttttgtagcttcccaagaatcataacaacagtgatgatgatgatgacaacagcaaagacaatgaagacaaactacaggtacgcaggacctaccaacaccaggcattgagctgagtattacattaaaaaaaaaaaaatccagccaggcgcggtggctcacacctgtaatcccagcactttgggaggcggaggtgggtggatcacctgaggccaggagttcgagaccagcctggccaacatggtgagaccccatctctactaaaaataaaaaaaattagctgggtatggtggtgggcacctataatcccagctactcaggaggctgaagcaggagaatcacttgaacctgggaggcagaggttgcagtgagccaagatcacaccacttcactccagcctgggcaacagagtgagactccgtctcagaaaaaaaaaaaaaagaaaaagaaaagaaaaaaatccagccagccctgccaagattcctcagcattgtaaaagacaggtttcatgttccccaatttacatgtgggaaaccaagggtcagaagcctgagcaggtggaacctgggagtggctgctccactgccgaggcccgttagcacccagagcagtgcccattaatggatgtacctcaaagagcaaaccccttgcctgtggggaagctggatagggcctgggcagctgcacacccaggctgatggcctctgattagcccagtcacaagctgccttgccgtgatccagaatgtcccggccaccacataattttatcattttctatgcatgtcatgcagtgaaaaaggttagaagccccactcgtcagaacagcctgactcttgagacccaggtttttaggtggttttctcctcccccatcaccaggaaaaactacttgcacagtggggagccctcagtttctaaaggttcccccacacagatgaaatagaaggaaaagcaccctccaagtggagaatgtcacatttactaaatacttacaagctgccaggcacaagaatccaccccccaccatcaagggacaccaggacccagtacacattgggtggcagtagctccatgtgaccgaagtacaaaaggagttcagaggtaaacaactttcccacatccagtctgtctgatcccaaaaacgatgctctgcccacagccccacactgccatataaccctaagcctctcttgcaaagtgctttggtgataccaatgcctttcttatgaaggctgggaggagccaaaagcttggagaatccccaccacacacgagcaaagaatggagcaatgcccgagagccacaggatcactttttttttaaaggatggggtctcactatattgcccaagctggacttgaactcctgggctcaagtgatctttctgccttggccccccaaagtgctgggattataggcatgagccactgcgcctggcccgcaggatcattttagaagcgagaaaaccaagaagaaaaaacactacttcatacatttaaaggccagagacacaaaaaaaaggtaaaaagtacacattgtaatgatcattctagtacacaggagacagccacaatctgctgcccttcactgtgacagactggcttggaattgacagtgccaggcaaattaacgtccctgcccaagcagatgctcgggaggctgcggctaaggcacaagcctcaggagtgctgcaaatgtaggtgggggaggcccctggagtgaggctccagaagactggaggagcattgctgtgggaggaaggatggggagagaatagttcttaaataaggcaaagtaaatataggaactgtctcattgccctgctcaaattggcactaatgtgacagaacacaaacccaccaagaaaacaggagaagaaataacagcagatgagagaagtgggtaacatttcagaagctgaaaagcagacagatgcaggcacagtacctgagctaacagactagagaaagcagaagctggagccggcaggagggaagaccgatacaaaacccgccgcctctgtgtcctctgcagcacgcaggagggctcaggaactagtcaccagttgcctgagaaggtggggaggtgcacaggaggactggcagtgtgtgagtgtgaggagcagttgggtccggccggcagcaggcaggccacctccactggtggggcactggaggcttattctccagggatgcccggcagagatgagggaaaaggcaagactgaatgcaaagattccacaagccctcctcttcccctaacacacggtggtgcccaggggactgaaaaattcctcactgaagaaaccgtccagcccaagagaaaagtcctagagatactggcatttggcaacctcctgaagaaatagccaggccctgcccagccactctggtgaggtccacaagctggcaaacccactaagccacacagaaaggcctgccaggttttcagtgactttaaaccaataaaatacagtcaaggattaccaaaactcagaaagactcaaaagacaggtaaaaacaattaagacaaaaaaatgaagaaaagagacatggcaggaaacagacggaagcttcaaaagttttcaaagcctccgagaagacactctattcacaaacaaaacaagaacagttaccaggaaagaactctcagaaattaacaagtctcaatacaagggttagaagacaaagagataaaaaagtagaaaaaagataagcaaactggagaagctgttcagaggatctaacatctgatgaatcaaaattccaagaagggactacatagagaaagtgattaacaacaaaaaaacagaaattctcagaactgaaggacacgagtttccagatggaaaggatatactgagtgcccatcacgatgaaagaaaaacattaagaatatcactttcaaatttccaaaaagagagaagatcctaccagttttcaagggaaggaaaacgcacagccaccacagcagacaacacactgagaggaagcaaagggcatcagactgccaaactgctgcactggaagctccaatgttagttctaggacctggccaaactactgatcaagtataaagtcgagtaaagacatctgtaaacatgtgaagtctccaaagcttctcctcctacatcccttctctcaggaacctactggaacatgtgctccatcaaaatgagtaaccaagagggtggagatttcagggtgggaaacacaacaaagaggcccagggaagtcatggggtagtgtccaagggaaaccccatggtaacagctggtggtgtctctagtcctagacagcaagcaggccagaacagagtaagcgaatggagtgctggtggggatcccactggggaaacagaaaaacagaactgagaaattacctgaccctactgagtttatggttatgtgaagactttggaggggaataattattcaatgcacagaaaaccaagcaaaaacaatgacaaggcaattattaactccaaggcaaaaaaacatttacaaaaaagaaaatgtaaggccgggcatggtggctcacacctgtaatcccagcactttggaaggccgaggcaggcagatcacgaggtcaagagatcgagaccatcctggccaatatggtgaaaccctatctctaccaaaaatacaaaaattatccaggctgtggtggcgggtgcctgtagtcccagctactcaggaggctgaggcaggagaatcacttgaacccacaaggcagaggttgcagtgagctgagatagcgccactgcactccagcctggcaacagagcaagactccgtctcaaaaaaaaaaggaaaatgtaatagtactctacagctctgcctgaacatacttacacagtcaaaataatgtaactgaatattaaagtaacccccaacttgtgctattcccatattgggagaatggtaggagagaaaacaggagtggggagagtggtgtatgtaagaaagctaaaccctcaactcctacagtaggaagttaataggcaatttctataactgatcatcaagaaattactacataagctattgcttagaaagatgaaggctggccaggtgtggtggctcatgactctaatcccagcactttgggaggccaaggcaggaggaactgcttgagctcaggagtttgagaccagcctgggcaacatagcaaaaccccatctctacaaaaaacaaaaattagctgggtgtggtggtgcgtgcctgtagacccagctactcgggaggctgaggtggaaggattgattgagcccagggggtcaaggctgccgtgagccgtgattacaccactgcactacagactgggtgacacagtgacaccctaactccaaaaaaaaaaaaagaaaaaaggaagaaagaaagaaatatgaaggtaaacaacaaaaaagagtcaaaagcggctgtcttcaaggaatagaattgtgggtgggaaaatagaagcagggaattgctgtttttcacaataatctaaatgttgacttggattaaaaagtctttctaaattaaataaaggtataattttagaaacttaagaaatttaatctttctatgagtttgtcttcccttctataaaatgggaacaacattttatatggctgaagtgaggattaagtaaaacctatgtatagtacccatagcacatagcttgacctgtctccatagagggcctggccttctgcaacacttacagcacctgaagtcctgtgtcactgtaggagcaagcgcagacctcttcctccttacttggcagagctttacaaaagccaggttttaagcacaaatatttgggtggagccatgggttgatgaggatactgcgtgggcatttctaagctccttccagatgccagtccgtacttgggatgccagcccagcccatcttgccttcccagcccctaggccatccagtctggcctcctctccacccacagagctcacacagcccaaagctccaaatgccaactcccacccacctttggagcccagatcttccatggggccccacccagctcagtccaagtctctgctccctgttctttgggctcaaggtgactagccccccttttctctatgctctaacctctgactccaaccacctacttcaggtcttccctggtttctgagaccagggccacagaacaagatctttggagcccaagaagttcctgagagaaaaacaaaaaaacaaaacaacagccaccttctgcactctcaatggggaagagaaactggcctggaggaagctccaagttttcaattcttacttgttcagtcgaatggcatattcctttagggcaaacacattgtcagcaaagacaataatcttgtcattcctcctttcatgaaacttgatcagaaactggcaagctctaaatttgttggggttcatggtgtacagcaagattcgtttcttggttttgattgccacatattcccggtaaaattcaggagacatagggcaccagacctgtaatacagtaagaaccaggggtcattttacaagtttaaacaccacacaatttaaaacttttgaagacctttctctagcagaattagctttaaaacaaaaccagtcaggtgcagtggctcatgcctgtaatgccagcagtttgggaggctgaggcaggcagatcacttgaggccaggagttcaagaccagcctggccaacacagtgaaacccagtctctactaaaaatacaaaaattagctgggtgtggtagtgcatgtctgtaattccagctacgcaggaggctaaggcaggagaatcacttgcccaggaggcggaggttgcagtgagccaagatcacgccactgcactccagcctgggtgacagagtgagaccctgttttaaaaaaaaaaaaatgctatgtgaattagaaatcagtacaactgaaaataaatgcatgcacaaaactaaacccaacctaatacctcctattgaactggacgttttcacatgttaaccacttaaaagatttttaaatgcaatcacatccagggagttattttcacaccagctgcaagtgtgcgaaaccagattctcaattggtagtgtcagcaattcttccatttaagccacacttccacacacgagtcagcactgctactgagtaccgccacctcttcacacacttcccagcagggctgggagcatatcagttaggcgcttggggctatcagagcaaagccctttgctgccaggctcccaggcagcactgtggtatcaggggccttcattcatccctgtgccctgaatgctaatcctcacccacagaaatccatgactggtaaaccccatggctaggaaaaagaatcatcacaaattcaggggtatgtgagatatgtgacaagacagaagatatgcagcaagtgggtctagtaccacccaaccacagggtgactgaggatcctgtatgaagtggtagcaggtgagcctaagtcctgacctgtgtctgcccatgaggaatcgatctgatcactcccctgcccataggaggaggccctttcccagacgcccccagcccaggcccagctacctcagcacactggactttggcgatgtagccattattctgcagctccatccagttggcttcgtagagcttaggcccaatcagaaaatttaaatccacaattttgtcatcttcgcggacgagggtcgcagtcaaacccagcttacagtgggcctgcacgatggtgagcacccttcggaacatcttggctgaggaaacaatgggagcattcacactgtcacttttctttcttattttttatttatttattttaaaatattttttgtagagatggggtctcattatattgcccaggctggtcttgaactcctggcctcaagcaatccccctgccttcgcctcccaaagtgctgggattacagacgtgacccactgcacccagcctacactgtcactttttcaaatgctcatagctgtgcaacttaacactggcttatgacaccacctgaactaacccttgggtttcaggaccacagaagctggctctagacaagaatgactaggcaaatgcttcaccatcacttttagacctgtccaaaagaaaatgaaaaggagaacaagagggtgaaatgagcttaaggaatctccaagttaatgaatcccagcattcccctcacaacagttatcagtagaagtacagatggcaatttgaaatacaacctgcaatacttactattaataccattaagctctaaattacgcaaagaattttcccctaacacttgtacccaggttactgaaaagaaagttgacaatctagggagaggaagaaatgaaagaagccagctcttctcagcttcccatcattttcccagaaaccgagaagaaagccaagcccacgggagtgatgaaactccaggaactgttcgcccaagccctccggcccgccttaggaaactcccctctccaaactttaccaattcaatcactttggtcaaccagcaacctctttttcttcctttcttttgaacattataattctctctggtttatcaaataaaataaacacataaagggtatgagttattcatttttaaaaaacctaatttatggatttccacgggctcaccttttaaaaattctaatactctgaagcaaggttaaaatgtttgagtcatgcttatcttacaatataattgaaagtagggctaatgatatttcagaaataaatagacacaaaaatctaaggaaaaagaggcctgaatgcaccaaaacacaaagacgttcacagtgaaataacatagggttgcctaactctaagtaaatgtttagtttttacatctacatggtttgcacacaacaccacatgcaaacacacacacacaaacacacacacacacacacaacacagaaaacaaaatcagctcagggttatgtctaaggaaagactgtgctggctccaaaatacagtagccaagaacctcagaccaagctccccatgttagagggaaatggtagtcaaggcaatggctacaccaacccagtgtgggccccagagaggcaacactgggggacatactgacccaagacaaggataaggcaggtaggactctgcctggacacccgtgaccccatcacacccctctattacactctcctacagccctgacagctgtcacaggtgaataactcacagcatactactcaatatatttttacagacatgcagctgtggaaccacctagatcaggatatagagaaccaggcacccagaggtctctcccctgaccccttctgtcaataactagcactcttccttgagggaaacactcctctgacttctgagaggggtctgcctcctttctgaactttgcatgaatgaaatcatagtatgcacttttgtgtgtggcttgtatcactcaacattatgtcatggttgtcatttggcatttatttgtgtggttacttggctgtcccttccactttgtctccagtgccaagtacagtgcctaaacttagtaggttctcaataaatacctgtagaaataatgaaactggcacagtacctagcacacaggaagcacttaatatacacaagtaccataatatgaatcattaataaaaaggcataacagagctccttttgaaaaatctgtaaaacagcacagcaatctttatcctttgagataaatctcaaagattgatcactccacctaacccaacacagcagacgttaagacagtcaggagacttactgtgacttcctagcattcccttatttaacatttgctctctgggacaatgagcatggccaggccactgggcttatggggcctgtactcaaaaatcccttagagtttgttggtttcactccgcaactcaaccaaagactaactcatccagtgaactagacgagagacagacaaactcacagacatatgtgagtgtgagatgcacctttttgtacttgttcatcagataaccaatcccaaatctgtgctgttgtcccctggaacctgggacctggggcttgggttaaagaaaaacatgaacgtgtaccaaacatatagtcagacagaatgcctcaagccctgaacacagcttccaaccaaactgctacagaacaattccagactcctttgtgggtagtgattctctgtaccatcaattttcaatcctagcagacccaatacccacccttccaccttttttcttttgagtttttaaattctcacagtaaaactgacttggggcggggggtggggggggcacttctatgcattttaacatatttacatttttgtaaccagcaccacaatcagggtacagataaagacagcatcccccaaaattcccctgtgctctcctttagagtcatccatctctgaccccccacttctggcaaccactgatctgctggccagcactatactgtcgttgtataaatgaaatcacatactatggaagcttttgaggctgacttctttcactcagcaccatgcttttgagattcatccaggttgcaacatgcagcaagtttgttctttttcactactgagtagtgttccagtgtatggatgtaccacagcttgtttatccagacacccactgatgagcacctgggttttggatattatgaacagagctgccataaacattcgtgtacaggattttgtgtaaacctcttttcatgtatccaggatacacaggaatgggactgatgggtcatgtggtaatttcataataaatggacaaactgttttccacagtgaccatacactttgcaatccatccctccaggaatgtgtgacagttcagttgctgtgacctcatcagcacccgcacatcagtattttttattttggcccttctaactggcatatgggagcatcctgtggtgggtttaaatctgcagttccctgatgactaatgaggttgaaccctttttcaagtgcttttttgacatatgtatatccttttttggtgaaatgtctatcaatttctttggcctatttcttaacctttttgccatggcctgaatgcctaacaggaaactcaaattcacacatctaaagcccaactcctgatagtcaccttccagaccagctcctttgagagtgttccccatctcaattaatgcccactgtatcctccctttgttcaagccaaaaaccttagtgtcattcttgatttctctctgattccacacctgacctgtcaattaaagcttcacaacatatccagagtcggatcacgccttcatccttactgggattccacaaactcacctcaccgcttctgtcttgcttccttcagtctatttccagcacagcagccagggcagtatttttacagtgtaaagtcaactcatgtcatgctctgctcaaatccctcagatggcttcacactaagagtacaagccaaagttcttgtcgtggcctacaaggtcctacaagacctgccccaataccgctaatcttcctcagccttgactactgttcctatgctctcctctggccgcatggccaccttgtgctgtctcactatgccaagtactttcccacagcagggcccacaccctgggcttccatcagaaagacctccaatccctccctggccagctgtgaacatctctaggtatctccagaaacccatcagggctgaagagctctcatgcacagaaagaaccagatgctggggccattttgacattttgaacactacctgtgaaaatgcctcagatttcattttgttcatagtaacctctattagactccttaatttaccctaatctgttcatctttattttttttttttgagacagagtctcacactctgtcacccatgctggagtacagttgcacaatcatggttcactgcagcctcaacctcccaggttcaagtgatcctcccacctcagcctcctcagcagctgagaccacaggtgcacaccaccacacttggctaattaaaaaaatttttttttgtagagacatgtctcactatgttacccaggctaatcttaagctcctgggctcaagcaatcctcctgccctggcctcccaaagtgctaggagactacaggtgtcagccaccatgcccactcctaatttgttaatcttaatcccttaatctgtttttatcaaaaaagattcgcccaaaaaactatacagcaataaaaggaacaaactactgataaatgctaaggcacagatgaatcattatgggaagtgaaagaagccagacataatatatattgtatgattgtgtttatataaattttccataaaaagcaaatctatagtgacagcagttcagtagtcatctgaagctagatagagaaacaaagattgactgcaaatgagtacaaaggaaatctaaaactggatcatggtggccgaatgcagtggctcacgtctataatcccagtactttgggaggcccaagcaggcagatcacttaaagtctggacttcaagaccagcctggctaacatggcgaaaccctttctctactaaaaatacaaaaatttggccaggtgtggtactttacgcctgtaatcccagggtgaggctgaggtgggcggatcacctgaagtcaggagtttgagaccagcctgaccaacacggagaaaccctgtctctactaaaaatataaaattagctgggcatggtggcgcacacctgtaatcctagctactcgggaggctgaggcaggagaatcacttgaacccgggaggcagagcttccagtgagctgagattgcaccactgcactccagcctgggcaacaagagcgaaactgtctcaaataaaaaaaaattagccgggtgtggtagtacacacctgtagtcccagctacttgggaggctgaggcaggggaatcagttgaaccctagaggcggaggttgcagtgggccaagatcacacgactgcactccagcctgggcaacaaagcaagatgccatctcaaaaaaaaaaagaaaagaaaacttggatcatggtcatggttgcactggtccacaaatttactaaaactcattggattatatatttacaaggggtgattttatggtatataaattaaatcaatagagcagcttaaaaaaaaaaggtttgcccatgatacttggagaagtagggcttctattacatattgactaaggatcaatattccgggcttcaaataaaacacatcaccaccattttgggaagggcttttcagtgctcctaacccagtttttagagggccattaaaaaacggatgaagctgagcagcaaaaggaagatggaggaaagaaaatatcattttctaaatcactactgagccagtgattaagcaaactgtgaatgtgaacactcctgcctgcatcccacttaagaattactggccgggcacggtggctcacgcctgtaatcccagcactttgggaggatgaggtgggtggatcacgaggtcaggagttcaagaccagcctggccaagatggggaaaccctgtctctacaaaaatacaaaaattagcctagcatggtggcaggtgcctgtaatcccagctactcagaggctgaggcagagaactgcttgaacctgggaggtggaagttgtggtgagctgagatcgtgccactgcactccagcttgggtgacagagtgagactccctctcaaaaaaaaaaaaaagaactattaaaagctttacccagcaagccagcaagtctttctagccagttgggtgggctacacagcagtccctttcccaacctaacaactggaaattggtttgtctgttcagcaagtggacagctcagctccagcctgcttacctggtatggtgtgcacttcatccaggatcatgaggccccactcctgggtcttgagccactccatgactcgctcggcctcccaggaccttttggtggtgtggcccagcatggagtaggtgctaatggcaacggagcagccgatgggcttgtccttggcatcggaggtgaaccggcagatctggctgtcgtcaatggtggaccacatcttgaactgggctttccactgctccacagaaacagctgagttgcccagcaccagacagcgttttctgacagtgcatgcagcagtcacaccaaccagggactttccagcacctacaagaaacaagagtgcaatcccacccaaggacaggttgaaatgaaggacagggacaggcagaatgactcacaagtacagcaatctaggaaaatgtcttgtaacagtccacatagctgacatctgagcgacacacactgctccagcctgttttcttctttataatgaggagacatgcccacttcacatacatatgtgagaaatggcaggcgctggggcctactgtagcactttacacacatctcatttaaatgtcaaaatctcaaaacaaaccagtgagaagagaaatgcctgttattgttattttaaagatagaaaaacctggctgagccaccatgccacggtggctcatacctgtaatcccagcactttgggaggccgaggtgggtagatcacatgaggtcaggagttcaagaccagcctggccaacatggtgaaaccctatctttactaaaaatacaaaaaattagccgggcatggtggcgggcgcctataatcccggtcacttgggaggctgaggcaggagaatatcttgaacccagtaggcggaggttgtggtgagccaagatggcgccactacactccagcatgggcaacggagcaagactctgtctcaaaaagaaaaaagaaagattgaaaaactaaagctgaggagtactttaccttgcccacagccacgggacagtgaagctactgggtcccagcatgcctggcccacagaaggaggcactcggcaaaagaccactattattattacacagcaaacggggctgagaattcagggatgcgctatgtgtgtacagagaaaatgaaattccaggagcttctgagtttactaccatccaccatttgaagatcaagagaaaaatcaagcttttccattaaacagagatccttcctttattataaaaatacactgtgagttaccaggaataaacgtaaataaaaaaaatttgtaaagtgaaataaaaaaggaaaacaacatcaaaataacccttggagttttggaaaaaaagaacctccccttccctgaagaccttgcctctgtaagtcctcagtggggtcccaaggtgagtctgctgtggtctctggccaagaagctaggctaggacctgacactactgggataagtggtcaaacaggtgcccagggggccactcctgcctttccctggacctgcacaccatcctagtcatccaggaacaccaaagtttctgcgctagggagtctccaaatacacaacccctaaggctgattcaagaacaagaacctaaccccactaagtgcaacagccccttgccatcattacaatctcacccctcatgtgctctaatttttcttcgctgactctagcaccacccaaggttgtacacatctgcttaccatctgtctcttccccagaagagtgagctccatgaggtcagaagtgttgttctagccaccataatacccccagtgtccaggccagggcccatacacagcaagcactcaaatatttgtcaagtcatgaatcagggagtcacctgatcttggcttttcagcaaggtgtgatttagggaaatgtgcagagagaaagcgggaggcagctggcagatccagacacaacagcctgaccaccttcttaactctggtaccacttaccgcagggaagaacaatgacccccgaacgtgcacgcccgtttccaaacatctttcgcaagctcttctcctgatagggtctgaggacagctgtgggctttaggtcaatgttgatatcagggttgacagaatcattccggaagtcatattctgccaacagagggtactccaggtggatgcaacgtttctggagttcctcaatcatttcctggaaagagggcacaaaaggggttttaaaatcttgttactgtgctcaaaaacattacatcttctaagaggtccaatggtcaaaaaagtggcattctatctaaacttctacaagattttagatcttgctcagtcaacaaccgggataaagcacagaaaagcaacccagactaacaacactttgaaaatgaaatctaatcagcaggcaaaattgaccttcaggcaccatttctcacatctcctcaggaacctgtgaagaccagcctaccagcctgaaaaagaggacactgggactttaactccatcaggagaaatgatgccatggctcacagataataaaaaggagaaagcaattcagggaccaacagggactccttcctttcacacagactacaggcagagtcgacacatggctggactagcttctaacagcagctcagtgaaggaaccaggaggaaggtacattcactaacctgcttgacttcaaaagacactgtctgtgtctcttcttcttcttcttcatccttgtccatttgctcatagaagtcaaacaggtccatggggatgtcagatttaccctgtggatctgtcactcgggaagtggagggcccaccactgctttcagcagtcttagaaatctgtgagagaggtaggtgctgaacgtgcacacaacatttaattctgctgttatcaagcaatgggtgaagttgtaaagggtagaaccagcagggctgctaggttgtaagtgctgggttaaagacacctgagagaactgaaatcctaaatgcctgcccccacccaagggtggcccaggagtccacatacggcagatttgcttgtgaaagtctctgtgatgagctcagtggcctccccttcagagtttcttaagcggcattctcggatcacggggtcctggagaagatgctggattacatcagggtggcaactttcaacgaagtatctgcaagcaggggaggaagaaggggtctactgaccagcaggtacctcctggagattccactgctcattcaattagatggtctggaaatacaagcctcatgactctccccacaacccttcgccaaatctgtaccatgagctgccggccatgatttaacatatgagggttgtgactttgaggtcaagtaggcaggggcctgagcccagctccactgctagaggaaatacagtggccagtggatgagtttccagtctgggccacatctcttgtttctcttctcttatctgtgcttcacagaaaagacagcataaacatcaggtccttcccatatccctttattcctgctggtgcgcagaaagtgacagtgccttgggacaggcctgtcatggaatctcttacctgttgtgcttcaagaccagcttgacttttccatagctgacagtacacaactgcaaatacagataacatccaacaggtaaatgtgcagctaactcagaacacattcattactggtcacatcttacacctaccaaccaagtgaaaagttcattttactttagggaaacccaacttgcaatcctaaagtggtcagatgtgcctaaactgagctttttccattggcctctgctttctgagaacaaaatcttcctcttgcctgggtaattctgatgcatatccattaagttataaaacgctgcttaaaatcttgcattctgcctttcctctctattcccacagcccccaccctagtctagagaagaccacaccagtattactacaactccacagagtatgtgcacagtaattgcggcttaaataaaatgcaaagcctcttcaccaatgctcctatttccccaaatagaatgtaagcatcttgatggcagagaatacagcttaaatcctcccaggttcccaaccacctttaggaaggaatacagtagaggctgtgtggcaacaataaaaatttgccactcaggccaggcacggtggctcacacctgtaatcctagcactttgggaggccgagccaggtggatcacctgaggtcaggagttcgagaccagcctggccaacatggtgaaaccccatctctactaaaaatataaaaattagccgggcatggtgacgggcgcctataatcccagctacttgggaggctgaggcaggagaactgcttgagcctgggaggtagaggttgcagtgagccaagatcatgccactgctatccagcctgggcgacagagcaagactccgtctcaaaaaaaaagaaaaaaaaaatttgccagtcagactttgaggggctgcctatccccgctgttgtccctgatccaccactacagtgcaccaacacctacatccctgcaggcaattcgcagccaagaccaggcagagccacagtgttggtacaaggtcctctccttgggcacgctttcttttttgttgttgttctgaggcggagtctcactctgttgcccaggctggagtgcaatgaatggtgagatctcagctcacttcaacctctgccgcccgggttcaagtgattgtcctgcctcagcctcctgagtagctgggattacaggcacccaccaccatgcctggcgaatttttgtatttttagtagagacaggaatttcgccatgttggccaggctggtcttgaactcctgaccccaggtggtccacccacctcagccacccaaagtgctgggattacaggagtgagccactgcacctggccgggcacgctttcacatcacaggaaaagagagttctctccaggactcctgcagcttctctgggactggctgcagtaccatactgaattcctgtggcactcttctgccactccagatcccaaggtctgaatctgactccttttggatcagccaaaggcaatgaaagccactgtccatctcttttaaatggcattcacccatctcgcagaagaaacctagcatgttcaactattaatcacatggaaccctctttgttttgtcaaaaacatctgaagttgtttttgactttccctcatggaacttgttgactattggtctcctgcagatacttagctttagacagagtttaccacctgtgttagtcagcttgggctgccataataaaattccagactgggtggcttcaacattagaactgtattttctcagagctgtggaggctgaaagtctatgatcaaggtatcagccgattcagtttctggtgaaggctcttgtctatggaccaccttcccattgtgtactcacatgacaagaagggcaggtgagagaaagcatgctccggtgtctcttcttaggaggacactaatcatagcggatcacgacctcatttagtcttaactactttcttactccaaatacattaccattggatattaggttttgaagacaaaatttgaggggaacacacacaattcagtccccagcacactcactttgggctgcatttccaaattctccctggctacaatgggcctgaattagtagcccctctgtgttaatacccacagctgggagcggctcatgagaagcgtggcctcacccagaacacaatgctggatccagagtgtagcggctcatgagaagcatggcctcacccagaacacaatgctggatccagagtgtagcggctggggtaatcagtcgttatgctccccacaggaaatctgaatggcacattctcatggctgccacaggctgacaacatggagcacctatgcctattgttacattagcagggcaggtggaattgctggtctcagctgtcacttgccttaataaactgcataattccatcagggactccagtcttgctgagcttcctgaggtactcggtgatgtcactggtttgcagcccaacgctgacagctgcatacaaggagtaggcagttagtttgtactcatgcacatgggttggtcggcacactggctctgcaatagccaccaagaagtcttgggcatatttgtaaactggagagaaggcttccaagaagatatggccatcgggagcctgagagataccaaatggacaaaacagacaaggaaacatgagttgcagagactactgggctcttgcccatatcattatcaagaaagaataagctgcccaacaccacagatattcttgcaagcactccttcagacaactgtggggcctgttacattaatcagatacagaagagtaaagaaaaatagaagaaagtgtttccaaagtcaacagctgtttcctactattctgcacagagaaagcccatcttactggctatcctcaagttaccttttggctagatttcaactaaatgtataacattaattatttaaagtagagcaaaagcttgctaccgaacatgtcttccattatttgaggaaacaaactgttacatgataaatgctatttattcggcagataaaaggattcactacatggggtagggctggggaaggagtgagagtaaaccgaggggttagagctgttggaagcccaggtccggccgccacacgtgtgcgcaactgctcgctgttgccttgggctgttccaacgtgtgtggatgaaaattctctcccggccagttctaggggcagtatcctgaatgtcagttttgactctgaggatgcccaagatttagctgccgctccgcacactcctgggccctgcccaagctaagggcatgcttaccacccagaggggcctggaggtgtggtcgtccttcagcggcatttgcagcctgtagtccttggctccatattcatccactttggtgcctgactcatccacctgcttccccgccgccgagggaaccgcttcctgagggtcgttccccggggcgtcctcttcatcatcctcttcatcctcatagtgccgcttcctggatttcttcttgtctgcaagataccaacacagaagtaagcccagcaggagccttcagggttccctccgcaccgcttggcagcatttcacctgcgccgccgcaaactcctagctaagagccacctgcatcccgcaggcgttgcgcccctcacccgtctcccctaggccgagttcgctgggctgcgcccaggtccagcatctctcccgcccaaaggcctgtcccaacggggtgcgcgcgggagggccagcagggtcggccggcgcagaggcccggagcagctccgaggcagagcggggggcagggccggcaagggcagtcgtggctgagcgtgcccgcgcaacgtctcaccgcggtccgctcggtctcttttgcccatggcagctacagcagcagagagaagatgaccccgctcccacaggcccgccgcggcatccgctctggggggacttccggctcaatccggaagctccc

SEQ ID NO: 76 - DNA, 20811 bp, Homo Sapiens
tggcagcagcagacatttattgagctcactgtggccggctcccctcttagcccggtccccacatcgctagttcttatagcgtccctatgaggtgggagctgtcgctccactttgcgtgtgggaagactgaggcaccgaggccatgccaccagcccaaagtacagcagacaggctcagaaacaggaggctgcctgtcctccatccccagggcaggaagtaaggccgagctccaaacccactctgccccagggcaaggctttaggcaggggaaggatacggccaggtcagcacattagaaagtggggccagacgtggtggttcacgcttgtaaccccaacactttgggaggccaaggcaggaggatcacttgaggctaggagttcaagaccagcctgggcaacataccaagacccctgtctctacaaaaaaaaaaaaaaaggcgggactggatgcagtgttgggaactggggtccgaaaagttcccagacactcccttctccgcaggcctcagcctacctgaaacagaacaagtatcaacaagcggaagagctgtacaaagaaatcctccacaaggaggacctacccgcccctctcggtgagcccctagcccctgtctgtcttccctcctggtggcttctctatgtccccatctcagtgtcccccatctttccccctaggtgcccccaacacaggcacagctggtgacgcagaacaggtgaggatgggctgtgcttcggctcctggggtgggcgtggggactgcatgggcctgggggactgagcagcatccccggcccctccccaggcccttcgccgcagcagctcactctccaagatccgtgagtctatcaggcgaggaagtgagaagctggtctcccggctccgaggcgaggcggcggcaggagcagccgggtgagtgttgatcaggtcggcaaagagccctgacatcagcagaatccacagcccaccccacccccacccccatcttgctcaagaaccttccatggctcccatctcccctgtgatacacacagatcaaaccctgtgctggaaaggtccctcgtggaggggggccactcctggattcactcatttcctccctgctgccctctttgcagaatgaagagagccatgtcactcaacacactgaacgtggatgctccaagggctcctgggactcaggtgagggggacatctgggtcaaaaatagaggaggccatgtgggtaggtgcagagatgaggcaaaggcagggcggtcgggccagtggtggagtcagcaggtggtgggttggtgtcagaagagacccaggacaggagcaaagatgggttttacttggggtagaggcgagggggttggatagttggctgccaggctggacctggagctggagggtggatgtaacacttgcccctcacctcccctccaaccatcccctgtgcctgtctccagtttcccagctggcacctggacaaggcccctcggaccctcagcgccagcacccaggacctgagcccccactaacgtccagtgaactgcgctggccgcagcttcttgggaacagtgcaggagggatgggctggtggggtgagagggggtctatcatctcctggcccccccttgcctctgggtacctggtggatagctgccttctcctgcgattaaaggctgtggacgtgacagtgagaaatgtcacctgacttcataagaccttctagcaccaccgccgctgggaaccagggccaggcaagactcaggagtcaccaggaaccgtttatggccccacccgccccactcagagctgctgagcaatctgctctatcctcttcagcgtctcctctgattctagctgctccaggctgagcagggacaggcccagctgatcctcctgcagagaacagaggaaagggagaggggggcactgttgggcaggggcccaggcagctgctgcacttccccaaccacccccccgaatggccagtagggacaggatgtttgaatgaatttggagatgtccgtataatccagagcgggccatccctgtcaacataagatggggctgagggaggagccagctagggagtcggagaaggaccggctttctccaggccagcaccgtctctcctgaaaacgcccaatgcctcctcaccccaacttctctcaccctgccgtgcctgggccacctgctggcatctgtggcccctcgaatctcccccttccccccagagcctggcacgtagatgcacgataaacttctctttgctgagggcaggaggacaggcaggctgagggtggggagtggggagaatccaaggggactttctggaggagaagctcagcctgggagggtgccgggagggggacgcaggcctcacccggtggaagggctgtgccatctgccgcaggaagtacttggccacctggacaccctcgtccacggtcaggttgaggttggcatctgtgaggtgctcctggatccagcggggcagcttcccccgcttgtccccacgggcaaaccgctgtgggcagaagcgcaggccagggacagaaggtcattcggggagcctgggccactctccaccctgcaacccaccccacctgggaaatgaacgggaaacagcctggttcttggagcctgggatgggagcacaggggcacccctgaagctgcaccttgtcggcaaagaccatgaggccgtagtccgtcttgcccctgatggcccgacccacacactgggccgcgtggcgcatggcatcgaaggtaagaaagtcattctcacgaatctggaactggtcccgcaggtattccagccgcgcctgcagatacggaggatgagaagctggggaggtgggggagccactcctcccttgatcctaacactgtgggactccctgggagacagagctactcaccttgagaatgcggctctgtgtgtagacgtaggggacgccaaacatgatgacggcccgcccgtagtggtgcactggtgggcagaggagagggggcgaggggggttacaagtgtggctggtgggacagggacagcctcacgcgacccaggatgctgtgtctgagttggggggagagggtgtgttcccgccgggtgcctagggacagaggggaggggagggcccctctgtgcacctaggctgggggtgggtggttccccgcgggagcagacagcagagcgggcaggtgttccagagagctctgggaagacacctggggaggaagagcccagtccactcaccaaagtcgattccctcggacactttgccccgggccactgacagcaggatggccccgcggccattctcgcaggcctgaggtggggagaccgagacgcaagttaggtcactcctcagagccacctccccgacccctctccacgctggcctcgcacacccacctcctggtacttctccagggcgacactggtttcggcaccatcctgggtctcaataaagagcagcttgttcctctggatgttctcaaggatcccctggggaaggacccagggaggtcagggtgggttcagggcacagccatcctggttacatccaactcttctggggactcccacatcaccatgtctctgggcctcagctggctcatctgagatgtggtgagggagggtggaattgtccaacctcagttctttggggaaacagtgatctgggtggggaaccaatcattgctggataagtggggcaggcatgtggcccaagcgggtggccaatcagggcaccccaacccctgccagcgattggtggaggggctgactgtgaggcaggcagagccaatcagaggctgccctgagacttcccatatgacactacaatagagacagtgtggagccaatgcaaggacagaccactgggacagaatggagagtccagaaacacacagccacctgtgcagttcagtggggagagcttttactggagcaagtggattttcaaatggaaccaaaaaatgaaccttgaccccctacttcacaccacatagaaagatgaatttgaggtacctcatagacctggatgtgaaagctaaaaccacaagctcctagaaggaaacaaaggagcctctctctatgaccttggggtaggcaaaggtgtcttaagtaggacacaaaaggcacctgcgctgtggggactgggtcacctttcccgccgcgtggaagccgcctattgaagcacaaggccgatgtcctggctgtgaggatgacgttcccgcctcccatgcgtgcctttccaatacctggattagccaagttcactcacctcaccccaaagtgctttcacccactcctgagagcccggccatggtgtgctcagaggcacaaagtgcagagtggcctcccctcccacccatgtcctgctggtcacccagggcctggctgtggtgagccctgtttccagaatgccccacgacctcctctagctgcttccctgaaggggctcctgcagacccttgagaggctcgccccgagtcttggtccagccttaattctctagaattcctctaacccagctagagccacgcctgctatctgggcctccccaccaggccatctgtgctggaggataacagggatgggtaaccccaaaagcagcagagaagcaaggaacctagaacgtgggggtgactctgccacagggtactcctctgagggaggggcccacattggggcttatatctgcattctcagcctgatgtactgggggcggggcatgggggtgtgtgctgcttacaccccattcctacatgctgcacacactctcctgtcacacaggaaacctgtcaccatcagagtgtgagaggaatgaagctgacatagcggtgcagtgccagggactgaggagagcaggtgcagggagggggtggccaggcgtacctgctcataccaggaggccacggtgctctccatgtactggtagctggtgaagaaggccacgatgccatcagggaccacagcggacatctccagcaggaggttcccatagttccggatcacagctgcaaggggtcagaggttgggccctctcctggcccaggtcctcctcccttctctgtcttagaactaggagtttctggaaaccccactgaggctgcctgtcaggcttttcacacatatccccctcctcctcctcccgggcgtgtctgaggacccgccttgccacttcctgaagtcacacctggctatgtgatttgccatggccaatgaaatgagtgcagaaggggccgggcgctgtggctcacgcctgtaatcccagcactttgggaggccgaggcgggtggatcatctgaagtcaggagtttgagatcagcctggccaacatggcgaaaccccatctctactaaaaatacaaaaattagcccagcgtggcggcagaggcctgtaatcccagctactcgggaggctgaggcatgagaatcgcttgaacccgcaaggcagagactgcagtgagccgagatcatgccactgcactccagcctaggcaacagagcaagactctgtctcaaaaaaaggccatgtgtcacttccaggggagcacccttaggaaccagtgcacaatacactgtgaccactgtgatcccacctgtcacattatgctgcctctgacacacccagcggtggaggttcccaggtgaggagacacagggcaggcccctaccagctcacagtggacgtgtaccacgggcaagaaggaaactctgggctgagcaactaaggccagggatatttgttacagcagcatgactcagcccacctgactgatacacctcccctcttggaacccacagaaaccagccccactggcagcataccaatatcctcccgggtctcaaatttggagctgatggccacctggtcattgccacggccgatgatctggagagcaacagaggtcacgataagcgaggcagcagcaactgctccagcgtgagtgctgaccacctgctggtgctgttctaagctttttttttttttttttttaaagagagacagggtgtcaccatgttgcccaggctgatcttgaacacctggcctcaagtgaccatcccgccttggcctcccagagtgctgggattacaagcatgagccaccacacccagtctgctctaaactttttataaacacagtgtcattgaatgaaccctcagcaaccctgttatctgcattgcacaaatgacctgggctcagagaaggtgagttgcctgcccaaggtcacacagcaaacaggtggcaaagatggaaccggacccgagtctgtccacactctccaacagcagctacactctagccagccccaggccctgggccagccggatcccgaagaacacccctcgccatgccggcgggcatcccaccagccggcaacctcacacaaccaccatgcagtgggggtcattaccggtccacaacctctgacaggcaactccaaaagccaaaagctctgaacacatttctttttcaagtttggcacaaactcatgaagcagcaaaacctgccctgccccgagtctctccagaggcctgacttactccttagtgtgatgcttcccaatcttttactgccgaaatgggagtttgactcgggggagctgcccagaccccactgtgggcatcacacaccacacagcataggccttgtctctaaaggctggaaaattctgaattccaaaacaaatggctgcgcgcagtggcttacacctgtaatcccagcacttcgggaggaccaggcgggcggatcacttgaggtcaggagtttcagaccagcctggccaacgtggtgaaaccccgtctctactaaaattacaaaaattagctgggcatcgtggcacatgcctgtaccagctactcaggaggctgaagcatcagaatcacctgaatccaggaggcggaggttgcagtgagctgagatccgtgccactgcactccagcctgggcaacagagcaagactccgtcgcacaacaaaaacaaaaaaccacatccagcctggggacttcagataagggactgagggctcatgttgacatgcacgtgttacagagacggagacggagaggaaggctcacttacctgggtcacagccagaccacgtactcggcaagatgctaagatgctgactaagcgcctacctgtgccaggccctgggcgacctaagtggtttaccccagttctctctctcaatcctctcaaccaccctgggagatcagggaggatacattcccatttcacagatgagaaaactgaggcttgagagtcgagcccacagagaagcagaatcaagcctaagtctgtctgaatcccgaacccagcctcttcgctgtaaagctctcctgcctgagcagtgggggaagccaaggaaggagggcggccccttgcccccatctcccctcccggccccagccctagcctctcccactcaccatagggcagaggcagacccgtgccagcgtcatggtgaaggttgccatggtgacggggtggaagtccaggatcttggggtagatgtccagcggggacagtgtctgtggcgggacagtgggagggatctcagcaggactgggcagggaccaggaggcccatggagggaggtcagggactaggaggggacggggaagggtccttaccccagatgtgatgatgacagactggaaacgctcaaatacgggtttgatggccagcgaggcgtccatgcagctggagagagatgagggcagtgagggcccggggggctgggcccccgacccacagagcattcacaccctcaccgggcagggtcccacctgaagtgcaggatggggttggcaatggtcggggttctgtcgtcaaagggctcgatgatgatggtgaagcctgcagagggcaggcaaggaggggtgagattaccccactacagccacagctgcacccactcagtcattccctctcctgctccctcgcttcaccccaatctccaccccgtactgcctgggagtaaatgcgaccaaacatgactgcttaagccccaaaccaggcatctgagtccaaaatacaccccaacctgtccgcttcgggcccacacctgtgcaaactttcacgaaggatcccaagtagagagcccacagccccgcccactgctcactctcccagcaccgcatgggctgcccagcacccacgccaaagccaggagccagagcctcaagctttctcccatgaccttttcttgtttttgttttttgagatggagcctcgcgctgtcgcccaggctagagtgcagtggcatgatctcggctcactgcaagctcagcctcctgggttcaagtgattgattctcctgcctcagcctcttgagtagctgggattatagggacacccccctacaacacacccagctaatttctacatttttagtagagatgggggacctgcagtggtccacccgcctcaggctcccaaagtgccaggattacaagtatgagccactgcacctggcctcccacgacctttctacctaagccatcagcaaagccgggcagctctgcctccaaaacctacctgcaattcgcccactgcccccgaccccacgcggggccagccaccatcacctcctgcctggacccatcatcccctgctcgcttcacggcagccagagggaccctagggaaacctgagtccctgagtccagccatgtcacctccccgccccaagaagcctcccatggcccccacatgcctccagtggcctggtgcctgaccttcaaaaatcagcaggctcagtccccccagggcctttatacttgctggtcccatgtggcctggaaaacctcccaaggctgctccatttggtcatctgagactgctcaaaagtcagcccctccgagaggccctccccagccaccttttctacgcagacatattccaacacaacaatgtattttttttcatgataactgtcactttctggaattatttccttgtttatttggctgcatctttgctactggttttcccatctggaatataagttctggggggttagggatgagatcttttttggttcctgctgcttccacagtgctgagcctggcctgtttgttgaagaaataaatgaatgaatgaatttacatattcggtttcacacagtgaaaaaaaatcaagtcctctgtgctggggacacagtggtgaccaagccagccttgcccctgctcgcatgggttcgcagtccagtaggagacagacttgtcctcagatagtgatgactgagagtgggcagtgctgggacagaggtgcccagaggaggggcctgactcagcctgggggtcagggagggcttcctggaggacaagacatctctactaagctgagaacctaaggatgagggggaggtggttgggggatgaggaagatgaggaaggatgatccaggtgaaagaccatgaggtgttggcagatgggaaatagtgggtagagaatgacaaaggtagggatggaagatggggcaggacagagagacagaggcagaagcagcagccagccggcctcgctacccagccccagggcaagggcccagatctccatcctcctgtcaggccctgccgcaggacatgaggcccgatctggtttcctgggtacaggagaaacccccaggaggcagactgagcccctggtcagcttcacgctgaggatggggagggaacaccggcccataaagcctccagaatgatgtccctctctcgtaacctgaaaatctgaacatcagcctctactcctcttgtccctggtcccaaaacccaggcaccacgctccccatatcccagcctctctacctcccacatctctctccaaaccatacctttctctctccccatggccacatcctggccaaggcccctcccctcctgctcaggtccctgcctgccacccagtctcctgcctctagtccctgccagaagaactctttttttttttttgagacagactctcattttcacccaggctggagtgcagctggtgtgatctcggctcactgcaacctccgcctcccgggttcaagcaattctcctgtctcaggctcctgagtagttggaactataggtgcgtgccaccacgtccagctaatttttgtatttttagtagagacggggtttcaccatattggtcaggctggtctcgaactcctgacctcaggtgatccacccacctcagcctcccaaagtgctgggattacagacatgagccactatgccaggcctattttttttcttttttttttttgagacggagtcttcgctctgtcgcccaggctggagtgcagtggcacgatctcggctcactgcaagctctgcctcctgggttcacgccattctcctgcctcagcctcctgagcagctgggactacaggcgcccgccaccacgcccagctaactttttttgtatttttagtagagacggagtttcaccatgttagccaggatggtcttgatctcctgacctcgagatccgcccgcctcggcctcccaaagtactgggattacaggcgtaaaccaccacgcccggccttttttttttttttgagacgaagtcttgctctgttgcccaggctggagtgcagtgccacaatcttggctcactgtaacctctgcctcctgggctcaagcaattctcctgcctcagcctctcaagtagctgggattacaggagcccaccatcacacctggcaaattgttgtatttttagtagagacagggtttcaccatgttggtcaggctggtctcaaactcctgacctcaagtgatctgcccacctcggccccccaaactgctgggattatgggcgtgagccaccatgtctggccccagctaatttttgtatttttagtaaagatggggtttcgccatgttcaccaggccagtctcgaactcctgacctcaggtcatctgcctgcctaaccattccaaagtgctgggattacaggcatgagccactgcgttcagcacccagaagaaatctttccaaagcacaactctgggccgggcatggtggctcacgcctgtaatcccagcactttgggaggccgaggccggtggatcatgaggtcaggagatcgagaccgtcctggccaacatggtgaaaccccacctctactaaaaatacaaaaattagctgggtatagtggcatgcgcctgtagtcccagatactcgggaggctgaggcaggagaattgcttgaacccaggaggcagaggctgcagtgagccaagatcacaccactgcactccagcctggcaacagagcaagactccgtctcaaaaaaaaaaaaaaaagcacaaatctgacctggcaccttgcttgctagaatctgccatggctccccagtgccctcaggagcacaaagatcaactcattaccgtgccctctagtgtgagctgaccccatagaatttctctggcctcctcccttaccactgcccatgccatccttctccactctgcagcccgaggaagtctgtgaaaatgtaaatctgagcacaaggcttactcaagaactatgtatggctccccactgccttcaaaatagggcccacacttccaagccaaaccccacaaagccctgtgtgtcctgccaacaaccctctagaccctgctgggaccctgattccagctgctaggaggcccagcagggacagaaaaaggtgagcttacctttggcgtaggtgctgacaagggtggcaaagttagcaaggagggtgagcggggagaagtcagcaaggtcggtgatctccagagtatgcagcagggaccggaggcgttcagcacagaatctggcggggaggagagacggggtcggggggcagacggaagcatgagcaggaccagcagccctgcctccgccatcacgacggtcacgtgcctgtctccccagccaatgagcactcagtgagggtgggcactgggcctgttttggaaacttgcacccccacgctgtacacctgcatgtcacaaatagccattgccgcataatggcacagacagagcaataatcagacactccagagtcatgtggtcacttgtcacacctgctagcacgacctcctaagtgggttctttttttctttttcttttttttctttgttcagatggagtcttgccctgtcatccaggctggagagcactggtaccatctcgactccgcctcctgggttcaaatgattctcctgcctcagcctcccaagtagctgggattacaggtgcctgccaccacactcagctaatttttgtacttttagtagagacggactttcactatgttggccaggctggtcttgaacttctgacctcgtgatccacctgcctcagcctcccaaagtgctgggatgacaggtgtgagccactgcacctggccctaagtgggttctgatcaaaacaagagacgcacaatcacacccagaaccccccagtcatggcattaatcccgcatggccacatggtcacgcattcacacccagagcctctcccactgcctctcacgcacctatggggacacacacggtgtcggaaccccatgggctcacagaggaatgcagtcaacacccacatcccacagagtcccacggataccacgtccacacactcacgcatgtgcagggccactcggccacaaccacacacaggcagggccgaggcagggtcatagagcagctggctttgaagccaggtgggcagtcacacttgcaaacctgcctcccgcacgtcagccctcccagcctggctcctctaaccccaggcgcctaccccggctggtcgctagctgaggatgagtctgtcccctccactgggccatggagcctctacggctgtgtccccagcatgaagcaggcacttggggaatgtgtgttgagtgactgagatcccctctttgccctcacaagtctccaatcctggggaagatgggcaaacccacatggaaggtggcctcacccacagaggcagggcagccagggcctttggagcccacaggcatggcttcaagccccaactaccgggcacagtgctgtgtggctctgggcaaaggcttcccctctgggagtcccagtgtcctcatttgcagggtggggatgctgtactgggggtgcaactgaggtaaggaacataaagggcttagctcctccttagtgctcagggcagggtaggtgattggcttcgctgctctctcattaacccaccaaagaaccctgtgaagtaaagacccgactccttggccattttacaaaggaggaaactgcagttcaaagaagacccatgacttacccaaaggaaaagccccctcgtatcccttggtcattctctgcctgccctgtgcctcaagagactgactcccccaaaatgcgcccagactactccatggggacgcccctgccctcaggtttggaagattagaggcatcggtgggaagatacatgggccggggacacctcctccagctcccagcctgcgaggccctggtactggtttctgctcccagcagaagcccctgtccaggcccccaccagttggttctcaacacactccctccctgccgctgtggcctggcttagctcccagctctcacctcccaccctccttggctcctcccccagcccgcccctctgtaaatggtgctcccactctctcttgggtgggggagattctccaatccagccaggtgttgcctgccaggcccctgcccgacgcacggacccaggatcagctccaaccttgctcccggacctcccaggtcagaccagacaaggtcccacgtgcctcgcccagctcactcactcctgatgctgcagtggtgacctggggctacaggcgtggaggacacggctctgcataaccgggacctgccgggcccccaccccgcgcgctgtctggggccgcacctgaggggcttgcgctggatgcacacgcgctgggccaggccgctcaggaaggcgggcgggctctcctgcaccacatgctgcacacgcagccgccacttcacgtactccagcagccgcctcaggaagcccaggaaatgctcggccgtgcggatggagccaggcactgcctctgcgaggagacgctatcagcggcgacggggaggcgggaaagggactggggggcagcggggggtcggggctcaccctgcagcacttcgtcgggcagcacggggttggccaggtgggcgtccgtctcccgggcggcgctggcctcccgcagcccctccaccagacgccggtactcgtcccgcaggcgctgctcgtctgtctctttgatcctgcggagagatgagctggggctgggagggggctggcaaccctggggacaagtcagacaggggccagggtcccaggggcagggcgggcaccaccgccagacgtccccggccccacctgagcaccgtcttctgcagggtctccaggttgccctggcaccggtcaagggtccggcgggtgaggttgacgctcatggagtcgatgcagacgttgtctggagaagggggagagagccggctcaggcaggcctgcaggggcctcactcagaggggctggcatccctttggcccctggcgcccccctcaccaatgttgtgggcctcgtcgaagaccacgacggccttgcgggccagttccttggacaccaggtctgcaatcttggggtccaggaggtagtggtagctataaaccaccacattggcatgcaggatctggggggccggggagcagggttaccagggccctgccaccccaacccctacccctacccctggccacactggcccgtcactcccacacaggcctgcacaggcagacacaggccaggcagaagtatgagcagatggatagagacagaccaacagatacgggcacccaccaacagggagatgcagacaggcagactcacagcaagcaacagacagacatgggcagacaggagacgggcgggcagcccacaccctcacactcgcccctctgcccatcccaccagcctcctcactgagtatcgagcaaggaagtatgggcaccagccctggcgccgccccagggccttcaggtcatccaggttgtagatgccagcggggaggggcacctcacgcccatgggcatcaaattcctgggacaagagtgccaggggtcagggaggctgcctgccccaggctacctgtcctgcctccctccctcagccctgccctccagtaacctcatagaatcggcagtggggcaggctggtgtcatgctggtactgcgcccgcacataggaggctgtgaggctgtggcatttcccatcgacgtccttcccaaagcgcaggggtgtcacctgggggtgtggggcatcttagcacccagacagggtggaaacccaaccactcttcaaaccctggtctccacacctcccagctggctggggttttggacaacttgaacctcagtctgttgcattattagttaagacgcgtgggaacttaatgcagggatacaagagtagtaaaattgggctgggcgcggtggctcacgcctgtaatcccagcactttgtgaggctgaggtgggcagatcacgaggtcaggagttcgagaccagcctggccaacatggtgaaaccctgtctccactaaaaatacattagccaggcgtggtggcacatgcctgtaatcccagttactcgggaggctgaggcaggagaatcgcttgtatccgggaggtggaggttgcagtgagcagagatcgtgccatagcactccagcctgggcgacagagtgagacaccatctcaaaaaaataagtaaaaataaaaatacaaaaatgagccaggtgtggtggtgcacacctggaatcccagctactcgggaggctgaggcaggagaatcccttgaacccagaaggcagaggttgcagtgagccgagatcatgccactgtactccaccctgggccacggagccagactccctctcaaaaaaaaaaagagtagcaaaattgttacattcttacaactacaagttatacatacatatttttggagacaagtccctctgctactcaggctggaatgcagtggcccaatcacggctcactacatccttgacctcccaggctcaagtgatccttcccccactcagcctcccgagtagctgcggccacaggtgtgcaccaccatgcccggctaatttttgtcttcttagttgagatgaggtcttgctatgttgcccaggctggtctcaaactcctggtctcaagcaatcctcccacctcagcctcccaaagtgctgggattacaggctgagccactgcgcccagccagccaaaactaatattttattttttgagacggagtcttgctctgttgcccaggctggagtgcaatggcacgatcttggctcaccacaacctccgcctcccaggttcaagcgattctcctgtctcagcctcccgagtagctgggattacagacatgtgccaccacacccggctaattttgtctttttagtagagacagggtttctccatgttgatcaagctggtctcgaactcctgatctcaggtgatccacccgcctcggcctcccaaagtgctgggattataggtgtgagccaccgtgcccagcccaaaactaatattttaaaacaataagcctgaaaaatctttagcatataggttgaagataactacttcatccttggaaatgccaaaacgcatggaaccttggcagggcctaagaatcaaaggaggttccacacagtctgggactccccttacccctgacctgctctgtaccctctaaggcaccatcacagcctaaggctttttctgaagaacaaatccttttcctacgccaaaaggaaagctccaaggcagccagcccttccttctccatttcccctttcatcagtcaccgaggcctgtgctctttgtcatccactagatgtattatttctcacatattcttacaaataatgtgatataatatatagtctgtgggcccagtgtgggagtttgagaccagcccggccaacatgatgaaaccccatctctactaaaaatacaaaaaactagcagggcgtggtggtgggtgcctgtaatcccagctactcaggaagctgaggcagaagaatcacttgaacctcggaggtggaggttgtggtgaaccgagatcacgccactgcactccagcctgggcaacaagagtgaaactccatttcaaaaataataataataaataaggctgggcacgatggctcatgcctgtaatcccagcactttgggaggctgaggcgggaggatcacaaggtcgggagttagagaccagcctaaccaacatggtgaaacaccgtctctactaaaaacacacaaattagccgggtgtagtggggcacctgtaatcctagctactcaggaggctgaggcaggagaattgcttgaacccgggaggcggagcttgtagtaagccaagatcactcccctgcactccaggctgggtgacagagtgagactccgtctcaaaaacaaaacaaaacaaaaatatatatatatatacacacacacacacacacacacacacacacacatataaaaacatatatacacacacatatatatgtaagtataatatatacacatatatacattctgtgggttaccacatgtaaagtattcagaacagtgcctggcacacagtgagtacaatttttttttttttttgagacggagtttcactcttgttgcccaggctggagtgcagtggcgcgatctcggctcactgcaacctccccctcgggagttcgagcaattctcctgtctcagcctcccaagtagctgggattacaggcatgtgcccagctaatttttcaattttttttcagtagagacggggtttctccatattggccaggctggtctcaaactcccgacctcaggtgtccacccgcctcggcctcccaaagtgctgggattatagtcgtgagtcaccatgcccagccaagtacaatgattttatagcataatttaatgataactaatattgtatttgtcatatatcattatgcatataaatatcatgacaatttctttttttttttttttaagacagagtctcactctgtcacccaggctggaatgcagtggcatgacctcagctcactgcaacctctgcctcctgggtacaagcgattggcattaccgacgtgtacaccaccacccccggctaatttttgtatttttagtagaaatggggtttcgccgtgttggccaggatggtctcgaactcctgacctcaaatgatctgcccacctcagactcccaaagtgctgggactacaagcgtgaaccactgcacctggcctatcatgagaatttctaacattcttttagctctttgtacatgctaagggcatcggctgcaacatttcacccaattttatcatcagcaaccttatgaagcaggtacataattatccccattttacagaaaggaagactgaggcccaggtggcagaaaatgcctctccataaatactgggctagtaagtttcagagccaggaaaccaggcttgccagagactctaagagctgcctttttaacctctcctaggcctgggtagaatttgaagactccctggaggaagtgtgcttgcctgggccacgatgaatgagaatttgaccactgagacgggaattctgtgtgtagccactgcatgcctttgcaagagatatggcctggggatccaggacttgtggttggacgaaagagttttctctacctctgggctaagggcaaggagaaggaacaggtgctcacctcagggtgaatacacaagtttttgcgggagctcagagccagtcccagaaacggcagcttctcgccctcctgcttctcatagaagttgagcaactttcgaagctcttcaatcacctactccaaagttggggggcagggggagcttgtgctcattggaggcacaaacccctgccctgccaggtcccagtctcttccccagcttcccaaacacccccgaaagctggtgacggccaccgccagggggaccaatagggcctagggaacagtggggctggagcaccaggatgagtcccagcttaccttctcaatctctggcacagttcttgagcagtagatgagtttggtcacctccagcggatatgcctgccgataacaagcggactcagtccctgtcccgccccttcctttgtctgcctttacgggttcagcgcatcactcactctctggtatgccatgatcagggccaacagggatactgtcttcccggtgcctgagggcatctccaggactccatgaccctgcatgttggggaccagaggggcaacacacagggtctcagaaccttgggcacacaaactctggggactctccccgacccccaatgccaccaactcagaacagcaggataacacagcagcagttaagattgggcagtgggtttgaacctcacttctgcctcctccttgttgagtggtcttaggcaagtaccttcacctccccagacctcagtatccctatctctaaaatgagcctaaagccaggcgtggtggctcacacctgtaatcccagcactttgggaggctgaggcaggtgaaccacctgaggtcagaagttcaagaccagctgggccaacaaggtgaaaccccgtctctactaaaaatacaaaaaattagccagatgtggtggcgcgcacctgtaattcaatctcaaaaataaataaataaaataaaatgggcctaataataaaaccttcctcataacatgactatgaggattgtgagaaattgcaggttaaatatttggcacagtagctgatatatagtgaacttttctcccttcttttttaagagacaagtgtcactattgcccaggctggaatgcagtggcacaatcatggctcactgcagcctccaactcctggcctcaagcgatcctcctgcctcagcctcccgagtaggtgggattacaggcgcccgccaccacacctggctaatttttgtatttttagtacagacggggtttcaccgtgttggccaggctggtctccaactcctgacctcaagtgatccgcccgcctcgtcctcccaaagctctgggattacaggcgcgagccaccgcgcccagcctattcaccattattgttttagataacggaagattatggggtcctggattcccagggacctcggacttctaaaatccagacgtcctgcaatctgtcttaggcccaggcgtggcagccccaccggtcgagtgggcgggtcgggcccaccggccacccaccttggcgtccagcgtgcgtttgagctcccgcatgtaggagaactgctcggggtagatgtagtcgtacgggaagtagaccaggagcccgtccacgttgagcctggcggcaggggctgctgggtcagttcccgtcccctcagcccctctcccgcctccacagtgcccggtcgtcgagcccagagaagggtgacgggcccggcgcccccggtaaccctcaggtcctcaggagcctcggggccccctcagtgtctcctcgctatcactgctgctccctgcggctgcccccgtcccaccccttcaccctcccctcgcccccttggggacccaggcgcgcccaccgatgaccccatcttcaagaccccccgcgcccgctagcgagcgcgacccccagcccccttctcacttcatggcgccggccggactgtgcagcggggtcgacccgcctccctcatgaatattcagcgagaggccgggtcgtggacatcctcgagggctcgctccacctatattacgag

SEQ ID NO: 77 - DNA, 44775 bp, Homo Sapiens
ctccttccgcgtggtccctccccctcaggccgcggtcgcgattacgctctctacggcctgcgaccgcagggccgttgcgggctggagacacggcgccgactggaaccggaggagctctaggccaaatggttgggccagccaggatcccaggacccttcgccgctcgagaccggagagaggaaacgaaacaggcgggaacccgtgggggagggagggaactagcggaaggtgtcatggcggccgcgctcttgagtcacgtgcccagggcccgccttgctacttccggtcacgtgccctcagactcctcgcagccagcgatggaggcgagaccccctagtaacagaggcggtggctactgctgcggccactgggtttcggcctcttcccagcagcggctctaagaagcgcagcggaactcgaccggatccaacccagttagttacttcctgtctagagttgtagcttccacctggtaagtttagaccgaagaatgcaggcgggcgggtgggtgggcgggtgaggagctgacaggcctgggggccgctggacggcgtggattctacccctgttcccagcgtcgctgtcgccgtcctcccaacgcccaagcctggcgtcttgtttgcccttatcccgaggcgaggaagaggcgacccctaatctacttgtctaaaggaaacctgctcttaaattgagagcaggtttacccaaagccaggatcagatttggcttatgagaatgaagtggaggcctctcccagacagagaagcccttcccgtcaggaaatgtgctgttgagtctgggattctgtaagagaaaagctgtcaccttgttgtctgcacaccttttgcttccacctgtcaatcttacctctcttaaaaaccttaacacgtgccagtccacacactcctagttttggtcatttgattgtcgtgtaatgatgaaaaatagaccatgagtacctggatatatgtaattattttgtaaatcccccagtgttctcaaaggccaaattaaataaggaggtgacttttcttatttttttttaagagacagagtcttgttctgtcgtcctggctggaatgcagtggcgtgataatagctcactgtaacctcgaattcctgggctcaagcgattctcctgcctagacctcccaaagcgccagaattatgctacagtgcctggccccaaatgactcctaaactccaattttagcatcagtaaaatggggatggggaaagaagatatgaaaaatacaccctttgtccatttgaagacccagtcttaaaaacaaaaacaaaaaaaaaactgagtggtttgaatgaaatgtgctttgcagtgagtattgactccatacaaaccaatatccagacttgtgattttcaaacattttaaaggagtggaacaatttctccccatgaatttttatctggaacccaatatataaagcagcatgctctggtggaactaaatttaaaagggccaggccccaccaccccacttaacttctatcctagaggccactccttggaacacagtttgaaaaccactgaactggacttaggtaattaagccaaagttgccaaccttaagattttttaaaagacaaaaccagagcagttgagatggagaggtcacaaccgcagggaaggtaacctctagtagcaggccttggacttagagaaggactaaactctggagagaactttgtacctgttagcaggcttaagtccctcattcagaaaggagaaaaaagagatggtctgctatcctcactcagccgacatttttttttttttttgagacggagttttgctcttgttgcccaggctggagtgcaatggcgcgatctctgctcactgcaacctccatctaccgggttcaagggcttctcctgcctcagcctccccagcggctgggatcacaggcgcacgccaccatgcctggctaatttttgtatttttggtagagacggggtttcaccatgttgaccaggccattcagccgacttgtagcagtgcaacagattggtaagtttgagtctctcttaggtgatataaaatacacattgcagtacaaatgtgaaaaaaaatcaaagcaaattcagagagggcttttgaaaaatactaggaaacttggtgcagtgtgggagaagaatcagttaaaagtagtgaagccagcgaccagcaccagtcctgggttgtgaatgcttcctgtgtgtactgccctcaaggcttgtaacttctccctgctggtaccatgtgtcctgccctctgataacctgcttctctgtgctattttattccctaccatcagaatgttgtctggcataccttgagctttcctagcattttggccaccatttatctctgccttatgcatactgctgatagagatgtctttgtgcccttcctttctctttcctgccttcagtgtggcagtatcagccattgacctagtagttcctcttttcaccactttgattaccaactgattactcttctctcaattttggtaatatactcttgtcagcatgcagtatttattaatggatatgagcatattttcttctgtcatgcatctctgtcgcattttcctcctgcctcttccctgcactgctgtaaaatgtacaagtgctcagtcctaaaattgccacatcagttattctccttaatatcttccttgtctgtgaaattatccttaaaacagtacattttggtcactctttacatacttataaagttattccctttaatgctgaattgttcaaacacttttggattgcttgatggcaagcagcattccaaatctccatttttgtatgctggcagatataacagtgctctctagtaatccttctttcagaagatttctctttcacttgttgctccctatctcctctcctccatttatctcttgcacattggaaaaggggatgtaggtaatggaaatgcagaggtgcagtaatgtaaagatttgtattcaaccagttcatattcttccttatcactgttgccttttaagagcaagatccagttattagaatctgtatgagaaatggtacattgatctgtgaattgaaaactatagtggttcccggagtttaggcaaagatgtatatgcaaagattccttattatgtcttagcaagagattgtattcttttaacagcaagatcttaaatgatgtcattgatacttcttggactcttcttataggccaaacactatattactgggtgctatattacagagaacccgacatatatggcctctgccctcccttatgaagcttgcaatctgtcaggagacgtgtacattaaaagaatcacattaaaaattatgttgttgtaagtgccatgaagaaaataataggagactttagctggtaactttgaagcttaacatagactgaaaaaaaaaatgagtgaaagttagccagttgatgggaaaggaagagaatgtacaaaggctcagagcaaggtatatgaatttagattcggacaaatacatttttaactgcaaataaattaatgcctttaatatagatcttgctatttaaggaagtcttagaccatttcataagtaaatagtcttttagtaaagcgagatcttcattgacctgatctgtttaaatgtagcctacaccaataactttcataaatttctatggctcttatagagttctcctgggaagaagtgtttgccactcaaggaatacactcaagaaaaacctggaaatcacagaaggcattgtaagatagctacagtgattctgttaaacctcctgaaattggtccttgaacaattaagaggtgctacagatgaccaggaaaatttaccaggcaaattagctgtgagacaattgaccatttgtgcccaatgttcggtaatttatctcagatttattttttaaatttccccataaatgaattttgatataaatggttttatatgttatatataagaggttatggctgggcgtggtggctcacgcctgtaatcccagcactttgggaggctgaggcaggcagatcacccgaggtcaggagtttgagaccagcctggccaacatggcgaaaccccatctctaccaaatgtagaaaaattagcgaggtgtggtggtgcgtgcctgtaatcccacctatttgggaggctgaggcaagggaatcgcttgaatccgggaggtggaggttgcagtaagccgaaatgaggccactgcactccagcctgggtgacagaacaagactccttctcaaaaaaaaaaaggttatgtttttcccagttgctgtagtcagttctgtctcatgatgtattctccactttgcagtttctgtcttcatgcatttttttaccttctcaactcataaaggtctttgtattattttccaatactaacactttatttgtgcctgtaagtccagttaattggagacttgctctatcagctgtccttgctcactgcttttcttccaactgctgacatacttaaaattatcctacttaagtaggataatgaagtatcaacatacttaaaattatttgccaacttccccgtcagatcctcccctcatctttcttagattttaattcatttttcttaaaacatatgtttcctaatttgtatggtttgcagtccagtttcatattctacagagtgggctttttaaaatatgttctctaactcccaacctcaagtgatccacctgcctcaaaacctcatctctactaaaaaaaaaatagaaaaattagctgggcgtggtggcagatgcctataatcccagctacttgggaggttctggcagaagaattgcatagttatatgtttattgtaaagaatactagaaaatgaatgttaaaataaactattgaaaatagaaaacactgttttcaaattctcacactagcacccctaacactttcctgggttacctttataaacatttggtttgatagagaagaaactcttgggaagacttttttttttaataactgctctagtataaaatacataattattatagatcagaaaagagaacatttaaatcatctgtatttttatcacccatagataatcattattaaatttggtatctatcccttcattcgcatatattttcagagtaacatagtgaaatttcaaagacagactgacccagattcaaacccagttctgctacttccctgatggtttaagaaagcctcttgatttctcagacccagtttccttatctacaaaatgtaactaataatagaacctacctcatgggattattaactggggactgagataatgcctataagaaacttagtgcagaacctgacacattattaagcattcagcaaattctagatgatggagaatactctgtcacccagactggagtgcagtggtatcatcacggctccatctccctggactcaggtaatcctctcatttcagcctcccgacttgctgggactacagatgtgtaccaccaggcccagctaatttttatagtttttgtagggacagggttttgctatgttgcacgggctggtcgcaaactcctggtctcaggcagtctgtccgcctcggcttcctaaagtgatgagattatagacgtgagccaccctgcccagcctaaattttagatttttttaaatttaagaatatggggcaggccgggtgtagtggctcacgcctgtaatcgcagcactttgggagactgaggcgggggatcactaggtcagttcgagagcagcctgataacatggtgaaaccccatctctactaaacatacaaaaattagccagccatggtggcatgtgcctctaacccctagttactgaggaggctgaggcaggagaatcacttgaactggggaggcggaggttgcagtaagccaagatcgggccactgcactccagcctgggtgacagagggagactccatctcaaaaaaaaaaaaaaaaaagaatatggggccaggcactgtggctaacgcctgtaatcccagcactttgggaggccgaggcaggtggatcacctgaggtcaggagtacaagaccagcttggccaacatggcgaaaccccgtctctactaaaaaatacaaaaattagccgggcgtggtggcaggaacctgtaatcccagctacttggggggctgaggcagggagagtttcctggaactgggaggaggaggttgcagtgagccaagatcacgccactgcactccagcctgggtgacagagcaagactccatctcaaaaaaaaaaaaaaaaattttatggaatcatgccaggcatggtggctcacacctgtaatcccagcactttgggaggctgaggcgggcggatcacttgcgtccaggagttcaagaccagcctggctaacacggcgaaactccatctctactaaaaatacaaaaaattagccaggcatggtggcacatgcctgtagtcccggctactctggaggctgaggcaggagaatcgcttgaacccgggaggcggaggttgcagtgagccgagatcgcgccaccgcactcctgcctgggtgacagtgagactccatctcaaaaaaaaaaaaagaatatggaatcaaactacatgccttttttttctgtgtatcttttcatgtcattaaatagtcttaaaacagttttttaaacttcaagaagggaaaactctcaaagtcttaagacatcaaataagtcagttaaaaggtggtatcgtttattaagaattgtgatcctttatcatatttgatatatggatatcaaaatgggattgtaagaaaacaaattctcagtggtgagtaaaaatcacaaaataatggacttgaatgtattttatgattacatttgtaaggtgggtacagataaggtaagcacaattaaaaatgaggaaaattgatgttagggttgtgacatggaattttttaaatccctttttaattaaaagcagtcatctaatcgggctttattccagcgtttgcaaatgcctacataatgcagactatctccacctgcatgactcagcagtacctcacattcatcatgtccggaactgaattccttatcttcactttcaaatctgctcttccttctcattaatttctgaaaatggtaccactgtgctcatgtcagtaaggctcagaaatggggtatgggcaagcaaccatgacgcttccttcagcactttaacaatgtctgttcattctgctgcttcagtggtcctccttgtcccttcctctccagtctctcctgctgctcacagattaatttctaaaatacaaatcactcccctattcaaaagtcttcagaagttttctgttgtttgccacatggggtggccttctccactatatgcctccatcttaaccatccaacctcatatcctactgatctcatgaaccttatgctatatcctaagcagattactcattcctagagagtttcagtccactgccccaaactatttcctttgcctctgacacctgtttccctttactttctctgtagaagtcgtctcttcaagacccaatttataaccaaactatgtattaaacagaatgaactgatacatatacaacaatatggtggatttcaaaaaacatgttaagcaaaaaactagagacaaaaggagtacatactgtatgattcctttcatatgaaatcctagaacagataaaaactaatctgtggtgatagaaatcagagtagttgctagaggttggggaaaagagattgacctgaaggaaacatgagggaatgttcaagggtgactgaaatgttctgtctctcattttgggtaactgtaaatgggtgtgtactatagtcaaaacgcatcgaacagaatgcctaagacctatgtatttgttggtttgttaattatatcttagttttttaaaatggctttttaaaaattctgtggcaaacatttctcatggctttctgagtgaagaaactgcctcttgagtcctaacttggaacatttttgtgtcccttttgggacttcatgtcgtgggtagcaactgtctgaagctggtggcaccagtaataaaaagaattcaccaagacagttgtaggtaaagaaaggcagatttgttagagaaagtaggaaaatatgttgcaagaaagcaacgtgcagattagcaagcggagagctgactgcaaggagacaaaagcttccaggggattttataggattgtacttttgttgaagagggctacatgaagtactgctaacaccaaggctgcagtgagctaacttgcatttttctatccgctgaggttctggtgataagtggggcacaggaagattgtgaattatttgcacgggagggctatgtgtcctggaccatgaagaaaggctgacttgtagcttatctgctttttctttttgctttcccctgctcccaccagcctgactccttttccctaattaggagtctacacacattctaattagtatacactaacaaatagcacacatatacacacttgctcactgccctggaagatctttgaaagcagaaatcaacagacgttcatctttggatagtccccaggctccttggctcagtacagatttgttggataaatgtattcacattgacctatttcctttctgttctcgggatagaatagcctgtaaagacctataaaaggggtatctgactactcatacttgagataatcaacttcagagaaagtaaggtttcacttttttccctgtattttttatttctaactcattgtttgagcgaataagaagtaataattgttttaatccagtggtttgttttgttttgttttgaggcagggtttcactttcatccccaggctggagtacaatgttgcgatctcacctcactgcagcctctgcctcctgggctcaagcgattctcctgattctcccgcttcagcattccaagtagctgggactgcaggagcacatccttttgcccggctaatttttgtattttttgtgggaatgggtttcaccatgttgcccagactggtctcgagctcctgagctcaagtgatccacctgccacagcctcccaaagtgctgggattatagacaggagccaccgtgcccagccatatttattaatcttaagaggtgttggtttgctgggcgcagtggctcacacctgtaatcccagcactttgggaggccaaggcgggtggatcacctgaggtcaagagttcgagaccagcctgaccaacatggagaaaccccgtctctaccaaaaatacaaaaatagccaggcgtggtggcacatgcctgtaatcccagctgctcgggaggctgaggcaggagaatcacttgaacccaggaggcgaaggttgtggtgagctgagatcacaccattgcattccagcctgggcaacaaaagtgaaactccgtctcaaaaaaaaagaggtgatggtttaagtagttttttgggggttttttttttgtaactttattacaagaatttctgatttctattgtttttaatccctgccgtactccccttcctaatacttattttcccattatgttcaaatagaagttctcaattattttggagaactaatggcagatccagtatttcattgttcccattttatttgtttagagacacaggtctcactcagtcacccaggttggagtacggtgtggtgattatagctcactgccgcctcaaactcctgggctcaagcaattctccccctttggcctcccaaagtaattagacctattttttgtacagacggggtctcactttgttgacaaggctgatctcaaactcttgggctcaagtgatacctcctgccttggcctcccaaattgcggggggttacaggtgtaagccacatcacttggcctgttttcattagttttaaccctcagaaaaatgttgcggtaaagcttcacttatttgcccagggcaaacgtaattgttaaattatattttggccattcctctggggatgaaaactaaagtcataacttcaccagaaatggcatatatgtggcattggtgccacaactttccccatcctggcccatggcagacagcaccatcagtcagcagtttttctcactgagtccagacagccacactcaagcctggaggatttgggttgggcatttaagattctcagaggcaggggatggaggtggagggaccagactctttcttaggtaactagttaggcattataccaatgaatcatggccaagacgtggagagcagttgaagacatttgaatgttaaaagataagaaattagcatgtgaagtgttaaatatttagttctctcagttttatttatacagaagaaacagaccagaaatcaggaaactttggtgtggtttcagctctgggagtggttctgggaagtccccacatatcttgcagactttagtttcaattgaaacaaatttgaactaaataataaatatgactgtaattctacagttttacaattgtaaatatagactatatgaaagactacacattttcaaattgtgtgtgtataagaatataactgaggaaaataaattaataatactcattagcatataagtattgtataaatttacacctgtggtatgagcaaaatgaaatttaattgtagaggaatgatgccgtgcaactttatcttcaactttgaatgagaaaagagactttcttcttccccgttaatttcctacagtttagattttatatttgaaagggactctagaagtcaacaaattcaaccctaattgatgtgtggaatagtttttttcttcatcttttttttctctcttagcaccttctagccaccatggcaacctcatctgaagaagttttgctgattgtaaagaaagtgcgtcaaaagaagcaggatggagctctgtacctcatggcagaaagaattgcttgggcacctgaaggcaaagatagatttacaatcagccatatgtatgcagatattaaatgtaagtcagctatactaagttctgatgtatttgtatgtcatagttgctagtaattttgtaaagagattatataaatctttattttatatcaaaaaatcaactatgtagaaataattacaaaatggggtcactgaatatatactgttttataacctgaccttttcacttaataacagaacaggtacaggtttacatataatatgtaaatctacctgacatatagatctccacacactttaagagttgcataatactccactaaatgaatatacaatcatgtatttaaccagccctctgtggttggacacttaggaagtttccagaatttttttattgcagtgtttgcactaatatcatttcaaggttgtatgtgtaggatacatttctgcaaagaatttcctgtttaatagttgatgtgtttttttgtgttattgttggtagggacagagtcttgctgtgttgcccaggccggtctcaaactcctggcctcaagcaacactcctgcctcatcctctcaaagttctgggattatgttataggcatgcaccaccatgcttggccaggtttatgcatttaaaatgctgatagatgatgccagattttccttcactaaaattgtaccagttaggcaagttgtctgatctttgcttatgtggccatcttctgttgagaagactcaaccttatagtgaatgtaggtggtggaatctctttttataaatttcaggcatgggctaggtgcaatggctcacacctgtaatcccagaagtttgagaggccaaggcgagtggatcacctgagatcagaagtttgagaccagcctgctcaacatggtggaaccccatttctactaaaaatacaaaaattaagggccgggcgcggtggctcacgcctgtaatcccagcactttgggaggccgaggtgggcggatcacaaggtcaggagatcgagaccatcctggctaacacaatgaaaccccatctctactaaacatacaaaaaaattctctgggcatggtggcgggcgcctgtagtcccagctcctcgggagcctgaggcaggagaatggcgtgaactcaagaggcggagcttgcagtgagccaagatcgcgccactgcactccagtctgggtgcgagactccttctcaaaaaaagacatatatttctgagagaatgccctacaaatttctgttactagctaatagccttagctactaacatttctgtaacaatagacttataaattagcagtattagcgtctctctcaaatgggaagctagccccatagctttgtgtaatacacacgcacattgtgataaccacagtgtacaataaacagtatgcccatctccaatttctctacaattcttctcagttattggtgaaagcagtgcatacccaaaactagatttgcaccagaacagtttcaagttgaatatttgaaggaatgcccacatctgaaagaagcaattgaaattgatttagttcttatcatagctgacaaagttacagaaaattttaaagaatgatacagtgaaaacctacgtaatatgccccacctagatattagttattattttgccatatttgctttattatttgtgtgtgcacttttattgcttgtaataccattatcacactgaaaacattttaataaaaaatagccattgttacatttccattggttgtctcagtaatgtttatagttgtggtttttggtttatttttttatttttttattttaaaaaaaacggtatccaatctaggttcctgtagttgtcatttctttagtccctttcagggtatagccttgtcaaatatcaaacattctgaatatttctgattgtctcctcaaggttttaatttattcctgtatacctgtattttttataagctaaaagtcagatctaaaggcttgaatatattcagcttaaacattttgtgcaagagtaataacatacatagtgacattcacttcctgttccatcacctcagaaagcatatagtgtcaggttgtctcacttttaatgaggctaagtttgataactttattaaagtggtgacaccagatttctcgaatataaaattacatatttcccttgcaaaaagaaatgccatgggccgcattttgcagtcttttggatcatgataggtcattttttattaatgataatgttgatttggggcagtttgtttaaaatacattcaggaagctttaaagaggtctgccctgccctagttgaatggtaacaaaagcccattaatatctggaggtagtagcagtgggtgagaagtgctgcatgacaagagtaccaaagaaggaagcagagtgttagtgagtttgatgagcatgctctggttgtatgggatcatttaagaagagtgcattctacaaaagcatcagtattggaatagggcagttaaagcccaaaggaatcctgaatcatcttgggagaagtaacttactgtatggttattcccacagtgtgagtgtcatcatctaactgccctcatgcttctttttaggccagaaaattagtccagaaggaaaagctaaaattcagcttcagctggtcctacatgcaggggacacaactaacttccatttttccaatgaaagcacagcagtgaaagagcgagatgcagtaaaagaccttcttcagcagctgctgcccaaattcaagaggaaagcaaataaagaactggaagagaagaacaggtgggaggaaaagaatagccttttgaaagagatactgggttctctatagtctcctagtatgctaatagcttgttagctatccccacgttttttcggttttggttttggttttttgttgttgtcgtttttgtttttgttttgtttgtttgtttgttttggtggtggtggttttttgtttgtttgtttttggatttttttgagacggagtttcgctctgtcgcctaggctggagtgcagtggcacaatcttggctcgctgcaacctccacctcccaggttcaagcaattctcctgtctcagcctcccgagtagctgggactacaggcatgtgccaccatgcccggctaatttttgtaattttaatagagacagggtttcaccatgttggtcaggctggtctcgaacttcctgaccgccagtgatccacccacctcagcctcccaaagtgctgggattacaggtatgagccaccacgcccggccacctatcctcacttttgctatgatactgtaatgtaggaaaatatgggctctagtgtctttaccttggtgtttagttttcagctttaaaatcttactgcttgtttgactttgggaaacgagaatgtgcaaacccagaagctgaattaactgcatcatgcttaacatctgcttaggagcagaaccgggattggaaggtgctgaagttccttaatttcttttcccagttctctgtcacagagaagatgctaagccattggaagtatgcttatgaacaagaaacctaaaataattcacactgaaaaagtgagacagtatgtaaaataatgagaatttttttttttttttgagacagaatcttgctctgttgcccaggctggagtgcagtggcgtgatctcagctcactgcaacctccacctcctgggttcaagcagttctcctgcctcagcctcccaagtatctggtatcacaggcacacgccaccacacttggccaatttttctatttttaatacagggtttcaccacgttggccaggctggtctcaaactcctgacctcaagtgatctgcctgcctgggccttccaaagtgctgggataacaggtgtgaaccgccacacctggccacaatttccttatgaattattccatcaccaatatctttcaggccagcagtgcttatatctgtgcatgcttagcgccatgaaaaatccattgctgaaggcggggcataatggctcatgcctgtagtctcagcacttttcgaggctgaggtgggtggatcacttgaagtcagaagttcaagaccaacccagccaacatggtgaaactccacgtctactaaaaaaaatacatatctatgtatacaaaaattagctgggtgtagtggcgcatacctgtaatccagcaacttgggaggctgagtcaggaaaatcgcatgaatctgggaggcaaaggctgcagtgagctgagatcatgccagtgcactctagcctgggtgacagagcgagactccatctcaaaaaagaaaaaaaaaacttcattgctggaaaatttcaagcatacctccttttctgcccatttacttctgtatatgaaagagaatacattcagccttccatatccaggagttctacatccacagattcaaccaactttggatcagaagtacttgggaaaaaaataacagtacgataattaaacataatacaaataaaaatataactatttaccttgtatttgatattacaaatagttattattataagatttataatataagatttaagtatatgggaggatatgtataggttgtatgtaaatacaccattttatctaacggacttgagcattttcagataccaacagacagtacactgcagacatggtgatctttgaatcactgggatacggagatgaataagatcaaacccatgtcctcaaagggtttaatctttcctttacacctacctccatttatcaccacttcatttgttcctccaaaaatgtggggtattttgctcttaattactgaaaagtgaactgaaggacctctgctgctcaaacatcacaaaataaaagttgtgtgtttcaatgttttgtgttgccaaaatctttttaaaatgtacctacatggtgttttattctagaagttcagttatattcagtatattctgctttacagaatgctgcaagaagatcctgttttgtttcagctttataaagaccttgttgtgagtcaagtgatcagtgctgaggaattctgggccaatcgtttaaatgtgaatgcaacagatagttcttccacatccaatcataagcaggatgttggcatttctgctgcatttctggtatgtgagccttctagatttctgaagaaaataaaaattcaaaccccaatatgtgtcttaagaccattattccttttgtaaaacttagcatttccttaaaggaaagtaatggaaaattgagtatccatggtattcttcactattattgaactattattattatgtttgtttgtttgtttgtttttaaaagacagggtctcactctgtcacccagactggagtgcagtggcacagtgatagctccctgcagcctcaaactcctgggcttaagcgatcctcctgcttcagcctctcaagtagctgggactagaggtgtgcaccaccttgcctggctaaattttcttatttttatagggcggggggcagctctttttgtatttcccaggctggtctcaaatccctggcctcaagagttcctcccatcttagcctcccaaagctctgggattacaagtatgagctatcacactcagccctcttccaaaatgtttttaaaatacatataattttttttaaatttatatttctttttaccagttatgttttcttggcctttggacttgaccctagcatgctggtagtcaaatggaatttgaaaatgactctttcagagtttggactaatacttactttttcaaatattttcaaatgtagggctttctgctgcctttttaaacctttgccatattttacttacaatacaaggttaaatgtatcatgaccatattatagaaaatgtaagatttgtaaactatattagaacaattgggaataccttatctgtggaattatggaatggaattcagtcagttggtattctagtggaaccagaatagtattaacacattcaacaaaattttgaatactatttgtatgtttggtatcttttttggatgtttattagtgaagtgaattaataaggcctttcccaaagaagtcagtcagttaatgttaatttaattatttactaaccaaggtttgtagtgatttttatgactatacaagttttatcttaaagctccactgcctctctgccttcatacttaaacatgcctatttgaccatattagacttccaaaggagcagattttataggtcacttaagaccgtgagaaaccagtcaggcttttttgagtcctgcctctgtgcaaaaagtgaaggtgagggactttctctgtctatgcagttagttcagaaatttttttttccacctttgtccagtgtccactgggacctgagccatctttccctgatgctctaacgtgtatgtgtgtatgggctttgttttaggctgatgtccggccccaaactgatggctgtaacggtctaagatataatttaacttctgatatcattgagtccatatttaggacctatccagcaggtaagaagaatcagttctttcagatggttaaaatatatggatatattctatagtatatcagtgaaaaacaaaaagcttcagattcctgatcaagtgcaataaattatgtaaagtactttttacccagtgcctgacatatggtagatactaggggctcagtaaataatgtgttgtcatcagttcactaatatgactgccattcgagtctgtctgtactactaactcagatcattcttcattctgcatccagagtgaccttcctaacccacaaattacttcccgtgcagatgccatcctaaaagtatagattccttgaccccagcctcagtgatttattatgtgtagacaaggatgagagccagtgtgtcagtcattcttctgactaagcagtactctcttaagctgtattctgttctcgcttccctcttccccactcttacccctttagtcccttaggaatctctctctcaggactcagctcaagcatcacctccttgccacctctatgaaatcctggccagtcccagtggctcacgcctgtaatcccaacacttcaggaggctgaggcaagaggatcccttgaagcaaggggttcaagactagcctgggcaacaaaacaagaccctatctctttttttttttttaattgagacagagtcttgctctgtcaaccaggctggagtgcagtggcgcgatcttggctcactgcaacctccgcctcccaggctcaagtgattctactgcctccgcctcccaagtagctgggactacaggcacgtgccaccacgccaagctactttttgtattttttgtagagatggggtttcaccctgttggccaggctggtcttgaattcctgacctcaagtgatctgcccgcctcagcctcccaaagtgctgagattacaggcttgagccacagcatctggctcttttgtatctttctgatggtaacataattgtgtagtgtttattatgtgccagacgcttttctaagttctttttctatagtaactgatttaatcatcacgtaaacctatgaagtagaggtactgttatgaccctcattttacagatgaggaaaccagggtgcagaaagattaagtaatttgctcagggtcacacagatagaaagtggcagacctggaattttaaactcagagctcagcaaacaatgctgttgaactctatgcttgctagtgtgtaagccgctggagtgctgagctgacagtccagtggatattgagatcattattaccccacaagctaacacagtgccttggattgagagtgcacatatataaatgagcaaacaagcagactcagctctgactcctgagattcttggtatttctactaaaacttcaaaaccttattcttttggtgcaaataaggttttgtttgtaatttgtaagatttatagaggtcatacctcacctaatctctcaagttacccttcatatttataattagattataacttatagtatgtagagttgagagctttatggtctagattttgctatttgtatttcagttacctaatttgagaggttttaaaaatggaaattcagtatataatatttgtgggtttttttccacagtaaaaatgaaatatgcagaaaatgttccccacaacatgacagagaaggaattctggacacgttttttccagtcccattattttcacagggatcggctgaatacagggtcaaaggatctctttgcagaatgtgccaaaatagatgaaaaaggtaactgtttatctctgatagacactggtatttaacttgccaccctctagacattataagtgttaatttctgagacagataagacatgctgaactttttattttgttgattttctaggcctaaaaacaatggtttcattaggagtgaaaaacccactactagatttaacagctttggaagataaaccattagatgaggtaagaagcaataaaagaagttttgagagaaaagagtcttttcctagtcttcaacattgtcttaagcgtagtagacctattccacttgtgagaatgtcaaataagcaaaatactgttacttgaagtgatttatcggaagtgctttgaaatagcgttgtttgccattaaaattgcctagaagaaatgaaattcctgtgtgagttgctaaaaccttttaaaaataaatttctagctccctcatccgcagttctctagtaataataaaggcttaatgtgatgagttcagctttatgctctagctaacatttaatctaaagaaatatggataaattaataaataaggaagataacaaacatttgttgattgcttactatctgccaaaccttaagcactctcatgacccttataccatgccaaccccaatgtttcagcaagtaggccatcatgtatgacctacctacctcagcatcatgaccccagacctacagatttatctacttgcagagaaagagatggttcctgttgtgatcaaggataattttatcactgcctctgtcttctaggccagaacttgtcttcctcagttattccctttactctgagttttcattttcttgctcttatttttcttctttttctgtctctttttttttttttttttttttttttttgagaaagagtttcactctgttgcccaggctggagtgcagtggcgcaatcttggctcactgcaacctctgcctcccaagttaaagccattctcctgcctcagcctcccaagtagctggaattacaggcacgtgccaccacacccagttaatttttgtatttttagtagagacagggttttgccacgttggccaggctggtctcaaactccttacctcaggtgatctgcccaccttggcctcccaaagtgctgggattacagtcatgagccaccacgcccagccagtgtattttcaatttatactttgatcatacagtgagtttttcaggacatcaccctttcagaagtgaagaagaatctatacaaacatggccctctttaattatcctgagaaaataaagcttagtggcgcttagacttacaacttagtatgaaaggaagacttttttagtgctttttttttctttaaaataaacatgatggcatattgtacatgtacatttgtaactttatcttctgtttagtatcaatagctgtataaaccatcccatagtttaaaacatagactttaaaaccaaactagctgacttagattctgatatcttctaacatttctaggccctgtttggtttttgttttgttttgttttgttctgttttttgagatgggatctcactctgttgcccaggctggagtacagtggcctgagctcggctcactgcaacctctacctcctgggttcaagcgattctcctgcctcaggctcccgagtagctgagatcacaggcacatgccaccacgccaggctaatttttgtatttttagtacaggcggggtttcatcatgttggccgggctgatcttgaactcctgacctcaggtggtccacccacctcggcctcccaaagtgcagggattacagatgtgagccactgtgcccggcccaagcccagtttttttgtttttgtttttgttttccttagtgaggctaatagtacttgccttataggatttctatgagttaaaagagcctagtgcgtaataagtagtaggtaataggcattattgttgttatctgtatttttagatgcctgcatagtattccattggtatgggtatatcaacatttatataaccaatctttttactacaaatattggttgatgccatttttcatttggtgttccttctttccttctcaatcttctggttatagtaactatcacaggctatgatctatggcctcctgaatgcattctctctattccattgctttactagatatggggaacaggggagggagtaaaaataaaaataaaaacattcttgttacataatgatgaatcctgaataaccatagtctgtctttgactgcagagctctagctgcctacttgacatctcctctcaggtatttcaaagacatctcaacttcacatgtaaaatggaatctttgattcccatcctcataaacgtatctccatgggtattccctctcttagtaaaaagcattacaatttgctcaagccaaaaacctgggagtcggcgagtctccttgattcttcctcttcttttttatgacgggctcactctgttgcccaggctggagtgcagtggcacaatcatggctcactgcaatcttgacctcttgggctcaagcaatctgccttaggctcctgagtagctgggactgtagcacaggctaccacacctggctaattttattttttgtagagacagggtctccctatatttcccaggctggtctgaactcctgggctcaagctatttttccacctcggcctcctaaagtgctgagattacaggcgtgaaccattgcagccagccatgttttcctcctgttatgtccagcattcagtgtatcaacaagcctcgtacaatacacctctcatctgtgggatctacacaaacgcttacaccctttcatgtttacggtatcatcatctttggcctgtttgcttgccttagccttctaacctttatttttgctatcttgtcttttatagtttattctcccctagcagtaataattataatataggccgggcgtggtggctcgtgcctgtgatcgagcactttgggacgccaaggtgggtggatcacctgaggtcaggagtttgagaccagcctggccaacatggtgaaaccccatctccactaaaaatacaaaaattagccgggcctggcggcacatgcctgtaattccagctacccaggaggctgaggcaggagagtcgctggaaccggggaggcagaggctgcagtgagctaagattgcaccactgcactcctgcctgagtgacagagtgagactgtctcaaaaaaaaaaaaaaaaaaaaggattataatataaatcagatcctaataatcccctatgtgaatctcttcattatcttctcattgagcttagaataaaatcaaaactcctacaagactgctagatttggctcctgcatacttctcagttggggccacttctactcattcatgctttagacataatgaccattcacttccatgccacgctttttctacctcagggcctatgcacttaactgatcttctacctgcttgttccctaaccagcttctgcctatctttagatacctgttctaatgtcatttctcgccaggtggggtggctcatgcctttaatcctagcactttgggaggctgaggtgggaggatcgtttgagtccattgtgagaccacatctctaaactttttttttttttaatttaaaaattagctgggcatagtggtatacacttgcagtcccagctactcgggaggctaaggtaggaggatcacttgagcccaggaggtcaaggctgcagtgaactgcgattgcaccactgcactccagcctgggcaacagagcgagaacctgtctcaaaaaaaaataaaaatataaatttaaaaattaaaaattaaaaagttgcgtgcttcagagaggctttctctaaccacccacaaattcagtcacttcatcatgttaccctctgttttattcaatgacattttccactttcaaaaaatattgtgtttaccttgttttacttgataattgcattcacactcctctcagagtgtaatcttcatgaagctgactttgttctgtttattggcctgttcctagcgcatgtcatgtagtaataatcacttagtaattatttgatacattgatgaacagcatatggatctttttttttttttttttgagatggagtcgtgcccttttgcccaggctggagttcagtggcgtgatctcagctcactgcaatctctgcctcccgagttcaagcacttctcctccctcagcttcctgagtaggtgggatcataggcacacaccacgcccagctaatttttgtatttttagtacagggtttcaccacgaccagactggtcttgaattcccaacctcaggtgacccacccacctcagcctcccaaagtggtgggattacaggcgtgagccaccacacccagcacatatgagtttttttttttttgagacggagtcttgctgtcacccaggctagagtgcagtagcaccatctcggctcactgcaggctctgccccctggggttcatgccattctcctgcctcagcctcctgagtagctgggactacaggcgtccgccacctcgcccggctaattttttgtatttttagtacggaaaggatttcaccgtgttagccaggatggcctcgatctcctgacctcatgatccacccgcctcagcctcccaaagtgttgggattacaggcgtaagccaccacgcctggcccatatgagtctcatgatctttctttcacctttttagcctcaccaattcctggaccaccgttattagtgtattgaaccatatacagtctcatgacacaatatgtactacattgctgctttgcttgtgttttgttttatttttaaatagagacaaggtctcactgtgttgccaggctggacttgaactcttcggctcaacagttcttctgcctcaacctcccaaataatcaggaccacagtgcctctttgcctttgtttaagcagtttcctctccctgaaatgttattgtctccgatctacttggcaagcaccagtttatcttatggttctctgtgaacctttttcgaaccctcttctccagtaggattgattagtaattctctccagcccagcttcccactaactagtatttaagctcctatggcatggggtcttaatcaattttgtatctacatggtctagcaagtagcgtgcactcaatacatgttttaaaatataatctcattttattctcttttatcctactttatagagcttggaaaagtttatcttgcctagattaacgttagaaaaagaatttgactctttatctttctgaatccatagtcagtgtttttctcactatattctattctttttatttacttttttttttttttttttttttgagacagtctcactctgtcacccaggctggagtgcagtggtgcaatctcagctcactgccacctctgcctcctgggttcaagtgattctcctgcctcactcagcctccccaacagctgggattacaggtgtgtgccaccatacctggctaatttttgtatttttgatagagatgaggtttcaccatgttggccgggctagttttgaactcctgacctcaggtgactcgcccaccttggcctcccagagtgctgggattacaggtatcctgactctattgcttttatttaacgttttgataactagatccaaattgttctttaaaagagaaatgcagaccacgcacggtggctcacacctgtaatcccagcactttgggaggccaaggtgggcggatcacttgaggtcaggagttcaagaccagtctgaccagcatggtgaaaccccatctctactaaaaatacaaaatattagccgggcgtggtggcaggcgcctgtaatcccagcttctcaggaggctgaggcaagagaatcacttgaatgcaggaggcgaaggttgcactccagcctgagcaacagagcgggactccatctcaaaaacagagagaaattcagtttaagatgtattttgtaatgctaaaacgagttagtgctatttgttaatcttttatgtgcataatgtcacttgtttttaaatgtttgttcataaatatttaatgttcgtgagaagtaataaaagtcccatcatccagcaaattttttcagctaagcgtgtcttataataagaaaagcagaacctttttaaaaaatttttaatctattatttctcacagggctatggcatttcctctgtgccatctgcttccaattctaaatccataaaagagaatagtaatgctgccatcatcaagagatttaaccatcacagtgccatggtcctggcagctggactcagaaaacagttaagtataaatgcagaggtgcagtaactgggcttttcaggatatccagatggagttgtggtgttgttttgcttgtggtttttaacgttaacttttttttcccctttattttaagagaagcacaaaatgaacaaactagtgagcccagcaacatggatggaaattccggagatgcagactgctttcagccagcagtcaaaagggtatgggcaaaaaaatatgaaccatttggggctcaagtttctccaaatactttatgtgactgcaagtactgtatacgcttatttcctgtgactcagttcttctaactaagatgttaagcatttggcttaaagtgtatagcattacaaagagtatttccccagctttggcttgccagccaactttccattgactctagcctgttagccatttttattgttttttgtttgtttgtttgtttgttttcctcacatgtacacatacatacagattgttcttatatgtgattttgttctctgggaataaaatcttcattcaacagaggcaatatgacagaaaaaccgaagtttcatgtatatgatttttcaaagaaagtgaattggccctcatgttaaacctagcatttcagagctgaaagtgtcttctcattaaatattgaagaaatcatttgagggtgtggagaaggatggacagaattagctgcttgtgtatttattcttctcctgcaactttgccacgctattttgtacctcccttcctaattatgataaagctttcttagagagcagtcaggcaatgtgtattaaatgtttaaagctttacacccttagttctacttgtggacatttatttcttaagaaagatgtatactaagatttagatagaaatattcattacagtatcataataaagacagtagcaaggattctgttatctgtgttgcattaatacaatagagattgatgcaactgttcattattttgaaagcattaatgataatattgcatcaaagagttcactgaacagattgtacagtacagttttacacacaaaaaaaatagtttgtgagctttaaaagggccttcaaatgaatatgctaaacggttatctttcaataaagagagtatgggtaagtcttaatttctttcatttatttcagtaatttaatgtttttgttgttgttattgtttgtttttttgagacagagtcttgctctgtcacccaggctggagtgcagtggtgcaatctcagctcactgcaatctcggctcactgcaacgtctgcctcctggattcaagcaattcttctgcctcagcctccggagtagctgggattacaggcgtgcaccaccatacctagctaatttttgtatttttagtagagacggagttttgccatattggccaggctggtgttgaactcctggcctcatgtgatccgcccatctcagcctcccaaagtgctggggttacaggcatgagccactgtgccagcctatttcagtaacttaatgtttttacaggcatgtattacctataaaattaataaagccagtgaggtatttcttttttgaactaaagcaaagctaataataagttatagagaagttagagaagaaatctattaagtgatactttctttgtatactgttgggctgagtacccttgattcttggtggtgaacaagttatcagaaatttcttggccaggagccgtggctcacacctgtagtcccagcactttgggagtccaaggtgggtggatcacttgaggtcagaatttctagatcagcctggccagcatggtgaaaccctgtctctattaaaaatacagaaattagccaggcatggtgacgtgcgcctgtaattccagctacctgggaggctgaggcagcaaaatcacttgaacctggcaggcggagttcgcagtgagctgggatcgcgtcgctgcactccagcctggatgacagagcaagactccatctcaaagaaaaaataaaaaagaaatttatttacttgtgtgaatttttacaatacagatgcttctcgacttaaatggggctacatcccaataaactcataagttgcaaatactgtaaatcaaaaatgcattgaatacacctaatgtatggaacaccatagtttagcctatcctactttaaatgtgttccgaacacttagattagcctgtagttgggcagcattacctactataaagtgtattttctaataaaatgttgaatatctcatgtaactcattgaatactgaaagtgaaaaacaatgtatgggtactcaaaatatggtttctctactgaatgtgaatcactttgacaccatcataaagttgaaaaattccaagtcaaaccattgtaagtcaggggctatcagtattcagtggtaaatgctggctctaactattcttccaagtcagtggttgactgctgtttattctataaagggttacaatttatagattctctcacttgtagaatgagagattcagaattaatagcagacagagtccctaccttgatggagctttcatttaagtgtgaaagtcaggtgacctaacaaggccttggcataagtttaggatttggattgttatgggagcttgggtagggacatgtcataggtaaggcaacagcaggggtagagataagcttgacatatgtcaaaaatcatgaagacatcagtaatccttgaagttggctgaaaggtatagagttgagaaagtagttaaaaaaaaaaaagtcaggctgagtctaggtaaggatgtgtttctctgaggtcagatttgttcctgtaccataaagggactatttagaatcttaaagctggagcaatttaaaacgttaagttttcagattgaggtcagatttgtgacttcatgtgaggtcagatttgttcctgtaccataaagggactatttagaatcttaaagctggagcaatttaaaacgttaagttttcagattgacgttttttgaggtatagttaataacctgaatgttctgattctagtcttggtagtcaataagagttgaccagatgaatttcatagctttgtagaggatgaaatatttcaaggctgatttgcacaaatgtttacatagatcatgtatctttcataagtaatatgtttgtattattacaaggctgtaaaaatttaagcaggttgttaatagcacagggggtaacagattaataaaattaatgaataaaattactaaaagagtccagaagtaaacccaaatacgtggaggaattaagcatatgtatgatacacatgacattttaaaaatcagtgggaaaaggtaaattattttacaaatggtgttagaagcactgattgataattttgttaaaagaaacttagattccctattttactcctaatccaaaataaattctgagtggatctaagattaagcaaaaattaagccggaagctgagcatggtagcatgtgtctgtaatctccgcaatttaggagactgagtttggctggggaggtggtgatatgcgcctagaaaaaaaaaattttttaagccacagatgtataagcaaaaagcgggcaaagaggcggaatttttttttttttttttgatgaagtctcacttgtcgcccaggctggaacgcagtggcgtgatctcagctcactgcaacctctgcctcccgggttcaagcgattctcctgcctcagcctcccaagtagctgggattacaggcacctgccgaggagaggatttttttataattaaaacaaaacaaaacaaaaaaacaccaaactggaagataaagtatttacaacatgtaaaagactgtttccttaatatttaaaagtcttattttttaaaaagtacccaatataaaaatagtggagagcataacagatcattcatttggggaaaaaataataaaatgtaaactttcacctaccagattggcaaaagtaaaaagttcaataatacttcatgtggtcagagtgtaagaaaactagtattcttaagtagttgttgagaaaattggttcagccatttgtaggacagtcatctctaggaagagaagctcatggtgggaagacttcattttttaccctctgtacagttttgttttttcagtcatgtttattgtgtaagagaaagttgtgacaaaataaaaagtactgtgttaataattataggcgaaattacaagagtccattgaatatgaagacttggggaaaaataattctgtaaaaacgattgcactaaacctcaagaagtcagataggtaagtttggtcaatattaagcagaatagctatgtaacaattcagtccaaaatatatcctacaagtatagcactcatgttttaatcagttcgtcaccatcaaagtacaatatccttttctgtttaaaatttaggcttctcaggaagcaaaaatgatcaaacccatgacaataaatgtggatctttctgctgttgctttcttattgcccttatgggaattaaattattttattgaaatctctttacttatcgtttcttgccttgaggggaacttagtactgactgctaaaatgttgcaaagacaaatgttgagcatctttactgtgtgtgattagtaatttcttctgtgctaacctgcaggtattatcatggtccaactccaatccagtcactacagtatgcaacaagtcaggacattattaattcttttcaaagtattagacaagaaatggaagcttatacacccaagttaactcaggtaggtgacttctactgtttgaaggccagaattcccatagttccttcctcagtttatgagcacaagcagattgaaccatacaactaatattttaattgggcttaaagacatagttctgctaaataaattgaaaaaatcaagaggtagcaagaaaaggtgtttggcatattcaagaggcatctgaagataagatgataatgaaaaaaaataagttgatgaattttgtgatttttacttccatatacttttattgggaaaatctcccaggtttccaaattctgtctggacattattctctgaatattctgcatgactcaggcttaaaatatgtaaaacagctcatcattgttctttgtttctcttcgtacttcagttgatcagcaatttgtcagttctgccttcaataatacttcttgattctatcacccttatttaggcaaacctgattgattttccataatgctactgcaagttgtctttctaaaatcacttattttggccgggcacagtggctcacgcctgtaatcccaatactttgggaggccgaggtgggtggatcacgtgaggtcagaagttcgagaccagcctgaccaacatggtgaaacccgtctgtactaaaaatttaaaaattaactgggcgtggtggcacacacctgtaatcccagctactcaagacgctgaggcaggagaatcacttgaacctggaaggcagaggttacagtgagctgacaccgcgccattgcactccagcctgggcgacaagagcgaagctccatctcaaatagatagataaatatttaaatatttaaaaataaaaacatgtattttatcactgcggcttgaaaaccttcactgcctcccttcactgcagtagtctgagtgcctttgtctggcctgcaaaactctttatagtctggccccagcccactactcgagtctcatcttcagcgatagtctccgctactcccttccacacatggccaagggttccagcctaacacactaagctgtccagaatcttttgatcacattatctccttcatgcttcctgtgcttcggcttatgctctttctctttagaattcccttagccctgtttctcccccaaggaactaataattactcaagactcagctccagtttcattgcctctggaaagtaatccttaactagtgcaaagaagaatttgttttttccttttctccgtttttatgagcactgaggcactgagtgtatacctatattacgttatttatcacacatcaagacttacttttttactttttattttgaaatctcagattttacagaaagtgacagaaaaatatgttttccaacccattttgagagaaggttacaggcataatttccctttacccctaaatatttcgatgtatattttcaaaaaactaagacattctcttaaataacagtacaattatagaattagtaagttaacattgatgatgtgttatctagtctatatatcttactacattttcaccagttataccactaatgttctacatagcaaaagaaagcttttcttggtccagcagacaagctgggtttatgagttgtatttatttctcatgtgtttttagtctcctttaaaatggaatgatttgtcaatctttgtcttttcataactttgacattgaaagagtactgggcaattttttgtagaatgaccttaaatttacctaatgtttcctcatgactagattcacattaggcatttttgccagaaactccacagaagtaatgttgtatcctactcagtgtgtcatatcaggaggcaaatgatttgtatatatcctagcttgtgatattaaattttttcacttggttaaaggtagtatttgcctggtttctccaccaaaaagttaactatttttccctttgtaattaatacatatcttgtggagctgtactttgagactatataaataccccatttgtcaccaaattttttatttttattttttaatattattatctttagagacagggtcttgctctgatgcccaggctgtagtgcagtggcacagtcatagctccgttcaacctcagactcctagactcaagcaatcctcctgcctcagccttctgagtagctgggattataggcatgtgtcaccacacaacaaacttacatctggtagtttttttagaatcactgatgattcttgcctggaagagcagttgttaaatgatgattttctaattccatcagcccttctatgtatatcagctgacatgaaaggaagagcattcccttctcctctgtttgttatttatatcagcatggattcatttatgagttaaacactgttgctatctttttttctttgtttctttttgtttttgtttttgtttttgagatggggtctcactctgtcacccaggctgaagtgcagtggcatgatctcggcccactgcaacctccacctccctggctcaagcgatcctcccacctcagccccccaagtagctgaaaccacaggcactcaccaccatgcctggcaaagtttttgtatttttggtagagacagggttttgccatgttgcccaggctggtctttaactcctgagctcaagcaatccactcgcctcggcctcccaaagtgctgagattacaggccgtttttttctttttccttttttttaaaatttttttaatttttctttattttttttttatttttattttgtgagacggagtcttgctctgttgcccaggctggagtgcagtggcatgatccccactcactgcaagctccgcctcccaggttcacgccattctcctgcctcagcctctggagtagctgggactataggcgcccgccaccacgcctggctaatttttttgtatttttagtagcaacggggtttcaccgtgttagccaggatggtctcgatctcctgacctcgtgatccacccgcctcagcctcccaaagtgctgggattacaggcgtgagccaccacgcccagccttttttctttttattaaccaaggtacaacttaacatacagtaaaataaataaataaatttacttatttatttatttatttcgagacagggtctcactttgtcccccaggctggagtgtagtggcacaatctcggctcactgcagccttgacttcccaggttcaagcaatcctctcacctcagccctccaagtaactaagtagctgggactccaggcatgtgtcaccatccctggctaatttttatatttttgtgtgtagacagggtttcaccacgttgcccaggctggtctcgaactcctgagctcaagcgatccacctgcctcagcctcccaaaatgaaatttatctttttaagtctgctattctacaagttttgataaacacatgctgttgtgtagccaccaacaaaatcaagattttaaaaaaccggttctgtcaccccagaaagtctacccatgcccctttacagtcaaacccttcctacccacttcacacaggctctcctgtgtctttctgacaatatccccgtcattcttagcccctccttactgaatggtatagtaagatagatgttccaggcttatcttacatctgccctgtcccaggcgtggaattttctttttagcactgagtggatcaaggtaggaaccaagatctgggaccgggcacagtgactcacacctatagtcccagcactttgggaggccgaggcacgcagatcacttgagagctctagaccaccctggccaacatggcaaaaccccgtctctaccaaaaatacaaaaattaactgggtatggtggtgcgtacctgtagtctcagctactcgggaggctgaggcagaagaattgcttgagcctgggaggcggaggttgcagtgagccgagatcgcaccactgcactccagcctgggcaatagagtgagactctgtctcaaaaaaaaaaaaaaaaaaaaatctgggcactaggtatacattggggtgtcattgtcccttcagcagaaagctagaaaatacatatgtgtacataaatgcacacataaccaacctgggattatttgaccaattctttcaatgtagactatagttgtccagtatctggcccttgggcccgagtagacccacataacttttgtcttgggggtggtggtgtttgtttgatttagaggtgaggtttctgtcacccagactggagtgcagtagcactatcatagcttactgcaaccttgaactcctgggctcaggcgatgctcccacctcagcctcctgagtcactaggattataattgtaagccaccatgcccagctctccccatgtaatttttttacactgtagtcaatctttgtttttttttttttttttttgcagtcagggtcttgctttgttgcccaggctggagtgcagtgacaccatctcagctcactgcagcctcaacttccccaggctcaaatgatcttctcatctcagcctcccaagtagctaggactacaggcatgcaccaccatgcccaactaatttttttgtattttttgtagagacagggtttcaccatattgcccaggctggtatctgacaaaaggaaaataggaataaagtgagctccaatgtccccttcactcatggttgtcccatactgtacttttacactaagttgaaaaaatgttttcatccaatctatacatggatggatttctactcataaaaacttcattggaaaatcttagagatgctaaccctgcacttgctgtttcacaaattatttgttcctccctatagcagtgcctccctacagtacctggcacttgataggcactcatcgaatagataggtcaattttttcctaaatgttgatgttgatacagtggggagtatatttttcccccttttggctatatttattcacttccttgaaaattaaatgacagttaataaatttctgctctttatttttttttcccccactctgttatcaagggtatatgttagcaaagccaggtgcggagtacacacctgtagtctgtcccagctactcaggaggctgagggaggaggattgcttgagcccaggagttcaagttcagcctgggcaacataacaagattttgtttcttagaaaaataaatttaacagaaacaaaggatacaggttaacatgttgttttacctgttttctttccttaaactcaattttaccttcagtggtaagagttctcatattaaattgaattggtacttaagaaagggctttaactaggcaaaaccttgggagttttgaggtccctgtggacttgcctggcatgcctgggagatttgtaggtatcttctttctacacggattgtgtttctgccctcaaggaaaatagttcactttgaccactgtaaatgatgtagtatttaaacaaaaggaaaagcacttcattgtctgctctaaaactaaaatgttaagaaagagaggtggcaaaaaaaaaaaagggaggaaaaccagttttaatgcatcttcatttttttcaggttctctcaagtagtgctgccagtagtaccatcacagcactgtcacctggaggggcacttatgcagggaggaacacagcaagccataaaccgtatgtgccgggccatcttctactactttctgcctaaatcagctttaaaaagcaagctgggaggagtgctgaacttttattggtttttccttggaataatcctgggatttctattttgtagatttgtttttatacattcagattctgaaacacatctagacaagatcttaggtttcagaaccgtcttactattacaaatagtggtacattgctagtttctctaatatcatagtaaaagctcctttcttctcccctacctcttagaataaaggggaaacctgaaagtttctttgaaatcccaagagcttttaaattttatgatctctcagccacaaaattactaacttatctgaaaatagcacatcctggtttggcattgacaaagagtacacattcaaatttattctctgagtggtcatttttttcgagactgtatatgttaaaatagctcttaacctatgggccttgttcttcttttgcagagatggtgccaaatgatattcaatctgaattgaaacacttatatgtagctgttggagaacttctacgacatttctggtcctgctttcctgttaatacgccattcctagaagaaaaggttagaaccagttctgaagacagccagataattgtggtagtgacttacaagaagttttgaaattggaaagttttattgagtcttaccatgtgacagacactgggataactcttttgcatacatcgtttcatgtaaacctcacagcatctttatggagtagctattggtacccattttatagatttggaaactgagatccagacgagttccataactaataatcatacaacttaaaacttgtatctacctccaagccactgtgaatagagacccaaaacaaattacatcaataaagttatttatatttgatacgtttttcagggataacaaaatccaaaataagaactgacaacaaatatagcactagctttttaacactaaaaccgctttaaccaattaaaggacagttgacaaatgaaaaatgtaacattaatagtaatactataaattgctttcataaactatgattaagtaaaagataaagacctcattaagcacaataggcaaacactttacaagcaactcactaaagaatggagtggcctaggaagattaaggggaaatgctcacacttaccagtatgcagataaattacagctacagtaaaagaacattttggccaagcacggtggctcacacctgtaatcccaacactttggcggggctgaggcgggagaattgtttgagcccaggagttggagaccagcctggacaacatagcaagactctgtctccaaaaaatacataaataaattttttaaaagaatatttttttcacctactaatttgcagaagaacaaaaatcttaaaatgatcaatgttgaccaagtagccaagagtcctttcttccactgctagtgtttttttagatgcttttacttcagcattcaaatgaaacttcaaatgaaattcaacatttagaaatttaggaaataattaggaatgcaaatacttagctagagatggtctaccactctctaagatagaggaaatggcctaaatatctaccagaagggggttggttagagaagcatttggtatattcatacgttgaaagacaataattattttattttattttatttattgagtcagggtctcacgctgtcacccaggctggagtgcagtggagtgatctctgctcactgcagccgctaccttctgggctgaggtgattctcccacctcagcctctctagtagctgggactacaggcatgagccactaaaccgggcactttgggaggccaaggcaggcagatcgcttgagctcaggagtttgagaccaacttgggcaacatggcagaactccgtctctacaaaaattatgaaaagtagctcaggtgatcacctgagcctagagaggtcaaagctgcagtgagccatgatgttgccactgcactccagcctgggtgacagaatgagaccctgtctctaaatgaatgaataaatgaatgagtgactatttaaatgagttgggattttttgttgtttttgttttttgagatggagtctcactctgtcggcaggctggagtgcagtggtgtgatctcagttcactgcagcctccacctcctgggttcaaccaattttcctgcctcagcctcctgagtagctgggactacaggcgtgtgccaccacgcccagctaatttttgtatttttagcggagacggggtttcaccatgttagccaggatggtctcaatctcttgtccttgtgttccgcccacctcggcctcccaaagtgctgggattacaggcgtgagccaccacgtctggccaaatgagtatttatgactgaaagatattcacattgaagggttaacaatgtgatataattggtatatttttattttatttttacatttaaaaaaattctacaagaaaagtaactttcatatgtagaagattgtttttctgttggtctctacagcttgagatttctctgtaatttattgtttctcatcttttttaggtagtgaaaatgaaaagtaatttggaacgattccaagttacgaagctctgtccattccaagaaaagattcggagacagtatttaagcacaaatgtaaggcagcaatctgatttttgcctgatcttctttctctttgtagtaaaatgatgaaattgattttgctttcatgtaaatgagtagatacttaattttcttttttttttttttttgaaacggagtctcactctgtcgcccaggctggagtacagtggctccatctcagctcactgcaacctctacctcctgggttcaagcgattctcctgcctcagccttctgagtagctgagattacaagcgcatgctgccacgcccagctaatttttgtattttagtagagacggggtttcaccatgttggccaggctggtctcaaactcgacctcaggtaatcagcccaccttggcctcccaaagtgctaggattacaggcatgagccactgcacccggccaatactttattttctgttgctcaaagtactgttttttaatattgaaatgtgtcatgcattcagaagtatataaaatacatacatattttttaaataataaaataactgtctgtttactcaccaatcaggaaaattagtagaatgttgccataacccatagatattccctgagtgcccctgtccagttgcataccactctctcttcccctccagaggtcatgactaaccaaagcatttgtgataaccatctccatgctttcccttagaaaagttttacaatctggccgggtgcggtggctcatgcctgtaatcccagcacattgagaggccaaggcaggctgatcacttgaggtcaggagttccgagaccagttctggccaacatggcgaaaccctgtctctactaaaaatacaaaaattagcctggcatggtggcgcatgcctgtagtcccagctactcgggaggctgagacaggagaattgcttgaacctgggagacaggggttgcggtgagccgaggtcatgccaccgcactccagcctgggtgacacagtgagactctgtctcaaaaagttttacaatctatgtgtatgttctgaaaaatacatattactaatttattaatttggaaaaactgagtagcaagcacaaacctagcagcgtaaggaaagatagaattgccactactcatagtaagcaaaactgttcctgggttctatttggcatcagcttccctgattgtttacagtggggaaagtcagtggatgaggtattgagaagtgtcactttatgcccagcatttttagcattgtatttaaaacaaggttagagcaaccacatcagatcatttgtatgtgcagttatacaagccctcccagaggtaccttggaaagaatagtacagtcacgtgttgcttaaccacagggatgtgttctaaacaattcattgacagacagttttgttgtatgaacctcacagagtgtacttaaaacctagctatatagcctactatacttctaggctatatggtgtagcctgttgctcctaggctacaaacctgtacagcatagtactgtactaaatactgtaaacagttttaacacaatggtatgtgtgtatctaaacatagaaaagttgcagtaaaaattcagtataaaagataaaaagtggtccacctgtaaagggcatttaccataaatagagcctgcaggactgcaggactagaagttgctctgggtgactcagtgagtgaatgtgaaggcctaggacattactgtacactactgcagagtttactaacactgtacacttagactacattaaatttacaatatagctttttttcttcaataataaattagccttagcttactataacatttttaccttataaacttttaaatatttttaaagtttttcattctttggaataacacttaacctaaaacacccattgtatagctgtacaaaagtattttctttgtattcttattctataagcctttctctctctctttctctctctctctccctctctccgtatagatatatatattttttctttttcttttttttttttttttttttgagatggagtctagttctgtcgcccaggctggagtgcaatggcatgatcacagctcattgcaacctctgcctcctgggttcaagcgattctcccgcctcagcctcccgagtagctgggattacaggcacccaccaccacgcccagctaatttttgtatttttagtagagaccgggtttcactgtgtcggccaggttggtctcgaactcctgacctcgtgatccacccacctcggcctcacaaagtgctgggattacaggcgtgagccaccacgcctggtgccttttttctatttttaattttttttttctttttaaacttttgttaaaaactaagacacaaacacacattagcctaggcctacacagagtcaggatcatcactatcactgtcttccacctccacatcttgtcccactgaaaagtcttcaggggcagtaatgcacatggagctgtcatctcctgtgaaacaataccttcttctggaatacctcctgaaggacctgcgtacggctattttacagttaacttttttatatatataagtaggagtacaccgtaaataatgattttaaaatacagtaaatagataaaccagtaacatattcattatcattatcaagtattaggtcctatacataattgtacatgctatacttttatacagctggctacttaataggttcgtttacaccagcatccctacaaacgagtgaataatgtgctgctgtatgatgttacgacatcactagatgatgggaatttctcagctctattataatctgatgggaccgccatcatatatgcacattatgtggcacatgactctagttacaaatttaagattcagtattcaataagtaggataaataaaaggggagttttacaattgaaagctgaaaaatcatcagcaagatttttcatatttatttcctaaatattctaagtgggttttcttaaaatacaaaacagcattacttataatcagatagaagcttggagtgtcttctcacagcagggcaaggatggcagataggtttcaggtcatgtgccttctcaattgattataactgcttggagtgctgtgttggaaaggatgctgagggccaggcgcggtggcttacacctgtaatcccagtactttgggaggctgaggcgggtggatcacctgaggtcaagagttcgagaccagcctggccaacacagtgaaaccccatctctactaaaaatacaaaaaattagccgggcgttgtggcaagtgcccctaatcccagctactcgggaagttgagacaggagaattgcttgaacctgggaggcggagattgcagtgagctgagatcgtgccattgcatctagcctaggcaacaagagtgaaactccatctcaaaaaaaaaagaaaaggatgctgaggccatgcatagccttgcagaaggatatggtgttcatgtcttccaattgataatatagatactgctgcccatcaaacagaataagtaatttttatagtttccagacagagctaaatattactatcccccataatgataaacaggtatggcagtaagggtaatttttttaactctgtacccctcagacctaaacattgacatgccaaaggaatttaggacttcctgatctccatctccatcctcccagacttggcaaaactttacttctaaacacataaacactgtccacctccaaggaaacatattccagagacttctacctcaaaagtcagtataagccagatgcggtggtatgcacatgtagtcccagctactcaagagactgaggcaggaggatcacttgaaatcaggagtttgagactatagtaaactaaaattgcacctgtgaatagccactgcactccagcctgggcaacgtagtgagaccatgtctcaaaaaaataaaaaagattccatatgatcctgttgacttctagctatgtccatgatgagggcaaaattcttaatctactcaaagatctatagtcctgacccaagacatgacatagcacattgtgtgaagcattgaaaccatttaggttttctgtaatctgctgagttgtattgaactcctgaaatgctggagttggaaaaaccctaaaaatagcaaactgtttcacaaaattatgcagaattaactgcaggagcttttgaaaatcaaagattcttgggtctcatcccaggcctgttgaatcagaatcttcaggagaataaggcatttttccagtgttctgccaagatgtatatacggggctgggcacagcagctcacgcctgtaatcccagcactttgagaggctgaggcaggaagattgcttgagcccaggagttcgagaccagcctgggcagcatagcaagagtccatctccactatttaaaaaagaaaaaaaaaaaaaacctggccgggcatggtggctcaggcctgtaatcccagcactttgggaggctgaggtgggtgaatcacttgaggccaggagttcaagaccagcctggccaacatggtgaaatcccatctctactaaaaatacaaaaattagccaggtgtggtggctcatggttgtaatcctagctactcgggagtctgagacatgagaactgcttggacctgtgaggtggaggctgcagtgagccaaaatcacaccatagcactccagcctgggtgacagagcaagactctgtctcaaaaaataaaataaaataaaataaagtttatactaccatcctggccttagttggctgaccagtattcaaatctagaaaatcacagatatagttcagacccctcgtttgacagaaggaattgaggcctggagcacaattgtgactttcatattgtcctattattggttaatgacaggacagccattacaaccgcagccttttcactgccccctactttctgtctttcctttccacacaaaatgtgtctgacagcaccttctcagagggcttgcacattacctcattgactggggaaatacagaggagctccgaaactacactctgaagtgtgtgccagatttgggttggaaggattaacttcccctgcttttgcccagttgttaagtgtcttgctgtgtttttcagttggtaagtcacatagaagagatgctccagacagcctacaacaagctccacacatggcagtcacggcgtctgatgaagaaaacgtgaggtggccatgatgcttacaggttttgtgagattgagagaactatgacctgcagcaactctggaaacctggcctgacagacaagcagatgacctcacaggagtgataagaaacatctgctccacgccaactcccagagctgatgctattgtacttgcacattggagactgaaaggaaagaagggactaaatgctggggaggtaaattaagacagaaccaaatgagctaagttgcaaatatatatatatacacacacacacatatatgtacatgtgtatgtacatatatattttaaaagactgtttactgcagttgctcaggaactgcttttgattcacattaagctgctttcagaaattaaaaaaacactttttaaagggtgcattgataaaatctgaggttttttggttgtcgtttttttctgtgtacatttttttcctaagtttatggcacagggtagaccttaagtattcctcctccatccttcattcttcaccctccattggatcctcaagttttaatgaattccaattataccttacatcagcaagttaaaaaaagtactttaaaataaagcaaagggagactgttgctcaaccatcaggaaacagttgtcagaagacatcattggttctgtgtttcctacggaaataagaaacgataaatattgcactgaatgtttgtggtttggagtccctgaataataaagagggaatatatttgcagaaagtcgcatagggttttttaatgcagaattttgtcagaagacaatggcgctgcatgtttttctttgagtgcaaatgtacattgctaagatttttttaagatggcatgtgctttgaaaagaagatattgcatttttaagagtttaaaaatcttatgagtgagaaatattaaaaaaatcttattttcacctctttagaagaaataaaagatgtttctcctatctccttttctctagtatttgactgttactgtccttggcgaatcgataatcattgcatagtgactgaaaagcctaagtgcaaaaaaaaaaaaaaaagatgttcttgtttctgaacttcgtgccatattttgttcctgatgggatcaacttaatgtttaagactttagatgtcttgtattaaaaattacacaaaaaaagtaaaactttttatacttacccttttaactct

SEQ ID NO: 78 - DNA, 74155 bp, Homo Sapiens
ttgtatttttagtagtgacggggtttcaccatgttggccaggctggtctcgaactcctgacctcaggtgatctgcccacctcagcctcccaaagtgttgggattacaggtgtgagccacagcgcccagcctaatttcataagtattgataaattttcatcttacactgaatttacattcagacttaactttcttcttacactaaattaatgaattaacataaatcataaagattctatatttaattataaaaacataaaattatcacatcaatttaattcttataagtttatacatactgcataatgactttgaaaacagtataactcaaaataatagaaaacaaaattaattgaatgaagtactactgaatttcaggtatttctgtgacaacacaaatttaaaatttaataaaatattaccttttcttagcaaaaagtttcttaagtcagattatcctttcatgttttaaatgaagcttcttctaaagaagtccttttattcacagttgcaaatttctttttaacacatacaatgtatactacatgctggaatcaaacacctgaaggagctggaatcttatgaatacagccagggcaacagtgtagagaatcatgaacaaaaacatcacagtccacacagaaaacattttggcacacagcacaaacataaacctgtagtgaaaagaagaaaagtgataaactagtttccaaaagttaattacagcacagctagatgacattcaaggtgtgctttgctcttttatatctctaccaattttttcccactacctactttattacttccaatgtactctatattctcaaatctaaggcaattaattttttccccaaaactatcccttagaaatgagggaatggttttgtttttgagtctttaaagtctattctattacagttcgctctcaatcatttcattcttaggtttaggaaagacatatgagcttcaaaccagcgctacttttgaatgcttagcaagaccacctgattgattcaattaaaaagagaagcataaaaatttaacatcgatttaattattcttagggaatgacctcacaattgcaaacatatttccctttcaagtaaacctttaaaaaaatatgtcaaatgacacagataagacaagcagaaaggaaaaaactacatttgttctttcagcattacatatacgagtacttgcgccttgggataaaatttccagggcagcttcacacacagattcaaaaatcactaaatctcagaagtatttggctttgaataataaaaaaaaaaagaatgaataaataaatttcaaacaacacagacaatgacctattcttaaaaactcaaatgaggccgggtgtagtgactcacacctgtaatcccagcactttgggaggccaaggcgggtggattgcttgagcccaggagttcaagaccagctggtcaacatggtgaaacccagtctctactaaaaatacaaaaattggctgggcatggtggtgcacgcctataatcccagctgcttgggaggctaggcatgagaatcacttgaacttgggaggcagaggttgcagtgagccaagattgcatcactgcactacaacctgggtgacagagcaagagtctgtctcagaaaataaaaccaaaaaactgtcaaatgattcaaaaagtggttccagttaagagtaaactactgatgtcaaagaggtatataaaacttaataaaattactttataaattgtgacagtggaagagcaatacttctaattattattttatataatatatatagttttaaatatgaacatgtaactaaattaaaaattaaagctagacagtgatccatattatttacatctatacaaatttatttattaaagttggccctcttcaaaatttaaaaaagtattttctcattggcataatggaagaatcacctattatctgtggccaccttaaacaatttcaatgtgttatcacacagcttaaagtataatatgaagaaaatattttaaatactttcagactaaatgcagtttagcttgaaagctaaagacaaattacatgttttacaagggtgtaccaaagtagacaaaacaatcaaagaatttaaaaaaagaggaaaaaaattaaaaaatttttaataaaaagttttaaaaagatgaattacaaaatactttatagcaaaaattagaatgcagaataacaaaactactatttaaactattttgttcctattttaccttcacctattgtcattatctttacaagaaataaactgatatgagcctggtctttaacaacctgttgaaaacttatagtaccattgatttcaatatttcttgtacattacttaatatttagaaagccaaagaacttacatgttggtctttcaattccccctgacatccataacaaaatctgaaaaaaaagtttaacaatgttttttcttagaatttactcattaaaatagttcaacaaaatctcactaactagaatcctttaattaatatgtacttgtctttacacatgactttcaggaaaaagagttaagaataccaataggccaggcacagtggctcacgcctataatcccagcactttgggaggccgaggcgggtggatcacctcaggtcaggagttcgtgaccagcctggccaacatggcgaaaccccatctctactaaaaatacaaaaattagctgggcatgatggcaggcgcctataatcccagctactcaggaggctgacgcaggagaatcgcttgaacccaggacacggaggttgcagtgagccgagatggtgtcattgcactccacactgagcaacgggagcaaaactctgactcacaaaaaaaaaaaaaaaaaaaaaaaagaatagcaataattaaaaaaaaaattccacagtatatacaaggtcatctgacagcccaaaatttagtttttattttcattaaggttaactgtgagcatgctttatttttctttgttttcgagtcagggtcttgctttgtctcaaaggctggagtgctgaggtgctatcacggctcactgcagcctcaacctcctgggctcaagtgatcctcctgcctcagcctcctgagtagctgggactacaggcatgtatctccatgcctggctaattttttattgaggcagggtctcgctatattgcccaggctggtctcgaatgcctgggctcaagcaatcctcctatcttggcttcccaacgtgttaggattacaggcatgagccaccatgcccagccagaagcactttctaacgtttgtttgatagtcacttactctaataagtgctactttgtgattcttcacagtttttggctatgaatctccaactatgaaagaagagaatttaattatctttcaatcatcttgaacccagtaatgcataaatatttaactagtgtcattctcaattctttctacatagtgaagtcttccttttggatagaacaataatcaatgtttagtttactatgcctataaaaatattctcagctaagccataagttttcccctatttaaaacattttttttttcctggaaatactgtgttgctattcccaaggttagtttcctatataattgacactaattcaggcccaatcttctccggaatagtctaactgtcctctcgatatgttcaaatacatcaggagttctgcagttttcatccccttggtgatctctctcctggagcatcctgactgtctccaaactggacggttccccatatgtgacacacaggtatcattctggaatttctccttaccatcatcctaggccgttcttcagcctgttttgaattagatacatattactagatcccatgtcattctccttctcagttcctttgaatcacctacctcttccagaccttccccagaaaaatctctttttgagaccttacaagtctgaaaatgtctttattctacctacacttaactgatagtttggctgggtatctaagttggtaacaattttcaccacaaactttgaaggtgactgctccctctctgcatccggtgttgctaatgagaagccaaacaattttaattccagatcctttgtgtgtgacctagtttttcctctctggaaatgtttagggttaatggtttattgtgtattctgaaatttcacaattatggggtctgccttccttcaatacgttaggcacttggcagtccctttcttttatcttcgttgcagagatgaggtcttgctgtgtgacccaggctggcctggaactcctggcctccagtgatcccccagtctcagcctcccaaagtgcaaggattagagctatgagccacccttcccagccaacaggccctttcaatctagaaagttctgtccttcaatataaaatttctttgaactatgtctttgatgattttctatcctactttttttctttttttctcgtatcattctcatattggaccttctggataattccaccagtgaatattcttatctttactctcctatttgaacctctttattttactccttttattgtactttctggaatatttcttcaactctatcttctatagtactgggtttttcatttttactacatttaacctcaaccataagcaaataaataccaagctaaaacaatgagacttttttctttttcttttgcctgtgagttttggccaatataaaaaagtttcataatacctaatgttggctaaatgtgggaaaacaataaatgaaacttctttgaagaacaactttacaatatctatcaaaattcacaaaacatgtaaaactcttgactcagtaattttacctctaggaatttaccatgcatttatacttgtacaaatgttcaaaaatatagatataagcattatttgttaatagcaaaaaaagaaaatcttaaatatccaacaggaagcaattgattatataaaccataattatacctgaaatatgcaacaatttcaaaaacaacattgatctagatatggtgatattgaatgacttctaaatgatttaagtgtgaaaagcaagatggatacataattgtttttggctagccagtaagtgtttaatgtgattcctaaatcctggatgttctttttttttttgatggagtttcgctcttgtcgcccagctggagtgcaatggtgtgatcttggctcactgcaacctccacctcccaggttcaagggattctcctgcctcagcctcctgagtagctggggattacaggcacctcccaccacacccggctaatttttatattgttagtagagacggtgtttcaccatgttgaccaggctggtctcgaactgctgacctcaggtgacccacctgcctcggtctcccaaagtgctgggattacaggcgtcagccaccgtgccagccgatcctagatgttcttaaaagtagtaaatctttattttctgaaaactattctctaaaggattgactacctctatttcagaccttatttgttgtatttcacacaaatagcattcgtaaaaatacttaaagattttagataaattatgttatgccagatttttttttttttgagacgaagtttcgctcttgttacccaggctggagtgcagtggtgcgatcttggctcaccgcaacctctgcctctcgagttcaagcgattctcctgcctcagcctcccgagtagctgggattacaggtatgcaccaccacactaggctaattttgtatttttagtagagatggggtttctccatgtcattcaggctggtgttgaactcctgacctcaggtgatctgcctgccttggcctccaaaagtgctgggattacaggtatgagccaccatgtccagctttttttttcttttttaagagacagtgtctcactatgttgccccagctagtcttcaactcctggcctcaagtgatcctcccacctcagcctcccaaagtgctgaatgagcctcttattttcagtagtgtgctaggactggattgtactggatcaaaaggatatattgttaaatatgtattcaagaaagctggttgttaattgtagctaaaaattggccatggtgggagtattcaaaccatggaaatcagcaaatactaccaatcagggctttttttcttttccttctggaaaactgatttagtagtacaatcatcacccctatttatacataggtgggtttagtgaaattatttggtttctggagattcagatctatttagcaacgagtcatttcaatcataactatggcattctttatctcatcttccatattagaagtactcttgtccaagttaatcagattattttttaaggtagtaacaatctattcaaacattagcttaccacttataacagatataaattagtccaaactgaaatacctttctccattatattcttctaggggaatttcttgaaaagcatccaaaggaaacaaatgatggtaagaccgtgccaagtggggagcagacaccaaagtaagacctaacacattaagcagagagacatgttgagtagtccaaacctcatgaagacaacggctgaaaagccaaaagatgtaacttcagcagaatatgttcagtttcttttaggatggcagttattaattttacctgtggctataacagaagattgtaggatggagtcttagttctgtcactaagtgtgtaaccaacctgtctcggtctatttgcttacttatattataaatgaaataaaattcgacaattctattagtttaattcttcattcttatatatatttactttataaaggtaagagatggaaaaatgtctactacatctactgcactgcctttaaagaatatacttttttcagaaagaggatcaggaaactagaatgctacatttatacgtggaagtggagtactgggcactcaatttaaaaagtaatctatttttctttgcacagattaaatccagaaacataggaataacttaacatttacattaattttagcagcaatacagattaagaagtcattcaagatttactgaataatgaatagttgttttcttaccacagattttacactcaacaggtagctcacagtactttgcccgacactgtgggcagaaatagcctcctaatgtaagccctggctcagtattgccatccaaatgcctgtagggggaaaaagggtaatatataatgatctgaaaagttagagcgggaaagcatgctatcttgaccttaaaatcttgacactatttaaaaatctatttaaaagtctgtatttttggccgggcgcagaggctcacacctgtaatcccagcactttgggaggccaaggcgggtggatcacctgaggtcaggagttcaagaccagcctggccaacacggtgaagccccatctctactaaaaaatacaaaaattagccaggcgcctgtaatcccagctacttgggaggctgaagtagaattgcttgaacccaggaggcagaggttgcagtgagctgagattgcaccactgcactccagcccgggtgccaagagtgaaactccatctcaaaaaaaaaacaaaagaagtctatatttaaaaaaaaaatttataactttttgtagagatgggggtctctcactatattgctggtcttgaattcctagcctcaagtgatccacctgccttagcttcccaaagtgctgggattataggtgtgagccaccatgcctggtctaaaagtctattttaaaatctgtgagtatgtcttataactcaattatgctacattcatttttttccccctcttcatttttttttttttttttttgagacggattctcactctgttgcccaagctggagtgcagtggcacaatctcaactcactacaatctccgcctcccaggttcaagcaattctcgtgccttggcttcctgagtagctgggattacaggcacgtgctaccacacccagctaatttttgtatttttagtagagatggggtttcatcatgttggccaggctggtctcaaactcctggtctcaagtgatctgcctgcctcggcctcccaaagtgctgggattacagatgtgagccactacacccagcccttctcttcatttttaaagtctctattactatctttgaattcactaattttttcttctgcagtgtctaatctgctgttaatcccagccaatatatttttcatctaaaacactgtattcttcatcactagaagtttgatttgggtcttttttataccttccatatctcttcttaccattctcatgttctctaacatcctgaacatacagagtacatttataattgttgtcctaacatctttgtctactaattcttttttttcttttttgataagagtctcgctctgtcacccaggctgtagtgaaatggcacgatctcagctcgctgcaacctttacctcctgggttcaagtcattcttgtacctcagcctcccaagtagctgggattacaggcgtgtgccaccaggcctggctaatttttgtgtttttagtagagatgggtttcgccatgttggctgtgctgatctcgaactcctgggctcaagtgatctgcccacctaagcctcccaaagtgctagcattacaggcaggagctaccgcacccaaccctttgtctattaattctaccaactgggttatttctgggtatgtttccattctgtgatttttctccattttatgggtcatattttcctttgcatccctggtaatttctgccagggactatgaattttgctttgccagacattgtgaattttgctttgttttgggggctggattttttctttttctttttttttgtattccctcaaatatttaagggtttgttctgaaatatacttcattaacttggaaatagtttaatctcttcaaaatttgcttttaaactttggtaggctggtctagaacagctgttagtctagatttttcttttcttttctttttgcctctggttccagttcttgtgatagaattaatttgatcccattactgtggactctattcaatgcctgtcatgttaagaggtatttccatacagactggtgagaacatgaatgttctctgtgtgagctctggaaactgttctgtctgctgctttccagtgattttttccctgacttccagtagtctcctcacacaaaagggctgatcaacgctcagctgctgactcatgagcaagtctatgcagctccccagagagttctctctgtgcagatctttcctctccagtactctgacctgcaaaattatcgccatctcagcctccttgaaagatgaactttgtttcttcaactcaacaacatctccagcctctgtgtgcagcctggaaattccatccaggcagtaaggtggagtgctcttagggcccatctcatttgtttcctttctttcagggatcattatcagcaaggcttgctgtccaacgtctgaaaaccactgttttatatattttgtctgctttttttgacaggagggtaaatctagtccctgttacagctttttggctggaggcagaaatcttgtttgtgatttttaagaattactctcttaaatttaattttgttttataattatgtaaaatacaaagctctgaagttaaaacaaggtacagtaatattctatataacattttggtcagtgatgaaccacatatatgacagtggtcccataaaataatacattttagttgtaccttttctgtgtttagttaaacaaacactaggtgttacattacaactgcctacattattcagtacacaatatgctgtacaggtgtgcagcctaggagcaataggctatactatataactgcgatgttagtaggctacactatctaggtttgtgtaagtgcactctgtgatgtttgcacaatgatggtatcacctaatgacacatttctcggaatgtatccctatcattaagtgatgcattcagaaaagtctagggtctaaccctttgcttttccctacacactcactgaggtaaacattaaaaaaaaaaatttccccctccaccccttttaagtttttattatttccatactattgtttttattattaacataaacaagtatatacatccacttacatctctactttcttcttaggtgattagcagcatactacaaaattctctcaaactactgttttacttagtaatttatcctgaagatcactccatacaagtatatagagatagtcttcattgcctatcttttgaatttataacttaaaagaaggaattaaaaatgtaaaaacattatcactgatattttcaaggtctttacttacgccatgctgaaagagggttttgcatcctggtcagataaagaagcaatggtgtgctgaggaaatccttcatagaagaaaatgtattactttctttttccaagcaaacagcagaattctaggactaagaacctaaaaatgttcttctcaaaaagccaatgaagttgtacaaaatatcactttactgcctttcagataagcttattatagcatgatgaaactgactaattccaagctacaagaaaaagtagaggaaatgggggaaagacctgtctatatatgacctcagattctgaagttcatatatatatttttcttttttttttttcttgagatggagtcttgttctgtcacccaggctggggtgcagtggcatgatcttggctcactgcatcctccactgcctgggttcaagcgattctcccacctcaccttcccatgtagctgggattacaggcatccgccaccatgcccagctatatattttctaacttaatgattaacactactttttaaagaggttgtaatttttacatcatttctgataaaactgaagatatcatagtacaccattttatctacgtttatgcttttatgtttaaaattttgaaatgctcaaatctttcatgtaatttgttttccatatacaattttaaattctgaaaacatgttcaggaaaagcagaaaccatttttaaaaagatatattacataaaaaatgtaaatgtatctacatatcaaaacaaataaataaaagtaaaggcaaataaccaacaagaaaaatatttgcatcgggtgactgagaagggttaacattcctaaaggactctaataaataaattataaatttaaataactttaaaatgaaataagaaaatatatcagtaaatcaaaaagattagccaaacataagatctaaaatgtattgaatgtttacatcaagcattattctaaacgcatcatctgtattaactcaatccttgaaacacacaataaggttgatagttactgacatcattaaacacatgagaagaccgtggaaaagagaggtcgactggtaatataaaaggccaaaagtagaaaagcattttatttcattaacatttaaaaatatacatattaaataaggagattatttttctattaaaagttatacttttttcaatataaatgtaataaattttcattgtaacatttttgtaaaatagaagaaaataacattttaaaaaagtgatccaaggccgggcacagtggctcaagcctgtaatcccagcactctgggaggccgaggcaggcggatcatgaggtcagaagttcaagacaagcctggccaacatggtgaaaccccgtctctactaaaaatacaaaaattagctgggcatggtggtgcccgcctgtaatcccagctactcgggaggctgaggcaggagaattgcttgaacctgggaagcggaggttgcagtgtgagctgagatcgcaccactgcacttccagcctaggaaatagaatgagactccatctcaaaaaaaaaaagaaaaaaaaaagtgatccaaaaccaataatttcccctcctttgagcaatttggtgtacttccctgcaagctttgtctttgcacagtttgcattacacagctttgatcatccagtacagagaattttgtagcttattttatttttattttattttatttttttgagacagagtcttgctctgtcacccagactggagtgcagtggcgcaatctcagctcatggcaacctccgcttcctgagttcaggcaattctcctgtctcaacctcctgagtagctgggattacagatgtctgccaccatgcccagccattttttggtaatttttagtagagacagggtttcgccatgttggctagggtggtctcaaactcctgacctcaggtgatccgctagcctcggcctcccaaagtgctaggattacaggcatgagccaccacgcccggcctttgtagcttattttaaaaaatttttaatataagtgtttttcttttgttttcttttttgagacagagtctcgctctgtcgcccaggctagagtgcagtggtgtgatctcggctcatttccagctctgcctcccgggttcatgccattctcctgcctcagcctcccgaggagctgggattacaggcgcccgccaccacgcctggctaattttttgtatttttagtagagatggggtttcaccgtgttagccaggatggtctcgatctcctgacctcaagatccgcccacctcggcctcccaaagtgctgggattacaggcgtgagccaccgagcccggcttaatataagtatttttctataaacacagtttatacctttctagccttaaaaataaagaaagccaacagtattttctgggtgacaggactactggtagttttaattttttttttccacttctctgtactttccaaaattgcttcaacaagcatattttttctttaaaaattcttaaatattaaaataacttgtgcaaatgaaaatggagagcctagatatgtattttttaaaaacataaaaacacttacccatacgaataagtgagcattcagaacttgagctagcaggaggaggactaacatgatgtgtgagcaactctttgtaatggctttcatctaaaataacatggtacgtgcctaacaagatgaaaagggaaaaaaaaacaccttcatagacataacgaactgtacgttctatgtaattctgtaaaagttgtatcatctgaaaatgtacatttttaaaataatgattttagctaaattatcacttttaaaaccttatttaagtaatatatctaaatcaacttctctaggaataactataattacaattgattattattactattattattattttaacatataaatagagacaggtctcactatgttaaccagactgatctcaaacttctggcctcaagtgattctcctgccttggcctaccaaaatgttgagattacaggcatgagctatcatgcctggcctgtaattacaatttaattaaagacaagttataaaatctttataaagaattacatacagtaaaatttccagctttccaagagttataatacctcctctaaatactgacataagtactgaaaactctttgcatttggagatgatttcttatggaatcaatgatatatttaagatgactgcccatattttagactactttaagtttagtagctcagaacagattaaaacatcctaatttaattaataaattatttcctacacagtaattataagcaaatattaaataaattatatatataccaccagtttcacgagcaagtacagtgcaaacgcgaacttctgcagacaatccaataacagatactctaattttagctgcctttagggtcttcataaaatccaagtagatagatagttttaggaaagaagaaaaacatttaagatttaatgtatttgaaaaataaagaatgctctgaaaactagtaataaattcaatacatctaccacaaagatgaatcacacatacaaaaatacatatatatataaatcaatttgctacagaattctctttacagttataactttggttttgattttttggtctaccttgattagatcataaatattagatggatcgcaagttgtaaggctgctaaagatgattagtacttctcgacttgtatgtccaggcatgtgtcttaaaagaaagataaaatacactccaattaggtacaacaaattatactaccaaaaaatttacccagaaagaacagtaaacataggattacacatttagactatagaatatctcatttgtttcaacaatgcaaagaaaggttgtgagtatattttaaacactttaatgcaaatttttctaaaatgagctatgcacttcaaaaaattgttaattgattcatttaatatttaccaagtactctcaagttctgggggtagagtgataaacaagactgacaatgttcccgacatcattaagcttacattctagtaggtttgtttcatacaaagtctagagtatacaataaaaaatacaacaatatatggataaactttaaactaaaatgtggcaatatcatatggatcagctttaaagtgcagagatgtggcttcaaaacagtaacacacacttctttctcaaagactatagtagtcccctcttatctgcagaggatacattccaagacccccagtggatacctgaaatcaaggatagtactgaaccctatatatacagtcgttcttcggtatccttgggggattgatttcaggccctcctatggataccaaaatctgcagatgttcaagtcccagatacaaaagggcgtagtatttgcatataacctatgtacatcctcccatatattttaagtcatctctagattattgataatacctaatacaatgtatactatgtaagtaattgttatcctctattatttaggggataatggcaagaaaaaatgtctatttgttcagtacaggtacaatttttttccaaaaatttttgatgcgtggttgatcgaattcacagaagcagaacccaggattcagagggctgattataccatgtttttccctatacaggcataccttggagatactgcagggttggattccagaccgcagcaataaagcaaatatcacaataaatatttgcaataaagcaagtcacatgaactttcaggtttcctagtgtatataaaagttctgtttacggccagggatggtgactcacgcctgtattcccagcactttgggaggctgaagcgggcacatcacgaggtcaggagatcgagaccatcctggctaacacggtgaaaccccgtctctactaaaaatacaaaaaaatgagctggacgtggtggcaggagaatggtgtgaacccaggaggcggagcttacagtgagccaagattgcgccactgcactccagcctgggcgacagagcgagactccatctcaaaaaaaaaaaaaagaaagaaaaagaaaagttctgtttacactatactgtagtctagtaagtgtgcaacagcattatatctaaaaaaaaaagtacacacctttatgaaaaatactttattgctaaaaatcgactgaactgtcagtgaataatatctttttgttgaaggagagtcttgccttgatattgatggctgctgactgatcagagtggtgctttctgaagggtgaggtggctatggcaatttcttaaaataagacaaagtagtttgttacatgggtcaactcttcctttcatgaaaggaatgcaaatgctgtttggtagcattttattcatagtagtacctctttcaaaatgggagtcattcctttgaaaccccactgatgctttaccaactaagtttatgggctattctttttttgttttgagactgattcttgctctgacacccaggctggagtgcagtggtgcgatctcggctcactgcaacctctgcctcctgggttcaagcaattctcctgccttagcctccccagtagctgggattacaggcatgcaccaccatgcccagataatttttgtatttttagtgaggacggggtttcaccatgttggccagactagtcttgaactcctgacctcaagtgatccacccgcctcggcctcccaatgtgctgggattacaggcatgagccaccatgcccagccagtgtagatattttgacctctttctatgaatggcatttagaatggtgaattctttccagaaggttttcaatgtactttgctcagatccatctatggcagtcacagccttatgatatgtatttcttaaataatcaagacgtgaaagttcaaagtattcctttatccaagggttgcagaatgagtgctatgttagtagatatgaaaataacattaatcttcttgtacatctcaattagagctcttgggtgactgggtgcattgtcaatgagcaataatattttgaaataaatcttttttctgagatatatctcaacaatgggcttaaaatattcagtaagcccatgctgtaaacagatgtgctgttatctgggctttgttattccatttgcagagcacagactgaatagatttagaataattcttaaggactctaggattttcagaatggtaacaaacattggtgccaacatcaagtcaccagctgtattagcccctaacaagagaagaagcctatcccatgaagctctgaaaccaggcattcacttcttctagctatgaaaatcctagatggcatcttcttccaacagaaggctgtttcatttacattgaaaatatgaggccaggtgcagtggctcatgcttgtaatcccagcactttgggaggcagaggcggaggactgcttgagcccaggagttcaagaccagctgggcaatgtggcgaaaccctacctctacaacaacaacaacaacaaaaattagctgggtgtggtggcacatgcctgtagtccctgctacttgtggggctgggagaatagcttgagcctgggagtttgaggctgcagtgatccatgattgcaccactgcactctaacctgggtgacagagcgagactctctctcaaaaacaaaaaagaaaaagaaaatttgatatttagtgtagtcaccttcatcaattattttagctagatcttctggataacttgctgcagcttctacatcagcacttgctgcttcctcttgcactttttttttctttattttgagacggagtctcacagtgttgtctgggctaaagtgcaatggcgcgatctcggctcactgcaacctctgcctcctgggttcatgcgattctcctgcctcagcctcccgagtagctgggattataggcgcacaccaccacacctggctaattttttgtatttttagtagagacagggtttcactatgttggccagactggtcttgaactcctgacctcatgatctgcccaccttggcctcccaaagtgctgggatgacaggcgtgagccaccgcgcccagcccctcttacacttttatgttttggagatggcttctttcattaacctcatgagctcagctctgttagcttcaaacttttcttctgcagcttcctcactgctctcagccttcatagaattgaagagaattagagccttgctttggattaggatttgacttaatggactgttgtggctactttaatcttctatctagaccattaaaactttgtctgtatcagcaataaagctgtttcactttcttatcattcatgtgtccactgaagcagcactttgaatttccattatttttttcttattttgagacaggatcttgctctatcatacaagctggagtacagtagcacaatcgtagctcactgcagcctcaaactactgggctcaatcctcctgcctcagcctcctgagaagttagggactacatacaggtgctcgccactgtgcctggctaatttttttttttttttttttttttttttttttttgtagaggtggaggtcttgctatgttaccaggactggtctcaaactcatggcctcaggtgatcctcccatcttagcctcccaaagtgttgcagttacaggtaagagccaccacgcacagcccagcactttcaatttccttcaagaactttacctttgcattcacaatgtgactaagtgtttagcacaagagacctagccttcagccagtcttgcattttgacatgccttcctcactaagctcaatcatttctagcttttgatttaaagtgagacatgcgactcctccttactcttgaacactcagaggccactggagggttattattggtgtaatttgaatatttttgtgtcttaggagatgggggggccgaacagagggagagagactggaaaacagccagttggtggagcactcagaacacacgtaacacttatcaattaagtctgttgtcttatatgggcgcagtttgtggtgccctaaaataattacaatagtaacatcaaagatcactgatcacagatcaccataacagatataacaataatttacaaagcttgaaatattgcaagaactaccaaagtgtgatatagaggcaagaagtgagcacatgctgttaaaaaaaaatggcaccaacagacttgctcaacagagttgccataaactgtcagtttgtaaaaaaaaaagttatctgaaaagtgcaataaaagtgcaacaaaatgaggtgtgccttacatacacacctatgatcaataatgtataaattaggcacaataagagattaacaacaataactaataatggaacatttataacaacatgccggcatcactactcctgcactttgaggtcattattaagtaaaataacacaaacactgcaatagttttgacagtcaataacaacagttaatctgatgacttaggccattacatgggtgggcagcatatactgtgaggatctacaggaccaagggatgattcacgtcctgggcaggacagagagggaaggtgtaggatctcatcacgctacccagaatggcacacaacttaaatcttatgaattatttattactgaagttttcaatttaatattttcagaccaagagtaactaaaactggaaagtgaaactgcagataaggggggattactataatttaacctcacagtaattcagagtcataataatcatgaacattaatattgcataccatttaattaaaatgatagcttgtagatttttaagttgtggtgaccagttttcacctacactaaatagacctttttatgctttctgcagcaattttatcagttagttatagctttcctgcttatattttcattgttatcttctcagctctcactggtagaccctgctactgtacttacctctattacatgtgttgcctccttctcatccacttcaaaactagaaaaatatctattatataaaggtataagtctgagccagggcggactatccagagataaaatatataagctttagggaggctgaggtgggcggatcgcttgaggccaggagttcaagaccagcctggctaacatggtgaaaccccatctgtactaaaaatacaaaaattggctgggcatggtggcacacacctgtaatcccagcactagggaggctgaggcacaagaatcacttgaacccagaggtggaggttgtagtgagctgagatcacgccactgcatgccagcctgggtgacagagcaagactctgtctcgaaaaaaaatatatatatacgtgtgtgtgtgtgtgtgtgtgtgtgtgtgtgtgtgtgtgtatatatataatagatatataagctttaacttatatatgtaagtttaacatatatataagctttatatatatatgtataataaattatatatataatatgtatataaagcttatatatatatataagctttaactataccaagtatttcctttggggtcttagctctattccatatagctgaacttgccatatctattaatttacagatatatgacattggtgcaaaaggaactgtggttttggccattactttcaaaataaattaataaatgttaataaaggtacaaccaacttacaattattatactatattaaatctcattttaataaaatattttttcatcaacatatttttgtactattgatactgccgacagttttaaattatatttttataaaacctttaacaatatcttactaaaatgtaaaataaagattactaaccaacaccacactaaacatcataaataacactacataattcttgtacttaacaattttgttatagctgggtttatgggccccatattaacacatcacttcagcttaactcatttaaaaaacttctaattcaattatacataatgtataatactaactttagagtctgcatagctatgcttagggaattataaagagatggctctccatggcaggtcatatccacagctttcttcaaagacgttatatgttttcttgggtttcctaaaatagaaataagatctttaaataaaatcctatatattaaaaaagtttatgtttctctcaaaatttacatatctatgatgttaaagaacagaatcctttcaatgtatatttctgttggaattttatctgcaatattttgtaaacactctcacttcatactgaaaaacagaatacaaataatctccttatagactagcatacatattttaaaataatgctaacctagagtgcatttttttactcttaatatttccatatttcatcatttttaagaccaatacattttcacatttaacatctctgaaatcagcatgtgtttaataatcactggtagccagcagcacttgtaacatagtctttgcctgttcatatgtgaacctacaaataggtcttcatatgttgttgcttcaattgcattatgtacattgtcctcttcatggtgagtttaactgccatttaaaatgtttttaaggccaggcgcggtggctcacgcctgtaatcccagcactctgggagaccacggcaggcagataacctgaggtcaggagtttaagacacacctggtcaacatggtgtaaatcccatctgtagtaaaaatgcaaaaattagctgggtatggtggcatacacctgtaatcccagccactagggaggctgaggcacaagaatcacttaaacccagaaggtggaggttgcagtgagctgagattgcaccactgcactccagcctgggcaacaacagcgaaactccatctcaaaaaacaaacaataaaatgtttttagaaatgttgttaatacaaaaggctatatttttatgtagaaaggtgtggaacacagcagtgaggcataaatttattataatgaatcaaatattgatggaagaatgcatgcaattccgtatttttcttgagggaagaaatcaagaactttacaagacctaagaaacgaatattcccacaaacagacgaagctgtgttatcttaccaaatagcatctgaaaagattgtctatcttatgctaagcaattcaaatgaaggggggagaagctgccaaatccttttttttctttttaatataatatttttttatattatttatatttagattatatatatatctgttgccaggctggagtgcaatggggcaattttggctcaatgcaacttccacctcccaggctcaaaccatcctcccacctcaacctcccaagtagctgggactacaagtgcccagcaccacacttggctaaatttttttgtatatttttggtagagacagggtttcaccatgttgtccaggctagtcctgaactcctggattcaagcaatcctcccgcctcagcctctcaaagtgctgggagtacaggtgtaagtcaccacgcctggcccccaaatttgagatgtctgtacatgtcaaattaccaagaagctagtatagccaactcatatatcatttgatactgtgtcaaagtttaactactaggacttttccttcttaatggcttataaaagtatcttgtaattgatggaatctgagtttcaatgaaatatagtattccgtaaacattttccatttcagcactgtcttcgtatcaatcaataacctaagtatcattaaattgattttgtcataaaatataatccatcaaagcatactattaaacatttaatttttaatctgtcactattatacataatgttacaaagagtatctttgtagagtgatcattctccttccataacattccctaaatataatttcaggaacaatttttatgcttttctaaaaaatattgaactaatttgtaagactatcagcactataaataacagtttctctgtggttccacaagcaacatattgctttggaaacttaattttgctcatttaaaatatattaaaaaataaaatgttatgtaattgggtggagtttttttggattactagtttccctgatttaatttctgggtttcttctgtgtgaatcatgtcttctttgtctattcatcaacttggagctcccttgagtttttactcatctgagtaagttttaaaatattaaccatttgtaatatttaatatttactgcaagtattttagattcataaattttagagatgaaaagtacctcgctaagcagtccaaatccctcacttcataagtgagaaaattaatctaaacaagtgaaatgacttgcccaaagacatatgcctgcttaactgcaggaccagcagcacccaaacctagatctcctggctctctatccacttctcttcctaccctacaaaattatttttaatctcccactgtgttatgggtataggaaaaaagcatactacaatagtgtcagtgtggtttacagcagtggtctgattggagggaaaaaaaggtggcttcaagaggcctgtcagaatctccagaatatttttcatctttatacatgacttcactaacatccatagaaaactgctggggccgggcatggtggctgatgcctgtaatcccaacactttgggaggctgaggtgggtagatcacctgaggtcaggagttcgagatcagcctggccagcatggtgaaatcctgtctctactaaaaataaaattagccaggtgtggcagcgcacacctgtaatcccagctactcgggagggggaggcaggagaatcacttgaacccgggaggcggaggttgcagtgagccaagacagcaccgcctgggcgacagagtgagagactccttctcaaaaaaaaaaaaaaaaaagaagtaatagaaaactgctggtaactcggggtgggtaaagtgagaggaaaatattgaccttatattcctaccttggaggaaccatccttcttccactatataataatcctgcttagttcatgtggtgctgaccctacttctatcctgctctgggcatcagcaggcaatcgaagcgtacaaacaaaatacttcatttcctggccactttgttcatggatgggcagatcgtaactcaggccaatcagagttctccctagacgtgtgctgaagctataggctacgggtacaatgtagactgggacaattaagagacatcttttcaacttccagaaaatctatcagagaatgaagccagacaaagccaggaccccaacatatgcagcaactatatatggaattggcccacctttgaacatagcccaaaattttccttctgcacttaagctagtgtgacattcttttggttactcacaactgagtttcttgaatcactccaggccaatgtacatttcactcctcactgcatttaatgaaaaactactaatgaagaaagtatgtcatttcccttatgtgtgccggcaaggataaaaggttgaaaaccagatttaagggagagtgtatttcacagaaaataaaatagaatcagtgatgcaaatttgtaacagcatatataccaaagcaaataaaaaatgccattactacgttttgaaactaaaattcagttaggtatgtcatggaagcagaaaaattgattcattagcaatagctacagtttaatttttatactttttcccttttaaattagatgcttaactttataagaatttaattttaagattaactggattttataaatgattacaataactgtattttaatattttcaggataaggccggatgcggtggctcaagcctgtaatcccagcactttgagaggctgaggcgggctgatcacaaggtcaagagattgagaccatactggccaacatggtgaaaccccgtatctactaaaatacaaaaaattagcagggcgtggtggcgggcatctgtagttccagctactcaggaggctgaggcagggaatcgcttgaacccgtgaggcggactttgcagtgatccgaaattgtgccactgcactctagcctggcgacagagcaagactccatctccaaaaaaaaaaaaaaaaaaaaggaaagaaaaaaaatttcaggataagcacatatagattttaaataaaaacatttatattcaatgtagtattatttaccactacgcagaactcaatttagaatagttaaccttgtatcctaagaatataatggtgggggagatgttattaaattgtttcacctagagaagacagaggaaccacccttcacgttacttattaagcagccatataaacagggctacgaggttgggtaaataaagcaaagtccttgagtcatgtaaaggtaattttatgcatacctgaaagttcagtcaatttttcagctcttttactcttagttacaattattccaatcttgaaataaaaacaaaaattattattaatataacaagttatttcctcccattaagaatatatataactattcctgtagatgatattggagcagaaaaaaaaataatttatatagctaaaataaactagtaattacaaaagaaagaagcaacaggtgagaaactttttctcatgctgtttttggcaaataaatttagctatgagttcacattacgtttaacttttagagttattacgcttttcatttttaagtataccagaaactggttaaacaatttgggtaattcacaaaatacatgtccaatttttaaaaataaattacatttggaagcaaaataggaatctaattctgaattctatcacttagatacgtacctgactaataggattttgatcaaaatattcctctacaaagtattccaacaactgtttaaacaaaaaaagacatactagataaaggcaaaataacaatcataaagaacacgtccaactgatgtttgtgaaacctgttaatcaagcatcacttctcatgacttttaaacttacagattttcaaaaactgttaagtaataaaaatattaaacagtaaaaacgttaatttgaaatggtgggtgatgagataggtttgagctaggttttaaaagatggaaccatttggatgtgtcagaagaaatttcaatgaggaaaagatccaatgaagagagatgggagaacgagcagaattgagaataggttttgataaattaggaatacgaacatatttgtaatctgaggagacagagttaagtaaggcaaaggagaatgaagattcaagaaagaaaagggataactgataaaccaagatcctgatgtggggtgggaggatagaaattaaaaacacaaataattagctatgttggtttaaaatttccctaaataacctggcagtacttctacttagctatcattagcattaactaaaaatacaaggcaaaaaataaaaaatattgcattctttaaaaatatcctttagaatccagtgttcttccccacttttttagtaaaagtttaagtgattttggtacaaatttaaatgatttagtataaacttaaattttacctttaaagtacacgtcagtctattaggctttaaatcttggtcttccattgttcttgatccatctactaccacataaaggtggcgcatctatcggaaaaaagaaagggccaatttcaagtacttgttttgttttgtagaaactgggtctcgttctgttgcccaggttggtctcaaactcctgggctcaagcaatcctcctgccttggcctcccaaagtgctgggattataggcatgagccactgtgcccagcctcaagtgccattttgactagtaaaaatggcatttaataattacatattctatgcacgtatttttaacatattcttttaaaaactttgttgttttgctattgttttttctagcaagacagaatgtttctctaacctaaactagttctgtactagtaaaagaaaaaataatgacataccattccaagtcgaacttgtccatggtgctcaaatactctgttaaaattatacaaacattttaatgtaattccatatactatccccccccacaaaaaaaatacaactttccaattgacctcctttgtttttctttttttctaattctgagtaagaatgtcataacgtgcatttttagtggagtaaataattaacttatggaatacaatacacacaattataggtattgtagacagtctctaaagaccatttcctgctggggcaagggtaggtggctagttctttccccatagtcagaaggcaataggtcagttaccctgaaacacagctaaaatgaagtactgaggagtatttatagatagaaaggcttaaaatgaatatattttacctttttaagatacataggaaggttacatacctttttctctttgccttgaatagaatgtcttctattgtagctttaagtgatccagattcatcttctttaagaatctccctataagtcataattatttgtttgaaaagacaagctaaaatgattactagcccaaatgaaatgaaaatatatgtccacacaaagatttgcatgtaagtgttcatggctgcattttcctaacagtcaaaaactgtaaagaacctaaatatccacagactagtgaatggataaacaataatgtggcataaccatagatgggaatactattcagcaataaaaaaggaatgaagtattaatacacactgcatcatggatgagtcttaaaaataagtgaaagccagccacaacagaccaactattatagtcatgcatcgcttactgacagggatacattctgagaaatgcattgttaggcaatttcattattgtgtgaatatcacagggtatacttacacaaacctagatggtatagcctatcccacgcctaggttacaaacctgtacagcacgttactatactgaatatcttaagacaactgtaacacaatggtcagtatttgtatatctaaacatacatagaaaaggtagagtaaaaatacagtattataatattatgggaccattgtcatatatgcagtctgtctttgaccaaaacatcattatgtggcacatgattgtatatgatcacatttttgtgaaatgtccagaaaaggttaaaatttggagacaaaaagtagactaatgattgcccacaggtggaattaaattaagatttaaattaattgtaaatgaatgtgaaggatcttactggagtggttacaatattctaaaactggtttatgataatggctgcacagctcagtaaattattaataaaacatcactgaattgtacattggaaatgggtgaattttaacatatgtaaaatatactttaataaagttgtaaagaaaaaaaaagacattgtctaaaagaaaagacagggcaataaagctctccttaccatgttctttcatagcctccttcccatcgcttagttctttcaggttcttcatccatttttttcaaaactgtattttattattcaataatctgtaaaaaccattagaatgtaagttatctaaagatgtttgttacaaaattcatccaattaaatttgaaaattagacacatatatgaagtaaaaaaaaatggaatgccaggtcatcttattctttgtattttactcaataattgtcttaaaaatcttcatagaactccatttctcatttccaagaaataatatgaacttatacacaaacttggtaccaataaaaataagcgtctttttacgatttgtaaaagaacaaaaatgctttatagatgtgtcacatgacaaactgtagacttgtgaggagtcagtatgggcgtagttgaactattatagctgagtgacatgtgattcattgtactatctctctgtgtatgtctcagttttctcataatcaaaagtttttaaatcacatttattatttataaatgggtaaatgctatagctcataattcaaaaaaaaaggacacaaaattaaacatagttctttgagacatctccaaactgctttccatagtggctgaactaatttacattcctaccaacagtggataagcattcccttttcttcacaaccttgccaacatctgttattttttgactttttaataatatccattctaactggtggtgagatgggtttgtggttttgatttacattgtggttttggtttgcatttctctaatgatcagtgatgttgaacattttttcatatatttattggacacatgtatgtcgatccaacaatcccaatactgggtataaacccaaaggaaaataaaaccattctaccaaaagtacaagagcactcatattaatcacagcactatccaaaatagcaaagacatcaaatcaacttagatgctcataaatggtggactggataaagaaaatgtggtacgtaatatatcatggaatactagcagccaaaaaaacaacgaaaaaaaaacacaatgaaatcctgtcttttgcagcaacatggatacagctggaggccattatcctcattgaattaacacgaacagaggcccaacgcaatggctcacgcctgtaatcctagcacttgggaggccaaggcaagtggatcacctgaggtcaggagtttgaaaccagcctggccaacatggtgaaaccctgtctctactaaaaatagaaaaaaattagccagatgtggtggcgagcacctgtaatcccatctactcaggaggctgaggcaggagaattgcttgaacccggaaggcagagaggttgcagtgagccgagatcgtgccactgcactctggcctaaaaaaaaacagcaacagaaaaccaaagacggcatgttctcatttacgagtggaaactaaacactgagtacacgtggacataacgatgagaacaacagacattggagactattagacagggaaggatgggagagagtgagggttgaaaaactgcctatcaggtactatgtttactaccagggtgacgggatcatttgtataccaaacctcaacaacaagcaatttatccatgtaaccaacatgcacacgtactccgtgaaaataaaagttgaaaacaaaacaaaacaaacaaacacaggccagggccaggtgcagcggctccatccctgtaatccctgcacttttgagaggacaaggtgcggatcacctgaggtcaggagttcgagaccagtcaggccaacatggcaacacccgtctctactaaaaatacataaattagttgggcatggtggcaggtgcctgtaatcccagctactagggaggctgaggcaggagaattccttgaacctggagggcagaagctgcaatgagccaaggtcacgccacttcactccagcctgggtgacagagcaagactccgtctcaaaaaaaaaaaaaaaaaaaaaccaggccaggtatgatggctgacatctgtaattctagcactttgggagactaaggcaggtgatcacttgaggtcaggagtttgaaaattagctaggaggttggtgggagcgggcccctgtaatcccagctactggggaggctgagacaagaggactgcttgaacccaggaggcacggaggctgcagtgagccgagatcaggtcactgcactccagcctgggcaacagaatgagaccctgcctcaaaaaagaaagaaaagaaaggaaagaaagagagagagagaaacgggcacggtggctcatcctgtaatcccagcactttgggaggccgaggccagcagatcatttcaggtcaggagttcaagaccaggctggccaacatagtgaaatgccgtctccactagaaatacaaaaatcagcagggcctagtggtgcacacctgtaatcccagctactcgggaggctgaggcaggagaatcacttgaacctggcaggtagacactggagcgagccaaggttgtgccactgcactccagcctgggtgagagagcgagactctgtcattcattcattcatgcacaaataaatgtcctcatcacacctccatcctccccaatgcaatctccctcccaactccaccacctcgtggctcactgcaacctccacctcccgggttcaagtgattctcctgtctcagcctcccaaggagctgggattgcaggcgcgtgccaccatgcccagctaatttttgtatttttagtacagtcagggttttgccatgttttatatttttgtagagccagggtttcacctgacttgccaggctgatctcaaactcctgacctcaagtgatctgcctgtaaacagaatatttttgtttctttttttgttttaagacggagtttcactcaccacccaggctggagtgcaatggcgcgatctcggctcactgcaacctccgcctccgagttcaagtgatcctcctgcctcagcctcccgagtagctgggattacaagagcccgccaccacacctggctaacttttgtgtttttagtagaaatggggttttgccatggtggccaggctggtctcgaactcctgacctcaggtgacccactcacctcggcctcccaaagtgctgggattacaggcgtgagtcaccacacccagcctcaactgaacattttgctcctccctgttttctgttacgtattgtgaactttaaaaatgaaaaactcgcataacgttctcaacgtttttaaactcaaattcttggcagggcacacagtggctcaaacctgtaatcccagcactttgagaggccaaggcaaaaggattgcttgagttcaggcgctcagatcagcctgggcaataaccttgtctctacaaaacatcaaaaaattagctgggcgaggtggcgagtacttgagtcccagctacttgggaagcaaaagtgggaggatgacttgagcccaggagagtcgaggctactatgttcactactgcactacagactgggtgacagagtgagaccctatctcaaaataaataaaataattacaaatatataataaatattataaatataaaagtaaatagcaactgagagacttttggctgaccatatcaaaggaattcttttttttcttttttttttgagacaagagtcttgctctgtcgcccaagcttggagtgcagtgacgcaatctcggctcactgcaacctccgcctccagggttcaagcgattctactgtctcttctgtctcccgaatagctgagattaaggcacacgccaccacagctaacctttttatttttagtagagacggggtttcaccagcctgttggccaggcctggtctcgaattcctgaccacaactggtccgcccacctcggtcctccaaagtgttgggattacaggcatgagtcaccacgcccggctaaaaggacttcttaattagagctgcctgcaacgggaaatccgactggacaggaggtattaaggtccctaaaactgcagacgttcaatgggaagtctgattgtaaacatgcatgctgtttaaaggattcatgcatcctgaagatggactttgtaaagatctccaatggcctgtcacttcccgtcagtccattttcttcttaaaaatatcagcgaggccaggtgggtggctcacacctgtaatcccagcactgtgggaggccgaggcgggaggatcacggggtcaagaaatcaagaccatcctagccaacatggtgaaaccccgtctctactgaaaatacaaaaattagctgggcgtggtggcacgcgcctgtagttccagctactcgggaggctgaggaaggagaatcgcttgaacccgggaggtggaggttgcagtgagccgagatcgcgccgctgcgctccagcctggcgacagggcgagactccgtctcgaagaaaaaaaaaaatttttaagtgatctgtttcctggaatccaaccccaaacaatccacgttcctcagcataagcctactggtgtgattcccgttacatgagctcggaatgctatctgccaacaaatgagagcaccaaacatcccaatttaagaagcttttcttcacaccttaccaagctatgtgaaactggcaagggtgattactgtccttgtttttcaggtatgggattcaggctcagaggttggtcactttctcaagcgggtcacaaactcgaaccctgaaccatcatttctaaaagtcgcgcttttacttagggagagacggcctgcagcttccctccctactctgcggctccccagacgaaagttaccttcctctgccttcacaagctccttcacatcctccttccctatgagcccaggcagggcaattcaacctccgttccccgccacgaaaacgctcccagccgcctagctagccagacggcctgccccacctctgcgcctcacagacttccacacgcggactcaccggcgccgctagaaggactctcagccggaaactccgcccgacactcctctccgccgctttaggggcgccccggaagtcattccgccgcgccctgcggccacgccgaaacgttccggatgctgcagagtgcagctgccggagcggggcgctcaggtgcagggcatggcctccgctgagttggggcgcggaaagggacggtgttccagctggaattcacagagaaccggaaagagtgatcgccattcgctctcggaaggtcgaaggctctgcagccatcgacctgggttctgaggagctcgatctggtttttctacttctaaaaggttgggatgaaggaccctggccacagaagtaaagccagaattatccttgcttcttgctgtgtatttcaggactcctccattgctcttgctgttcattcaacaaacattgagcatctactttgagcctgatgcatgtctaagcactgaagaaataacaatgaaaaactgtcaaaaatccttgctctcgtggagttttccttctccaaggggagtcagtatgaagaaaaacatatactatatgaaatggtgataatgctgtggagaaaaactaagcactgaaggggaaaagtttgcagtttaaaatagggtggccaggccgggtgcgatggttcacacctgtaatcccaggcatggtgatttgggaggccgagcgggggtggatcatcggagggcaggagttcgagaccagcctggccaacatagtgaattccgtctctactaaaaatacaaaaacattagccgggcgtgctggcaggcgcctgtaatcccagctactcgggaggctgaggcaggagaatcgcttgaatccaggaggcacaggttgcagtgagccaaccttgcactccagcctgggtgacagagacttcatctcaaaaaataaaatagggtggccagaggagtcctcgctgggaagacagttaagccatgacctgaatgaggaagggtgttaaccctactgatacctaggggaaaagctcttcagacaaagagagctgcaagtgcaaaggccctgaggtagaagtgcattggggtctttgacgactgcaggagtgagcaggggatgagtggtggcagctgcaatcagaagggtaaggtggggaggagaggctgtgagcactgttaagaactttgggggaattgtgatggcttggaccagcagctggtgagaagtgactgaattctaaatcttaccaatacactggatgtgtgttatgagaaaagaatcaaggatacctccatagtctttagctgagcaactgaaaggttggggttgcaattattaaaatgttggcggggtgggtaagatcaattcagttttggacaagttgtctgactgccaattaacacaagtggaattactggcatttcccatacttgagaaatggagaggcagtgcacccccagatgagaaaagggttaggaataacacaaaggaactgcagaagctagggcctctttccttccccatcagcatactcatcccctccattgcctttattttattgttaaaaatttttcccatctctgttgtctccctcaaaaatataaacagaaggtatcttgcatagcagtggaaagaacagccctggatttaaaatcaggctctgacacactggctgggtgacctcaagcaagtcacaacccaagtctatgaactaatgtgtaaaatggggttgtctccaccaaccctgcagggcttagtgggaactccataatcagtctcatttcctcccagaagacaggattttaaaagggagaggaggggaaattagtatcgcagtgccaggaagcttccatgcttgcctccctcccacctttgacctcattagaggactcacacacaaattccacacttttccttttgtgcccttccttcctatccacacttttgcttccttccatcttaattgaccatcctatttgcaagacgggatgcattcctctaggacaaacagcctagaggaatcccaagccccaagtttcttgcatatgtttgttatccatcagcctgggaaggctttaaggaaaaccaggaaaaagatagaggactccccaataaatataaagcatatttgcgaagagaggagactgaaacagttttcccaactgtaatatttgctctgtatagattttagacatggatgttaagattcaactaggaatggtactacagcaaaacaaaatatgcataaatccataatctcttggcatgattatgactgacatattctaatcatttacaaagtggtagaataaattatctaacctactcagatgttttttcaacttgtaaaactaaaagacaactataaagaatggataatctgttctttgcccatgagtggccagacacaatcaacagggttaggacattcacaatcagctcagccagtggaatcagatataaaaagcatgcaacttgaaagactgggagaagtgaacctgtctattccaatagacaggctcccttacagggaaactaaatcattccagaaagcctcatctaaaacctctgtaattgacaacagtatctaacaatcgtgatcttgataagtaaactatttgctgtaacctaaagaagcatttgtttatcatgtacaaatatttagaatgccaatcctgcattctctgcctagaattcaaaagaatttacattctaaggctgcacccagcacagatcaatcatatgggattggatgacacatgcacttttaaaaaacacaatttgcttttagaaaacttgttaaagtttcaccttctggctttggaagatgggggtagctaggcatatttacttttagacaaggactgagtcacacattaactaccttcttaactatgagattattacaaatatatttttacaaatacaaaaaactgaagtacagagaggctaagttaatttctccaaggtcccacagcaagtaactgcagaagggcaaagcaaaaataggacaacacatgtaggcaataccaagcagttcttgtggcagcaactggaaaccttttggagacaccattctgcatttcgttgtagtcatacacaaaaccctagttatgtatccatgcttctttctcataatgccaaagtggcactattctaatttactaacaaggttttctaaaaactacccaaattattgtggtgtttttgctcacttcttcccattagaataaatgtagacaataagaaacgcatgagggatgacatagtcctccatcaaatctgtcctttcacacaagagatggcatggtgtagtgtagcagaatcatgagctgccaggaaattatgaattctgattcctccagctgagtctttgaaaaagtccagatgagaaacacttccatcctgatgctgaagcaaggagaatgtccttgtgtgaggaattctcacaacaccaactgaagctaaggtccccggagccatgataaaagcacttttctgccctgattcttctttacacacatgtacccattcaggtctttacagatatttcacaggaagcatttatgttacaagtacttaaaatgcactcgaaattaatataggatactttatttacatcagagtgatctcacattatccaatccattaacaaagtcaacacaggatggaagtatagaatctaacagttgaagagactaagatcctaatcccttgttttgccacttgctagtgtgacaacagccagttaatctatcatatcattagttccttgtctataaaagaagaataagaaatggtcacatgtcaaaagatcgttgtgaggattaaatatcatatatgtacttatgtgtatgtaacttatttactataaatactagttgacttcactttatttcaaaaaatataaagcacatatgacaaaacattaacacatgttatttctgggcggatggtacttatattttatacttttctgtatttaaatttttcaaaataaaataatgatcctatatacttttaatacaaaatcacatatgtagggcatcactttatacgcagggaatctttacaaaatgaactatgtgctatcacaacaaactccttagaacaatagtttataacaaagcagaattccagacaagaactacaggtcagaaatggaagggatgtcggaaatctaatctaaacctctgactttctagactaggaagctgcttgagtggcttttcaaatttacatccagctagttaatgccaacgccaacagaaacaccctgatcctagtttcctaaaacggtatttagtataaatacacatgaaaatttttcttatttttgaaatttcaaagtccaattttataacacaattttacaatgcaaattcttgctgtttcactttctggattcagctgaatagttttgtgaaaatactgacaaacttgccttcacgaactgacttccaagaacaaattgttaaaactttaacagaaaaatcagttaaaggtgctcatcaagagagtccttttcatttggtataaatccaaaactatgaaaataccttttgtattatgtgcatgcagaaaattaagaatttattcaatttgcagaaataaatcagtgatataatggaaacatttaaaattttatctctggaaaataatccaaaatcatctatcaaaaattataggccgggcgcagtggctcacgcctctaatcccagcactttgggaggccgaggtggatggatcacctgaggtcaggagttcgagaccagcctgaccaacgtggagaaaccccatctctactaaaaatacaaaaaaaaattagccaggtgtggtggcgcatgcctgtaatcccagctactcgggaggccgaggcaggagaattgtttgaacctgggaggcggaggttgtggtgagctgagatcgcgacattgcactccagcctgttcaacaagagcaaaactccatctcaaaaaaaaaaaaaaaaaaaaaaaatacacacacacacacacacacttaggccaggcatggtggctcacgcctgtaatcccagcactttgggaggccgaggcaggcagaccacaaggtcaggagttcaagaccaacctggccaatatggtaaaaccccgtctctattaaaaatacaaaaattagccaggcatggtgatgggtacctgtagtctcaactactcgagaggctgaggcaggagaattgcttgaacccgggaggtggaggttgcagtgagccaagatagcgccactgcattccagcctgggtgagagtgagactctgtctcaaaaaaaaaaaaaaattatatacctaaatatctgaaatgcatactaaagttcagtttatagattattctaaaaaaaagtttttagaaaagtctaagctgggatgatcacaatcaacttggtcagcacagtgctatcaagtaattttactaataagaatctgaatttttaaaaaagtgatacaatttaagggcaccatttgaaattatttggtatttcgtggtatagcattctattcccagacatatcagcattcttacagccaaaggaatgggaaacgactaaccagcacagcatccaaaggagtataaacaacaacagatacaactcctgagtgtggttttccattgctgtgtgttaacagcactaataacatcaaacaggttattatggaaagaaaacaccaggtttaataccttataaaatatgtatagaaattgaacattcctgtaagatacagttcaagtcacaattgaattataaatgtaatcagatattctgatataatgaaaagttctagttggtttttaaaaaaaggcatgcaaaaagataaaaagtatttaaaaacacacaaaattctaaccaccgggtttaaactttgatcttaaaaaagtaaatatatatttacaatctttaaatttcacacatttgttacttttacatgatctttattatttaagaaaaacctcttttaaccatttatataacagaaaaaaaatagggaggctggtagatcatcacatatatagtagctaaaatatgaaaggccagggaatttattattaatgaagtcataaaacagacttaaccaaaagtgtgtgctaggaaacaagcagtttcacttcagagacttcattgcaggaacccagtttccttatgtggaaaaaagtgattataaataacagttatctgaaaggtggttgagaggattaaatgagatcacctatgcaaacaaatacatgtaggtatgaagacatcgtctggggtgtgaaagtttagttcacaccagaaccttcctttaaggcttaaaaacctcaaacagtatttcattcttaatacaagaaccaatgtttaaagcataaaatccttaattggagtgttcagcccagttgattatcaaaagcgatttataaaatgcttcaatactgatgatattaaagcaaccaaaactgtgatgctcacagaggtttggcttccggggttatggtccaaagtcatttgccttctgagaagattgcagagatgtcagatacttaatttctcaaacaacttggcatcagccttctatgttttctgtctatcatagtctccaaccatcttcttgatgtgtgacaatttgctgtttaactgcttgcaatgattcttcttacttttgtaatctgcagactaaaaagggagaaaatgaatcacataaattcaacaaaatgaaaacaggtctgctgggaaggcagaattgaacacagaaatggaatatttagtcaagagaattgctgggagtgttaattgaagtaaaatacgcaaggtgcctggcagtatcactaaccacacaggcagctgattctatttgctcagttctgtcttctaacctgggtttttccaaaggataccctcatttctaaaaatctgtaaaatgaccaagaaaacttaccagcctttttgctaacacatcatctaaaactgtaagtaaaacaagagactggtgatctcatttgactggggaaagggaagctgaataggggataagagagatgggaaattttactgtataccctttaaactcttatttcaaatcatgatgcctgtaatttataatttttttttcttattttagaaagggtctcatcctattgcccaggctggagtgaagtggtacaattatagctccctgcagctttgaactcctgggttcaagggatccttttgcctcagtctccctagtagctaggactacaggcatgtaaccacagcacctggataagtaatttacaaaaattttaatataatttttttttaatgttttaagtcaataatgactgtcatgccaagtgttagcaaggatatagggcaacaggagtctgtagtggttggtgggaatgtaaactggtacaagtactttggaaggccatttgacagtatctactaaggctggatagacaaatgcccatcacttctacgctcaaacatttacaaatatgtatgaagctgcaatatttttaaatgccaaaaattgggaacaacccaaacgttcattgacaatagaatggatgaataaagttgcattttatatacaacactacaaagcaataaaaattaatcaaccggccaggcgtggtggctcacgcctgtaatcccagcactttcggaggccgaggcaggtggatcacttgaggccaggaatttgagacctgcctggccaacatggtaaaaccccatctctactaaaaataggaaaattagccaggtgtggtggtgcttgcctgtaatcccagtggctcgggaggctgaggcaggagaattgcttgaacccaggaggcagaggttgcagtgagccgagattgtgccactgcactccagcctgggcgacagagcgagacactgtctcaggaaaaaaaaaaaaattaatgaaccatggccgggcatggtggctcatgcatgtaatcccagcactttgtgaggccaaggcagggggatcacctgaggttgggagttcaagaccagcctggccaatgtggtgaaaccatgtctttactaaaaatacaaaaattagccaggcatggtggtgcgtgcttgcaatcccagctaggctgaggcaggagaattgcttgaacctgggaggcggaagttgcagtgagctgagactgcgccactgcactccatcctgggcaacagagcaagactccgtctaaaaaaaataatagtaatgaactacaaatggacccttacaaacactatactgagcaaaagaaatcacacacaaaatacatactgtgtggttccatttatgtaatgtgcaagatagacaaaactctatgatgttagaagtgagcatgatggacccctctggagagagtgtaaacactggaaagtagtacaagtgagggtgggggtgctgggggtggggaggtactgggaaatatatttcttgatctgcatacgcaggtatgtggtcacattgtgaaaattcaccatgttatacactttgatttatacacttttctgtatgtatacttcaacttttaaaaaatatataaaataaaaaatgaaaaacatgtaatagaaaagctcttcctccagatgagtaggtatgggaattaaaataaaaagaagaagaaagaaagttcttcctaaaagaacaatctcggatacttactcccttcacttgcttcagtctattgtattcatcagcagcagcctattaacgacagacacaaaggaatatgtttactggggcattttctcttttaaaagtaacattcctgatgttatactttggagctaaaaatgacagcttatgacaaaaatataagcaattaaaagaatgaagtcgtaaagctcttaaaactcatgatcagcaggaaggtctgaaggaattcagtgaagagacatttatgatactgtatctttcacatttcactcacataggcaggtaactatctgttctgctacttctcatctctcctcatgccagtccccatgctacactgacaccaggaagatcttttataacacagagcgctcgctgatcaggtaatatcccactacacaactggtctgagcttcccattaacttctcccctcatccagtttcctacctttccagtctcagtacccatcatcagcaactcctttaaaaactgagacatgttaaatgcttcaggatttcaatcatgttttccttatggctgtaatcatgcacctccccgcacccttctgtctggaaagctcttaacgattccctcactgtgaagcctccaaagactttatttcttctatgagcagttagttatagtgctttctacacatgatgcaaatacagcattaatcatactgtctaaattgtttagatgtcaggttttttttcttaaaatataagctcttttagggtggggacaagattttatgtctctagctccagcatttccacatcatcaaagaaaaataagtgatcaataaatgttcactaaattaagaaagatctataacaccctatagaaaccataaaagaaatacataaatctaactatataaagatgtgaatacgtcaaaactaaaaagtagatcacctcaactgaaaaatggcagaatatttaatgagatgtgcatcaaatgagtcctgtattgtatcaagagggagacacagttggtgcagtctctctggagggcaattttgcaactttgcaaaggtacgtaccctctgactctcagcaatttcacattctggaattagttttagttagataagcaggctgggcgctgtggctcacacacgtaattccagcactttgggaggccgaggcaggcagatcacctgaggtcaggagttcgaggctagcctgaccaacatggcaaaaccccgtctctactaaaaatacaaaaattagtcaggtgtggtgccacatgcctgtaatcccagctactcgggaggctgaggcgggagaatcacttgaacctaggaggcgaaggttgcagtgagccaagatagcgccactgcactccagcctgggcgacagagcaagactccgtctcaaaaaaaaaaaaaaaaaaaaaaattagataagtagacaagagtgcaaaaacagagaggttcaccagtatatactggtactactggagtagggggagacatacttaaatgtctatccatagaaaatgactcttaaattatgatacaaccataaatttgaaagttgtttacctaattttacacataaaaaacttaaaagtaagtaggtctttattattgatataaaaaaaaaaacttgctgttaagaaaagacagaaataagcagtgcaaggaagtttttttgtttgtttttttttttaaagataaaaccccacaataagagtatgtcaaagggacacgggaagcaactgaaagttcccaacggtcaaagcgagaacaattagagctacaaaataaagcagccttggattataattcacagtataaaacaggtatctgtaaagtccatacttacgtaagtgattgactgatcaataaaggaacaaattaacaagaagagattaatctccctctaaaaggtggtgtaactacattaatttcagtatgtatacaaaatacagtatgaaaaggatggattgaaaaaaaaatccagtaactttacatggacaaattctatctcagccaggtgatcaagggagggaaaaaaaaaacccataaactgttgatttaaaagacaggaagaaaataagtgaaacatggaagatgatgtttccttaaagaaaggtgtatgtgccttggtgactcctgcttggagagattgttttaactaatattttggtgataaggatttcttgatggtaggatttaagatgatttctttttctgtatacagttctgtgttaagttctttttttttttttttttttttttgagatggagtctcactctgtcactcaggctggagtgcagtggcgcgatcttggctcactgcaagctccgcctcctggattcacaccattctcctgcctcagcctcccaagtagctgggactacaagtacccgccaccatacctggctaattttttgtattttttttttttttttagtagagacggggtttcactgtgttagccaggatggtctcgatctcctgacctcatgatccacccacctcggcctcccaaagtgctgggattacaggcattagccaccgtgcccggccgcttaagttcttttctacagaaagaatgaatggctttataaataggaaagataataaggctattttattattattattattaatttttgagatggagtctcactctgtcgcccaggctggagtgcaatggcgcaatcttggctcactgcaacctcccccatcccgggttcaagcaattctcctgtctcagcctccccgagtagctgggattacaggtgtctgccaccatgccctgctattttttgtatttttagtagagatggggtttcaccatgttaggcacgctattctctaactcctgacctcaggtgatccacttgccttggcctctcaaagtgtggggattatagccatgagccaccatgcccagcctggctattttattttaaataggaaaggatagatgtacatagaatagtgctttgtaggggctgggcgcggtggctcacgcctgtaatcccagcactttgggaggctaagacgggcagatcacgaggtcaggagatcgagaccatcctggctaacatggtgaaaccccgtctctactaaaaaaaaaaaaaatacaaaaaattagccgggcgtggtggcggacacctgtaatcccagctacttgggaggctgagtcaggagaatggcgtgaacccgggaggcagagcttgcagttagctgagatcacgccactgcactccagcctgggcaacagaacgagactccacctcaaaaaaaaaaaaaaaaacagaatagtgctttgtaattattaactattatacattagtacaatcttctattaggaaagaatttcatccaaaacccaatctcaactattcttcaatgaaactgcagtttgataactactagcacatttttatcaacattaatataaaggatgctgtacctccacagattagattcaaattctgtttaatatataaatatcaggttgaatttaccatgtactcttcactttcttctctatagtcatccaattctttatccaaacgggagagttctttattgatctcatcaagttctgattgtaagctcttgtattcctgtaggccagtgtcaaaattcctcttgtacagttgtctttgttgatctgaagtgataggtggatattccctaaaaggtgagagagaaaatgactacatatgtatccttagcagacataaaattcaatgctccttcctcaaagataataaagctggttgggtatggagaatgacattttcttgtttcgtttttgtttcttacggggaaagagagagagaatacaaataagttctattaagagtgactatatattactgctcattttttaaaaaataaaaactatgcctacgtaatttgcagaaataattttgaaaatcatttacaaaattgaaggtacaagtcataggaactcacttatttcccatacacaatatcaataatggactacttatgtttataaagtttttcttttctttttttttttttttgagacaaagcctgctctgtcacccaggatggagtgcagtggcacaatctcggctcactgcaacctccacctcccgggttcaagcgattttcgtgcctcagtctccacagtagctgggattacaggtgcctgccaccacgcccggctaatttttgtattttagtagagacagggtttcaccatgttggccaggctagtctcaaactcctgacctcaggtgatccacctgcctcagcctcccaaagtgctgggattacaggagtgagccaccatgcctggcctgtttaaagtcttaaaactggaattctggaacacaaagtccgctttgatcaccacagtggcagcacagctgactggaagtggctgtttcctgctaccacccatagttttcagactggtttatttattttttgctcttgtttttccgaagtggaaatagcttatctacttctttcacaataaaaatagacattaaaaatgtacatgtataaaaacatgtgctcactgttaaaataatctggcaattcattaaagtataaagaagaaaaactgaaattttgtatcacacctatttctcaatataccagccactccttacataggaagacgatgccattaacccataatccatagagaaaatactctgaatcctttcacaggactggagtttcacaatgatgtggaatttcaaattttagatctaacaatctaacatcttcattttacagaggggagaaatttaaatgatttgatcaaaagggaaacaagaatttcagattttgaaaattttcaggctgggcatggtagctcacccctgtaatcccagcactttgggaggccgaggtgggtggatcacctgaggtcaggagtttgagaccagcccagccaacatggtgaaaccctgtctctattaaaactacaaaaattagccgggtgtggtggcgcatgcctgtaatcccagctcttcgggaggctgaggcaggaggattgcttgaacctgggaggcggaggttgcagtgagccaagatcgtgccactgcactccagcctgggcaacagcgtgagactctatctcaaaaaaatatataaagttttcagttaaatcttccgtgatacaagttaggtgaatattttacagatagatggctaagccaggccaaaaactcttgaggggagaggggaagataaagtatcagaatcatcagtgaataggggatctcaagctacccatgccccgcctatcattcctcactctctgagaagcgatgttttgattaccattcacattgcaaatgtttctgatgtgcgtcttagtcctcagaatacttgggcataggaaggctacacatcatacacaaatacatttggtgatggtggatggattgtaacaaaaccaccaaaacacaaagaaacttaaccacaactgtggctgaacactaaattgttacctcaattgtttacggaactctttggattaaactttaaaagaaactctcgtcttatcattttaagcttaatttaaaaaataattgccggccaggcgcggtggctcactcctgtaatcccagcactttgggaggccgaggcagggagatcatctgaggtcaggattttcaagatcagcctggccaacatggtgaaacccgtctctactaaaaatacaataattagccgggcatggtggtgggcgcctgtaatcccagctacttggtaggctgaggcaggaattgcttgaacccggaaggcagaggttgcaccgagccgagatcgtgccattgcactccagcctgggcgacagagcaagactccgtctcaaaaaaaaaaagtaatgccaaaggaaaaccatagcactggtttgggaattttataattagtaaaacaaagttcttctatacctggattttatttatttgaaaggcctttggttgttttttgagatagggtctagctctatcacccagcctggggtgcaatgatgcaattatagctcactgcagccttgaactcctgggcttaagcaatcctcctgcctcagcctcagcctcccgagtagctggaactacaggcccacaccactatgcctggctggtcttgaactcttagccttagcctcccaaagtgctaggacatctttcttccgtgactattggtataagaaagagcactggtgaagttcaccagccacactgtggaaagttcaaagtggttactgccaaagttcaaagacatggttactgccaaacattctctccacttcaaactttgtcacaaaagggtgctaaggaaaaaaccagccaacaccacacaaaaaactgtctccagtcctggttggcaaagaatgaaattacaccagtgacctcaatttgggaggcaataactccaacacctggttggtctcctttaattatcagaaggagcacgtgggccaggaaaggagagctgagtcggtacctgatccagtcctcctccagctcatcacaggactcgccaccagttgtgtagtctgtctcatagtgatcttgctctgttctctttgaccttcctgctcttccctttgcaggtgctctttttgaaggtgtctcaaagttaccaccgctgctgtaacgaggctgcctgaagtcatccacaggcgaagttaatggaagctcctgaaccacttcaggaaccctaataaaaacaggcatcattgttcagtacactacagccctttgccagtgcactgtaatcacagagcacagccataataaacaccagcagacatctgcacgcaggtgcactcacgcgaggacttcagatgttcaacactgagcagatgcctcgttttctgcattcaatttgacagcagttcagagtcctctaatacacacaagtagtaggttccaatttaaaggggagtagccatttttataccttctaagtacaatggatctcagatttcattttaaaaagttcaggctgatctataagaggtgtttacttgacctgtgccagggacttactctacaaaggctgtcaggaaaacagtgatcattcttttctacaggctcttctagttccctggaatgctgcatggggaagaatgcacacatgctctttgtaatattgatcttatactaccatatatcaattatcatattaagataaaatcttgcaaaataaactaaatatctaaactaaaaaagtaaaaagctttacattgcaataaattaaagagttcctttaggattctttttaaaattgctgttaatcctgaagccacgtagaatgaatagaagggttaccattacacacttactattttcttctaatacaattatttaaagttgcatcacaattgcatgtttcggacacaaacatgaaaataaccctaactgaggaataaaataccaaagttgaaagtgggaactacttctgagtaaaagaaatacgaagtttcattttcttgtagaaaagggcaagaacagaaatgaaaacaccaaagaatgggcctaagactttccaagcatcagccttgccattccaatcaactatttaaaatgtctgaagcgtttctttttgctgccaatttacataaactatcatactgagctcttccaggtttagtcccttttctaggtgatccacatgtgctttgctgtaactgttgtcagagtcttagatttctaagcacacaatttcttgcagactctaaactttggggtatgtgtgtgtagatgcaggtgggggtagtatttatttcttctttcaagatttatggccggaggcggtggctcacacctgtaatctcagcactttgggaggccgaggtgggcgaatcacttgaggccaggagttcaagatcggcctggccaacatggtgaaaccccatctctacaaaaaatacaaaaattagtgcactgtggcaggcatctgtaatcccagctactcgggaggctgaggcagaagaattgcttgaacccaggaggcagagaatgcagtgagctgagatcgcaccactgcactccaccctgggtaacagaatgagattctgtctaaaaaaaaaaaaaattattcaggtaatatggctttgtgtgctatgctaatgttacttctaatggagagaaaatgtgactttctccatgagtcaatgattaacaagttcctagacactctgccaaaactgccaggtactatgcctcttctttgaggtagaaaaacaaaacctttagaatgcagtggattcattttaggggtggggccaaagagggagggaactaaagggcaaaagaaattagaaaaaaacataaaaacaaaaagtaaaacatcaaagtaggcctcctgccagaatttttatgatattagatattgatatatctttaacttcgaagttttcctcccctcctcctacacccctttaaaatattaacatacttgatctagcatgaaagctaaaagcaaaatgtttcacaagaaaagtattgactacaggtgtgagcaacaccacactgggctaatttttaatttttttgtagagacagggtctcactctgttgcccaggctgagccttccacatttcccaagctgcgttgatctttccagcccagcatgaagttttctttcccaaagcttacatagcaaaaagattctgattggccctttttgggtcactgtcatccttgaagccaggagaatgttctctgattagcaagacttagatatgcctcccaataatggtagcagctctaaaatacagtgtgtacaacaaacgtcattctaatagtcatggcattgttgatcatgggttgtttctctgccttcactgatgctgtgtgtaatcagaaaagaaggattcttatgcatgtgttttcaattcagtaattgtcctgaacacctgacatgcatagagtactgagccaggtgaccctgggaagaccaggtccatgttctcacggaggctgcaaaacaggggtggaggaaagtgcacaacaattctgctgagagtcagggcaaggtaggagcaataaaggcagcgtgaaggagtgtgagagagaataaaacaaatgactgaagaataaaaagaacaagccggccaggtgcggtagctcacacttgtataatcccagcactttgggaggctgaggcagggggatcacttgaggttaggagtttgagaccgatctggccaacatgttgaaacccctgtctctactaaaaatacaaaaattagctgagcatggtggtgcaagcctgtgatcccagctactcaggaggctgaggtgggaggatcgcttgaacctgggaggtagaggttgcaatgagccaagattgcaccaacacattccagcctggatgacagagcaagactccatttcaaaaaaaccaaaaacaacaaaaaaaacccaggcatggttgcatgcacctgtagtactagctactcaggaggctgaggcagaaggatcacttgagtgcaggaatttgaggattcagtgagctatgatcacaccactggactccagcctgtgtgaaacagtgagaccctatctctaaaaagtaaaaataaataaataaataaatgtagatggctatcctgtcacaacagaagctgaactgagaagaaagccaacataccgacagatgaaagagagcacataacagccctgctatcttctgaatccttcgattatgccatgactgaagctacagacgtccttgggcctcacgtgactcagataattcctcctttcacttaagctattttttttcatgatttttttttttttaattgagacagggtctccctatgttgcccaggcaggtctcaaactcctggcctcaagcaatcttcccacctcattggcctcccaaagtgctgggattatcagcctgaaccaccatgccccatcttaaactagtttaaactgggcttctataactcctctaacttgcataaaagtcctaacatcatcctaccagcctattactaccaaacaatggtctcatttagcaatgcaaggagtcagccttctttgaaagctttgcattgcagcaacattcaacttccttgatttatgaagggtaattcaacctgggtgtggacaggatagtggagagtgtacctaatagggctctcccaagttcgtttagtaggtttggagaggcaaccatcttcagctaaattctggtgtcccctgatgcaggattaattctcagagctgactgccttaaaattctaaggtatgggacattataagcaaaaggaaccagatatgagagtaaactgcattattccattttatttaaagtccaataataacacgttcactaacagatggtgacagacatcaaaatagctgttaccttggggtgggtgtgggtgggtattgatggagaaagggcacatggggaccttatgtagggctcaaaatgtatcttggtggtgggagttaagtggtcatagatgggaaaactcatcaagctgtatactcaagattagtgctctttttatggaatgtacattacgcgttgggagaaaaaaacatcttaatactgatttacctcatccttggcacggatgggtggatggacacaatgttctccatctaattccttctctatccactagcatggtgaggaagagaggtgctcatgggttactaagcacttgcaagaatgccttaggaaagacaggctatgacttatgtgttcttattcccattcaagtgggtgtcctctgaatcctctatagcactcagtactctactatgaacaacactttacaatttctattgccccccagaggctgtaaaatccttccatcattaccatgctctgggggagatattgtgcattagtatctcttagtaccactcccattcacccattcatctgggttctaaaatgaagcatcgtgtttgcactttccagaccttcaaaaaaaattctggggcataagtttggagtagaaactagtacaatccttaagaaataaaacttttactacatctatcaaaatgaaaaaatgcacatttattttagctcagcaattctgcctccagatacattcacatatgtataaagtgataaatgtataaggttattccttatacatttgtggtctgtaataacaaaacattgggggaaagtgtgcatcatataggattaatacattaagtataccagccaggtgcggtggctcatgcctgtaatcccaacactttgggaggctaaagcaggcagatcagttgaggtcaggagttcaagaccagcctggccaacatgacaaaaccccatctctactaaaaattagccaggcgtggtggtgggtgcctgtaatcccagctactcaggaggctaaggcaggctactcgggaggcacttgaacctgggaggcagaggttgcagtgagccgagatcgcgccactgtactccagcctgggcaacggagcgagactctgcctcaaaaaataataataataaaataaataaagtatacctatttggtagaatattatacagctataaaacacaatagtgcttcttcttgattataattaaaaaaataaaacagaatcaggcaactcattgcatagtgatatggacaatatccaagataaaatatattgctaatgatacatttggtatgctaatattttctttttcttttttttgaaacagggtctcactctgtcacccagactgaagtggagtggcacggtcttggctcactgcaggcttgacctcctgggctcaatcaatcctcccacctcagcctcccaagtagctaggactagaggcatgtgccaccatacctggcaaatctttatattttttgtagagagggggtttagcaataatgcccagggtgttctcgaactcctaggctcaagcaatccacccacctcagcctcccgaagtgctggaattacaggcatgagccactgtgcccagctctggtatgctagtattttaagggggggtgggggaatcaatgtactttggccagtatctttatgttttaaaatctgtggagaaatagaaagtgatgacattagttgcctctggggagaggaactagctagctggtaccttttgtcccttttaaattttccactacataaagtattcaagaataagaaagattaatacttaaggaataagactttcaaattaatttcaaatgaatttgtgaaactatcctggtttttgtgaaaagggacaacaccagggaatgctgtgtaaccacgcaggccttacaatttagaggaacagctggtgccaagatgcagtatagatatacattttgtatgtatgaaagttctgcaaattggtccttttatagttgatgagcatgatgattgggtgttcacacgcatgtgtgaaatgtcccaccctcaaatcttgttacaatattggcacattacccatctgacatgaaaaaggagaaaaaaaaagttctgcaaatcatagcttaaaaattttagaggctgaggcaggaggatcacttaaggccaggagttcaagactatcctgggcaacaaagcaagaccccttctctacaaaaataaaaataaaaaattagccagccatagtggcacatacctgtggtcctggctaaagtgagctatgaagcaagaggactgcttgagcccaggagttcaaggtcacagtgagctatgatcacaccactgcactataggtctgggcgacagagtgaaacagcatctcaaacaaatgatgaaaaaaaaaaacttagaaggattgcatctctcttgcgtacccttgtccctaacactctcaagtgctttagtttttgtcaaaatccaaagagaagaacagagaaaatgtgctttctccaaatcattcacaattgaaatcaacagcaagatcaagtctgaataccaaaacaactatgcactcagagtaaatctcatatatcatggcccactaatcaggagtcgggcattggggataaaacttcaaagcaggccaggcgcggtggctcacgcctgtaatgcccgcactttgggaggccaagacaggtagatcacctgaggtcaggagttcgagaccaacctggccaacatcatgaaaccccgtctctactaaaaatacaaaaattagccaggcatggtggcgcgcacctgtaatcccagctactaggaggaggctgaggcaggagaatcacttgaacccaggagacggaggttgcagtgaactgagatcacactactgcactccagcctgggtaacggagtgagactccgtctcaaaaacaaaacaaacaaaaaaacacttcgaagtaacaaaaaagttatttccagtagatacacctttaacatagacattcaaactagctgaaaggaaattttttgggctttttcagtctccaaaggaacttagagttctagaattacagtcacaaagtcataaagacatttcagtcaataagggactaataaaagtatacagcaaatgcaattatgtacagtatataatacttgacaataaacgactatgctactggtttatgtatttacactatattttttattagattccttcaacttattaaaaaaaaaaagagttgaaacaggaaaaaaagttaaaagagcctcaggcaggtgcttcaggaggtattccagaagaaggcactgtcaccatggaagatgacagctctgggtgtgttattggccctgatgaccttccagtgcaacgagatgtggaaatggaagacagtgatattgatgtaggcctaggcaaatgtgtatgtttgtatcttagttttgggtttgtgtgtgtgtgtgtgtgtgtttatttttattttttttgagatagggtctctgttgcccaggctggagggcagtggtgcaatcgcagctcactgcagcctcccaaagtggtgggattacaggcataagccactgcacccagtctgtatcttagtttttaacaataaagtgtagaaactaaaataaaatttacatggtaaaaatagaaaacagcactttgggaggccaaagtgggaggatcacttgaggtcaggagtctaagaacagcctggtggcagggcatggtggctcatgcctgtaatcccagtactttgtgaagccgaggcaggcagatcgcttgagcccaggagtttgagaccagcctggacaacatagcaagaccctgtctctacaaaaaaaaatagaaaaaaatagctgggcatggtggagcacatgtgtagtcccagctactgaggtgactaagtagtctcagctacttaggtgactaaagtgggaagatcgcttgagcctgggaggtcaaggctacagtgagctgtgaccacaccactgcaccccaggctgggtgacagattgagaccatgtctctaccaaaaaaaaaaaaaaaaaaaaaaaagcttatagaataaggaaaatacttctctatatctatacaatgtaggtatgggatttttggcttttcttttatttttggctggatttgagctcccgggctcaagtatgatccctcccacctcagcctcccaattagctgggactgctggtgtgcaccactgtgccagggtttgtgattgtgttttttgttgttgttcttttgtttgtttgtttttgagacggagtctcactttgtcgcccaggctagagtgcagtggcgcgatctcggctcactgggagctccacctcccgggttcacgccattctcctgcctcagcctcccgagtagctgggactacaggcacccgccaccatgcccggctagtttttcgtacttttagtagacacggggtttcaccctgttagccaggatggtctcaatttcctgacctcgtgatccacctgcctcagcctcccaaagtgctgggattacaggggtgagccaccgcgtccggccttttgttttttttttttgagacagagtttcactttgtcacgcaggctggagtgcactggtgtgatctcagctcactgtaaccgccgcctcccaggttcaagtgattctcctgcctcagctttccgagtagctgagattacaggtgtgagccaccatgcctggctaatttttgtatttttagtagagacagggttttgccattttggccaggctggtctcgaactcctgacctcaggtgatccgtccacctgggcctcccaaagtgtggggattacaggcgtgagccactgcacccagccatgtgattgtgttttaagtgttattacaaaagagtcaaaaaaattaaagttatagaaagctaagatttattatagaagaaagaaaaatgtttagtaaatttagtgtagcctaagtatagtgtttataaagtgtacagtaatgtcctaggccttcacattcactcaccacttactccctgactcacccagagcaacttccagtcctacaagcttcattcatggtaagtgccttacaagatgtaccatttatttatttatttagatggagcttcgctcttgttgcccaggctggagtgcaatggcacaatctccacttacaacaacctccgcctcccgggttaaactgactctcctgcctcagccttcccacgtagctgggattacaggcatgcgccaccacgcctggctatttttagtagagatggggtttctccatgttggtcaggctggtcttgaactcctgacctcaggtgatccacctgcctcggcctcccaaagtgctgggattataggcgtgagccaccgccccggccaagatgtaccattttttatcttttatatttactgtaccttttttgtgtttagatatacaaataccactgtattaccgctgcctagagtatttggtatattaacatgctgtctgcatttgtagcgtaaaagcaagaagctataccacatagcctaggctcgtagcaggctatccatctaggtttgtgttaagtacactgtgatgttcactcaaggatgaaattgcctaaagacacacttctcagtattcccatcgttaaacaatgcatgactatatatgtaaaaataacgacttcatcatccttaggcaaaaattacatccccgtccataccaattatctccaatagtcttctctcactagtcattaggtggaattagaattgagctttagggtaagtgtttccaccacagagataccatttcaattatcatatgacacctaccctaggccagacgttcactgaggtttcacatctcccagcaatactgaggacctagcacagcaaatgaaataccacaattcctggattcaaatgaagtcttctagtttaacagaaatgtatgtgggcagggttgattaatgtgaaatgtcctcccttctgtttatgagatccaacaattataggcaaaaggagaggctgagcacagcactgacctctgctcagtaacttcctctcaccctcacctaaacttcaaaaccagaaatagcagaaccacattcctagagtgaaagaacccaacccaacctttcaatcaaacaagtaagtgaaaagaagcattttcaacttagaagggaaatagaaccccaccctcctcatcctggtcttccaagtagccgtaggcctctgtaccaacaaagcaaagattgttgtaataccaagatccagatccagcttttgtgtgcactgctggatattttttttaagcagaaaggcacaaaaacaacaaaaaccaattatatgcaaatactcatttttacactcagtctatcaaactaagagagatgctacttacggcgtggatttataggaagactctggataaaaccgcttgtcattcactttgccattggaagagtatgccatgggactgtcaactctttccacatagtcagatgggggtgaaggcacgtcctgtgtgcctgcagacacatttttaaccttaaaaaaccccaagagatagttattatttatcttgtaatgaaaagggggaagacactgaagaaaattatcttatatacattatctaatatttatgtggcccattaaatactattaacactaataataaaaaggcaatcattacaggttaatagttaaatccacattgtaatagacatataaacagtgctactgctagtttaaacaagtatattaccaagaagaaaaatctgatcacctagttctcatcctaatgtgattaggtttcataattatctatggcaattttccacctccatattaggaagactggtctcattatctcacgcccacattagaaagaccactctcatttaacctaagccaggtctcggttaggagaattttcatttctaacaagctctcaggtaatgctatgttgctgtctgtgcaccacacttggaaaagcactaatctagaacaaagcacactggtagttcttaatccattcacctctcaacgtggaatgttaaaaccacagaagaaattaagaagttcaagctgacttctactcttttaataagagatttgtttattctcccttaatgtacgttctctatggctctattactaataacctacacaatatatcacacaacatcagtgccttcccttttcactttccttatttcattctgatgtgtaagtgaattcatcctacaaaagtaacatgcattagaaattatgccttaataggccaggcgcggtggctcacgcctgtaatcccagcacttggggaggctgaggcgggtggatcatgaggtctgtaaacaatttacagaagactaaagggatggtgaaaattaactttgttagcaattttaatgagaatccaaatataggagacccacattttttcccatattttcccagttttgaatgtttatgtatacctaaaaggcattacatcctttgaaagcagctgtcattatgcatgaatctggaacatacctacctttaaatacggattttggatttcaaatgcatctctactatgttctaccttattatttgtattcttcatgaactcactttgtcaaaatgcaatactttttgttttttaatttatttttattttttgtagaaatagggtctcactgtgttgcccaggctggccttgaacacctggcctcaagtgatcttcctgccttccaaagtgctggggacggtaggcatgagccaccacacctgtccaaactgcaatacttctgaaaactttagggctcatagttttgttgaagtgatagatgatggctatattctttgttacataacagcaaaacatttttgtttttacatttataaataccaattagaatgactttcagtggattggttttcatttttcacatcatctttaccttcctgttactttgtgtacatatctgtctttcatacttgtccacttacaaactttttcaagtaaattctggtgttacaagcataaaagatgaaagaacgttgtcacatggtcacttgtccttttagcaattatgcgatgattcaactgttctaggtacaactagagggagagtatcccaggcaagggagataacaaatagaaaggccctaagacacaagtgtatttaacatgtttggggaacaacaaggagttaatcgtggctggagtggaagtaaggaggagagattaaggagatggagctaagagaggtagtcaagggccaggccatatgtcagcgatagtaaggtcttcagcatttacttttttaagctgggagtccatggaaaggttttgaacccaaggtatagcatgatctgacttatagaaagagacttctgattgctgtgttgaaaatacaccataggtttgaagggaggaaacaggctgactagttagagccagtgtgggtagtggtggttggatctgagtatattttccaagtggagccaccaggatttttcagtagattgactacatgtggtgtatgaaagaggagtgtcaagtgtaactccaagatttttggcttatgcaactggaaaaataaagttagaatttaatgagatggaggtctgcataaggagtacttttgtggcaggaaagaaattgggttttgaacatgtgaaaattgagatgcccattagtagaagttggatgtgaataaagagtcccggccaggtgcaatgcctcatgcctgtaatctcagcactttgggaggccaaggcaggagaatcttgtgagcccaggagttcaagaccagactgggcaacaaagtgagaccccgtctatattataaaataaaaaaatagttcagaggagaggtctgggctagagatggaaatgtagaagttagtaaatttaaagctgttgaactagaggagatagctgaggaagtgcattcaaatagagaagatgtcagaggagaactttggggttctctcagtggttagagataggatatgaggaaaaacagtgcaggagactaaggaggagctctcattgagttaggaaaatcaagagggatgccctggaagccaaatgaaggcagtgttttgaggaagaggggtgatgggccatgtgaaagccaataggtcaaatgctgctaatgggtcaactaaagtgaggactgagaagtattcaccaatttagcaatgtggagctcattggtgaccctcataagagctgttttggtggaatggaggaggtaaaatcctggagggggagaacataagaatgagagaacagttgacagtgcatgtaaacaactctttcacggaactttgtatttctgaatttttgtttatttggctattaataaaatcatatctgatatagctttattttagtaaggtttgtttttgtgggacttcagttgtgtatacacatatgtgtgtgtatgtatgtgcgtatggtgttttgatgtaaaatttattattgtgggtcatggttaaaaaaaaagcttgagaatgaggagttagatcaagaaatagaaggaatgttgacataagaagttgtggatgtaggagattctaccatgtagacacagtggaaggatttagggagttggagcaggttgggatatgtgatcagaaagcgggagtttagctctctcacttgcccctgcttttaccatgtgatgtgtctgctaccccttcaccttccaccatgactgtaagcttcctgaggtctccctagaagccaagcagatgccagcaccatgcttcctgtaaagcctgcagaaccatgagccaattaaacctctttgtaaattacccagtttgaggtatttctttatagcagtgcaagaatgccccaatacaggaaattggtaccgagaagttgggcattgctataaagatacctgaaaatgtggaaacagctttggaactgggtaatgagtagtggctggaagagtttacagggctcagaagaagacaggaaaataagggtaagtttcgaactttttttttttttttttttttttttttttgagacggagtcttgctctgtcgcccaggctggagtgcagtggcgtgatcttggctcactgcaacctctgcctcccgggttcaagtgatttttctgcctcagcttcccaagcagctggggttacaggcatgcaccaccatgcctggctaatatttttgtattttattagggatggggtttcaccatgttggccaggctggtctcgaactcctgacctcaagtgattcacccacctcgacctcccaaagtgctaggtttacaggcgtgagccaccgctcccggcaagtctggaacttcttagagactagataagtggttgtgaccaaaatgctgatggtgatagggacagtgaagtccaggttgacaaggtctcaaaaggaaacgaatttattgggaactggagcaaaagtcacacgttatgccttagcaaataacttggctgcattctgcttgtgtcctagggatctgtggaagtttgaacttaaaaactatgacctagcgtatgtggcagaagaaatttctaagcagcaaagcattcaagatgtggccttctgctactaacagcctgtgctcagatgtgggggcaaatgaatgacttaaatttggaacttacatttaaacaggaagcagagcctaaaagttgggaaattttgcagcctagccaggtggtaaaaaaaaaaaccattttctccaaggaattcaagcaggctgtggagcaaccacttgctgatatttgcataactgaaagggatccaagtggtaatatccaagacaatggggaaaaggcctcaaaggcatttcagagacctatggggcagcccctcctgtcataggccctgaagccaaggaggactgaatattttcctgggctgagcccagggccctgttgccctgtgcagcctcagaacactgctccctgcatccagatggctccaactccagcaggggctcaaaggggcctaggtacagcttgggctgttactttggagggcataagccatagccttcacagcttccattaggtggtaagcctgcaggcacacagaatgcaaaaatggtgaattcttggtagcctctgcctggatttcagaggatgtatggaaaagcctgggtgtccaagcagaaccctgctgcaggggcagagccctcacagagagcctctactagggcagcgtggaggggaaatgtggggttaaaggccccacgcagagtccctactggggcactgcctagtggagctgtgagaagagggctactgttctccagaatggtagagccactggcagcttgtaccctgcacttggaaaagccacaggcactcaacccagcctgtgacagcaggctgaactctgcaaagctataggagcagagctgcccaaggccttgggagcccaaccctcatatcagcgtgccacatggaaaccaaggagatcattgtggagtttcatgatttaatgactgccatgctgggttttgaacttgcatggggcctatagcccccttttttggcaggtttttccctaatgggaatatttccccaacccctgaaccctgattgtatgttggaagtaaataatttgttttttattttataggctcataggtggcagggatttgccttgtctcagatgagactttggacttctgagttaatgctggaatgagttaagactttgcggcactgttgggaaggcatggttgtattttgcattgtgaaaaggacataagatttgggaggggccagaggtggaatgatgtggtttggatatttatctctacttatgttgaattttatcccgagtgttggagatggggcatggtgggaggtgtttggatcatgggggcagatccctcatggcttggtgttacctttgtgttgttactgagttctcgtgagatctggtcatttaaaagtgtatgaaacctgccccctgcccccccactgtctctcacttgtttctgctttcatcatgtgacatgtgtgctcaccttctgccatgattttagtttcctgaggcctccctaaaagccgagcagatgccagcaccatgcttcctgtaaagcctgcagaaccgtgagtcaactaaacctcttttctttatgaaagaaaaggaaggaagggagagagggaaggagaaaaagagagagggagagatggatggaggaagggagggagggcttacaaccatgaggacagtttttaggtcaatgagggatgacttgggagtcctatgaagactgatgtaaactagaataaagggcatgatgagcttatgattcaaaagtattttgtcatagaaatagtttgttttctgtaaaagaacacagtaaatattttagctttgtaggccactgagtctctgttgctttaaaaaatgtgaaaaccattcttagcttgagggctggacagtccagggccatactttactgaccgctgcttgaactaaacgctgttagaagcagctctggaaaaataatttgcatggaatcttatgattttttttttttttttttgaggcagaattttgctcttgttgcccaggctagagtgcaatagcgcgttcttggctcactgcaacctccgcctcctgggttcaagcaattctcctgcctcagcctcccgagtagctgggattacaggaaggcaccaccatgcgtggctaattttgtatttttagtagagacaaggtttctccatgttggtcaggctggtctcgaactcccaacctcaggtgatccacccgcctcggcctcccaaagtgctgggattaccagcgtgagccactgcacctggtcaagtattatggttttttaatagtatgcacacatgggacaaaactcaactggtataaaagggtatgcaggagaaaaaaagcaaacttccctctctcccttttctgtccaccagccatcctgttctcctccctaaactcaattatggttgcctgttttttatataagttttccatgaatttataaatacatcacgtgcatatatcctgtcagtcaatattaagaaattactaggttattttgtgtttatgtgtgcactattagatttaatgagttatgctagttgttgcctcttatatccacattcagtcttcattgtctgttctgtaataatagatctgggccctgtaaatacctctcccatgacagtaagcacagagtgaaactttgtcaatcgagggtgctgctgacacactgaaggggcaagggctgcttttcctggttccattgtgctcctctaggcagacacctgcaacacctgtgccatctgcaataccagctcctgtagcacatacactctgcctctgcagcacctcgttctggctgcacacttcttgggcggtgcctaacttcagcagcacccaatggtcagcagcgcacagtacccccacatgaatggcttcccttgacatgcacaaggtcccttctctgcaaagtgccccaagcccagcaccttctccagctgcaactccacagcctcagcaaacctctgtctttcacagctgtgtcctctcacacgaagtctggatctcagcccggatctcagccctgagctttcttctttgagttgttctgtctcagcctggggtgaaaagcccatatcggctgttccctgcatctgcccaggcttctctttattccttactacccaatccccattccaatcctctgttaataactcttacggacagtccccaactcatgatgacttgacttaggatttttctactttgcaatggtgcaaaagtgatctgcattcagtagaaactgttcctcaagtactcatacgacctctatttttcactttctgtacagtattcaataaattgcgtgagattttcaatactttattataaaataggctttgtgtttatgattttgcccaactgtaagctaatataagtgttctcagcgtgtttaaggtaggtcaggttaagcgatgatgtttggtagtttaggtatattaaatgcatttctgacatacaatattttctacttacaatgggtttttcaggatataaccctgttgtaagttgaggagcatcttattttatttatttatttatttatttgaaatggagtcttgctctgtcacccaggctggaatgcagtggcacgatcttggctcactgcaacctctgcctcctgggttcaagcaattctcctgcctcagcctcccaagtagctgagactacaggtgcacaccaccatgcctggctttttttttttttttaatttttttttgtatttttagtagagacaggatttcaccatgttggccaggctggtctcgaactcctgacctcaagtgatctgcccacctcggcctcccaaagtgctggaattacaggcgtgagccactgcgtcaggccgagcatctgtatattaaactttccccattcaaatttctgtgtggtttctgtctcctgactggattctgatataatgcttaacaacctttctaattacaaaggtattacatataaaatcagacaagcaagaagacaatccatcccaccttctagtactcttgccctccagaggtagctccagttaatattttagtgctaaactagatttatttttgttttaaatagaaaaataatgcaggcacgaaagtaaaacaaaaaacagtacagaatgggagagactgaaaagtaagaatggcttccaggcccacttcctagaggtacgcactattaacatttttagatataaacttccagaaatttttttccagttttatttaggtataattgacaaaattatttatatttcagttgtacaacatggatgttcaacatgttttggtgtacatatactttctgatattataaatggttaccacaagcaagctcagtaacatattcagaaattcttaatgtagctagcaatataagtggttttgttttttgttttgagacagacagggtcttgctctgttgcccaggctggaatgcagtggcgccatcttggctcactgcaacctctgcctcccgggttcaagcaagtcttgcgtctcagccgccctagtggctgggactacaggcatgtgccaccacacctggctaatttttgtatttttagtagagatggggtttcaccatgctggccaggctggtctcgaattcctcacctcaaatgattcgcccgcctcagcctcccaaagtgctgggattacaggtgtgagccaccgcacccagtcataagtggttttctaaacaaatgagaccacaccatacatactgtccctatatttcatacttgggcaaggggaggggagttgacttttttcttagtgagaataaaaatgaggataaaagtatggttgtttaccaacttatagtagtatcatgaatttcgaatggtcttctggccgttcagaaaactacttaactggtaggaacgaaattctggacactgacattgatatagacactcatatcaaatataatactatgaaatactatgatatggaaataatatgcaatcactagagataaaatattttctacccaagtagagtggattcataagaaaattctaaattatagcatatgttgaactctgagaagcctctggaatgaagtcatttttccctaacccctgtttcctctttatattggcagtggataaatggaaagtaagttaactctactgtaccaaagctagttcaatatagaaaacaggttctacaaggattaaggaatattctacaaggattaaggaacatctcttggcccacagaagattcatgtggttcctgtgttaaacccgtttcatccatgtatgaaagtgattcaaccgttaagttagccatttattatataaattgaatacttcttccatattgtggcttttagatagattggcagacctgtccccaaccccttccctgttgaccatggacaatggagggttagctgtataaacttgattgaagggtttgcctttagctggggtggattactcagggacctcaaaggtattggtgatgatttatttcttgagcttggtggtgagtatgcaggactgtgttttgttttgttttgttttttagcaagccttacacattttcttttgtatgcaatatttaataaaataattttggataatttggtttttagcattaatcaacaactttttttacatcctcaatatgccccaagacaaattattgattcagcagtttttagctgaatcttttatttctgaatgattggagagaacggcagtatccatttctggagaatagttaagtacttagattgaggatgtctttctcatcacaggctggtctcaaactcctggactcaagtgatcctcctgcctcagcttcccaagtaggtgggattacaagcacgtgtcactgtgcccagcttaatataatattttgaaaatatctccttaaaaaccccaaagagctgatgggttaataaagaaccacctggcaaaaatctaagggagaagcagaaaccaaagaagtacagccaagcctaaagcactgacgccattgtgctgagagtttcaccatcctggacaaatatgagcttctcttttggtctcacaggaggtcacatgccaaggcacatcatgcctacaaaccagactaaattggcaagtcacagtggctcacgcttgtaatcccagcattttgggaggccgaggtgggtagatcacttgaagtcaggagttcgagaccaggctggccaacatggtgttcagtgtttactaagttaaggaatgatggtgcctaagtcatttagctaaatgatgtatttaagaaagatggctgcaccgttttccatgaactattaggataggctggtgagaaacagggaaatacttccaatgactacggattagcagatttccttcctgctgagctgccagatctgtaagttgcaatgtaagaccagcctaaccaaaaacaaaataaaataaccctacaaattattttggagtggcaacattatattagggatttctttcttttttttttttttttctgagatggagttttgctcttgttccccatggagttttactcttgttccccaggctggagtacaatggcgcgatctcggctcacattgcaatctctgcctcccaggttcaggtaattctcctgcttcagcctctcaagtagctgggattacaggcatatgccaccatgccagcaaatttttgcatttttagtagaggcagggtttcaccatgttggtcaggctggtctcgaactcctgacctcaggtgatctgcccttctcggcctcccaaagtgctgggattacaggtgtgagccaccaggcccggcctatattagggattaagaactcagattttggagtcaaaattcctgtatttgagtcacagatatacatttccttagctggatattacgaattactttatctctttatgtctcagttttcccagctacaaaatagcattaataatagtactttactttcgccaggcacagtggctcatgcctgtaatcccagcactttgggaggccgaggcgggaagatcatgaggtcaggagatcgagaccatcctggctaacacggtgaaacgccgtctctactaaaaatacaaaaaattagctgggcgtggtggcaggcacctgtagtcccagctacttgggaggctgaggcaggagaatggtgaacctgggaggaggagcttgcagtgagccgagatcgtgccactgcactccagcctgggcgacagcgcgagactgtctcaaaaaaaaaaaaaaaaaaaaaaaataataataataataatagtactttacttcatagagtgggtatgaagactgagttcatatttgtgaagtgcttaggatacttcctagtgtgtagtaaaggctcaataattacaaacagcactctgctttcttaatgagaaagagtgctattcctcacaatttaccatggatacaggctacacccttagaaccacaggcactttaactcttaaataaattattggccaagtagcttttccaacttacgtaaaaacaagtatattaaagtgccatccttacctagtttggaaggatcatactcagctgaaatttggatcaataatttctccatatggtggaagtttggaaattcttcaggaatgactgaaaaaacatttatattgccctccagatccacagacagttctttcaggcacaggaacttatccagattaggaaagatttggtctggaaagcagcacagtttcccattattaatctaaagagttctgaatggacattttaaaactgtcattttgattcatccagctattttcacatgcaaaccttccacataccataaaacattcttttttttttttaaagaatacatatatgaagatattgctttttgcagcttatgcactgtatgggaagccctgtgctactcttcagactcacaaaaagaaatacagcatctcggctaggcgcagtggctcatgcctgtaatcccagcactttgggaggctgaggcgggcggatcacgaggtcaggagtttgagaccagtctggccaacatagtgaaaccccgtctctactaaaaatacaaaaaaaaaaattagctgggtatggtggtgtgcatctgtaatcccagctactcaggaggctgaggcaggagaatcacataaacctgggagacggaggttgcagtgagccaagatcgcgccattgcactccagcccaggctacagtgtgagactccgtctcaaaaaaaaaaaaaaaaaaaaaaaagaagagaaaagaaatatagcatctcttcaacaaacggttggggacaactggatttgcacatgcgaaagaatgaagttggattcctatccctcaccatgtaaaaaaaatcaactcaaaatggatcaacgacctaaatataaaagctgaaatcacacaactcttagaaaaaacataggagttaatcttcatgaccttggatttggcaatggattcttagataggacaccaaaaggaccagcaataaaagaaaaaaacagataaattggacttcgtcaaaatttaaaactttcgtgcacaaaggacattataaataaagtaaaatgacaacctatggaatgggaaaaatattttcaaactgtgtatctgataacaggttgaaatccagaatatacaaataactcttacaatgcaacaaaaacaacaacaatttttaaatgagcaaacagatattttttcaaaaagtgaaaagatacttaacatcattttcatgatttgcattagagaaatgcaaatcaaaaccacaatgagataccacttcacaactactagaacggctttatgataatcacaaaacaaaatgggctgggtgaggtggctcatacctgtaatcccagcactttggaaggccaaggtgggtggatcatttgagcccaggagttcaagaccagactaggggccaggcacggtggctcatgcctgtaatcccagcactttgggaggccgaggtgggtggatcacctgaggtcaggagttcaagaccagcctggccaacatggtgaaaccccatctctactaaaaatacaaaaattagctgggtgtggtggcgggagcttgtaatcccagctacttgggaggctgaggcaagagaatggcgtgaacccaggaggcagagcttgcagtgagccgagattgcgccactgcactccagcctgggggacagagcgaggctccatctcaaaaaaaaaaaaagaaagaaaaagaaaaaagaccagactaggcaacatagcaagaatctgtctctacaaaaaataaaaaattatccaggcacggtggtgcatgctggtagtctcagctactcaggaggctgaggcaggaggatcacctgagctcaagaggttgaggctgcagtgagccatgattgcaccacagcactccagcttgggcaatagagcgagacactgtctgaaaaacaacaatgaaaacaaaaacaggtcgggcactgtggctcatgcctgtaatcctagcacttcgggaggccaaggtggctggactgcctgagctcaggagttcgagaccggcttgggcaacatggcgaaaccccatctctactaaaaatacaaaagttagccaggtatggtggtgcacacctgtagtcccagctactcaggaggctgagacaggagaattgcttgaacccgagaggtggaggttgcagtgagccaagatctcgccactgcactccagcctgggtgacagaattagactctgtctccacaaaaacaaaaattaacaagtgctgaagaggatgtggagtaattggaacctttgtacatggatagtgggaatgtaagatggtgcagctactgtgcaagttcctcaaaaagttaaacatagaactaccatatgaatcagcaattctgcttctaggtatatacccaaaatgattaaaagcaagaacttaaaccgatacttataatgccagtgttcattgcagcattatttatgatagccagaaggtagaaacaacccaagtgtctctcagcagcagaatggataaacaaaatgtactatatacataccatggaatattagctataaaaaggatgaagttccttttcaaagttgatacataataattgtacatatttatggagtacatgtgaaggaatgaaattccaatataggctacaacatgatgtaccttgaacagtatgcaaagtgaaataagccagacaagtgataatgcttataaacaatatctagaagaggcaaattcatagagacagaaaatagaagagaagttatcaggggctggtgggagggaagattttttttttttttttttttttttttttttgagagggagtctcactcggtagcccaagctggagtgcagtggcatgatctgggctcactgcaacctctgcctcccaggcttaagtgattctcatgcctcagcctcccgaatagctgggactacaggcgcatgccaccacgcccagctaattttttgtattttagtagagatgtggtttcaccatgttgcccagggtggtctcaaactcctgagctctggcgatccaccctcttcggcctcccaaagtgctgggattacaggcgtgagcccccgcgcccggcccaatttattgtttaattgggatgatgaaaaggttctggagatggatagcggtgatggttgtacaacatagtgaatgcttaatgccactgagttgtacacttaaaatgattaaaatgtaagctttgttacatgtattttaccataataaaacagtacttgaaaaaagatgaaaaattttctaaatttggtaaatgtcaacccacacattccaaaaaagttcagtgcacctcaagcaagatacatacaaagcaaagcacacctaggcatataacagtcaaactgcttaagaccaaagcaatactagcaacaattagaaaatgaaaaaatatttttaatgacatttacaatactttcaaaagatatgagtatctaggaataaatttaatgaaagatgggttaagtctacactgaaaactatcaaatagtgcttagaggagttaagacacaaatagatgaagatattatttcccattaatttatttatttcccagggactacaggcctttcttcctttaggcagctagggtgaaggtaatttctaagcatcatcttacatatagctaattcttttactaataacagataattcatgtctttattaagaaccttcaataatttaatataaatattttattcattttgtctgagttatttgaaaaccattctattattcaaggacttttcactaattcatgctactgtcaaaaaaaaattagtgaaggtttattttatatctgttctatcaatgagcatgcatgctttcatggcctcagaagttttcaaccacttaaagtaagaaaaagaaattatacatcagaatagtcatccaaaatatatacaggtataccttgtgactggattgtccctgagacttcaagagattccagggaaggcagggtgagaagcagttcctgttcggctgcgctgagttccaacttgcttatggagcacttggtgacagaggccttagacagctcaagagctgggcggatgctttctataaagcctctgctgtggtttaaatggagttcgatgcgctgtgaagctgagaaaactgtcattagaatctcaagcatatcctggcctacaacatcaatatcattcacatcgacttctagacagggaatcttgtactgctttggagaaagtttccaatagccagtactaaggtctggtgatgccctgcgctgcatatccatatagctctttacattatcctctttttcagctaaatttcgctcccattcattcataggttcaaaggcagaagcatagtcctgatctatagttggcacctgtgatttgtcaaaacatgtttccagaactgaaaaatgtgctctgggtgatgtcttatttcctcgtattgagaagtggatgctcctcaacaatgacaagctttctgggtggtcgaaaaagtactgtaagttaagcgcacccaaagtcagtgttctcccttgaaggaatt

SEQ ID NO: 79 - DNA, 28866 bp, Homo Sapiens
gggggctggcacgagtcacagcacctcgtgcgtcacttggcggcgccggacgttgggctgcgcaggatttgagacgctcccctgaccaccacttgctctgcgctgaggtgctgggacagccatggtttcagacggtgaggaccctgcagggcgggacttcgactccggggctcggctgtctcggtccggctacgactggccagatggaatgtgtcttttgggctggatagaatccgtttggtctttagaggagtagccaaggcattcagtcattcattcagtaaatagttttggatcgcctcctgtgtacaggcattattttctggattttagcagagatcgtgacagacaggggccttagtggaggttacagtctactgggtgaaacagatgacaataaataaaaataatttcggccgggtcgcaccccggtggattaggcctgtaatcccagcactttgggaggccgaggagggagaatcgcttgaagccgggagttcgagacctgcctgggcaacacagccagaccccatctctacaaaaaaaatgaaatattagccgggcgtggtagcgcgtgtctgtggtcccagctacgcgggaggctgaggcgggagaatcacttgagcccaggaattcgaggcttcagtgagctattatggcagtactgcacccagcatggccgacagggcatgacctcgtcaataaaaaattaaaaaataaattatttttcaaaggatgaaaagagctatgaagatgatgtaacagtacggtcctagttacaatagtacattgtgactaggattgaggaggagctgttttagataggggcctaggaaaagtgcaggatattgaaaccgacttgaatgattatgtgaagttctgggggaagtgcactttaagtgcatgggccctgtggcagattgagccaccaagttacactgagaagggagaaatggagagcttgcgggtagaggatggtggggagactcattcatacattaaactaccacatacagagtcagatgtcttgaagatttaaaaggaggctagagggatgagatcagagaaccagccagtttcaggtcatgcagggccttattggccgtgatagagaagttggcctttatttttaggtgcaatacaaagacattgtagagttttaagccagaaagtgttatgatctggtttgcaattttaaaagatcactgtggctgttgtgtggaaaatggactgtggggagcaagaatagagataggggagtcctttcaggaactgtaataattgtccatcctctcttaattgatgtgaaaccataccacaaccctgtgagggaggcaggcctggcattgctcctgtctacaaatgaggtagcgaactaaagaaggaaattcacagggtcattgcatgtgtatagatgcacacctttctttacaggcaacgctttttctgtctggcagacacagttgtattaagtgcttctgtcctaggtgctttgttgtgtgatttacacatttttttgttttgtttttctattaaaaaagaaaaaaagtggctgggcacagtggctcacgcctgtaatcccagcattttggaaggccaaggtgggtggatcacttgaggtcgggagttcgagaccagcctggccaacatggtgaaaccccgtctctgctcaaaatacaaaaaaattaaccggacaaggtggcgcacacctataatcccagctactcaggaggctgaggcaggaaaattgcttgaacccaggaggcagaggttgcagtgagccaagatcgtgccactgcactccagcttgggcgacagagcaagtctccgtcgcaaaaaaaaaaaaaaaaaaaaggtagagataaggtctcactgttttgcccaggctggtctcaaactcctgggctgaagcaatcttcctgcctcgacctcccaaagtgttgggattacaggcgtgagccactacaccagttctgatttacacacattattttatcctaggattagcaaattccatcattttttaagaagtccacagtcttaagtgggcaggactgggacgagagatcagaagcacaactaactgtaaaataaaatagtaagtgctaagtgtcattagaagagagagctgtgggttgtcagaggtgggcagtggggcagtgaagagccacagtctttatagtcaagcagatctgtctttagaacagggctttggccttgccacttgttagcaggccatatgtgacttaggacaagttactttcatttgcagaatacgaataccatatatcatatttcagctaatctaagataatattgattatgagatgtgcccttatttaatataccattaagaaagaaaaaatgctgctaatcttaatgataaagataccatccagatgtcaacaactattcaatgtaaaaaacaaggggtgggggtcatcttataattgatgaaaaatggcaggaaaatgtcctttgctgggtggttgtcagggtggaatgggattttgggattgcagattccggtgcttagtgcagaggaggctggcattccttctgctctgagataggggagtcatgaagaagaaagagtttgcgctggtttggggctttgaggagtaattgggatttgaatacacagaaatcaaagatggggtagagattctcctaatgtagaagacaggactgcaggaagcaaagtacggagggaggaaaggcattactgctctttgctattaaatgagcatcctagagccgggcacggcggcacatgcctgtaatcccaacactttaggaggctgaggtgggaggatcacttgagcccaggagttcgagaccagcctaggcaacaaagtgagaccctgtctctacaaaaatttaaaaattagccaagtggctgggtgtggtggctcatgcctgtaatcccagcactttgggaggccaaggcgggcagatcacctgaggtcgggagttcgagaccagcctaaccaacgtggagaaactctgtctctactgaaaatacaaaattagctgggcgtggtggtgcatgcctgtaatcccggctactcaggaggctgaggcaggagaatcgcttgatcccgggaggcggaggttgcggtgagccgagatcgcgccattacactccaccctgggcaacaagagcaaaactccgtctcaaaaaaaaaaaataataattagctggatgtggtagtgcacgcctgttgtcccagctgtgtgggagactgagacaggaagatcacttgagcccaggaggtcaaggctgcagtgagctatattcgtggcactgtactccaaccttgagaccttgtctcaaaaatttgtttaaaaatacataaataaataaatgagcatcctgggcctttcataacagtgtatactcacaggtttgtatgtctgtctgtcacctcaattagagtatagtctctttgaggggttggacccagtatccccaacacctaacactggtagtgtgaaagtttgttgaaggattaatgtgtttggggtggtgcgtgcatgtagtccttactactggggaggctgatgcaggaggatcacaagcccaggatttcaagaccagcctgggcaatttattgagacccccccatctcttaaaaaaaacccaaaaaacaaaaatccaaatgaatgattaatgtgttgtggtagcctgtttagtttagagaatagaattcctcttaacagtaaaatcttgacgtaggaattgcttttccctctgttttttaacttttttttttttttttgagacagagtcccactctgtcacccaggctggagtgcagtggcaagatctcagctcactgcaacctctgcctgccaggttcaagtgattctcctgcctcagcctcccgagtagctggaattacaggtgtgcaccaccatgcccggctaatattttgtatttttagtagggacggggttttgccatattggctaggctggtcttgaactcctgacctcagtgatctgcccacctcagcctcccaaagggctgggatgggcgcccagcctggtttttttaccttttaaaaagtgactcttaattacgattggccttgctgctacatgatttgatgagtacgggccaaattgacagctacgcctccctttaattttttgctcctgaaattctaccactgggattcctactactagttaaccagtgccttctgtccttgaccaggcattcagaatgcagtaggtggttttgtttgtttgtttgtttgtttgtttgtttccagacggggtctcattctgtctcccaggctggagtgcattggcaggaacatggctcactgtagcctcgacttcccggtctcaagcgatcctctctcctcaccctcctgagtagctgggactacaggcatgtgccaccatgcccggctatttttttttccccgagatgaagtcttgctctgttacccaggctggagtgcagtggtgcaatcttggctcactgcagcctccgcctcccgggttcaagtgattctcctgcctcagtctcccgagtagctgggattacaggtgcttgccaccaaacccagctaatttttttttttttttgtatttttagtagagatggggtggctcaacatgttggccgggctggtcttgaacttatgacctcaagtgatcccccctccttggccttccaaaatgctgggatcacaggcatgagccaccgcgcccggccctaatttttatatttttagtagagaaaaggttttgcgatattgcccaggctggtcttgggaacttctgagctcaagccatctgcctgtcttggcctcccaaagtgctaggactacaggcctgtgccaccacacctggccctcgttcagtagatatttattgagcagctgcaatgtgctaggcagtgtggtaggagtgaggataagcagtgaacaaaagagacaaaaattcctaccctcacagagtttacatttagtgcattggagatatagtggttcaggacgtagacaagaacttgctaagggcccactgtgctttaaagctttttttttttttttttttttgagacagagtcttgttctgtggcccaggctggagtgcagtggcgtgatctcggctcactgcaagctccgcctcctgggttcacgccattctcctggctcagcctcccgagtagctgggactacaggcgcccaccaccacgcccatctaattttttgtatttttagtagagacggggtttcaccgtgttagccaggatggtctcgatctcctgacctcgtgatctgcctgcctcggcctcccaaagtgctggggttacaggcgtgagccaccacgccctgcccagctttaaagctttaactgggtcttctgttaatctcataattataaggtgataaacatttaaggcatatagtggtgctctggatttaatttatgaattgggaatgttagctttgattcatttttatggagctaatgttttaaattttatttcttgttaatattttcagaagatgaattgaatcttctggttattgtagttgatgccaacccaatttggtggggaaagcaagcattaaaggaatctcaggtaagactgcttgaggaggcctttggagaattctggtttaactgagtgtttatattgcttttttaaaaaatggctttattaaagtataatttacatactgtaatattcagccactgtacaattcagtgattttttttaagtaaatttgcgaagttgtgtaaccagccccacatttctgctttagaatatttctttgactgcgtagcgttccctcatgcctgcttgcagtcaatccctgcttctatctccaagctgcaagcaaccactgatctgccctctatctctaaattcccttttctggacatttcatgtattgatttcatacaatatgtggtcttaaaaaatactttctattttgaaatattttatttttaaataatatagacataggaaaccagaaaagatacagagaggtcctgtgtacccatcactcaagttctttcagtggtgacattttacataatgatagtacaattttgaaactatcagtgcaatctacagacctaagcagattgcaggttttacatgtgctcacttgtgtgtatgcgtgcgtgcgtgtatgtgtgtggttctgtgcagttttaccacattcattgatttgtgtgtccatcagcaccaccatctcatgcctcagcctcccgagtacttgggactacaggtgcgtaccaccatgctcagctaattgtttgtatttttagtagagatggggttttgccatgttggccaggctggtctcgaactcctggcctcatgtgatctgcccgctttggcttcctaaagtgttgggattatgggagtgagccaccgcacctggctgattcttcatgtttgttcgtttgtaatctggtcccactctcgaccacaccttctttgcctgtctgtactcccaggcaactcttgatctctttgtgtcactgtagattagtttggattttctagatttttttcatgtaaatggaatcaaacaggttatagtggggaggtttttgtggccttttttttttttttttgagacggagttttgctcttgttgcccaggctagagtgcaatggcgcgatctcggctcactgcaacctttgcctcctgggttcaagtgattctccttcctcagccttccgagtagctgggattacaggcatccgtcaccacgcccagctaattttttgtatttttagtagagttggagtttcaccatgttggccaggctgatctcgaactcctaaactcaggtgatctgcctacctcggcctcccaaagtactgggattacaggcatgagccactgtgcctggccttgtctgttctttttaatgacaggttagctgttttccacttttaaatggtttaaaataaaatcagaagaataacatttttgtgacttgaaaattatatgaaattcaaatttctgggtctataaataagcctcactcataaatttatgtattttctgtggcagcttttgcattacaaaagcagaggtgggtagcaataaagattgcatggctcaaaaagcctaaaatatttactatctggcccttcacaaaacaagtttactgacctctggccgattgtgtggtctgttctggagaatgttgcatgtctacttgaaaagaatgtgcattcttttgtttctagtgaagtgttctataaatgtctattagtttaagttgcgtgatagcgcacctatagtcccagctacttgaggcgctgaggtgggaggatcactggtgcccaggcggttgagtctgcagtgagccataactatgccactgcactccagcctgggagacagagcaagaccccgtctcaaaaaatataaaataaaaaaataaaaaaattatcgagaatggaatattgaaatgaagtattgttgttgaattgtgtatttcttttttttttttgaaatggagtttcgctctgtcacccaggtcggagtgcagtggtgtgatctctgctcactgcaacctctgcctcccggttcaagcgattcttctgcctcagtctcccaagtagctgggaccacaggcgtgtaccaccacgcctggctaatttttgtattgttagtagagacggggcttcgccatgttggccaggctgatcttgaactcctgacctcaagtgatctgcctgcctcgacctcccaaagtgctggggttacaggcatgagccacgtgtctgcccccgtttttttttttgtgtgttttttttttgagacagagtctcactctgtcacccaggctggatagcagtgctaggattacaagtgtgagccaccatgcccatttccccatattttgatagcagcagttagtgtactcacatttaatataattattagtgtggttgcgttcatatctgctattttgttatttgttttctgtatgtatcatgaattttttggttctttgtcctcctttactgtcttttgtgttaaataaatattttttacgtactatattaattcttctgttgatttgattaattcttctgtatatttttagtttttttgtttgtttgtttgttttttgagatggagttttgctcttgtcgcccaggctagagtgcaatggcacgatctcggctccctgcaacctccatctccctggttcaagcaattctcctgcctcagcctcccgagtagctgggatcacaggcgcgtgccaccatacctggctaatttttgtatttttggtagtgacagggtttcaccatattggtcaggctgatctctaattcctgacctcaagtgatcctcccgcctcggcctcccaaagtgctaggattacaggcatgagccactgcacccagccttcagttattttctttttcttttctttttttttttgagacagagtctagttttgtcgcccaggctggagtgcattgacatgattttggcttactgcaacctctctctcccgagttcaagcaattctcctgcctcagcctcccgagtagctggtatttcaggcatgcaccaccacacccagctaatttttgtattttcagtagagacggggtttcgccgtgttggccaggctggtctcgatctcttgacctcgtgatccgcccacctcagcctcccaaagtgttgggattacaggcatgagccaccacacctggtcaatctcttcttacttgtgattctatttccaaaaaagatcatgtacacatgtaccagaagttaggacttgaacatatcttttggggggacataattcgacccacaacagttgctgtagggattactgtatgtatcttatcattgtgtactttagattaatactcatttaattccagtaaaatatagaggctttgctccaatatagatccacttccaccccttccccatgttcttattgtcatacatattacacctgcgcatgttataaatctgataacgcagtgttataattgttacttacacagttgcttacaccaagtataagcatcttttctcttgttaacaaaaaataaaaatatcagacaatattcatgttagaactacactcatttttcagctgaaaccatactcttttttctttttttgagatggcgtcttgctctgtcgcccaggctggagtgcagtggtgcaatctcggcttaccgcaatctccacctcccgggttcaagcaattctgcctcagcctcccgagtagctgggactacaggcacacgtcaccatgcccagctaattttttgtgtgtgtattttagtagagatggggtttcaccatgttgcccaggctggttgcaaactcctgagctcaggcagtctgcccgccttggcctcccaaagtgctgggattacaggtgtgagctactacgcccggcccaaccatactcatttttcaattagctatggatacaagaattcagcaaaaatcaacataggcattctgtgagaatccattgacttatgcaatttactataaagagtattgtgcattttactgttatttgtaaattgtgtgctacatactgctgtatcagtaatattcgtatgtacttgtgtacatgggtacctcggttttggggagcgaatggttaaacatccgccagcacatcactgcatgctgccctgttactccagaaaggctgcgtttgcactcatcagtgctgtatgagagttccttttttcttgtaccaacacaaaatgttcattctccttatttcatcttttgtcaatatgaggcaaaaaacaacgtaatctcaatttgcttccagtgtatttcgtggccatttgtatttctctcttgggacatcacccacttctttctttggatattcatagtgtgtggttttttttaaattaatgatttatggacagtcttttatattaaaggattaacccattacttgccatgtgttgcaactggttttttccagtttgtaacttgttttctttcacttttatttatattgtcacttttcgccaattagaaattttaatagatttaagttttttttccagtagggtgaaatttaccagtgtgttggtctattttttgagatggagtctttgtcacccaggctagagtgcagtggcacgatctcagctcactgcagcctccacctcctgggctcaagcagtcctcccacctcagcatcccgagaagctgggactgcaggcacgtgccaacacgcccagctaatttttgtattttaagtagagatagggttttgccacgtaagccaggctggtctcaaactcctgaccacaggtgatctgcctgcctcggcctcccaaagtgctgggacgtgagccaccacgcccagccaccagtgttctgttttctacctgaagtatttatttaagagaaacaggccatattccaggattatgaaaatatctacttatgaagactgaaacttcaaggatcatttgtttagtttgttactagagaagtttctctgaacatatgagtaccaaaaaaaaaatactgacttatgtttcttaataatattagttcttgtgggaaggtgagctcgaggaaagaagggatattctttatttgttttttcaaactttaaaagtttttaggctgggcatggtggctcacgcctgtaatcccggcactttgggaggccgaggcgggcggatcatgaggtaaagagatcgagaccatccttgccaatatggtgaaaccccatccctactaaaaatacaaaaattagctgggcgaggtagcacaggcctgtagtcccagctgctggggaggctgaggcaggagaattgcttgaacccgggagttggaggttgcagtgagccgagatcaggccactgcactccagcctggcgacagagtgagactccatctcaaaaaaaaaaaaaagtttttaattcatttacccactaagtatactgagcaacaactatattgttcactaagtatataccagacgtacagtagtggctcagtatagttagtgaacaaatgaattaaaaaattgtaaaggtctccagtgttttcagtatgtattcattatctactccacatatagtaatagtttgctggaaattttatcacagaacatgtgacatgtttgttattctttaaatgttacactgcaaatatttgtggaatattgtactgatgtagaaatgatctcatataagtacaattagaaaactatagttttcaagtgtttttgtttatggctttggaggaggggagctcctgagcaaatttttaacagtgaataattgtctaaaatttaaatgaagtcttttttttgtttgtttgttacagggtctagctctgttgtccaggctgcagtacagtggtacaatcttggctcactgcagcctggctctccagggcttaagcgatcctgccacctcagccttcagagtagctaagactacaggtgcacaccaccatgcctagctagttttgttttttttatagagctaaggtttcattatgttgcctaggctggtctcaaactcctgaactcaagcagtcctcccaccttggcctctcagggtgctgggattacaggcttgagccactgcacccagcctaaacgacatcttaattatgtcaagacctgacatggttatttggatagctaatttgtttttctaatgtctttttttttccaacagttcactttatccaaatgcatagatgccgtgatggtgctgggaaattcgcatttattcatgaatcgttccaacaaacttgctgtgatagcaagtcacattcaagaaaggtatgaccattgtgattgcttttgctcttcagtgcttaatattcatgagttttctgtgccagttggcatgtattgttcctactccatgttgcaaaagaaaatgttttctgtaccagtgaacagccacagcaccaagagccagtacatgtacattgtgatatccatgaaatttgcaaaccttattattagtagatagtagagttacacaatggcccatgtaatttgcacagattgaactatattatttaggcaaaaagggaaagagagctatcaaatcggacagctactttccctcacctgtcttcccattttgtgtctgccccagcgtgcaagttagatgggagatgtgattctgttttcctttagctctgcgtagttctcatggcctgtttccctgctctgtgagtgaacctggtgctttgaaataaggatttttcttataacgttggcttctaaacccaagccaactactccatctggtgcttggcagaagaaacagtggtcgcttctaacactagtgtgaaaactggctgtgttagactcactgcaagatggtgcatagcctgcagctgatgtgtaaatgtgaccgcagatacagcaaagtttttgtgaataatttgggccatatttacttctcacattatgcactgacagaagagttgaattaccatgtaagacacagctcttctatgtcttttttttttttttttttggagacaggatcttgctctgtcacccaggctagagtgcagtggcactatcatgggtcactgtagcgtctgaccttctggacataagtgactggacctcctgcctcagtctcccaagtagctgggactacaggtgtgcaccaccacactcagctaatttttgtattttttgtagagatggggtctcactatgttgcccaggctggccttgctctcctgggctcaagcagtcctttcaccccagcctccccaagtgctgggactgcagggatgagccactacacctggctcttctatgtcttaatcaccacattacaatagaagtgactcttgctcaccaacatatttcatatggtagctgtcagattttcttggttcttagggctgcctgcttcctctggtgaggtgagagagcccatgggccaccaaacacatactcttactcccatcctcgctgcatattttttctcagaattggatgaaaagatgatattagtttggttaaaataccagtaaaaactatacctgtcaaagtttttttttttttttttaatcaaaggtatcctctacctgattatcttaaaagtcacaaggccatggctgggtgcggtggctcatgtctgtaatcccagcactttgggaggccgaggcgggcggatcacgagatcaggagatcaggaccatcctggctaacatggtgaaaccccgtttctactaaaaatacaaaaaaaattagccgggcatggtggcgggcacctgtagtcccagctactcgttaggctgaggcaggagaatgtcgtgaacccgggaggtggagcttgcagtgagccgaggtcgtgccactgcactgcagcctgggcgacagagcaagaccctgtctcaaaaaaaaaaaaaaaaaaaagtcacgaagtcacgaggccgggctcggtggctcacgcctgtaatcccagcacttcaggaagctgaggcagattacttgaggtcagtttgagaccagccatacatagcagccaacatagtgaaaccccatctctactaaaaatacaaaaaattagctggacgtggtggtacactcctgtaattccagctacttgggaggctgaggcacgagaatcacttgagcccgggaggtggaagttgcagtgagctgagactgcaccactgcactccagcctgggcgacacagcgagactgtgtctcaaaaaaaaaaagagtcatgaatcactgggagaatcttttcagggacctttgggccagatttttattactgggatagatatgtacctcaaataataaactagtagtgagttagaatttggtatgaacctgttgtggttgtcatttgagaaaggaaggcacgggcacccctctgcagcatttctgagattataacccaacgccctctgtatttccccacacttttcagaaaacactggaatcagtaaaacattctgtggtgatagacaaatgttggccagtttgcctattttatacattttttctttgtttttatacgctttttctaattttatcttacacattttttttaaaaaatgaaatttaccgtggaatcttgtgagtcccacattgttgtaattttgtttgttgcctctgctgaatttcattctgatcatgagtgagcctgggcggtgaggcctggtgtaaccaggttttttcccctgctgtttcagccgattcttatatcctggaaagaatggcagacttggagacttcttcggagaccctggcaaccctcctgaatttaatccctctgggagtaaagatggaaaatacgaacttttaacctcagcaaatgaagttattgttgaagagattaaagatctaatgaccaaaagtaacaacttttaaacattgttattttgcaaatagtgttgattttggaggtcctttaggctttaagttcaaagatgtgaggttctttatgttgtatgcctgcacgttctcactttttaaaaatcattttcgtcaaagttggttcattatttgcctagcctctacagcatttgacgctgctgagcagcctttacttctggaaacacgacttttggcttctacgaatgccctgtgacctgtttttcctcttttcttgaaacattatttcatagtctctatttctggcttttccttcatcttgtctcttaaaatatgtttttaattcggcacatgattttcatcttttctccctctatatgttctcatccacttttgcctttaattatcttttacatatggacactttccaactttgtttctaacccagactttctttcatgctcaaatgcctccatttcagcgtcccacagtctctggacatggcccaggctagtctcattatctttgctctcactcacaccaccatttccattccctatttctgtcagctcccatccaagtagttttctaaacttaaagctttcatttttaactcctgctcacatccgacatctaatcagctacaaaatcctagtcgtttagcctcagaagtgtctccagaatcccgctccttattgtcatctttttatttttcatttttaaaatttttatagggacggggtctcactatgttgcccaggctggtcttgaactcctgggctcaagctatcctcctgcttctgcctcccagagtgctgggattacaggcaggagccaccacacccagcccccatccctattgtcatctcttttttttgagatggagttttgctcttgttgcccaggctggagtgcaatggcacgtgatctcagctcactgcaacctccgcctcccgggttcaagagattctcctgcctcagcctcccaagtagctgggattataggcacgtaccaccatgcctgactaatttttaatatttttagtagagatggggtttcaccatgttggccaggcttgtctccaactcctgacctcagttgatccacccaactcggccttccaaagggctggaattacaggtgtgagccaccacacccaggccccatcccttattgtcatcttgatcggcctcagcattattgacattttggtctggataattctttgttgtggcagctgtcctatgcgttgtaggatgtttagcagcatttctggccttgggccattagacaccataatatcccccagttgtgacaaccagatatgtctgtagacatagccagatgccccctgtagggcacattcaccccacgtttagagccactgctctagattgttatagcctctaactggttttctgactcctgtctccccagtcaagcctttgcactcagcctccagagttatcatcttaaaaatcaaagctgccattcctgggcttataggcctttcctggctccctgctgcctgcaggtgatggtttccaaaccttagcctgaatcagaatcacctgggggaaaagacaattctgtggagacagaaagttggttagtggttgcccagagctgggcagagactggggagtgattgcaaatgggcccaaatgatcttttagggtaatggagactgttctaaaattggattgtgatgatgattgcataattgtaaatttactaaaaataattgaattgcatacccaaaagtacttttagaccagaatttatggtttgtacattataaacctgttaaaaaatcagctggaaggcttgttgaaacagtgtcaggccccactcagtttctgattcactggatctagggaggtcctgagaatttctatttctattacagtgccaggtggtgcccctatagctggttccagaatctcaccttgagagtcactggcctccaggattaagtctcagctcagcttcacagtatagtgctcaagaccttttctggtctgacctcacccatgaggtgtcagttctcctggaccagctctaagctggcttgcacagagtgtcaatctgagctccttgccctcttgaactgcagttttagggttttgatatcttgagtgacttttttcacccaaggcaccaaacaagtggcaaactcctccctgcttctcatggctcgaggaaagagcttctccagtcttccccgcactggctgagcacggagagtgatgggaaggaggggatggtgggagagggagggcaagggggcctcagagccttgtaccctgtccaggctgctagacttatgcgtgacattttgtaccacatagatcatgaataaactggaacctttccaagtaaaaacgggatctttttgtgtgtgtatgtatggtaaagtacaaataacaaaatttgccattttaccgatttttagaatttttaatgtaaaatttacttaccataaaatttaccattttgacaatatttaagtgtacagttcagtaatgttgagtatattcgccttcttttgcaatcatcaccgccatccatcgccagaactttttcatctttacaaactgaaattctgtacccattagacactaactccctgttccccctgccctctggctagcccctgaacaaccaccaggatgttttacattgagaaaaggttaaaaagttgcttagttaaccattaccaagaacacattgctatgtttttaaacctagtttgaaaatgtcttgtttgatttcatttatgaagaatgctttggtgtgaaagcatacttagttcaataaagcacccaatgattttagttcaagaaagtacttaaaaattcccttttaatgttttctgttatttgcaggtgacataaagggtcaacatacagaaactttgctggcaggatccctggccaaagccctttgctgtatccttggtgtctgaatcatttagaaggtgtcttctgtaataaacatatcttaacttgtgacatttcttaggaccttgggtgcccattactgggacatgtgagtactctgaagtggagggtaattttttaaaaaatagtttacattggctttgaatttttttttctttttttgagacagtctcactctgtcgcccaagttggagtgcagtggcacaatctcggctcactgcaaccttcgcctcccagattcaagcagttctcttgcttcagcctcccaagtagctggtacaggcacccgccatcactcccggctaattttttttgtatttttagtagagatgtagtttcaccaagttagccaggctggtctctaactcctgacttcaagtgatccacccacctcggcctctcaaagtgctgggattacaggccacagtgtgtggctggctttgaaatgtttattaagacaagctgtaaaggccgggcgtggtggctcatgcctgtaatcccagcactttgggaggccgaggcaggcggatcatgaggtcaggaaatcaagaccatcctggctgacacagtgaaaccccgtctctactaaaaatacaaaaaaattagctgggcgtggtggcggacacttgtagtcccagctactagggaggctgaggcaggagaatagcgtgaacctgggaggcagagcttgcagtgagctgaaatcgcaccactgcactccagcctgggcgacaaagcgagactacatctcaaaaaaaaaaaaaagaaaaaaagataagctgtaaaaactggaagtggggaagagtgagaaaactctagcttctccattatgtctttctgccttcaggaaacactgcttcagggtgctttcttgtttcttattttgataaattcagactttttaaacattttcattttcttcttgacttgggaacagtgtttgatttttaaaagccatttaggagccctgaagcttaataaatgagtggctccttctccataggtgaacgggttgttttgcatagggcaataccttttcattttatctgtgtgacgttttctcagtcttatggcattaattttttggaggaggggcagtattgagtgattattttgtcctggagtttgatgtgggttgcctgaacatatttgtaaatcagtacttgtcccaggattcaaatttaggacatggtaggtaagaataggacagtcaagtgttgggaattttaattttctgggacagagattatattttggtgagattacaaagtccagttgactgcagagttaggaactgaaaacccccaatcactcttgtgtatttatcttggtgagtggagcatttcccttcttagctaggtagatgctgggtttatttaaaattggaggttatttttctttttactataaatatttatgaagcaaaataatatttttgtattccttaatgttaagaaattaagacattcatagaatgaacaaggaagttaaaggtaagagcctacgttttcctatgagaactgtaatcctacttattttactagtatttctttactagactgtttaaaaattggttaggaaaccatatatgattagtaagatttagttaaatttttttctgcttttttctctttgtagacaatcaggaaatgaaatcaaggatattggtaagataaaaaaatcattacttttttatatgacaactataattagaaaacataacgggagaccaggtgtggtggctcacacctgttatcccagcactttgggaggccgaggtgggcagatcacttgaggtcaggagttcgggaccagcctggccaacatggtgaaaccccgtctctactcaaaatacaaaaattagctgggcgtggtggtgcatgcctatagtcccagctacttgggatcccgaggcaggagaatcgtttgaacctgggaggcagaggttgcagtgagctggaggttgcagtgagccgagatcacaccactgcactctagcctgggtgacagagtgagactccgtctcaaaaagaaaaaaaaaagaaaacataatgggaaataaaacgcatttatagtaggagcaaaaaatgttaactatccaggattcatttaacaagcaatgtgtaaaactgatgataaggaaaactaaaattctgagagcgatagaagaataagtggagagccatattttgttcttggatgtcagttttcccaaaatcacactgtaaattcaatttacaatctcagtcagaatatcagggaggtttttttttttcctggcagggtggggagatttaaaaaagaaattcaaggctgagcacggtggctcactcctgtaatcccaacactttgggaggccaaggcgggtggatcacgaggtcaggagatcgaaaccaacctggctaacatggtgaaaccccgtctctagtacaaatacaaaaaatgtcgtgggcgcctgtagtcccagctactcgggaggctgaggcaggagaatggcgtgaacccaggaggcagaggttgcagtgagccgagattgcgccactgcactccagcctgggcaacagagcgagactctgtctcaaaaaaaaaaaaaagaagtgccaagtaacgagatattcattgtttgttgcttagcacaaatgaaaaagctggcagttcccagggttgatggtgatgttggggattgcttattctcatgggttgctgataggaggataaattggtaaaaatcttttctggggtgcattttggtaatctgtgtcaaaattaaatgttcatatactttagtaatcactgcttattttccggaggtaattagagagctgtgcagatggtatatgagggtatcatcagggtattgtttaaaactgagaactggaaactgcttaaatagtggaaatttatgaagtccgcaaggagcatagtatatattataattcattgacattagaatattttttcccacatatattgtggactgaaaaagcaggttgcagaatgctaagtaatcatcttgatacgtgtgagtgtgtgtattttggatgtgtgtgtattctggatgtgtgtatgtgtgtatattttggatgtgtgtgtgttttgggtgtgtgtatgtatttggggtgtgtttgtgtgttttgggtgtattttgggtttgtgtttgttttatgtgtgtatttggggtgtgtatattttgggggggtgtattttggggggtatgttttggatgtgtattttttggggctgtgtatttggttgtgtgtgtgtgttgggtgtgtgtatttagtggtgtgtgtacttttggggtacgtgtattttggttgtgtgtgtgtgtattttgggtgtacttacctgtgtattttgggtgtatgtccgtgtgtgtattttgtatatgtgtgtgttttgggtgtatgtgtatttggggtgtgtgtatttggggtatgggtgtattttgggtgtgtattttggagtgtgtgtatttttgggtgtgtgtgtgtattttgggggtgcatgtgtgtattttgggtgggtaggtgtgtgtattttgggggcgtgtgtgtattttgggtatatgtgcgtatgtgtttattttgtgtatgtgtgtgtttgtgttttgggtgtgcatgtatatacctgcccatgtaggtgctctccagaatgagttcatcaaaccgttacgtggagcgggatttcgggggaaatgttactgtcatctttatactttaggtatcatttaacaatgataaatgggaagacaaactggaataatgttggttgtggttcgcagtatattgtgtgacattggtgtgagaggactggcatgtgcctgggtggaattaacatgactgtgatttttaggtgattaaggctgcagaagacagtgcgttgcagtatatgaacttcatgaatgtcatctttgcagcacagaaacaggtgaactgagagcctgccgtttaaagtatttgtttcataacgaaggagtcaatttcattttttgaatgctctactctgaggtattctgactacgtaggcttatgaatgggcaaggaatccagaatctgtattatgttctagtcttttctctattttgggtcctggaccacttgagaatctgatgcattcccaaaacaatatgcactcaaccacagttttgcatagagtttcatggtattcaggtaacctttagcccatccttggaccccatgccaagaatccctggtttgacagtttgctgtataaaccttgcatcagtttctttatcttgttgctgtggcgaagctgtaaaaattcagtatttttactttgcaaagagctgaaatgttcagatgaagtataatacattttcttctttggtgtgtttatgaagaaagaaaacctccttaaaatttcagttttaatgtaaaatgctgctatagccatgcataatgttctctgttgtggagtggcagcatgatgtagtgaaaagagcctggactttggagacatgccgagtggggtgacagctttctcacccgctggctctgtgaccacagcccagccatgtcctgggtgcttcagctgccaaatgcaaatatctgccgtgcagagtcacgttgcatattgagtgagctattttaagcatagagtatggcatgtagtaggttctcagtatagggtaatcattattgttattattcctgtaatattttcaaaatgtttcttttagaatattttgattgatgcctgtgttttagactccgactcagggctcctccaacaggtatgttttaaaaccatgctttgtgtcggtggttatgacaattagtgatttttatattgattacaatttaaaatgaaagctttgggtatattgggttaaataaaatatgttattcagcctaattttatctatgtctttcccccttacgtatggagctactggaaaattttaaattacatattgcttgcgttatatttccgttgggcagcactaaaagacaaaaactgaattttactttaacccgaaagggaaacaaaaccctaaagtaagtctgaagaaattactgagtttttgttagatgttttttggccacaaatgttgtttcctaaaggatcagttacaagcacaaaactatgacaaaccctgaatttaggttactgctggggatgaaggatggggagagcgaggtccaatgggaaaatttacatgcttcaaaggctctgagattgtactgtttcttcagcttgatcgtaggtatatgatgttcattttattatttaaaccatacttacacattatgtatacagactcttgtacatattatatttcagtagtaaaaattcaaaaagtttgaattcattttttagcaacacatttcagtctacacattgtctattaactccaagacgatcttgtctctgccatgaattcacataccagctctacctcctcagccctcacattcatttttctagtccagtcccagactctcctgagttccagacttgcagaatcagccgtgtacgtagtacctcctcttggacgtctggcaggcatcttcagtgtcatgtgtcaaaagcagagagctcttggtttgtcctctcagcctcttcctgctccactggtagccccatctccctaagtggcagtgcagttcactcagcaactcaagcaaaaacctgactcttccttgtctcttctcttccctcctttcataaccatgagcaaatcctgttgattctgcctttaaaatatatcctggctgagctcagtggctcatgcctataatctcagcacttgggaggctcaggcgggtggatggcttgagctcagaagtttaagaccagcctgggcaacatggcgagacaccatctctataaacaatacaaaaaaattagcctatcatggtggtgcacgcctgtagtctcagctgttcgggaggtggaggcaggaggattgcttgagccaggagttcgaagctgcagtcagctacgatcatgccactgcactccagggaaaccctgtctccctcttaagaaaaaaaaatgtgaaagttggttctcagaacagctgtcagaatgaagctttcaaaatacaagattggtgcaaaagtaattgtggtttttgccttttttttttttaacagtaaacactgcaattacttttgcaccaacctaatataaattagaacctgttgctcacttgcttaaaaccctcccatagcctagcatcatacgttgactaaaacccagagtcagggcctgccagggccttccagatgctgcttgctgaggctcctgggaaccttttgccccgcatcttccacactctccctcttcagtccggccccaccgcccccttgctattgcctgaaacaggcctgcttcggccagaggggcgctgcactttctgttctctctgctcgcaagctcttcccgcaggtgtttgcatggcctactccctgcctgccttcacgtctctacttctgtgccacctcctcagagaagccttccctgaccaccattgttagtgttactccctctccccttagcctactttatttttcttcatagaaatgatcataacctataacattatttttgcatttacttacctgatttactctctgccttctccactagaaccttaacttcatgaggatggacactgtgatgtttactgctgtaaccctgcacagtgctctaaaacagttgttaaatgtgtaaatgaatctaacggaccaactgaaccaggactgtactatcagaggagcctcagggtcctaggatcggagctagggttttcagtgtaaatggaagcactgctgtgttaaagcgagaaagctgtgtttatgaaatgaatagatgaatgattgttgggaaaaactattaacatggacaggaaaccttagtgtcagcaaccaggagagcttgagtgttttgtgtctttggaaaactctgaagatagcaaaagtttggaaaaagaggaccaaattcaaaagagttttatttttattttattttattttatttttagacagagtcttgctcttgcccaggctggaatgcagtggcatgatcatggctcactgcagccttatcctccccagctcaaatgatcttcccactcagtctcccaagtatctgggaccactggcatgcactacaatgcctggctaattttttaattttttgagacagtttcactcttgttgcccaggctggagtgcaatggtacgatctcggtgcactgaaaccccaactcctgggttcaagcgattctcctgcctcagcctcccaagcggctgggattacaggtgcccgccactacgcccagctaatttttgtatttttagtagagacagggttttatactctattggttaggctggtatcgaactcctgacctcaagtgatccgcgattacaggcgtgagccaccgcgcccggcctaattttttaaatttattgtagagacagggtttcactatgttgctcaggctggtcttgaattcctgggctcaaacagtcctgaagccttggcctcccaaagtgctgggattacaggcatgagccactgcacctggacaaaaaagtgttatttcttaaagagaacagaataaagccatctcacagtttctttttacataataaaattaacaaaatacaatgaaaacaaatctcataaaaattaaaaatttttgtgcttccaagggcactatcaagaaagtaaaaagacaactgggagagatatttgcaaatgatgtatctgataaagggactagtattctgattatataaagaactcttaaaattcaaaaataagacaaataactcatttcaaagtgggccaaggattgaacagctatttctccaaagatctgcaaatggccaagaagcacatgaaaagatgcttaatatcattaccgaccagggaagtgcaaatcaaaaccacaatgagctattacttcactccactaggacacatgtaatcaaaaagtcagctaataataaatattggtgaggatatagagaaattggatccctcctacattgctgctggaaatgtaaaatggtatagccacttcaggaaacagttcagaacttcctcgaaaagttaagcatagaattaccatgtgactggggaaaccccgtctctactaaaaatacaaaaattagccaggcatggtggcgcatgcctgtaatcccagttactggggaagctgaggcaggagaatcacttgaacccaggaggcagaggttggagtaagccgagattgtgccactgcactccagcctgggcgacagagcaagactctgtcaaaatataaaaataaaaataaaataataataatctgcagtgtcatatcctcctctgattttgtaggcccaaggcattgctcatgagaacctcattcctctggaaaccctaggtaagtgcgagtttggcagcaagccgcctgtgtcttgcaggcttgtgacatcacgggaggactgtacctgaaggtgcctcagatgccttctcttctgcagtatttgctggtaaggagacagcagcggcgaccctgatgcctggagggaaggatgacctctgtgtcctgggaaaggaatggaagcaagatggctggtgctagtactcaggagaagggaataaatggaggccttggagttccaaggcctagaagggtgggcttcatgttatttttttcccatgttttaaataaaagtttcttttgtttgtttgttttacagtgggtgtttcttcccgatcaagatcagagatctcagttaatcctcccacccccagttcatgttgactacagggctgcttgcttctgtcatcgaaatctcattgaaattggttatgtctgttctgtgtgtttgtcaagtaagttaatgtacctagtttttcttttttttctatgttggggggcaggaaaacagtttctcagctgtgttgtttttcagccaccctattgtttctttttttttttaatttacagtattctgcaatttcagccccatttgtactacgtgcgagtaagtatctttgagattgtgtgggtggctaatacttcacagctctagaacattaaaaaatgttttcctctctgtaatttcaggacagcctttaaaatttctctgcctccagtgctgaaagccaagaaaaagaaactgaaagtgtctgcctgaggataaaatattttccccatcttttagagctgttaatagaaattatatagcagattctttgttgggaagactgaaaaaaataaagataggtataggataatttttaatatggtgaccttacagaaaatatttcccaaacatccttttcatcctgtgcttctggaggactgatttgtttgagggaatcattctatgcattatatcctaaaatattctatgactggtttctgtccatgtttgtggctttcatttttttaatgggatgactattagtcaaagtcagcttgtcatgactcatcataggctttctaacctactccctgaatccgggtcctcattgtgaaatgcatgccatacgaaatttgaacgtagctttggaaaaagggactatttgtggagtaatggcattaatcaacatagaacatcttatttgaatcaacagttaacttcagtagtcatgtgaataaaattcttattgtctaaattgagacagcctcagatatttgcagatatttactttttgtctgatatcagtacatatttggacaaagtcatctaaataatagtttgtcaccaaataactacaaaatctcattttaaatgagtaaggagaacgtgtacagaagcaaattttcttcaaaatagttgtgggaagagcttatatgtgaaagcttatgactggttttgagggagaacttactggagaaaatggactctatgttaagtatggttttcagatagaattctttccttttttaatgaggaaaaaaaatccacattaatattgaaactgcacctgtaatcccagcactttgggaggctgaggacagaggattgcttgagcccaggagttcgagagcagcctgggcagcaaagtgagaccccatctctactaaaaatttaaatgtatttattaaaactgttctctagaagctttggactgaatcccaaaagtgtttataagttcaaaagcaaaagtatttgtaatttcaacaacaaaaaatgtatttctttatgtaatcttgaaattattaaaagtccttttagcttctagcacatatttgtacaaagagtttaaggaatggtggctggtttggtttgttttttaaaaatgtttactgacgaggccgggcgtggtggctcacccctgcaatcccagcactttgggaggccgaggcaggcagatcacaaggtcaggagttcaagatcagcctggccagtatggtgaaaccctgtctctactaaaaatagaaaaattagccatgcgaagtagcaggtgcctgtagttccagctactcgggaggctgaggcaagagaattgcttgaatccaggaggcagaggttgcagtgagccaagatagcgcctctgtactccagcctgggtgacagagcgagactctgtatcaaaaaaaaaaaagatcgggcacgttggctcacgcctgtaatcccagcactttgggaggccaaggtgggtggatcacgaggtcaggagtgatcaggctgggtttctgttttgttttgttttgtgagacagagtctcgctctgttgcccaggctggggtgcagtggtgcaagctcggctctctgcaagctctgtctcctgggttcacgccattctcctgcctcagcctcccaagtagctgggattactactctactgaacccatgaggcagaaatttgagaccatcctgcccaacgtggtgaaaacatggtgaaaccctgtctctactaaaaatacaaaaattagctgggcgtggtggcaggtgcctgtaatcccagctactcaggagactgaggcaggagaattgcttgaacccaggaggtggaggttgcagtgagccaagatcaagattgcgccattgcactccagcctgggcgacaagaacaaaactctgtctcaaaaaaaaaaaaaaaaaaaaagtctgtactgataaaacccattgtgtacaaaactttgtatgtaaggaagattttaattttctctttatacaagctgagtcatatttaaataatttgatgttggcttagataatttcagatagattttatattctggatttgtgtttttgttaacaaatatacaaagactttggtgatcactttgcaaatatttgttaatccttgagtttgagaacctgtcttttaaaaataatattttgtatactaattaagtgtaatggaaatcacaattttaagtctaggaaataaagtattatatatactttcaaacaagctagcaaggcttttattattacttttttatttgaaatatcttatatatttggttagttctgtttaacttgtttttaactgttgcccttatgagttattttatataaatttttacaataaaataatttgattttca

SEQ ID NO: 80 - DNA, 31029 bp, Homo Sapiens
agcgtccctagcgcgatggcgtatcggcgcaggcgcactctgccggcaacgccgaggcgcttctgcatctgtgggccgaggtgtgtggcgagcgtccgagcggctggggaaagtggggtgtgggaacactgaggggtcccaaagaaaggggagaggaagagaaaagccccagaagcctgtccaccgggtgctgggggcacagggcggtgtcccccactctctccgggcccttcctggcggggccgcacggcagtccccccctcgtttaatcgtgggtttcctgtggggctagggctcgccctgcgcccaggtgtaagtggaagttaattaaatgggcgtacgctgagtggtttgtttccagcctaggtccgcacgggacgtgatttatttagtgaaggggcacaagatctggagatctggcttgtacttttttcctttggccaggaactacggcttaatctcttcctttggtctcctcatatgtaaaatgaggtggctgaggccgggcgcggtggctcacgcctgcaatcccagcacattgggaggccgaggcgggcaaatcacttgaggccaggagttcgagaccagcctggccaacatggtgaaaccccgtctccactaaaaatacaataaattggcctggcgcggtggctcacacctgttgtcccagcactttgggaggccgaggtaggtggatcatttgagatcaggagttcgagaccagcctggccaacatggtgaaaccctgcctctactaaaaatacaaaatttggcctggcgtggtggcgggcgcctgtagtccccgctgcttgggaggctgaggcaggagaatcgcttgagcccgggaggcagaggttgcagtgagccgacatcacgacactgcgctccagcctgggcgacagagtgagactctgtctcgaagtgtatatatacatatatatatattatatatgtattttatatataatatatatttattttatatataatatataatatgtatattatgtatattatatataatacgtatattatatataatacatatatataatatgtatattatatattatatataatattatattgtatattatatattatatataatatattgtatattatatatattatatattatatatattatattgtatattatatataatatattgtatattatataatatattgtatattatatataatatacagtatattatatataatatactgtatattatatataatatattgtatattatatataatatattgtatattacatatattgtatattacatataatatattgtatattacatatattgtatattacatataatatattgtatattatataatatataatatatattatataatatattgtatattatatattatataatatattgtatattatatattatataatatattgtatattatatataatatattgtatattatatattatatattgtatattatatattatatataaaagtgtgtatatatatacacacacacacacacgatacaacacagtacattagctgggcttagtagtgcatgcctgtagtcccagctactcgggaggctgaggtgggaggatcgcttgaacccaggaggcaagaggttgcagggagcagagatcgcgccactgcactacagcctgggcggcagagccagaccctgtctcagtaaaataaaatataaactaaaaggaggtggttgggctcactgtataatttttgaagcacctttcagaactatcttctttgattcctgtctcccaggatcttaccctttgtcattctcctgaatgggaaaagaaatcctttgaataatggacggtttatacctgggttgggcacactggtgtagagttaggcctcttgcttctattagggctaattgaccttgggtagaattggctggcgagtaagatgtggcattaatattccaagtagactcattttaattttgttaaaaaatcagaatgtcttttttcttaatgttaactgtctttcatagacttaactgttaaatattgacatttaattattttgcctcgtttcagaggcagatccccaaagtatatgaaagttaatgatttttaatttaatgttaccttactctttttattagcattcttcaggtcatctgaaccttctgagaaaacatggtcaacgtcttgaaaggagtgcttatagaatggttagtagttttgatactgcatgagttttaagtttaaatattgaatcttgacttgtatgtatgtcttttctaaaaccctgttgtttttaagatatggatgaaatcaagtctttcgcttttaacaagtggcacagattttgttgcaaagctcctggtgccagatttcagtccctctgttgaattgatggaactggcatgatcagaggcagcatatttgttagatgagtcgtctttagagaaacagtgcttgcattctcctcaaacatgatgaattttagggcctgaaagagttcaggaacttgcttaagtctttaccattacaaactgtggactttaaaaaagagaaaaacaacagagccaaatggaggtttcttaaattcctttaggtacattccagaggagaaactaaaaaccataaatgggcagagttgagttcctcaaagcaatccagtgtccaggaaccccgggaaccctgctctgtggacactcccattgtctgaaaatactactgtctactttcggtgcctctaatatgagccagtgcatggataatgatactgtttactgtgatggcaaggctaaggaggagcaagaccaaaccctaggacactgccaacatttagaacagcactagccaatagaaatctaatgcaagccacagatatagtcttacattttttctagccatcttaaaagtaacgtaaaatgaaacaggtgaagttaatatcttttgtttaaccctgtctatgcaaaacactatgctttgaacacatactaagtcttcaaaaaaatcttcatcttcaaagtcgaatggatattttaattttacagcacatctcacagactaaccgtgtttcaaggactctgtagtgacctgactagtgggctaccttatgcatagtgcagatttggagttttgatacaggagacaccaacaaaggcaactaagaagaaaatagccagtgaggctggagggaggaaagccaaaggaggaagtgttttgtagggatgagcggctgtgttgggcactgattgagaactggcatgagatgaagactggagttttgatgagagccatttgaatggagtggtggggagatgccagattgaagtactgtggaaaaggaaagggaggtgaggaggtggagatggagacttcggagaagttttactgtgatcatgagcaatctcatagagaactggattggtagctgacgaaggacatggtgaggggctcaggttcttgctatttttattttaatgtgaaagactagaatgtacgttgatgagagtaaaccactgcgggggagaggtattcacttggaaaagcaaagggggtgggatctggaccccagaagttctaaacacactgttctgttgtcttttgaaggcactaggtttgatgtacttattttcctattaatttgacataacataaacattttcctcgttggcctttagtgttatttttaaatacagaggatacacatacacagagtgtcagctatcactttttttccctcgtttcttccaattctaagtttaatcttcacccctgggtttgttaaatattcacttctctcttctgagggttttgtgtttttcttggtgttttagattcattcatctagaatttattgggaggagtggcataggtttgttaaatattcacttctctcttgtggggattttgtgtttttcttggtgtgttagattcattcatctagaatttattcagagaagagacatattattagataaggatctaaattagcttcttttttttttttttgacacggagtcttgctctgttgccaggttggagtgcagtggcgcgatcttggctcctggattcaagcgatactgctgcctcagctgcccgagtagctgggattacaggcacacaccaccacacccggctaattttatttttgtatttttagtagaaatggggtttcaccatgttggccaggctggtctcgatctcttgacctcatgatccacctgccccggcctcccaaagtgctgggattacaggcatgagccactgcacccagcctagcttcttttttgttttgggtgtttttgtctgttcattttgccaaatatctagttctccaccattatttcctttcttaatgatgcttgatgcctccttaatcacataattttactccccttgctattctctttcatcccttcccacattcatctttcttgttgcctattctagaataaccttgaaataacttagtctgtttccaaaataatccttttggcatattggttggaattgcattaaacctacgttttaatttgaaaaaaaagatgactggattgcatcttaaagaacaaaactctggggagactctgaagtctcagtgcccggtttgctgtcccgtatctaacctctgaattctacctggtctctctaatgactgtccatcaccttgcacttcagggtaatccccagactagcagtaatagcatcatctggagcttgttagaaatgcaaaatctcagacctcaccctaaatctactaaatcagaattgtgcatacaaagaatcttgttaagatgcatttaaattttgagaagcaataatactgttaatcagcttcagtttaataatgtttccctgtggagaagtgttttgcaccaggactattaaattttattttgcaggttaggtaccatccttgcaaaactaatttttccctttgaagtgaattctaaagtgtagtctgcacaatttttcaaaagggtaactctgtcttcccaaaaacacaagtcttccaaaaagattttgggcctaagaaataacatagattcccaaaggaaagggtatggccagtgctagtggattccctttcacagttagatgcagatgttaggatggtaactggaaaagtccttcagtttccctcatgtccatatttgatgccaaggagaagcctgttaataatatgattatcagtataagtctgtttattacttcataatatccatggattgtatgaagcatttaggtgtattggagtatggaatttgataggtctggagtttacaggcagaccactcaaggatcttctacagctgttgcaggtgaataccaaaattgaggctcagccctggaagccaagttggtttttggcttcatgcaggaaagaattcaagaatgagccacagagtaaagtgaaagcaagtttattaaaaatgagggaataaaagggtggctaccccataggcagagtggagtggggagggtgggaagcaggcgggcctgctaactggctattttatggccatttcttgagtatatgttaaacaaggggtggattattcgtgagttttctggaaaagaggcagggattctgtggaaccaggagtccccagtccagaccatacggggtaacttctagatattgccatggcatttgtaaactgtcgtggtgctggtgggggtggtttttagcgtgcgcatgcattatgatttgtgtatgatagtggtgaaggttgcttttgttgccatcttggttctggctggtttctttactgtatcctcgcttatcggtggggtcttctgacctgttgtttactgtctctcttgtcttggaaactagtcctgctgaattcctatctcacagctgcttccactgtcccaggaatctctccaaattccagtcccatcattgtattaatagaaactgatgtgtaatagcttatatagtgctgatccacatatatcttagattggcttcacttaactgccatatttaaactccatttctatcagttaagtttaactgattttgagtctgcagagatttgctaaagaagtaaaccaaattatgatgatggccatttattctcaccttcagagaattgaaaaatcagggcacttggatataatcttaactcccaagggcttatcaaatactaaaattgaaggctataaaagaagttttatgtttataaatttgcacttttatgtcaaaactgaaaggttggtgaaaatttcctctttgttgggatccaccatcaattgccaggctcacactaagtattctcccaaatctagccaccaagcaattaccaaagcaagcaacacatgaccacagtatgtctgtgtccagttccagatgctggagcagacctctggtataacagttgccacaattggtttggcaagtgcttcagcaaagatttgttgccaaggtgcaaattccaaccagtttacatcacaatagcaaagaatctggagaaatatgtattattaaactacacttatccttatgagtttggcttctaaagctatatcgtttatgagaagcgaagtaagaagtatggcaaaaccagtctaaccattgttctgtttttttctcagcatgtataaatcttttctcagcctttgcctcttagtagggccatgttcgctgaagttttccaggcacccaaaactgtgcctgagatgtgtgtgtgtgtgtgtgtgtgtgtgtgtgtgtgtatacacacacacacacatacacatatatagatatggcttagtaaatatttgtgtactgaataaattttgttaacagaattgagtccaggtttgtgatctcagccaaaatcccaaatttattaatgttcctttagagcctctctattcctacagtgagattcacagtgaataagatgggattcttgataaattaaagttttagtttgaaacagatgtgtatactaggcctccttttagcatgttgtatatcaaaatagcttttaaatgaggaggctgttgtcttccagtcatagcttttaaaaagcaagcaccccaccaagctgctgatggaagtgtaatcccaagaaacaactgtaagcaacttgtgatgggtgttttgtgcttttatatcctttaacacaataactccgtttctataagtttatctttaggaaatcgctgggtgcagtggctcacgcctgtaatcccaacacttcaggaggctgaggcgggtggatggcttgaggtcaggagtttgagaccagcctggccaacatggtaaaaccctgtctctactaaaaatacaaaaattagctgggcatggtggtggacgcctgtaatcccagctactggggaggctgaggcaggagaatcacttgaacccaagaggcagaggttgcagtgagccaagatcatgccactgcactccagcctgagcaacacagtgagaccccatttcaaaaaaaaaaaaaattttaggaaatgatcagaactgccaataaaaatgtatgtatttaatgtgctagaaaaagaaatttgttgattgtggcatattttaatcaaataatatagctgttaaaatatttgcagacattttaagtgattcagggaaatgacactgtacaatgatgttaagtgaaaacacctggattcctgtactaacgctgttttccatgtgacatgtgctatactaagcacttgctaatattaatttagttttcacaacagccctttgaggtaagtgctgtcatctccatttatggatgtacaaagtgagatactttgtatcaattaatcaattgctcagttacatagctattgttaaactgggattttaaatcccggtattctggctccagagcccaggctactaaacgttacatatactatctctccattataaaactaagtataatattgtgtttgcttttgttttttttttgaaacggagtctcactgtcacccagcctggagtgcagtggcacaatcttggctcactgcagcctctgccacctgggttcaaacgattctcctgcttcagcctcccaagtagttgggattacaggtgcctgccaccatgcctggctaatttttgaagttttagtagagatggggtttcactatcttggccaggctggtcttgaactcctgacctcgtgatccacccacctcggcctcccaaaatgctgggattacagatgtgagccattgcgcccagcctatgtttgctttttaaaaggatatacgtatgtcttagaattataccatatatattcataggttaatggttttgtaattgaaatagtaaattgccgagaccagctcggtctgggagaccctaacccagcagcgctagaggaattaaagacagacacacagaaatatagaggtgtggggtgagaaatcaggggtctcacagccttcagagccgagagccccgaacagagatttacccacttatttgttaacagcaagccagggatgagcattgtttctatagattatagattatagattacctaaaagtattccttatgggaaacaaagggatgggccaaaataaagggatgggttgggctagttatctgcagcaggagcatgtccttaaggcacagatcactcacgctattgtttgtggtttaagaaagcctttaagcggttttccgccctgggtgggccaggtgttccttgccctcattccagtaaacccacagccttccagcgtgggtgtcatggccatcatgaacatgtcacagtgcttcagagattttgtttatggctagttttggggccagtttatggccagattttggggtgcctgttcccaacagtaaatcatttgatagggatagaactaattgtaatttaaacctctctgcctatatcctctcacatggtcttggcattttaattgctcatttgagtacctactatgagcaagatgttttagaaatattctgtagtccatcaactttgcagtgtagctatggtactaacattgctgttacagatcacaggctctttggctccctatgtaataaaaattaacacagagctatacagttttcccagatgaggcttttatttcagggtttatccacaaatgcaagggagacagtacagtagtaagaactctgcggctgacccccaaaaaagctgatggggactttttgattaggcaaagcatgggaattgacatcagggataaggtatgcaggctgcgctgggtaaagcacatgaagggtacagtatgtggtcagcatctgtggttgcagtggttatcatactttaagttctgggttaaatgtgcagaacgtacagttttgttacataggtatacatgtgccatggtagtttgctgcacccatctacccgtcacctacactaggtatttctcctaatgttatccctcccctagaccccaacaccccacaggccctggtgtgtgatgatcgcctccctgtgtccatgtgttctcattgttcacctcccacttatgagcgagaacatgcagtgtttggttttctgatcttgtgatagtttgctgaaaatgatggtttccagcttcatccatgtccctacaaaggacatgaactcatccttttttatgactgcatagtattccgtggtgtatatgtgccacattttcttaatccagtctatcattgatggacatttgggttggttccaagtcttagctattgtgaatagtgccacaataaacatacatgtgcatgtgtctttatcatagaatgatttataatcctctgggaatatgcccagtaatgggattgctgggtcaaatggtatttctagttctagatccttaaggaatcgccacgctgtcttccacaatggttgaactcccaccaacattgtaaaagcattcctggctgggcgcggtggctcacacctgtaatccctgtaatcccagcactttgggaggccaagacaggcggatcacgaggtcaggagatcgagaccatcctgtctaacacggtgaaaccccgtctctattaaaattagccaggcatggtggctactcaggaggctgaggcaggagaatggcatgaacccaggaggtggagcttgcagtgagccaagattgtgccactgcactccagcctgggagacagagcgagactccatctcaaaaaaaaaaaaaaaaaaaaagcattcctatttttccacaacctctccagcatctgttgtttcctgactttttaatgatcgcaattctaactggtgtgagatggtatctcattgtggttttgatttgcattactctaatgaccagtgatgatgagcatttttttatatatctgttggctgcatagatgtcgtcttttgagaagtgtctgttcatatcctttgcccattttctgatggggttgtttgcttttttcttgtaaatttgtttaagttctttgtagattctggatattagccctttgtcagacaggtagattgcaaaaatctcccattctgtaggttgcctgttcactctgatgatagtttcttttgctgtgcagaagctctttagtgtaattagatcccacttgtcattattggcttttgttgccattgcttttcttgttttagacatgaagtctttgcccatgcctgtgtcctgaatgaagcccaggttttcttctaggatttttatggtcctaggtgttatgtttaagtctttgatccatcttgagttgatttttgtataaggtgtaaggaaagggtccggtttcagtttgctgcatatggctagccagttttcccgacaccatttattaaatagggaatcttttccccattgcttgtgtgtgtcaggtttgtcaaagatcagatggtggtagatgtgtggtgttatttctgaggcctccgttttgttccattggtctatatatctgttttagtaccagtatcatgctgttttggttactgtagccttgtagtatagtttgaagtcaggtagcgtgatgcctctagttttgttcttcttgcacaggattgtcttggctatgtgggctcttttttggttccatatgaagtttaaagtagttttttccaattctgtgaagaaagtcggtggtagcttgatggggatagcattgaatctataaattactttgggcagtaaggccattttcacgatattgattcttcctatccacgagcatggaatgtttttccctttgtgtcctctcttatttccttgagcagtggtttgtagttcttgaagaggtctttcacatcccatgttaagttgtattcctaggtattttattctgttagtagcaattgtgaatgggagttcactcatgatttggctctctgtttgtctgttattggtgtataggaatgcttgtgatttttgcacattgattttgtatcctgaaactttgctgaagttgcttatcagcttaagattttgggttgaaatggtggggttttctaaatatacaatcatgtcatctgcaaacagagatgatttgacttcctctcttcctatctgaataccctttattgctttctcttgcctgattgccctgtccagaacttccaatactatgtggaataggagtggtgagagagggcatccttgtcttgtgccggttttcaaagggaatgcttccagtttttgcccatacagtatgatattggctgtgggtttgtcataaatagctcttattatgagataataagagatacattccatcgatacgtagtttatggagagtttttagcatgaaaggctgttgaattttgtcgaaggccttttctgctgttgaattttgtcgaaggccttttccgcatcttttgagataatcgtggtttttgtcattggttctgtttatgtgatggattacatttattgatttgcgtatgttgaaccagccttgcatcccagggatgaagctgacttgatcgtggtggataagctttttgatgtgctgctggattcggtttgcccgtattttattgaagatttttgcatagatgttcatcagggatattggcctaaaattctctttttttgttgtgtttctgccagggtttggtatcaggacaatgccggcctcaaaatgagttagggaggattccctctttttctgttgatcggaatagtttcggaaggaatggtaccagctccactttgtacctctggtagaatttggctgtgaatccatctggtcctggactttttttggttggtaggctattaattattgcctcaatttcagaatctgctgttggtctattcagagattcaccttcttcctggttgagacttgggagggtgtatggtccaggaatttgtccatttcttctacattttctagtttatttgcatagaggtgtttatagtattctgatggtagtttatatttctgtgggatcgggttgatatcccctttatcattttttattgtgtctgtttgatttttctctctttcttctttattagtcttgctagcggtctatctattttgttgatctttaaaataaaccagctccgggattcattgattttttttttttttgaagggtttttttgtctctatctccttcagttctgctctgatcttagttatttcttgtcttctgctaggttttgaatttgtttgctcttgcttctctagttcttttaatttgatattagggtgtcgattttagatctctcctgctttctcttgtgggcatttagtgctatgaatttccctctacacactgctttaaatatgtaccagagattctggtacgttgtatctttgttctcactggtttcaaagaacatctttatttctgcgttaattttgttatttacccagtagtcattcaggagcagattgttcagtttccatgtagttgtgtggttttgagtgaattcttaatcctgagttctaatttgattgcactgtggtctgagagacagtttgttgtgatttctgttcttttacatttgctgaggaatgttttacttccaattatatggtcaattttagaataagtgtgatgggatgctgagaagaatgtatattctgttgatttgggtcggggagttctgtagatgtctgttaggtccacttggtccagagctgagttcaagtcctggatatccttgttaattttctgtctcattgatctgtctaatattgatggtggggtgttaaagtctcctgttattattgtgtgggagtctaactctctttgtaggtctctaagaacttgctttacgaatctgggtccccctgtattgggtgcatatacgtttaggttagttagctcttcttgttgaattgatccctttaccattatgtaatggccttctttgtctcttttgatctttgttggtttaaagtctgtttttaatcagagaccaggattgcaacctctgctttttttttttgctttgctttcgcttggtagatcttcctccatccctttattttgggcctatgtgtgtctttgcacattagatgggtctcctgaatacagcacaccaacgggtcttgactctatcccatttggcagtctgtgtctttcaattggggcatttagcccatttacatttaaggttaatattgttatgtgtgaatttgatcctgtcattatgaggctagctggttatttcgcccattaattgaggcagtttcttcctagcatcgatggtctttacaatttggcatgtttttgcagtggctggtaccggttgttcctttccatgtttagtgtttccttcaggagctcttgtaagacaggcctgatggtgacaaaatctctcagcatttgcttgtctgtagaggattttatttctccttcacttatgaagcttagtttggctggatatgaaattctgggttgaaaattcttttctttaagaatattgaatattggcccccactctcttctggcttgtagggtttatgcggagcgatccgctgttagtctgatgggcttccctttgtgagtaacctgacctttctctctgactgcccttaacattttttccttcatttcaaccttggtgaatctgacaattatgtgtcttggggttgctcttcttgaggagtatctttgtggtgttctctgtatttcccgaatttcaatgttggcctgccttgctaggttggggaaattctcctggataatatcctgaagagtgttttccaacttggctccattctcctcgtcactttcagatacaccaatcaaacgtagatttggtcttttcacatagtcgcatatttcttggaggctttgttcatttcttttcattctttttcctctcatcttgtcttcttgttgtatttcatgaatttgatcttcaatcaatgatatcctttcttctgcttgatcaaatcggctattgaagcttgtatgtgcttcacgaagttctcgtactgtggttttcagcaccatcaggtcatttaagctcttctctacactggttattctagttaaccattcgtctaaacttttttcaaggtttttagcttccttgcgatgggtagaacatcctcctttaactcacagaagtttgttattaccgaccttctgaagccaacttctgtcatctcgtcaaactcattctccatccagttttcttcccttgctggtgaggagttgtgttcctttggaagagaagaggtgttctggtttttggaattttcagcctttctgctctggtttctccccatctctgtggttttatctatctttggtctttgatgttggtgacctatggatggggttttggtgtggatgtcctttttggtgatgttgatgctactcctttctgtttgttagttttccttctaacagacaggaccctcagctgcaggtctgttggagtttgctggaggtccactccagaccctgtttgcctgggtatcaccagtggaggctgcagaacagtaaatattgctgcctgatccttcctctggaagcttcatcgtagaggggcacctgcctgtatgaggtgtctgtcagcccctactgggaggtgtctcccagtcaggctacatgggggtcagggacccatttgaagaggcagtctatccattatcggagctcaaatgccatgctgggagaaccactgctctcttcagagctgtcaggcagggacgtttaagtctggagaagctgtgtgctgccttttgttcagatatgtcctgccttcagaggtggaatctagagaggcagtaggccttgctgagctgcagtggactctgcccaatttgagcttccctgctgctttgtttacactgtgagcatggaaccgcctactcaagcctcagcaatggcggtcacccctccccccaccaagctccggtgtcccaagtcaatctcagacgctgcgctagcagcaagcaaggctccgtgggcgtgggacccaccgagccaggcacaggaggggatctcctggtccgcttgttgcgaagacagtgggaaaagtgcagcatttgggctggagtgtattgctcctccaggtatagtcactcatagcttcccttggctaggaaagggaaatcccctgaccccttgcacttcctgggtgaggcgacaccctgccctgcttcggctcgccctccatgggctgcacccactgtccaaccagtcccaatgagatgaaccaggtacctcagttggaaatgcagaaatcacctgtcttctgtgtcgatcttgctgggagctgtacaccagagctgttcctatttggccatcttggaagtgactcagttgttcagctttattttccaaggtgggacactccacaaccttggtttgatacttagatttcctaagtaaaaggcatggttacacatgagagcacagaagaatggctattttctttgtataattaaagccttggggttagcgggtacatcaccagcaaggtagtgatttgggttttctgatcagtgggacaagaaaaggaaaaaaaaaaggaaaaacatgtgaaggaggagccgcatcgaattcctgttctcatttctagttagaagcctgagaagttgagaggttgagtaactttatacattatacatattttggttggcagagctggggtctggggctaggctttctgggtccagtactctctttagacttttgtgtctttgtaacagtaaaacccctattatatgttttcttgggaaaatggtagctgtgtttctggttaacttaatgtctcctatggtgtctcttctcttaagaccctactcatgtaccaaattgttattgagcacctataatgttctgggctctaatctagacacccatatctcagattgaacaaaacccagactcagaaaacactttggaaaatgcttttaaaggggaaataaacctaagacagtctactcccaggatatatggaatttatggagtaatacttaaaaattttttaagtaatatctgttggccagttattatcaagaaagatagtttaccattgactaagccaagattgttctgatggattgtcagtgctgacagctttgaccagactattttacagctcactgcatcatcctggttaccattataccattatcatgctataatccttttcagagtcatactttataggagctatactaagcttctttaggagaaggtttcatgatatctgcccttcacacttccagggcaaagttgtttcttttctgtacaatagccttgatcctgggacttcaagtatgtatatatgctcttggctttgggttttgtttttttttctgctactctcaatatagaagtggaatggctctgtgttcagataggaatattccaggctctttgtgtttcatgacaaaatgtcccttaaactttgagtgtcttttttttttttttaataattaaagagtctttttaaatcattacatgttatctttacttcaggtacatgcttgaaaattcaatctcaaattgtctttcaaaagtttgaggcatgccagacacggtggcacacgcctgtaatcccaacactgggaagccgaggctggaggatcgcccaagcccaggagttcaagaccagcctgagcaatgtggtgaaaccccatttctacaaaaaatacaaaaattagccaggcatggtggcgtgcgcctgtagacccagttagtcaggaggctgaggtgggaggattacctcatccctaggaggttgaggctgcagtgaattgggattgtgccactgcactccagcctaggcaacagagtgaggccctgtctcaaaaaaaaaaaaaaaaaaagtttgaagcgattgatattaaagcgttatttcagtgttcactggccagtcattcctctaagctgtctcatttgtcagttagcatatttccccaagtgtgcggaataccattagtgttcaagatgatttgaagaacatacattttgggggagtagaatagaaaaataggccaggctcaatggctcacaactgtaatcccaacacttttggaggccgaggcgggtgggttgcttgagtccaggagttcgacataacagaaccctatctctacaaaaaaatacaaaaaaaatctgggtgcagtgacatgtgcctgtagtcccagctactgggaaggctgaggtgggagaatcatctgagcccaggaggtcaaggctgcagtgagccgtgatgacgcctactgccctccagcctgggtgacggtgagactctgtctcaaaaaaaataaagagagcaaaaaaattttttatatgaccagtttaatttatttgaggagaagaggaaactgacatatcaaactcttggttttatgccagatgaaacgttagttgatttaaaggcaatttaaagaaaaatattaagtgatttgcaacagagatgttacaagagatggctaaaatagcaaggatggtatacaaatggcaaacattttgaaagcattggtgtgatgattcagcacagatatgagtcctgaggcgcttcttggttttagtggtttagctctgacttcattaagatgatgtaaatttattccatttagaaaattcccaaagtcttcataaccacttaactcttgctgcctttaatacctgttagtagtagccagttactgagaataaattggtgtcatctgaatgtactgagctcaaactgtaacaagttaatctatcacatgcagacagcaatgtttcaatgtccagtttgtcttttattactgttacatttggatccaaagtttattttaaagggctaacacaaaacaactgttggtcctgtaaatcaaaaagtatctgagacaagtctcaatcaattttgaagtttattttgccaaggttaaggacatgcccatgacatatcctcagaaggtccagacaacttgtgcccaaggtgttcgggctacagcttggttttacacattttagggagacaaaatatcaatcaatacatgtaagatgtacattggttcagtctggaaaggcaggacaactcaaagcaaggggaatggggggcgggcttcccggtcataggtagattcaaagattttcttattggcagttgattgaaagagttattatctaaagacctggaatcaatagaaaggaatgtgtgggttaaggtaaagagctgtggagaccaaggttttatcacgcagatgaagtctccaggtagcaggcttcagagttgtttttgttttgttttgtgttttgttttgtgttttgttttgttttgttcttattagacgaagtctccctcttgtctcccaggctggagtgcaatggtgtgatctcggcccactacacccctcacctcctgggttcaagcgattctccttcctcagcctcctgagtaggtagtattacaagcgcctgccaccacgcccggctaatttttgtatttttttgtagagacggggtttcatcatgttggccaggctggtctcgaactcctgacctcaggtgatccacccacctcagcctcccaaagtgctgggattacagatgtgagccaccgcacctggcccagagctcttatcagacctaaaaaggtgccagactcccctggatcagggaaaagacctggaaaggaatggagagtctctacagagtcgattattcccacaagagacagctttgcagggccgtctcaaaatatgtcaaagaaacatattttggtgtaaaatacaatttctttcagggcctgccatctgccatgtgatgctttacaaaagtcaagctggaatttggtgttttattcctacaaaaagtctgttacctgggtcttaagatctctgtttttttgtttgtttgtttgaaatggagtctcgctctgttgcacaggctggagttcagtggcgcgatcttggctcactgcaagctccgcctcccaggttcatgccattctcctgcctcagcctcccgagtagctgggactacaggtgcctgccaccacatctggctaatttttgtatttttagtagagatggggtttcaccgtgttatccaggatggtcttgatttcctgacctcgtgatccgcctgcctcggcctcccaaagtgctgggattacaggcgtgagccaccgcacccggccaagatctctgttttaatgttaatactggtcagctatgcctgaattcaaagggaggtgggtatgaggcatgcccaacccccattcccatcatggcctgaactagtttttcaggttaactttggaatgcccttagccaaggggagggtccatcagtcagttggcagatggggggtggggtgcttagaactttatttttggtttacaatcccattgtgtaaagtgtatactaagaaacctctatgatttttatagaatatattgaagtacttgtggggcctggagagtgaagtgggcaccacggtcatatgagtcctcccttgtttgcaaggaaagcttaattgtagagcactgaagtccaggtttttgtctgactctcccctccccagccatcatacctgtctactgttgaattactctccttttattctccccaccagtccctccccttctacctttatttgtatgtgcaaggaagatttgagggaaacaactaaatttttaaagagtctgagtagaaaaacaatggttttcaagaaactgaaactttggtttctctgtcctataggcctcattttcctttctgcaatatcatcgggaagcaccctgtttaacctgcttcatcaaccccacgttccttctagaattgctcttcaagcttttttctattttatgtttccacctgtgctctttgtcaataattaatcaattgtttacctctgaaatttctcagtgtacagtgtcttactgttctagaaaatcttttcatttaaattcttattctgtataatactcaaattagagaattgctgaaaatgtgaagtttaacatttttttgtatctgcttaaatcagtgaccattatgctctgtttgtaaaataccccattcatcctcctgtcaccagctgttgttgccattcagttgcatgtcagtgtcatcccggagatcctcattctcattaagccttatatgccgatttttcctttttttcagtcacccaataaaccacagactcccaagctatctctgtctcttgcattttcatgatctatggccctgttcaccatctcctacccaccaccctcccccacctacccaccgcaatcctttccactttgccctctgggacatagtgagatggcagcagcaggatgccctgtagcctcagcctcttctctgaactttcctttttccttcccccacccaccttttccttttttgctgtgacaaaacctgactttgtcctgagctcactgcttctcccaccaccttatcaggtggtgccttttttcctctacaaaggcaccctcttgtaccattgggtcaggaaacaggatcagtaccttgcttattattgccacttccagaaattctccctccctcttccatagaaacccccagttatcaatcccagatcatcagagtggactacccaccaaccctcctctttataatcatctacagacaccccaatctgtcctgaaggttttcccttgaaaaaactatcttcagtagctcttctctcaaatccttagtgatgttagtatccgtgtgggtagtcctttagataccctgttctcccagttccctggcctcctcttccactgagcttgtcctccacctcatcacagccactcattcacatagttgtagctagacctatccttccttaccctcgtgccagctcttcagtctcatttcaggcatctgactctgaccaccacctcctctttccagttcactccctctcatacctcactccatcatttcttcaacttcgccagacctatggtctgttgatattcccatctgttcagagtcccacacctcttcctagcttccagtctacctttctggtcgttgtagcaaaatttctcagtaaagagaagacttggttctcttcactgtctctaatttctttcctcccatatgaaacccactccagtcatgctttccctattatgactccaccaaaactgctattgccaaggtccagtgactttctgaatccagggatcaattttcagcccttgctataccctataagcctttgacagaattgatcactcccacttcctgagtagcctttgttcacatcgctttcaggactctttgggttttctttctacctcggtggtcacttcttactcagcttcttcactcaggggccagtaggcatctcaaaatataacatcaaaaactaaaccttttttttttttagtagagtcagggtctcactgtgctgtccaggctagtctctaactcctgacctcaagcagtcctccagcctaggcctctcgaagtgctgggattacagcatgagccaccatgcccaccctaaaaccaaacttgatcttacctgcagatcttacacattcctctttatctcagtaaaaatctcctccagtcttccatttgctcagatgaaaaatcttggagttttcttgttcctctttctcaaagctcatgtccagtattagcaaattatgttggttttatgtcagtatatatctagaattcaaccacttctcatcacctccactattaccacctacatcaaaatcatcatctcttgcctggatgtcacctcatgggtcccctgcttccatccttgcctctgccactcccagtcttttctcaacccagcagccaatatgatccttacagttaaaatttaagtcagtttgtaagttaaatcatgtcacttggtaaaacccaaagtcccccaaatcagttctgaggctcatactcatctagggatagaagtaaatcccgtgttagcatcagttaatacctgtgcttgtacttaaatcttatttttcttgttttcagtaaattatagtgacatcttttggattaaattgttacctttacaattgatattgacatttctcaagacaccaaaagattatatgagatttttttctcaagaattgcaaaaatctgtggtgcagcttgacatttttatattcattttttgctaaacacattgtgtattagatctaaagagtgtcctttgtcatgattcaaggtttttatgaaagagacattttgctgtaaatctgtactgcccgagaagaaattgtatccctcttttcccttatgactatcctattctttccaaaccaaaaaccacaagttaataaaattgaatttggacctctttccttgaatgcctattacaagccaagcactgtccttgacattatctcctttaatttccgtaaacaattctgttatgtagcctcacttttgaggttgggaacagaggctctgggagattaagtacctattctattcaaggtcacacaagtaagtgatgaagctggggttgaatccaggtatgactcttgatatacaccctgcctgaccaaagtgactgtttaactggttttgtaagttaatttgtcactggtaaaacattgaacacctactggttccttagatgtaatgggcatagacaaggaagaaattcagtgtttaaatcagttaagaaagctgtgattctaggccctactaactacaaagctttcaatattcttttattttttccacttagtgacaaattattctttaaaaatcttgccattggcctctgcctcttcaacttacactaatagttcttttttttttttttgagacagagtctcgctctgtcgcccaggctggagtgcagtggcacgatctccgctcactgcaagctctgcctcccaggttcacaccattctcctgcctcagcctcccaagtagctgggactacaggcacccgccaccacacccggctaattttttgtatttttagtagagacggggtttcaccgtgttagccaggatggtctcgatctcctgacctggtgatccacccacctcggcctcccaaagtgctgggatcacaggtgtgagccatcgcacccggccaacttacactaatagttctaaaatgaagccatgtctataaattgttaacacttgaggcagagaggaagtgagggattgagtaacagaactttaaaaatcattctaaaaattctacatgttcacatttaattgctcaagtctctgtgatgtgatttgacaacaagctgtcttacaatcatgtgtttgtctttacagtgatcctgccatgaagcagtttctgctgtacttggatgagtccaatgccctggggaagaagttcatcattcaagacattgatgacactcacgtctttgtaatagcagaattggttaatgtcctccaggagcgagtgggtgaattaatggaccaaaatgctttttcccttacccagaaatgaaaatactcaatatggaccatttaggaattataagcagcaactgtgaaagacttgccactcaatatcttaggtgactgattagacatagagggttgttttaggagcatgccacgggaaagactgagggatcatgatcatttgttcagaaaaaaagcccctgaactgattttgttaccatagaatttaaaaaaaaaaaaagctttaacagttggctgtaatttggcttttattatcctttattaaaatacaaatgtcaatgcttttcctgcctttttaataccatgtcagtgtaacataggtatttattttgctcatccctgtgatctgtgcatttttgctgcgtggatgtgattgtttggtttcagttagaaacgtcatagatttgctgtttgaatatgccaaggtggggacttagacattatgtacgtctcacaaatcctacctgcataccagtcagctctattgaggaagacaatgtaaaactaatgtaaactacagtttgcatttccctgaaaacagaatattgtttttaagagggttagaaacaaccagtgggaaaggcacatgctgctttgtttagtttttccttgttcaaactttgttggtcacattttcccatctgtattcttttttattaagaaaacagcttagggaggctgaggtgggaggattgcttgagcccaggagtccgaggttgctacaaaaacaccattgcactctggcctggacaacagagagaccctgcctcaaaaaaaaaaaaaaaaaaaaaaaaaattctacttgtaccttattccctatgagaatacttatcaaacttatctaaaaaagaaaaataggaacagccatatgcaaagtcagcccaacaggaaaggacatattagattaaaatacattgcggcctgggcttagtggctcacacctgtaatcccagcactttgggaggctgaggcaggcagatcgcttgagtccaggagtcgaaaccctgtctctacaaaaaaaaaaatacaaaaatctgcctgttgtcccagccactggggaggctgaggtaggaggtcaaggctgcagtgaaccttgatcattgctactgccactccagcctaggtgacagagtgagaccctgtctccaaaaaaaaaagtgtatatgtatgtgtgtatatatagcaagagagagttctgtgatcaattgaaggcaaaaacagtaacactgagaggggctttgcttcccttcctgaagatcatgtcattggggtgggttcctgtaaagggaattttccaagagaaaagagaattttcatgacctgtagactcttacaaatccattttacctgcttccttatggtatgtttattcaaagcacctgtgtaccatatttattcacttacacagcattactgaatctggaaattttcagttaggtatattttacataattcccacccatataactcagtccatacagttcacagttttcattccctcatagcaatgcaaaaaattttgatgagttactactactaaaactagttaagtaaaagatgattcttaagaatttccaggctgggcacggtggctcacgcctgtaatcccagcactttgggaggctgaggcaggcagctcacgaggtcaggagatcgagaccatcctgctcggtgaaaccccatctctattaaaaatacaaaaaattagccgggcctggtggcgggtgcctgtagtcccatctactcaggaggctgaggcaggagaatggcgtgaacccgggaggcggagcttgcagtaagctgagattgtgccactgcactccagcctgggcgacagagggagactccatctcaaaaaaaaaaaaaaaaaaaaatgaatttccagctataccaaaatgttactaatgtatcttatatttcaggcatgtctaaatcaacttttagtatgcctcaggcatttgtcaccaaccttttatattaacatgaaacttagaaaatttttgatagaatcccagagttcaaaaggtattaggatttttgccactgaagtaaaaaagagaaaaaaagatatttatgagaaaactattgaacagtgactgtgttgtacccgagcaagttagaggaacgccacactttgagacgaatttaaaagtcctttatttagctggcagccaagaggtggctcacacttggaattctctcagctccgaggaaggggcttgattttcctttatactttggtttaggaaggggacgggagctcagttgcaacaattctacagaagtaaaaacatgcaaaaaattaaaaagacaaatggttacagagaaacaaacagttccaggtgcaggggctctaaatctatcataagatgtcaggtgtgggggctctgccagacacaaactcaaggctttatggtgtatctcttgagcgaaatcctgggaacttcgtacattgcttgcttcagtaccttatgagttaattggactctttgatatgttgagagtcagcttacacaagttaactccttgaggaaagggggtgggtaaggagtccttgatgtcctgtaaatgaaggaaccaaatggagttcctccggctttctcagctaagggagagcttattcacatggaaacaaggctaggtgattaagggagaaagggacagtctgaaaacaaggttagtaaaaacaaggttaggtattagaactgcaaagagtattaagtgaaataagtgaaggaaaatatgagctcttatttttaaaaagttgtgttggggcaaatgttaaatatctttctttctctggacattattaagaaagatagagtgatgtgaatgataggaagcccacctgtaaccacttagctgacatgtccaactatgggtgaacaggaaataagcgacattcacctaggctgtttattggaatctgactagcattatttgatttggcatactttacatgtccagaacaaggctgttggtgcttggcaccaagaaatttatgactttttttttttttttaaataaagtcctaaaggtagcattaaaatgacttaactggaggcaggaggatcactgaagcccaggagtttgaagctgcagtaagctaagaaggtgccactgcactgcagcctggatgacagagtgaaactttgtctcttaatagaactatggactgaagttgtgatattgagtgttatatttctcaataaaggttttttcttttaatactgtattaggtcaaattcaaggtcttaattccttgaattccaatttccttgtgaaatttcatgtgattaatttaaaattccagggatcctatctaacatcacagttgatggatataacaatgtattttgagaaatcagttttggtgaacagtaacagcattactgataataggcaacaaacactactgcattttatttctgataggcattataggtggtaatccaaatgattaatgattttattgctctttacattttctagaacaggtgatttgacataattgtacttttttctgagaagttggtagtgtacttactactctattttgcagttatacaataaatcttacttagctgacaactaggagtaaaagctctgacaaaaagcctctgctgtaactaaaatactgagatcattctatcttaacaaacttaacagatggggaaggggtatattttaaagatggagaaatgatgcagtttgcaaatatagtcaataaatattctcaagtgtacgtagctcaatttcatttgcagcaaagataacactgaaatgtctatggatgagattattggataaacttttttaaaaacactgttctcaagataggcaagtgattaagagcactgactgggccgggcgcggtggctcacgtctataatcctagcactttgggaggccgaggcgggcaaatcacaaggtcaggagatcaaaacaatcctggctaacaaggtgaaaccccgtctctactaaaaatacaaaaaaattagctgggcatggtggtggacgcctgtagtcccagctactcgggaggctgaggcaggagaatggtgtaatcccgggaggtggaggttgcagtgagccgagatcgtgccactgcactccagccggggtgacagagcgagactcccacccatctcaaaaaaaataaaaatgaaaagcactgattgaatctagattccttgagtccaagtgtcagatctctgcttactagctctgggatctcagatgtttcgttgattggatttctttgtgctcatttgtgtaaacaggaatgcccgtctttaaagactattaaaatgaatgtgagttaacacacaagaggtcttcaaaaagttgatggaaaatgcatattatgaaaaaaattatgcatagatttcaaaaatctttgcagcaaaataaactcatcattataacatgtctgaacaggatctagtttgaggcactaagaaggatatcagtttaaatagagcccctgtcagaacaatatgaattctgctaaaactgaagcaagaacaaacatcaaatttatggcaaagcttaggtggaagaatggtgcaatcattgatgctttgcaaaaagtttatgggaacaacgccccaaggaaatcagtttacaaatggataattcattttaagaaaggacaagacaatgttgaagatgaaacctacagcagcagaccatgccacttcgtgaggaaaaaattatctcattcatgccctacttgaagaggaccaatgattaacagcagaaacgatagccaacacaatatgctcctcagttggttcagcttttataaatctgactgaaaaattaaagttgagcacactttccactcaatggataccaaaaccatccagcccaggtcagctgcagacaaaagcagagctttcgatggaaatgtcaaacaagtgagatcaagatcctgaagcatttcttcaaagaattgtagcaaaaacagacttttaaaaccttgaattcagagacaggtataaagactgcttggtgattttgaaaggactgagatcattttgggagagatcatcttcagaaaatgaccagatacaacaagaatttaacatggcagccaaaccaacccactaacacacatttaaataagatacccaaatgcagaaagaaaagcacagtcgtcatgcaaaatagtcactactcattcaaaaactctatagttgtctgagtcgttatgctcaaaatatccaataatatttcttttgctgagctgtaaaataattattttgcaaacataaaagaaaaaaaaaagaattgtaacagaaacatggctttaccagtatgaccctcaagacaaaatacaaaacaatggctaccaagaggtggaagtggcccagtcacagcaagagcagattgatcaagagcaaaggtcatggtaacagttttttggatcctcaagtcattttgcttgttgactttttggagggccaaataaagatatcatctgcttattatgagagtgtttcgagagaaatccaaagcttagcagagaaacgcctgggaaagcttcaccagagggtcttccaccgtgacagttcccctgcgcattcctctcataaagcaagggcagtttagctagaatttctatcaaaaatcattaggtatccatctcccagtcctgatttggctccttctgacttctttttgtttcccaatcttaaaaaaatccctgaagggcacctgtttttcttcagctaataaaaaagacatggttaatttcccaggaccctcagttctttagggatagactgaatggctggtatcattgcttgaacttaatggagcttatgttgagaaataaaagaaattatattttatttttatcttttaattctatttttccatgaactttttgaagtcccctcagatataaagcagaacgttatgaaactgagttaccttgaatctagaagagtacaatgataaaggggaagatagaaacacacacatatgcgttgttttccccactttcacaatgccgtgcagaaactaacagatgaaggaggagaatccctaaaaacagagcattgggtagctagtccaccagcggtctgatgctttcattgatctcaaaactgtctctgagtaactctaccaggaaagttgtctggagggttaacatttctgaaaccatttttatctttgccttcattcttgaatgataattagtctcgaatgtttggatcacaatccattgaaagactaggctattttttcactgtcctcagacatttactgagtccagtttggactttattttattttattttttttgaaacaagatctcgctctgttgctcaggctgaagtgcaatagcgcaaactcggctcactgcaacctcccaggttcaagcaattctcgtgcctcagccatccctataggcatgcgccaccacactttgctaatcttgtatttttggtagagacggggtttgcaccatgttggccaggctggtctcgaactcccaacctcaagtaatctggcctcccaaagtggtgggattacaggcgtgagccagcgcgcccggcctggacttaacttctgaagaactctttctgtttagattgcaggagcgttctctcggctcatctcttgttttctcacccagctgttcttcttctagttggccatcattcttcatccctccctccctttcctgcagttaattatttctttgaaattttaaaacttcttaatgttgcctggaatacatgagtcttcctgatctcttcaaacggggtttgttttgttttgctttggggagaattcttttgacgtttttgaataagctgttaacaactttaatacctgtcttgtttgttttcttcagaaatttgttaattctccatgattagcacctttatgtggttatctcattattttcattcctttttaattctctgttttaggaatgcttgtcaaattcgtcactaaaattgatttactttcttgaaaacctgtttctgctgctcccaacatgatttaatcttggctactgagcttttggttacgttgcactccctttaaaattactccgtttaagtacagtgttcactctttgggtaatgtgtacaatagaagcccaatccccacctatacccaatatatccatgggacaagcatgtacatgcaccccctgagtctaaaataaaaattttaaaaaaacta

SEQ ID NO: 81 - DNA, 42636 bp, Homo Sapiens
ggaacgccaaccgcctgggcctagcgcagcttcctccgcccaccacggaagtgaggcggggatactaaagcgacggagcccggtggacggaagtgggtgttggaggctttaaggtagctttaaattcgtgttgtcctgggagctcgcccttttcggctggagtcgggctttacggcgccggatggctctggacgtgaagtctcgggcaaagcgttatgagaagctggacttccttggggagggacaggtgaggctctctggaaggacggggagggccccaagcggacagccccgcgccgcctccacctttgcgggttttcccgtggaggccagaggtctggcttggctgctcgttctcgttgggggaaaccgtccagacgcacttgctgcccattctttacatcctgggggtgaatccctgaggggcctctccttgctgaagagtagcctggagctggacggagactgacccgccacgtttccagccgccgcgagtctgctcaggaactctgggctctttgcttcgcgaaatgtaaaaatgcaaaaaggcaaacacaaaaactcccataaacttatgttatttctatttttctttctagtttgccaccgtttacaaggccagagataagaacaccaaccaaattgtcgccattaagaaagtgagttacctttttatgttgtttttaagtctccttgaagatgtctgtattattaattgactgatagccattttattagtcttgaccatactctgataatgagttactcatgtcattttcagagacaaaataattaattagtgctttgtgttcccaaacggaactctagggttgaacccgttttaatttctattgaaatgaagaagaagctgtatgttatttttactgcataaattcatatgttgtgggcaagtactgcccatcttttcggtcctcagaactattggataccatgatctttctaggtcactgtttatacctcacctgcatccactcagtgtgtcgtatctgtattttctgtgtacggatttaccatgaaagactttcactagcatgaacaacattgatgtgaggtctaaaatgagttcagtagcttcttatattcattcaaaagacctgggtcggattcagtagcttcttatattcattcaaaagacttgggtcgggccagccgcggtggctcacgcctgtaatcccagcactttgggaggccgaggtgggcggatcacttggggtcaagagatccagaccatcctggccaacatggtgaaaccctgtctctactaaaaatacaaatattagctgggtgtggtggcacctgtctgtaatcccagctactcgggaggctgaggcaggagaatcacttgaacctgggaggtggaggttgtaatgagccgagatggtgccactgtgctccagcctggtgacagagggagactccatcttaaaaaaaaaaaaaaaaagatttgggtcataattacataactcacgttcacctacattgtttcttttaaccttcaaaacaatctataaagtggttaaaagtaaccctattttatacttgaggtacctgagactgagtgactaggtgacttgtcaagatcacacagctagtgattgctgaagctgggatttaaatccaggtgtcctgatgttgcttttgttaccgttgctactttgaatctgcttctcctgcttcaaaaaccctaactccttggaagttatccatatttaacattaattccccctttttttggtcatcttccagcctccaagtactgtcttgcattcatttaaaacctgactgactacttcttctcaattattcctgccataatttttttattttttattttattttattttttattttttttgagacagaattttgcttgttgcccaggctggagtgcaattgtgcgatttcggctcactggaacctctgcctcccgggttcaagcacttctcctgtctcagcctctccagtagctgggactacaggaacctgccaccacgcccagctaatatttgtatttttagtagagacagggtttcgccatgtcggccaggctggtctcgaactcctgacctcagttgatccacccacttcggcctcccaaaatgctgggattacaggtgtgagccactgtgcctggccttctttttttttttttttttttttttttaacttttttactttttttatgtccgtgttttctggtttatgttttatgatccaccactacagccactccctttaaaacccttaactctactgaatctttcttcatctttctttcttttgtggtggcggggcaggaggaggtctcactctgtcgcccaggtggaagggttagagtgcagtggcacagccatagctcactgcagccaccaactcctggactaaagtaatccttccaccccagcctccaaggtagctgggactatagacacatgccaccaagcctggcctagtcatctttttaattctgtctctggttcactatatcatagccacactgacttttctgtccctgtacaaattaaatttattccagtcccagaatcacaggatcattgcatttggtctggcttcttggttggtatattttccgtctagaacatggcatggctgattccttatcatccaggcttcactcaaatgtctcctccatagaggcctttgttcattccagctacatgtatgcctccctccttccctatgctttgctatatttctgtcatcgatgtggcatttgtcgaaatttgaaatcctcctatctatgagtttattgtctgtttaattccattcacactgtacctagggccatggctagtacatttgtagacactgttaaaaatgtattggcctttcagctgggcgcggtggctcatgtttgtaataccagcactttgggagctcgaggcaggcggatcacctgaggtcaggagttcaagaccagcctggtcaacatggcgaaacccctgtctctactaaaatacaaaaattagccaggcatggtgcccctgctagtctcctggcctcaagtgattgtccttgcctaggcctccctaattgctgggattacacgtgtgagtcactatgcctggcctatttcttgaggtgttttttctcccccagttttagacgttgtctatactttctactatgaacattgaggatttggtgttgtagaccttattccaacactcataatttctactcccgttcatttgctaggatgtgtttaattttataaaaagggaaggaatcaataaataagttactctgtactcattcacctgttgagtcttggactttagaaatactgatgtatctcatccttttaaaaagattatgtggaatttgtttcccaatttatttaaccaatcacctattgatggccttttgggttatatctcatttttcagtgtgtgtcttaaatctgtgtatctcaaaacaatatatagtattgcatactttttttttcctttttttttttttttgagacagcaacttgctgtgtgtttccctggctggagtgtagtggtacaatcatagctcactgaagccttgacctcctggtctcaagcattccatctgcttcagcctcccaaccagctaggagtacaggtgcatgccaccgtgccccactaaatttgttgttcttcttgtagagacagggtctcactctgttgactagactggtcttcaactcctgggctcaagtgaaccttccaccttagcctcccaaagtgctgagattacaggtgtgagcccctgtactcagccagtattgcatactttaagctatatatgtatatttggcatattcttctgcaacttgttattcttttttttttattttatttttttttttgagacaaggtcccactctgtcgcacaggctggagtgcagtggcgtgatctcggctcactgcaacctccacctccccaggctcaagcagttctcctgccgcagcctctcaactgctgacctcaactgatctgcccacctcggcctcccaaagtgctgagattacaggcttgagccaccacacccagcctgcaacttgttattctgagtcaacattatttccgaaatcctctatatcgtatgatacatgtagatccagttgattcatgctcgttgattattagattccattatatgactacactgaaattttctatccaaactctcgttgataaacatttaggctgctttttaatgttttcctttaatacattccttctctggatagtcatctgtgagtcatcttgtatgcaggtttgagtttctctagagaatgtatctataattgaaacaaattatgaattgatgcttcagagtatcacaaccatcagctttaccagatatggtcaaattgctctccagaatgattggaccagtttactgtcccaccacattctcaacatcatttgcattgtcagactttaaaacgtttgtcaattacgtagattgaaaatggtatgtacttattgtttcaattaacatttctctgattactggtaaagttcatcatcttttcttacacttactggcttcttagattttctcctgttttctgttggattacgtactttttttgtcctattgatttattggacttattcatactttttgttttttttaatagagacaaggtttcactttgttgtccagtctggtatcaaactcctggccttaagcaatcctccagcatcggcctcccaaagagctgggattacaggtgtgaaccacagcaaccagccagaattcttttatattctggatattgatcctttgtcagaaatacacattgcatatatcatttcccagtctttggcaaggcttttagtttatttatggtatctttgaggtactgaaagttaaattttaatatgattgaatttgttaatttttttgaaatctttaaaggcttcctttttatgtgctttcctgtttctggattacaaagaattctgtacttgtaaaatttttaaaatattgattttaatacttagatctttattccatcaacaagtttttcctttgttgtatgatatgaggatccagtattttttttttttttcaatagagacagggtctttctatattggccaggctggtcttgaactcctggcctcaagccatcctcctgcctcagtctcccaaagtgcttggattacaggcatgagacactgtgcctggctaagattgagtattttttcttcagttgtcccagtactattaatagtctgtccttttcccaatgagttgtaatgccaaattccccatacccttgcaataccaagttccagtattggaacttgggtccaatttctgggcacactattctgttccagtggtgggtttgtttgttttttttcccattgctgttgaaatattacagtgactttaagaagtcttaaaatctgtcaacttccatacaccttgtttttcttcttcaaaatcattttggctactctatgagacagttgggaaatgtgaatcaggaaaatttgaataggaactagatattagatgctactgtggcattattgttaattttgttaggtgtcaaaatggcatggttatgtaagaatgtctgtattttagagatgcttacttaagtacgttggagtgaaatgacatgaagtctggggttttaaaatattttaggcaacaaaaaggagaggttggatgaatgaagtaagtgtggcaaaatattggtcactgttgaatctgggtgatggagtagagggctttatgaaattactctattttttattatgtgggaaaatgttaagaattttaaaatcaactgttcttagctccttccttttttgagacggagtctccctctgtcgccaggctggagtgcaatggcgcgatctcggctcactgcaacccccgcctcccaggttcaagcagttctcctgcctcagcctcccgagtagctgggattacagacacatgccaccacacccagctaattttttgtatttttagtagagacggggtttccatgttgaccaggatggtctctatctcctgacctcaagtgatctgcctgccttggcctcccaaagtgctgggattacaggtgtgagccaccgcacctggcctcttttatttttgaatggtactctttgtgtatatgcaccacattttctttattcattcatttgttgacagacgcatagattgcctccaaatcttggctattctgaatagtgctgcaataaacatgggagttcagatatctcttggacatacagattctgttggcatatatacatagcaatggaattgctagatcaaatgatagttctatttttagttttttgaggaacctccaaactgtcctccatagtggttgtactaatttacattcccaccaacaatgtacctagggttcccttttctccacatccctcaccaggattcatccttatcttttggataaaagccatttaaacttaggtgagatgctctctcattgtaggttttttcttttttttttttttttttttttttgagacggagtcttgctctgtcacccaggctggagtgcagtggcgcaatctcggtttactgcaacctccgcctcctgggttcaagcaattctcctgcctcagcctcctgagtagctgggattacaggtgcacactgcatcaccacacccggctaatttttgtatttttagtagagacgtggtttcaccttgttggccaggctggtctcgaactcctgaccacgtgatccgcctgcctcagcctcccaaagtgctgggattacagacatgagccaacgggcccggccctcattgtagttttcatttgcatttttctgatgctcagtgatgttggcaccttttcttatgctgtctgccatttgtatgtcttcttttgagaaatacctactcagatctttcgcccatttttaaattggattattagatttttttcatatagagttgtttgagcttcttatatattctggatattaatctcttatcagatggatagtttgcaaatattttctctcattctgtgggttttctcttcactgtgttgtttcctttgctctgcagaagcatcttaacttgatgtgatcccatttgtccatttttgcattggttgcctgtgcttgtggggtattactctagaactctacccagtccaatgttctggagaggttttccactgttttcttttagtagtttcatagtttgaagtcttcaacttaagtctttaatccattttgatttgatttttgtatatgatgagagatatgggtctagtttcattcttctgcatatggatatccaattttcccagcaccacttatttattttgtttgcaacaaagaaagagtttaattgtcacagggccaaccaagtgaggaagacagtagataattctcaaatctgcctccctgagaattcgggggctagggtttttcaaggatagtttggtaggcagtgggctaaggaatggggaatgctgattggttgggtcttggataaaattgtagagagttgaaactgtcttcttgccctgactcagttcctaagtagtggtcacagaaccagttgagtcagtttcttcatatgggctcctggtccaagtggcaccagttggtccatcaaaatgcaaggtctgaaagataccccaaccaccagttttacgttttacaatagtgatgttatctataggagcaattgtggaggttgcaaaattcttgttacttttggctacataactcctaaacaataattctaacctcgtgtaattttacaaagatgcttttagtctctgagcaaggagtgggttaattttgggaaaggactgttaatcatctttgttttaaagctaaactttaaactgaatttctcccatagttagcattgccaacactcaggaatgagcaaagagcttgtgagattaaaagcaaagatagggccaggcgcagtggctcatgtctgtaatcccagcactttgggaggcggaggcaggcggatcacctgaggttgggagtttgagaccagcctgaccaacatggggaaaccctgtctctactaaaaatacaaaattatccgggcgtggtggtgcatgcctgtaattccagctactctgcaggctgaggcaggagaattgcttgaacccaggaggtggaggttgcagtaagctgagattgcacctttgcactccagcctgggcaacaagagcaaaaactgtgtctcaaaaaaaaagcaaagatggagtcagctatatcacgttttactcactgttgtaatttttgcaaaggtggtttcaaaaatatgcctttttggcatgttgattgttgtgagctggttatcctgagaaactgcagatacaggagtagttctgaaaagttgcccttttttaagggaagtgtacgtttgtaaaggagtatctctttgacagggtgtctccctctctgcaccaggaagagaagaaagactagaaagactaaatctctagagactgtcaatgcagaaggcatcaacttaagtctgtacagcaaacctaacctctgcttaaggcacagcaccatttattgaagaaactgtcttttcctcattgtatgttattggcaccattgttgaaaatgagtttgctgtagatgtatggatttttttctgggttctctattctgttccattggtctgtgtgtctgtttttatgccaatatcatgctgttttggttattatagctttgttgtatgaagtcgggtaatgtgattcctcccttttgttcttttttcttaggatagctttggctattctgggtctttgtggttctacacaaattttaggattgtttttcctatttccatgacgaatgtcattggtatattgatagagattacattgaatctatagattgctttaggttgtatggacattttaacaatattgattcttccaatccatgaatatgaattatctttccatttttttggtgtgttgtcttcaatttctttcaccaatgatagttgttttttttttttttttttttttttgagatggagtctcgcactgttgcctgggctggagttcaatggtgcaatctcagctcactgcaacctgtgcctcccgggtttgcgccattctcctgcctcagcttcctgagtacctgggattacaggcgcataccaccacagctggctaattttttgtatttttagtagagacggggtttcactatgttggccagactagtcttgaactcctgacctcgtgatccgcctgccttggcctcccaaaatgcggggattacaggcgtgagccaccatacccgttcagtagtttttattttagagatctttcacttaatttggttaattcctagatatttaattttatttgtagctgttgtgaatgggattactttcttgatttctttttcagattgttcactgtgggcatatagcagggctactgatttttgtatgttgatttttgtatcctgcaacttttgtgaattatcagttctagtcgttttttggtggagtctttaggttttcccaaatataagatcatattgtcaccaggtgtggtggctcatgcctgtaataccagcactttaggaggccgaggtgggcggatcacctgaccaacatggagaaacctcgtctctactaaaagtacaaaaaaaattagccaggcatgatggcgcatgcctgtaatcccagctacttgggaggctgaggagggagaattgcttgaacctgggcggtggaggttgtggtgagccaagatcacaccattgcactccagcctgggcaacaagagcaaaactccgtctcaaaaaaaaaaaaaaaaaaaaagatcatatcgtctacaaacaagaagaatttcacttctttgcttgctcttgctaggacttccagtactatattgaataacagtggtgaaagtgggcattcttggtgtgttcaagctcttaaaggaaatcagtttttccccattctgtatactgaccatgggtctgtagtatatggcttttattatgttgagatatgttcttctatacccagttttttaagagtttttatcatgaagggatgttagattttatcaaatgctttttcagcatcaattgaaatgattatatagtttctgtccttcatttgttgatattacatatcacgttgattgattatagcatatgttgaaccatccttgcatccccaggataaatcccacttggtcatgatgatctttttacgtattgttgaattcagtttgctagtattttttgaggatttttacatgaatgtacatcaggatattggcctgtagttttcttactttgatgtgtctttgtctgattttggtatcagggtaatactggccccatagaatgagtttggaagtatttacttctctgtttttttggaatagtttgagtagtattggtattagccccctcccctcccccgtcctccctccttttcccctcccttccccctccccttccccctccccttcccctcccttaccctaccctcttatttttttaattttttttttctcgctctatcgcctacccaggccctggagtgcagtggcgtcatctcagctcattgcaacctccacctcctgggttcaagtattctcctgcctcagcctcccaagtagctgggattacaggcatgcaccaccacgcctggctactttttatatttttagtagcgatggggtttcactatattgcccaggctggtctcgaactcctgacctcaagtgatcggcctgcctcagcctcctaaagtgctgggatagccactgtgcccagcctagcccttcttcaaatgtttggtaaaattcagcattgaagccatcaggtcttgggctttttgctgggagattttttattatggcatcaatctcattacttgttactggcctgtttaggttttcagttttttcatggttcaatcttggtaggttgtttgtgtctaggaatgtatctgtttcttctaggttttccagtttcttggcgtatagttactcatagtagccactaattatcctttggatttctgcggtattggttgtagtgtccccttttttcacatctgtttttatttatttgcatcttctctccttttcttttagtctaaaggttgggtaagttttttagtggtcagggtttttattgggactggtcatgcaggcattttctgcctggcatgtaccaaaaatccagacttaatcatggcgaaaggtgaaagggaagcaaggcacctcttatggtggcaggagagatttttttttctagagcaggagtggaagtttgtttgtttgtttgtttgttttttgagatggagtctcgctctgtcgccaggctgggagtgcagtggcgcgatcttggctcactgcaatctccgcctcccaggttcaagtgattctcctgcctcagcctcctgagtagctgggattacaggcgcatgccaccacgcctggccgatgtttgtatttttagtagagatggggtttcaccatgttggccaggatggtctcgatcttctgacctcgtgatctgcccgcctccgccttccaaagtcctgggattacaggtgtgagccaccgcacccggccagaagtttattaaaaagctctagaagagtaggaaagaaatgaaagtgcacttgggagagatccaagtgggcaacttgaagaacatgtgtccaattttgatggtcttttcaaaacaccaacttgttattttgttgatcttttgtatttttttgtttcaatttcatttatttctgctctgatttttattattttcttctaactttgggattggtttgctcctgcttttctagttctttaagatgcatcattgtttatttgaaggttttgtttttggtttttttttttcatgtaggcagttacagctataaacttccctctgagtactgctttccccgtatcccaaggtttttggtatgttgtgtttccgttataatttctttgaagaaatttttcaattttcttcttcatctgtccattgacccactggtcattcaggagtgtattggttaattttcgtgtattacatagtttccaaaattcctcttgttattgatttctggttttatcccattgtggtcagaaaagatatttgatatggtttcagttttttggaatgttttaagacttgttttgtggcctaacatatggtctgtccttgagaatcattcatttgctgaggagaagaatgtttaatctacagccattggatgacattttctataaatatctattaggtccatgtggtctgtagtgcggattaagtccaatgtgtctttgttggttttctgcattgatctgtccaatggtgaaagtgggggtgttgaagcctccacctattattgtatggggtctgcctctttagtgctaaaaatattttatatatctgagtgctccattgttgggtgcatatatattttcaatttttatatcctcttactgaattgacgcctttatcattatatagtgactttgtcttattttacagtttttgcttgaaatctattttatttaatataactactcctgttcttttttggtttccattggcagtgaatatcttttttccatgtctttcagtctgtgtgtgtctgtatagttaaagtgtgcttcttgtaggcaacagatctttggggcttcttttttttttttatccattcagtcactctgtgtcttatgattgaagcgtttagcccatttatattcagtgatattattgataagaacttttattcctgccattttcttacttgttttctggttgttttgtggtctttccttccttctgtcctttcttcctgtcttccttgtagtaaaggtgattttctctggtggtatgttttaatttcttaatttttatttttttgtgtatctattgttatgtttttagatttgaggttacatgaggcttgcaaataatataacccattattttaaactgatgacaacactgattacataaacaaaccaacaagcaaaaagaaaactaataaaactctgcgttttaactttgtctccccactttgttgtactgtcttgaaaaattgttattgtttttgattggttcattttttatctttctgctggatatgagtagtttacataccacaattacagtgttataatattatgtgtttttctgtgtacttactattaccagtgagttttgtaccttcagatgatttcatattgctcattaacgtcttttctttctgattgaagaactccctttagcatttcttgtaggacaggcctggtgtttataaaatctctcagcttttgtttgtctgggaaagtctttatttctccttcctgtttgaaggataattttgctgaatatactattctaggttaaaagttattttccttcagcactttatatcatgccagtctctcctgtcctgtaaagtttctactgaaaagtctgctgccagatatattgggggctccattatatgttactggtttcttttttcttcttgctgcttttaggatcctttctttttcttttcttttttttctttttgagacggagtttcattcttgtttcccaggctggagtgtggagtgcaatggcatgtcgttggctcaccgcaacctcctcctcccgggttcaagcgattctcctgcctcagccttcccaagtagctgggattatagtcatgtgccaccacgcccagctaattttgtatttttagtagagacggggtttctccatgttggtcaggctggtcttgaattccctacctcaggtgacccaccctcctcggcctcccaaagtgctggaattacaggtgtgagccacagtgcctggcctaggatcctttcttattccttgacttttagagtttgattattaaatatgttgaggtagtcttctttgagttaaacctgcttggtattctataaccttcttttctttttttttttctttttttttttttttttggagacggagtcttgtttttcttgcccaggctggagtgcagtggcacagtcttggctcactgcaacctctgcctcctgggttcaagtgattctcctgccttagcctcctgagtagctgggattaccagcgtgagccaccgtccccaggtcccagtgttccataactttcttgtacttgaatattggtacctatttctgcatttgggaagtttcccgttatccctttgaattaactttcttctttgcctctctctctctacctcctttttaaggcccaaaacacttagatttgcccttttgagcctgtcttctagatcttgtaggcacgtctcatttctttattttttttcttttgtctcctctgttttcaaatagcctgtcttcaagctcattaattctgccttctgctttatcaattctgctattaaaaggctgatgcggctggacacagtggctcatgcctgtaatcccagcactttgggaggccgaggtgggtggatcacttgagctcaggagtttgagaccagcctgggagacatggtgaaaccccatctctacagaatatagaaaaattagcttgacatggtggtttgtgcctgtggtcccagcttcttgggggggtctgagtggagaggatggctttagcctgggaggcggaggttgcagtgagccgagattgcaccactgcactccagcttgggtgacagagtgacagagcaagactctgtttcaaaaaagggaaaaaagtgtgggtatggtggctgacactagtaatcccagcactttgggaggccacggtgggtggatcatttaggtcaggagttcgagaccagcctgaccaacatggtgaagcctcgtctctactaaaaatacaaaattagctgggcatggtggttcatgcctgtaattccagctacctgggaggctaaggcagaagaattgcttgaacccaggaggcagaggttgcagtgagctgagattgtgccattgcactccagcctgggcaacaagagcaaaactccgtctccaaaaaacaaagactgatgcattcttgagtatgtcacttgcatctttccactccagaatttctgcttaattctttttaattctttcaagtatttgttgaatttacctgataggattctgaattccttctctgtgttatcttgaatttctttgagttttctgaaaacagctatttcgaattctctgactaaaaggtcacatatctttctctgcaggattgacccttagtgcctaatttagttcatttggtgagggtatgttttcctggatggccttaatgcttgtgagtgttcactgccatctgtacattgaagagtcaggtatttattatagtcttcacagtctggacttgtttgtaccattcttattggaaggtattccaagtattcaaagggaatagagtgttgcaatctatgtctttggtcactgtaatcgtatctgcattagggggtaccccgaacccagtaatgctgtagttcttatagacttatagaggtaccatcttggtggtcttggataaggtccagaattctctgtattaccagactctgtattaccattctttcttcccctttcttcaggcagaggagttgctcctgtgtccatcagcaccacaggcccatgaagaggggattattgccagggtaccaccagtgttcacttaaggcccagggctcctcagtcagcttatgctggatgctgccaggcctgggactcatcttcagggtagtgggttcccctctgttccaggggtaggtccagaaatgccatccaagagccaaggcctggattcatggaccctagtagcccacctggtgctcttccccagggcaaccaagctggtccctaagctgcaagacagaatctcctttactcttccctctcattttctcaaacaggagtctctgctggtagccactacagctgtgaatgtgctgtgtcatacctgaagccaatatgtctcggagtttcacctgaggcccatggtgaggccctggttaccactgctgattattcagggcccaggggctctatagtgagcaaatcatgaatcctaaatggtctactttaagaaattctgtgggtttttttgtttgttagaagtagaatcgcctgttctgttgcccaggctggaatgcagtggtgcaatcatagctcactgcagcctcgaactcctgggctcaagcaatcctcccacttcagccttccaagtagatggaactacaggcacatgcaaccatgccccggtaactttttttttttttttttcgagacagagtctcgctctgtcacccaggctggagtgcagtggcacgatctcggctcactgcaagctccgcctcctgggttcaagcgattcttctgcctcagcctcccaagtagctgggactacaggcgtgtgccaccatgcctggctaatttctgtatttttttaatagagacggggtttcaccatattgtccaggctggtcttgaactcctgacctcgtgatccacctgcctcggcctcccaaagtgctgggattacaggcatgagccgccgcacccagccaatgccccagtaactttttacattttttgtagagacggggtcttgctatgttgcccagactgatctttaactcctgtactcaagcaatcctcctacccaggcctcccaaaatactgggattgcaggcatgagccacttgtgtttttgtttttttgtttgtttgagacagtctctctctgttgcctaggctggagtacagcagtgtgatcatggctcactgtagcctgggctcaagcaatcctcctgcttcagcctcctgagtacttgggactgtaggcacgtgccaccactcctggctaatttttaaaaatgttgagtagacacaaggtcttgctatgttgcccaggctggtcttaaactcctgggatcaagcgatcctcccaccttggcctgtcaaagtgttggaatttacaagtgtgagccactacaccccgccagtcttttcttgattactgacagttttctaaaaagcagtgagagaatgttctttacccaggtaatttattttgtgtaagactaaacctgttaatgtaatttgttatgtttattcagagtaacaacattttaaccatcacaatttgtaattttgctttttgaaaaatgtggtgtctaagagcatattattgggcttattaccaactctacagcatgttattttctgtatctttcctcccaagtagcctaatttgaagttacgtatttatttttaatcagggtacccttagttatttggtccacattgaaccttgaaaaggtaaaatagatttttcttaattttattatttgaatgtgtagttcagaaacttaagggacaagggtaggtatttgattctctcttatattgttaattttatctttctgatcatgattcctactctctttttgcctagtaggtacatattggttgctaattgtttttttttctgtggcgaagtatttgaagtatttacacattattcattgattctaaataatttaacacatttttaatatatttgggtttttttccgtttctaccagatcaaacttggacatagatcagaagctaaagatggtaagtatttcatgtaatctgacagataggaaaagttttctccttttttttttttttttttttttttttttttaaaaagacagggtcttgctctgtcacccaggctggagtactgagacacaatcgtagctcactgcagcctcaaacttaggtactcaagcagttctcccacctcagcctcttgagtagctagggctgtaaacatgtgccaccacttgtggttaatgttttattttttgtagagatgaggtctggctgtgttgctcaggcttctctcaaactcctggcctcaagctatcctcccacctcggcctcccaaagtgctgggattacaggcttgagccaccatgcccagcataaagttttcattctcactgaagaaacgagcaaagtatgaattaataagttagtaatggttctggatagagttactgcagggtccccgaagagtaaagatagactcagcatagagaaggagtatttggtgatttttacttactggatattcagagaaacattccaaatcacccacataaatggaaggcagcaagcttaattagtttgtctttctgtcttcattactgttttaggtgttacaagccattgttttttctgtttctgagtttctaattactttgaaaattcaggatacattttcatgaaagtacataaagcttactatggaatagatacatgaggaaattatttcattaaactttcttccaaagtcttatttattaggattcatcataaaatagctcttacaaaagagacccattgtctgtgtaagtgccaatactatatcttatttttattttgtttattttttttgagacagagtcatgctctgttgcccaggctggagtgcagtatcgcaatctcggctcactgcaacctctacctcccgggttcaagcgattctcctgcctcagcttcctgagtagctaggattacaggtgcacaccaccatgcccagccaattttttgtatttttagtagagatggggttttgccaccttggccaggctggtctcgatctcctggcctcaagtgatctgcccacctaggcctcccaaagtgctgggattacgagccaccgcgcccggcctgtatctaatttttaattttgaaatctgtcatttgtattggaaaatatactatcttatcactagtttgcttttagcacaaacaatatgccactaatatttgtagggcaagagtagggaagcttatcacctatatgctgcacacttatatatgttgttagtctagtagtggtgttcagatcctggtatagataaggtgaaatatttttcaccatttgtcgtagtctttgttaagctattttaaaagtaaagcaatattggcctggtgccatggcttacgcctgtaatcccagcactttgggagggtgaggtgggtagatcgcctgagctcaggagttcgaaaccagcctggccaatatggcaaaaccccatctctaacgaaaatacaaaaaattagccaggcgtggaggtgcacacctgtggtcccagctactcgggaggctgaggtgggaaaattacttgagtctgggaggtggaggctgctgtgagccgagatcatgccactgcactccaacctggctgacagggtgaaaccccatctcaaaaaaaataaataaataaaaataaagcaatgtaaaagaacaacagatttgacataaaaattgtcaaagtagcccttatttttgtgggtaatgttcactattttctgagattactaacctttctttaaaaatatgtgtttgtggctgggtgtggtggctcacgcctgtaatcccagcacttcaggaggccaaagcgggtggatcacgaggtcaggagttggagaccagcctgatgaacatggtgaaaccccgcctttactaaaaatacaaaaattagccgggcgtggtggcgcgtgcctgtaatccctgctactctggaggctgaggcaggagaattgcttgaacccgggaagcagaggttgcagtgagccgagatcacgccactacactctagcctgggcgacagagcgagactccatctcaaaaaaaaaaaaaaaaaagaagtgtttgtaaggtttgagatttcagaattattcactttttgctttgcctttttatataggtataaatagaaccgccttaagagagataaaattattacaggagctaagtcatccaaatataattggtgtgagtatgatcaaaactgttactgggatttgggactctgccttttcttaatataatggatgttgattaaaggctcagcaagatgacttgttctggatgagccttgtagaagcttaaaggaaatacattttctatcccagttgttttggtaggcattgtcttcaaaactataccactgattaaataaatgaaatattgacatgtaggctaattttgtcggaaataattttgaagtctagggagctctagcatgtagtggctgagagtgtcaacctgaattcaaaacctttctttctgcctgtgtgagaccttgagtgtgttcactcacaactccccagagtccctgcctcatagggaagttgtgagactagccaattgaatagatgtaaagtatctggaatagtgcctaccatagaaaatgtattcattcattcaatgatagctgctgttatttagaggatttcttaagaatcacatttgggacttttcttttgaattggagactggaatgaggttttcattggttaatttcttaattctaactccaaatatttggggaaagaggttgggtatttttttaagtaaaatttaatatttttatgcttcaaaatactaattcctttagtactgtccaaaaaaggacaaatgtcaaatttaatcaaatgatttaagctttatagggaattaccaacagtttaaatgctttttaaatttttaaaaattgcctcagttgctatgatactgtcaggtattaaatagtgaatcacattttaattttttaactttgcagctccttgatgcttttggacataaatctaatattagccttgtctttgattttatggaaactgatctagaggtaagattaagattcctggagaaattcctttgtcccagtttatcaaacaagaacctaaatatttgttttctacccaagaagatactggtagtaaaagaaaaaaagcttaattttgttgaaatttggatgtactctgaggcaaaaggatctctagttattttcttctaatcatttagtgatatccccagtgttacatacaaagatttggatttcattggcatttctgccttctaagttcccatagctagttgacgtcatttttggagaaatgagcattagacctataagatttgtttgcttttttttttttttgtgatggagtctcagtctgttcacccagcctggagtgcaatggcgtgatctcggctctctgcagccatcacctcctgggttccagtgattctctcacttcagcctcccaagtagctgggattacaggtgccaccacgcccggctaaattttatattttaagtagagacggggtgtcaccatgttggccaggctggtcttgaactcctgacctcaagtgatctgcctgcctcagcctcccaaagtgctaggattacaggcatgagtcaccatgcctagcaacctataagaatttaaaatttatttctggccagtgcagtgactcacgcctgtaatctcagcactttgagaggccaaggcaagaggattgcttaagcccaggagttcaagaccagcctggaccccatagatcctgtctcagctttacaaattatattaaaaaataaagaaacttatttccatataatcagagtaatgtcattcttttgaaagccaagtttttttgtttgtttttgtttttgttttgtttttttgagacagagtcttgctttgttacccgtgctggagtacagtggcgcgatctcaactcactgcaacctctgcctcccaggttcaagcaattcttgtgcctcagcctcctgagtagctgggattacaagcgcccatcaccatgcccagctaaaatagagatggggtttcactatgttggacgggatggtttcaaactcttgacctctggcgatctacctgcctgagcctcccaaagtgctgggattataagcgtgagccaccatgcccggcctctttcttttagataaatacctagcagtggtattgctagatcacaagattattgattagtggtatcgatcacaatattagtgatgctgttatagatcacaatactaatggtattgatcctggaaggacctatcataataggctatggactcaccactaggctatggattgcaccattgcactccatcctgggtgacagagtgagattcccatctcgaaaaaagaaaaaaaaaagaaacaaaaacgtatgccagaattcagttggtacagatgtttggctttattaataattatcaaaactggaacaatccaaacatccctcattctaactgtacaaacaaactgaaatactactcaggaatagaaacacactattgataaatgcagcaacatagatgaatctgaaatgcattatactaagtgaaagaagccaggctaaaaagactatgtattgaaccatttcatttatatgatattctggaaaaggcaaaatgaaaggaaccagaaaccagatcagcggttatgggggctttggggtaaaggaaaggagtaagtacagaggggcctcagggaatttggggaggttacggaactatgctttgattatagtggtggttacatgactggatgcatttgtcaaaactcatggaactatacactaaaaagggtatgctttaccttaaatctgattttaaaaaaagaaaaggggaacttttagttcctaactgataaatctagaataaactgacattaggcacagctcataaataatgccatcaaaactcagtcttacgctttaactaagctccattttcttctctgttgcattcttcatgtgtacagttctcaatatggtgttccagatgcttctaggtatatgtttgtagagtttaataatacctgaggaacgaaagtgctttcttttctttgattctagcacaagtacttggcctggttgattgacttgtcttgtatccctgaaccaatcacttggccaggagactgcagtgtgataatggggatgcctgggtcatgtgcctacctctggaggccttaggttgactcagtcctaccttaaccatgtggactaagctgagaagagatggcttcccaaaggaacactaactgctattgtcagaagatgcaagcagaaacaacaggtgtttgctactttcatgcgaaagcagtagaggacaaagcactgctttcttttcaaaccagaaatgctctccctacccatctaactctggagattttgacagggcttcctgaggaaacttagataacctcttttgagagtctcctgtattgatacttacattttaagtctgtaaattgttttatgtggtagagtttatttgaaataataaagggtacctgtatattgtatacttgctttacaggttataataaaggataatagtcttgtgctgacaccatcacacatcaaagcctacatgttgatgactcttcaaggattagaatatttacatcaacattggatcctacatagggtaaggtttttaatattgcttctttatactagtcaagttttatatagccaatttggtacatagtggtctgaatatgtaaattgtttaacaatgaatttatagctgactgttttatcccatctttttgctatatattattcccttcacttgttccagcagttggtgctgtaaggactccatattactttgtgaaatttagaactggaagagatccagtccctcatttttttttttttttttttttgagatggaatcttgctctgtcacccaggctggagtgcagtggcgcgatctcttgctcactgcaagctccgtctcctggtttcatgccattctcctgcctcagcctcccgagtagctgggaccacaggtgcccgccaccacgcccagctaattttttgtatttttttagtagagacggggtttcaccgtgttagccagaatggtctcgatctcctggcctcgtgatctgcccatcttggcctcccaaagtgctgggattacaggcgtgagccattgcgcccggcctcctcattttttaatagatgaagagctaagttgctaagtgacctgaccatggttatattttttttcaaggttggctgctgataatggacagagtattaaaacataggttttgacccaggcatggtggctcacttttgtgttgccagcactttgggaggctgaggcaagtagatatctcgagcccaggagttctagaccagcctgggcaatatagtgaaaactcatctctacaaaaaatacagaaattagctgggtgcagtggtgcacacctgtagtcccagctgctcaggaggctgaggttgggggatcacctgagcccaggaggtgggggttgcagtgagctgagacctcaccactgcactctagtctgggtgacagagtgaaaccctgtctcaaaaaaaaaaaaaagaacataggtcttttggctttaagttcagtattctttgtgctacaatgttgttgtggggaaaaaaatatagagatggtcttggattaactcatacaatgccaaaatactagaaaagtaatgtttcttgtagctctaaaattcaaggtacaaaatacagtttatgaaatagtgggaacattcagcttttagaacaaagctgataatttagctaggtagatgctagctacctagctatttagataagtagctaagaatatataatttataactagtaattctcatatcgtaagtttggaatccctcttaggttattgctgatgtctttttagcatggattttgaagaatgtcatcctcattcttatacattaacaacgtatattatgaaagttcatatttattattaatagtaggaaccatttattgagtgcctactatgagccagttattacactagactacagaaaatatcagatttaatcctcacagaaactctatgaagtatgtaaattatggcttagtgaaattaagttccttaccaaggttatatattataaccaatccaattttgctttgatgggattttatatcagtgggaaaaaaattgattgtttagatttcaggtgttaccttgtttttgctaagtttaaagttatgccaactaaatgtagcactacagtgttctcccctaccctgcttatttgtttgtttaaaacttccgtcatataggatctgaaaccaaacaacttgttgctagatgaaaatggagttctaaaactggcagattttggcctggccaaatcttttgggagccccaatagagcttatacacatcaggttgtaaccaggtaagaatctcttaaagctacatgtgcaggagtttgatcagaaatgagcatcaactggcttctctgaactatcttggcagagttaaggaatcattgttgatagataccgtcttaaaaaatactgccatttggccaggcgcggtgactcatgcctgtaatcccagcactttgggaggccaaggcaggcagacccacgaggtcaggagtttgagaccagcctggccaacatggtgaaaccccgtctctactaaaaatacaaaagaattagctgggcatggtggcgcacgcctgtaatcctagctactcaggaggctgaggcaggagaattgcttgaaccagagaggcagaagttgcagtgagcagagattgcaccaccgcactccagcctgggcgacagagaaagactccctctcagggaaaaacaaaaaacaaacaaaaaaaaaacctgtcatttttatgttaggtatactttaccacgatgaaaaaatacatagccccttttcaaacagagtctaacttaatcctaagacatttaccttgtaaatgggaacaatttatactttaacattttagttagataatctagaatttcagtggatattcttctacctaatcatctgatttattggacccatttttattatgttggtcagtgctgattctgtatccttctatgtaaatgaaaattctctaaacagagcaatgtcttgatatttgaatttttcatattggtaattatattttccatttgtatttttgatgtgaaaaaacagaaaatcacattaaataggaatgatagattttataatttttgtcccagtggcattttgttaatttccaagaccgttttaaggatctgcaaagattttcaaattctgtattttttctttttcttttttgagacaggatctcgctctgttgcccaggctgaagtgcggttgtgcaaacagtactcactgctgccttgacctcttgggttcaagcaatcgtgctacctcagccttccaagtatctggggccacaggcacgccccaccatggctggctaattttttaaagtttttatagagatgggtttcgccatgttgcccaggctggtctcaaagtcctgcactcaagcgatcctcccacctcagcctccaatagttttgggattacaggtgtgagccattgtgcctggccccaaagtctctattttaaattattttgccaccttcttccaaatagatgtcactgagtataaatcacctaagccctgagtaagaagtaggggatgtgagtaattgtttatgtaattgctagagcagttaagctcaacattcaggaactcatagaaacagggacctgtgtacaagagcattgttaacagagctttctcatctaccagtttctcatattttctctgtctgtaaatcaaatgctgctggtaaatcaaattaagatgaagactctgggaattgacaatgggatttagcagtgtggacatgactgataagcttgataagagcagttttgatggaatggtaaggatgaaagcctgattgaaaaggttctctgtgtgtgtgtgtgtgtgtgtgtgtgtgtgtgtgtatgtgtgtgtggtgttttgttttgagacggaatctggcactgtcgcccaggctggagtgcaatggcgcgatctctgctcactgcaacctctgcctcccgggttcaagcaattctcctgcctcagcctcccaagtagctgggattacaggcgcccaccaccatgcctggttaattttttgtatttttagtagagacgggtttcactatgttggccaggctggtctcaaactcctgacctcgtgatccgcccgcctcggcctcccaaagtgctgggattacaggcgtgagccaccacacccggcctgaaaaggttttaagagaggatggaagaaaaggaattggagacagtaagaatagacaattctttgaactgggcagagaatgaggaggcacctattaggggaggtagggtccagagaagtttaagactggaaaaatactggtatgtttgtacattgttgggaaaagtctagtagaaaacaaaagactgctgtaggagaaaaaggagagaactgcaagagtattatatttaaaacttcatgaaagagtatggtatctagtccttaaagtaagggattgcctttaaaaacagaaaacagacaaggatcgttcatccctagagatagaagtgctttgataatttcatgctaaaatgatactaattctttttgttctttaggtggtatcgggcccccgagttactatttggagctaggatgtatggtgtaggtgtggacatgtgggctgttggctgtatattagcagagttacttctaagggtaagtctaaattaatgtacgcactttaatattgttgttgcagttatttgttctgacagtttgtataagaattcttgtcctaggccaggcatggtggctcacgcctgtaatcccagcactttgggaggccgaggcaggtggatcacttgaggtcaggagttcgaagccagcctggccaacatggtgaaaccccatctctactaaaaatagaaaaattagctgggcatggtggcgggtgcctgtagtcccagctactcgggaggctgagacaggagaatcgcttgaacctgggaggcagaggttgcaatgagccaagattgtgccactgcactccagcctgggcaacagagcaaggctccatctcaaaaaaaaaaaaaaagaaaaagaaaaagaaaagaattcttgtcctgccaatgtctttacaacaaaaagcctacaaatagtccaatttttaaaaagccaaatgtagcattttttaatgttaatatgaaatgagaatatcttccatttaggacaataagaactttactgtagaagttttatacttcagaacatagaaattcacttgtaatatggcagtatctctataacaactaaatatgttcagataaacttttgtcctcctgagggtttttttgtttgggtctgttttaagtgcgctttaggaaatgtataataccaaccactgcagctactactctgtataacttaagccttgtgtgagaccattattttagttctgttgaaacagaacagatacaatgttactatagcatttctgtgactgagaccatcatcttacagtaaaaaaaatcccctgcttcccctcaccagagagaaagatgctgacttggaaacttctctttagctatgaagtttagatctccagaaagactagcccttacgaatgatgaaggtaaagggatacaggggaatccttctgaagctagtttttttctctccatattctgacccctgctctccctctccttaagccatatgtatttaaagaaattcaaaccaagattgaatagcttttttatctccttgaacacagaaaacaacttttgtacaccaaagagaaaaacactaaactaaaaatgtttagtttaagcatagtggtggctcacgcctatagtcccagctacttgggaagctgaggtgggaggatcacttgtactcaggagtttgaggcaagcctggacaatatagcaagaccccaatctcttaaaataaaaaaaagtaaattctgtgcatcattttgagaaacttacccaatgggcatttgtagaagaaacccacacattcaaacttggaaggtaatatgggaatcacagtgctaacagggggtcctgtgaatcagctggcatgataactgctacttacctgaacatagagtataccagaaattcacactgagaatttatcaaccaccacaatccattcatggccaagaagaaaacagaattccatagcccctaatgttatgactgatcactccattgagaaagcaaatgaagagagacagcagttgagagtagacaggttagagattgtggacctgttaacaatcatacttggaaatttattagccattggcattgttgctggaatcatctttaaagttataaggaaaatgacatgcagactaaagaattgtactcttctgccataccttttgtcctattttaagctgttcttgtgctcaattgaaaaggtagaaatgttgcccatatgaatgcttagccagggatcaccagatagttattaaggatcttcagatagtaatgaatacttccaaaatgaaaggcagactgaaacaaactaaaaagaaacttggaaaaaatggaaacaaccaaagcagaagaaaattcaccgcccccagccccctttccaaatattcagagatctaagagattatagtgcatctatagaataagcacaccatacttttttaaaaggggaacaataaaataagagacacttgaactattaaaaatagaagatagccaaaagcaaacaaaaacagtgaaaggaatgggaaagtaagctgcaaaactctttcattaactaaaatcaaaagatgaagagatggctaggcacagtggtacatacctgtggtcccagctacgtgcgaggctgaggcaggagaatctcttgagcccagcagttcaagaccagcctggataacattgtgaaaccctgtctcaataaaaagatagatggactatagtagagaaaagataaaattaacagattgatccaggattctagaatgtaccaacagaaaacaaggaaaatggagggtaggaaatctcaaaatagtgaagcactgctagatgtgaatcgtcagactaaaagtgccatgaagagtacaattatgaggccgggcgcagtagctcatgcctgtaatcccagcactttgggaggccgaggtgggtggatcacccaaggttgggagtttgagaccagcctggccaatatggagaaacactatctctactaaaaatgcaaaattagttgggtttggtggcacatgcctgtaatcccagctactcaggaggctgaggcaggagaatcgcttgaacccgggatgtggaggttgcagtgagctggagatcacaccattgcactccagcctgggcaacaaatgtgaaattccgtctaaaaaaaaaaaggccaggcacggtggctcacgcctgcaatcccagcactttgggaggctgaggcaggcagatcacgaggtgaggagatagagaccatcctggctaacacagtgaaaccccgtctctgttgaaaatacaaaaaaaattagctaggcgtggtggcgggcacctgtagttccagctactcgggagactgaggcaggagaatggcatgaacctgggaggtagagcttgcagtgagccaagatcgcaccactgcactccagcctgggtgacagagcgagactccgtctcaaaaaataaaaaaaaaaatgagtacaattatgaaaattacaaagaaaactttcaaaaaaaaattctaaaggctctgcatgaaaaaaaaaaacctgtgccaagacacactgttgtgaaatttcagaatacgaaggggtaagaaaaatattttatttgcacagagaagaaaagcagcatacatagaaaagaaaataaagtattagggaaaaagaatggcatgagccttctcaacagcagcactggaatctggaagtgttcacattgtgagggaaaatgatgctcaacctagaattctttgcctgttcatattttcagtttgctctgagggtaactacaatttattacatcagaaatttacatctaggccaggcagggcagctcactcctgtaatcccagcactttgggaggccaaggcgggtggatcacttgagctcaggagtttgagacccacttgggcaatgtggtgaaaccctgtctctaccaaaaatacaaaaattagccgggcatggtattgagtgcgtgttttcccagctactcaggaggctgagttggcaggatcactggaacctgggaatttgaggctgcaaggaggtgatatcgtgccacatcactccagcctgggtgacagagcaagacactagctaaaaaaaaaagaaaaaaagaaatcaagaaattagccagacttggtagtgcatgcctgtagtcccagctgcttgggaggctgaagtgggaggattgcttgagcctggttgtcaaggctgcagtgagccacgtttgtgccactgcattccagcctgggtaacaggctggggttcacctttaattgggctctgcaggcgctgccgcactctccacctggtgtgtatagggcatttggggcctttagagggcgcacttgcggtcagcaggctgaagaggctgcggcggcgaaggctggggagctgagctgagctggtgcagagacagcacaggagaaaaacagaaccgaaaaattcacaccgaattagaggagacagaccttgtctcaaaaaaaaagtttagggctgggtgcggtggcttatgcctgtaatcccagcactttgggaggccaaggcaggtggatcacctgaggtcaggagttcgagaccagcctggccaacatggtgagacccggtctctactaaaaatacaaaaattagctgggcatggtggtgggcgcctgtaatcccagctactcgggaaggtgaggtgcttaaacccacaaggcagaggttgcagagagtaaaccaacgggaagacatgagatgcagggaacataagattcaacacaggaaaaaggcagttcaaattctcatttaatagtgaaggaaagttctgggaaagcaggtatgcatcaggcctggagagtagctagtccagattggagcaggtggggtgaggacttcagcaggggtggcttccaggaaaaaaaaaaaaggaaccgatggatatgattggtttagtcatatagaaatcgatatttaataactggaatatttagcttttatataaaccaagttgtcaaagagcaggcattaggagttggtggcggagggctaggaaatcattacctttaggaaaaccaaattgtataagaaggggaattaatcttaattttggctctgcactgagcaaaagttacgtaattatcaaaaatgagagggagatgatgggtcaaagaaccaatttttattataagtctttagtactatttagtgttttaacaaggttcatgtatttaatacaaataagacattttaaacacacagcttaagtcccaaagcagctctttctttagggaaaaatagttttcttagtatggatattttcaaacatgcaaaagcaaagactagtaaaatgagcctctatctatactcatcaaccagtttcaatagtttcaacatatgattcattttatcagtactctcccacactagatatttttgccacaaattccaaacatgtaattttatccatgtttctttagtatttttctctataaggattccttttttttttttttttttttttttttttgagacagagtctttgtcgcccaggctggagtgcggtggcgtgatctcagctcattgcaacctctgcctcccaggctgaagtgattctcgtgcctcagcctcccaagtagctgggattacagccgtgcaccatgacacccgcctagtttttgtattttttagtaaaaatggttttgtgatgttgaccagctggtctcaaactcctagcctcaattgatccactcgcctcaccctcctaaagtgctgggattacaggagtgagccaccacacctggccatctataaggattctttaatcataaccacaataccattgtcatctgaaaaaagtgaacattaattccttaataaaatcaagtctgtattcagattttcctactttttctcataaatgtctttttacataggcttgttcaaattggagtgtgaaatccatacatcagacagcttagtttcatttttacatcatacaaaagcacaccaattcttaaaatttgtttaaattacaaccttgtccacaatttggcctgcaaagtgagggtacaggtgccctacaaaaaacaaaagataatccttttgggtttaagaagaaaattagcatgtctaaaaatagttgtaatattatttaatatccttttagtttttttgttttttgtttttaagatggattcttgttctgtcgcccaagctggagtgcagtggctccatctctgctcactgcagcctccatctcccagttcaagtgattctcctgcctcagcctcctgaggagctgggactacaggcatgcaccaccacgcctggctgatttttctatgtttggtagagagacagggtttcagcatgttggccagactggtcttgaactcctgacccatctagagtaagttaggtgctctttccatgtggtctaggatctcgtacttactcaacacaccgaattgtaaatgcttgtttatgtgtatcagcactgcttaccacctccacctaaggggagggcagggaatgtctcgttttcctcttttaattcctgaggcttagcacaaggcctgttatatgggaagtgtttattaaaatttggagtgaataaaatggatagtaaaggtgctgttttgttggttagcagtggtaggatctaataacgtacccaatacactttgtactaaattttcaatattcgttgcagagtttttaagtttttcttattaaatttatagtatttgtctaacaggtatcaaaaaccactttgaaggccaggcatggtggctgacgcctgtaatcccagcactttgggaggccgaggcgggcaaatcacaatgtcaggagatcgagaccattctggctaacacggtgaaaccccatctctactaaaaatacaaaaaaattagccaggcgtggtggcgggcgcctgtagtcccagctactctggaggctgaggcaggagaatgacctgaacccaggaggcggagcttgaactcctgcactctagcctgggcaacagagcgagactgtctcaaaaaaaaaaaaaaaacccatctctaaggctggcgtggtggctcacgcctgtaatcccagcactttgggaggctgaagtgggtagatcacttgaggtcagggcttcgagaccagcctggccaacatggcaaaacctcatctctactaaaaatacaaaaattagccaggcatggtggcatgcccctgcagtcccagctactcgggaggctgaggcagaagaatcgcttgaagtgaggaggaagttgcagtgagccaggattgcatcactcactgcagcctgggtgacagagcgagactctgtctctctaaaaaaagaaaaaaattaaaaaaaaaaaacccaccttgaaaagtctccctcttactttctttcaggttccttttttgccaggagattcagaccttgatcagctaacaagaatatttgaaactttgggcacaccaactgaggaacagtggccggtaagcctttatgcattttctttgaaatgtaattaggactctgtaaagttcttaaactgtcatatactttatatagtgctgtcacgtgaatattaaagacattcattataatatgtactcagaacactttaaatgataaagtatataaagtaagaagttacaattgtgatataccatcaacctcttgtatacatgtagtcctttccccccaccccagtaatcctgacctcagggtaatcactattaacaattcattgtaaagtcatgttaggagtttataagcacactacgaacataaaagggttgcatgttctttgactccttgacaaaaatgggttcacgtcgtatatatacacggtgtgaagccattatatatataaaacccattacacacacatgcacacatgtaggtgtacatatatgtatatatgatgtttctcttagatttttttaaattattattattttttttaatagagatggggtttcaccgtgatgcccaggctggtctcaaactcctcgtctcaagcagttctgcctcagcctcccaaagtgctggcattacaggcatgagccagcgcacttggctaacatgattttctaaatagtaattgcttactgatgtttctctttgattttttaaaaattaaacttcttggtgggtgcgatggctcacgcctgtaatcccagcactttgggaggctgaggcgggcagatcatttgaggccaggagtttgagaccagcctgggctacagagtgagactctgtctccaaaaaaaaaaaaaaaaaattaaacttcttattttgagaatattattcacgtgcaattgtgaatatataattcacaattatatattgtggctgggcacaatggctcacgcctgtaatcccagcactttgggagactgaggtaaatgggtcacttgagcccaggagtttaagaccagcctgggcaacatagtgagacttcgtgtctataaaaaacaaaaattaaaaaaatttagccaggcttggtggtgcacacattatggtcccagctactcaggaggctgaggtaggaggattgcttgagcccaggaagtcaaggctgcagtgagctgtgattgcaccactgcgctttaccagcatgagtaactgagtgagtccctgtctcaaaactataatagtaatactacagacatatttcacggaccctttacctagcttttacaagatgggagcatcttataaaatcagtacagtatcacaccaggatgctacagtcaagatacagaatatcaccacaagaatctctcatggtattcttttatagctatgcttactttccttctacctactccttaactcttggcaatcactaatttgttctccagctctgtaattttgtcatttcaagaatgttatgtaaatggataaatggaatcacacaatatataactttgtgggattaactttttcatatccatcataaatggaagttcattcaggtcattgcatgttaataattcattctctcttttgttaactgctgagtattgtgtggatttatttcagtttcttcaaccgttcacccattgaaggacatctatatttgtgttgtttccaatgtggggctattaccaataaaactgctctaaacatttatgtacagttttttatataagaatatatttttatttctctgggataaatgcccaggagttcagttcttgagtcatatggtagttacatattaatttttaaataacctgcaaaactccagagcagctatactgttttacattctcatcagcagtaaatgaatgctccagtttcttggaatcctctccagcatttggtgttgtcactttttaattttaggcattctaatgagtgtgtcatgatagctcattttgattttaattttcactgctctaatggttaatggtgttgaatatcttttcttgtggttatttgccatctttagttaaatgtctcttccccattttctgattggattctttgatttttgactgttgagtattgagagctcttcatatattctagatagtagtccaaaaagtgtatgtagtttgcagatgttttccctcgtgctgccttttcatcctctgcaaaattgtaatcaggtttgtcactttttctttaattgatcatccttttggtgtcaagtcaaagagctcttttgcccagcccaaagattttttgacaatttttttttcttttttttttttttttcaagacaagatctggcttgttgcccaggctgcagtgcaatggtgtgatctcagctcactgcaacttccacttcccaggctcaagccatcctcccacctcagcctcttgagtagctggggctgtaggcatgcaccaccacgcccagctagtttttgtgttttttgtagagacagggtttctgcatgtttcccaggctggtctgaaactcgtgagctcaaacgatttgcccaccttggcctcccaaagtgctgggattacaggcatgagccactatgcccttggctgtgacaattttttttgtatttttttctacaagttttgtagttttatacttaagtccaagatctgtttagagtttacctttatatgatgtgtgagacttagggcaaggttcagtttttgtttttttttttctttgagacagtctcactctgttccccaggttggagtggggtctcactttcttgtccaggctggtctcgaactcctgagctcaagtgaccctcctgcctcaatctcccaaagtgctgagattacaagcgtgagctgccacacccagccaagttcagatttttgcacatgtatgtcgaagtgttccagcagtatttgttgaaatgacggtctcttcattgatttagtttttcacttttttcaaaaatccttttggcagatttgtgtggatttctaagtcctttattgagttccattgatttatgtatctctctctctgccaatacaacagagtcttaatcaaagtagctatatgttaaatcttgaaatcaggtaaaatgagtcctcccactttattgttctttttcaaaatcattttagctactgtagtcctttgcctttccatataaattgtagaataattggtcctatatctaagataattttgctaggattttgataaaaattacattagacttgcaaatcaatttgaggataattaacatccttcctctgttgaatattccaatatgtgaacacgatatgtttcaccatttattgagatcttttgatgactttcatcagcattgtatagcttatagtatattaccctatacatgttttgttacatttttcacctgtttcatttttctttttggggtgattataaatagtactgtgtttttaattttgatgtccacatatttattgctagtgtacaaaattacaattgatttttaaattttcaatttatatccttttcagccttgtcttactactagttctaggactttttaatagatttcttggaattttctatataaaccatcatatcacctgaaaatgatttatttcatttgcaatctatatgcctttaatccttaagtttgaattacaaaattatttttacaggacatgtgtagtcttccagattatgtgacatttaagagtttccctggaatacctttgcatcacatcttcagtgcagcaggagacgacttactagatctcatacaaggcttattcttatttaatccatgtgctcgaattacggccacacaggtattttggtgtatcttttttatactaggaaatataaaaataatcttaactgtagcattgataaaaatagaatttcataaaattaacattttttaaatactggaaagatgtgtttttgttttaagaaataacaaactttgtatcttttccccaaactacaaacactattaagactgagattaaattatatgcacacagagatacaggagagtttacacttattacacttgcttagggacatttaaatacatgtctatttcacataattggcttgtaaatactttacttagaaaaagaaaaccaaggctttttatttgttaagaaactggtatatttcagttgagctcttacaaattcatttaaatcttgtagcaatgctgaaagtagtttgttcggcttattttttctttcctatataatgcaatccaggtatgcatgctgatcattctcacattgagaacatggtaatggggaggaaatggtatagtcagatataattgtatgcttacaaaagcttgaaaaatatttgaaataaaacaaaaactgaaactaactgctgtttaaaggaaataacaaactcatgaaaaatttggaagacctagaataacttagggcagagcactgtacaacacagtgcagtgattttacctcatgaagggagagactaatgaaagtgagatcacaggtctttatggaaacatattaatgtacagtaatattaagcatacaaaatagatttttttctctttaggtttgttccaggctacaaaatcattgtttaatgcacttgcttgtataagccttctctttttagcaatgtgtgctatgtgaatatatatggagatggatggatggatggaaggatagatagatatagatggataggtaggtaggtatatgctgggtatttaccattagaattattctcctaatttcttttttaaaaaatttttctttattatttttatgtccatgtgtacacatactcttttaatttcaaacaagtaatttgttgccttttcactcatacttctatgtatattatttccatcataataaacttgagaccacatttaattatctagaaagttgttttcattggtagtatagtttgaaacttaacagaaaaatactagttgttgtatttgggttgtattttaatagaatgaagtttttaaagtgagttttgtttcatggatgtctttattaaagttggaatgaggtattttcttagatctttagcccagaattagcctaatttgcatatagaactgctgtgatttagaagtaatgctttaaaaatgcagctgtaggccggtgcatcggctcacacctgtaatcccagcactttgggaggtgaaggagcaaggatagcttgagcccaggagttggagcccagcctgggcaacatgacaaaacatcatctctacaaaaagtaaataaataaaaaatgaaaatgcaactgttgaagtaaggaatctctaaattactgcaaataatattgggagtggtgaggaatgcttgcaaagtttatatgggcttcatctttcttaaaggattatcctaaaggaagtatttatttatttatttttgagacgaagtcttgctctgtcacccaggctggagtgcagtggcacgatcttgactcactgcaacctctacctcccaggtacaagcgattctcctgtctcagcctccctagtagctgggattacaggtgcacaccaccatgcctggctaatttttggatttttagtagagacagggtttcaccatgttatcgaggctgatctcgaactcctgacctcaggtgatccatctgcctcggcctcccaaagtgctgggattacaggcatgagccaccccgccctgccagaagtattttaaatcattgtagccactggacagcactatgctgctgatgtaaatagacaagcatgtgaacccgggaggtggaggttgcagtgagccaagattgtgccactgcactccagcctgggcaacagggtgagactctgtatccaaaaaaaaaaaaaaagacaagcatgacctgacaaacttgtcatttaggatataattatttttatcagaattgtggacccaagtcaagaaaatgtattgtatctacagcactatagtagggggaaaaaaagagaaaatgtattatagaacattggcctggtaattaatagaaataatcttggagaagcccttccaagtaaaatttctgtccatttgcaatggattgttgaattagaatccattggttccaacctactgtattttttaaaaagccttattttttaagaatttatattttacatgacttggaatttgaatatatatggatagtgtggccaacttgtaagttctttttaagtttctctctttgcattttgaactgtagagttcaatatgtagagaatggaaatgtacaatatttcactaaggatagctcataattagtataggttgagcatccttaatccaaatatccgaaatctgaaatgctccaaaatccaaagctttttgaatgatgacgtgatgccacaagtggaaaattctacacataaggacattaacaaaactttgttttatgtacaaaattaaaaattttgtcaaattaaaaatattttataaaattaccttcagccaggcgcggtggctcacgcctgtaatcctagctcttagggaggcggaggcgggaggatagcttgagcccaggagttcaagacaagcctggccaatatagcaagaccccattctccacaaaaaataagtgtaaaattaccttcagtttatatgtataagctgtatatgaaacataagtttcatttttaatcttggcttccatccccaaggtacgtcatgtatatgcaaatattccacagtccaaaatctgaagcacttctggtcccaagcattttagataagatatattcagcctgtataggctatttaattatggaaaaattagaagggagtctttttttcttttctttttttgatacggagccttgctctgtcgcccaggctggagtgcagtggtgcgatctcggctcactgcaacctctgcctctgggttcaagcgattctcctacctcagcctcccgagtagtggggactacagacatgcaccaccacgcccagcttatttttgtatttttagtagagatggagtttcgccacgttggccaagctgatctcgaacttctgacctcatgtgatccacccgcctcagcctcccaaggtgctgggattacaggcatgagctactgtgcccggccagtcttttaatggaattatcagccaatcttaggatcctaggtatttatttgtagtaatttccatttgcaaatacttgacattaattttgttttgttgggaatgagggcattcacatagtatttttaatgctccctataatcttgaaggtaagattttccttaacacatttcagatactcacctaccttacttttggtatcttttcttttaaaaggcactgaaaatgaagtatttcagtaatcggccagggccaacacctggatgtcagctgccaagaccaaactgtccagtggaaaccttaaaggagcaatcaaatccagctttggcaataaaaaggaaaagaacagaggccttagaacaaggtaagattcccacttttaaaagaaattaaatgaatttagaaaactccaaatagctcgtgtatggctagcgactgaacaacagcaaagaaatgtagcttgctagctatttaatttttataaatttaattgtataaagtagagagactgtgccgttttaggtatgtttactttcattgtgaatacttcggcagcttttgtgtatacctcagaattatgggaactatgtatgtgtaccttgttcccttcataaattccttctgtaaactacatgctaaatgtttaacaagtgctactggaaaaaatgtgtcagtgaaataatgtagttggaatgcagtgactggttaaaattgctatgagaatgtgaactttgttaaatgtgaacaacttttttttttcttgttctttttgcttcctaggaggattgcccaagaaactaattttttaaagagaacactggacaacattttactactgagggaaatagccaaaaaggcaaataatggaaaaatagtaaacattaagtaaatgctgtagaagtgagtttgtaaatattctacacatgtaaaatatgtaaaactatgggttatttttattaaatgtattttaaaataaaaatttaattctggtttttctgattagagtgcaaaagtgagaaaagttcaatactcttgaaatgtagaattgaaaatgcattagggaaaacttaataaaaattattaccagttatttggaagatctga

SEQ ID NO: 82 - DNA, 101554 bp, Homo Sapiens
cagtaataatagtttattatagcaaaaggctacagtttaaaatcagcaattgaaaaaggtgcatagggcagagtccagcagagattagatgcaagcttccagttgccctctcccaggggagtcatagagacagtgcttaactgccgctcacagcagcagtatgtgacaacacgtgtcaagtattgccaaccaggagaactcacctgagtcttggtgtccagggatcttttgggtatctttcatgaaggtctaaagtgcccacgtcgctgactttagtaactccatctgtttgactccagaggtcagactgatactgcatggaccaaggcccctcccgtaaattacattgttagcataatctgtatggtgtggctgaaggctttcagtaaacaaaggcactcttattaagcaggatatttcaagggccttgggtgggcaagggccaaaccttcctttggaatatccaaggtgtggacaacctagccctactgggttattaatcctttactgcatactggtgatatataaggaatgtaatgttttgataatgtaaatgaaatgtgttaatatctggaagatctgcatagctcagtgaagcagtatttttcagatgatcactgcatgatgcaacctatgatatgcatcagtaaatgatagaccagtggattttaatggaatagaatacaaatgttattatacatgtggtcagattctacatttcatttaacttatatgtaactttagtaagtaatagtcttcatatactatgaatcaaagcaatatagagcaacatattgaatgcagaaacagataaggaaatctgtcttctgttaagttagatagtaaacatttgtacaaaaatgtaaattggtgctgctcttctcataaattttttttggagaatatattttacgtgaagaatatgttatctgtattaacagttactccattatgtgtaatttttaaattaatttctaaacatttaagattttctgagttctaatttctaatacagtaaatattgacagctataacctacagaaacagaagttctttaggggccagcaattttttaaacatctgaacgggcctagagaccttttcgctgggtctcctctttctgggctagaggttatcgaaggatgagatgaacaactaaactaagggaaagatagtttgcaactggaatctcagggatatctggaactggggatgtgaatgctaccatgaatcttcatttccatctcttcatctgtttggtcctctcagcttcattctttcttcttatacacaggctcctcagagtactggaaaatctagcaaacaaataaacaagaactctttctttgatcttgcatcctaaatctttcgctatcagagaaaaaaacagatttgttagtatgagtgtgaaaaaaatacttgaatacttggttcaggtgtttatcagggaatgatcaactatgagtaggccagattattgaaggaaaatgatactttccctgttggaattgagggagaaagagttcccacagagagactgtgagtgttttccctgaattggatgggggctgaacaggcgtcttacaaatcatctttgagtgtcaacaagttgtatggactgcagatattatgggagttcagagtaggggaggttagggtgtttaagtgaggaaactcacatttctatctcagtttttgatgtgatcaaatggcattttatactgggtgagtttaggtttaaaatatcactttgggcacaggtggtctttagctaatctaatatctttgaggtggctgaattttggctctccctggaggtataggtattccttgaagggaagagtgatagataactaccacagggtaggaggacaatgcaaatagtttggaagccgggctttaccaagaaaaagaggaaggagaggtgagaaatagcttgaatgggagagtgaaagtcattctccagtttggctagatacgtggatttcagtaagcgattatgacttttgaatttccacataggcaggactttttgacagatttgttttcctcatctcccacctgccagtgtctactgtgttcaaggcattgtgccatgtgctagactagagaattgtgaagatgacttaaatgtcccccagtatccacaagtaactttttactttaatggagaaaacagatatgaaaatgattgattatattacagataagataaaatgccaaaaaaagtctaagaaatcagctgacatcatggtagacgattaattatgaccaagggatcaacgagatgacatttaaggtagacactgaagaatgagagagatttctgtagacaaagggatggcaataaggacattgcaaattaaaggagtagtgtgatcaaagaggtctgaaaatgcatgtttgggccgggcgtggtggctcatgcctgcaatcccagcactttgggaggctgaggtgggcggatcacctgaggtcaggagtttgagactaccctgaccaacatggagaaaccctgtctctactaaaaatacaaaaaatgagccaggcgtggtggcacatgcctgtaatcccagctattcgggaggctgaggcaggcaggagaatcgcttgaacccgggacgtggaggttgcggtgagtcaagatcatgccattgcactccagcctgggcaacaagagcaaaactctgtctcaaaaagataaaaaataaaaaataaaaaaataaagaaagtgcatgtttggtttgtttaagaaatgacaggtagtccagtggagactggccaagccataaagattactgaatgctgtaccagttgtttagatttaattctgtaagcaatgggactttttcagttttgatttgtgttttgggcatagttgtttctggagataatattatagatgtataaagagatggaagaccagtaaaactgaaaaatctgttgtaggaatagagaacataatgggtgggaaaggaaatgacaggatggaagaagagagcataggaaggtggaattgttaaggctttttgactgattggatatgagggaaacaggtagagaaataggtcagagatactgatgagaagtttccatcaggttgaattgtatttaattttttggtcttaaaaaaaccagcaatagatggttcagctcatagcttgggtatctggattgatgttaatggcaagtaaagatgagaaacaggagagagaggagaggtaaagagaaaggctgtgggacgaatgatgatggtcatttaaaaaaaaaaagtgttgagttttagttgttagttgagatatccagattgaaagatccagttgctggtggaaatgcaattctgtctttaaggttgatgggagagttaggaattatttacattgttaaatgttctttattgtgatactggatgagtatgacagatatgtgacctagattattagataagtgacacccccatctttaagtttgtttcagagatcctaaataaaacatttttgaatattacacctttttgagggcattatatttgggagctaggcagaatgtggtttccaaattatgtaaagtataaagagttttatattaaaatggatatattattctgattgtcatattcactatgttcataaagaagtacagaattacaacacagcttctattaatggctaacaggcaaaaacttcagtcttagtccattttctattactgcagcagaatatctgaaactggtaatttattttaaaaaactatttcttacaattttggatgctgggaagtccaagactgggcaggggggttggcatctagcaagggccttctagctacataataacaaagtgcaggtagtcacatggtaagagggcaggagaatgccagctcaggtctctccttctcttataaaaaccaccaatcccatcatgggggcctgccccaccctgatgaccctatctaatcctcacaaaggtaggcctcacaaaggccctaccaccaaatactgtcaatgtatgaatttggggattaagtttctaacaaaggaaatttgggggcacattcaaatcatagcagcttccttttaaaaaaatcttgtgtttttaaagaagtgtgctatcttttgggtttttcagagaccctctcaacctagagtaaatatagaatactatttaataatctcatattagaatgtttaatatgggagagggttgaacaactgctgtcaagattattttatgtgctattaaataagtagcaccttgcgaataatagtctgcttccattatttttgtatattagtaatcaagcagattaaatacttcctaggaattatggttatttgttttacttcaaaaacaatgttgatttaaagtacactgcaggtttaaaaagtttaatttcaaaaaatggatatataggctgattcttttttctaattattgaaagtcatttggaattgcaataaaaatttttctgtggtttcttcagtaatttgtaattcaatttattagtaatttccttaaaattaaaaaaattatggacactatgttaaaatctgtataccaaataatacattttaaactcacatttttggataattttcagaactattaatgtttaacttttttgtgctagaatgctctgagaccagatctgtttgtttgaaaaagcaaattacaagtataaatttaaagcaaatatgacgaatggttagcttgtgccttggcttctgttgcctgtaatagatgtgccctctaagatgttcttgctatggtacctggaagataattccttctttgcctggttactatagttatcttattgagggccagttggtttcagaatgcattttaaaaaatgggaaaaatagctgcggaaaaaataattagcttttcaaaagacagtaatggatagcttattccgattcccaggttatcagtagataaacagttaaatggacaatcacaaaaatacttcacaaccaaaggttcttcttcatttttctcatccttaaattttctacctctctccctcaaatttcatggcattttatttcatgtgtcaggattgccactatctaaatatctttcttctctgaaatttctagacctgtcccacagagacttgaggattgagaacatggagagtgggagtaaggaagttgcatggtccttcctgtatctgtttttaataccctgtgcctcagcatccctgttttgggggaacttcctgcacataaactgtcaaagcctctcacaattatagatacaaagctgttttctggtaacttgtggactcactgatttcttcttgcatgtgagaaaaagagctttggaaattaaagcggctctaaagtgccaagaatctgagtttatgggaaaagtcacctgactctgctacttggataccacattttttttttttttggagaaagagtcttgctctgttgcccaggccagagtgcagtggcgaaatctcggcttactgcaacctctacctcctggattcaagcagttctcatgcctcagactcccgagtagctgggattacaggcgtgtgccactacacccagctaatttttgtatttttagtagagttggggttttaccttgttggccaggctgttcttaagttcccggcctcatgtgatctgcccgccttaacctcccaaagtgctgggattacaggtgtgagccactgcgcctggcggataccacaaatttgtggtaacttcatctgtacttttattacatggtgctcttattgcagtccttttgtttgtgcgttccagacttttaataaattccccttagctgctctgctttgccattttaccacactgcttaaggcctatcttcttcctcattagatggcctcgattactactttatagggagaatcaaaattacatattttcaagttcactcatcactttgcttatttgtgaccttaaggaattagactagatatctgaaagctttttccatcctagatatttcatcttaaaataattttctctactttttactgtgaggcaactgtgtatttgttcttttgccattctatgattgtagacattgtgtttccacctatcttttgtctcttctgtttttaaggaaaagatgacctttttccctaataagactgtttttctcatgctcttttttttttttttcttttgagacagaatcttgctctgttgcccaggctgaagtgcagtggcacgatctcagctcactgcagcctcggccacctgggttcaattaattctcatgcctcagcctcctgagtagctgtgattacaggcgcataccaccacactcagctaatttttgtacattttgtagagacagggttttgccatgttgcccaggctggtcttgaactcatgagctcaagcaatccgcccacctcagcatcccaaatttctataattacaggcttgagccaccgcgcccagccgtttttctcacactcttaagctcattttttcccattttttttagagctttgccttttcaaatatcccccctttataatagatagttgtaatgaaacagttttctaaaggatatttagagtaatggtactaccattaggttgagattcattgctgggctaaaatgttcttggcattttgaagcgtgctttcatatatcatatagaaatccagagaacagttctacctgagcttctattataacccccacaaatatttgtggattccctactgtatgcaaagcactgtactaagaatgctatagggtatataaaaatcagcaaaatttggcctgttagaggaggagtttatggccagtataggggaacatgtaaaaaagtacaatgagatagaggaagattgatatctaaatgcagaggattttaaaggagggtgtattagtttgtcttcacactgctataaataactacctgagactgggtagtttataaagaagcaatgtttaattgactcagttctgcaggctgtacaggaagcatggcgggggaggcctcaggaatcttacagtcatggtagaaggcaaaggggaagcaagcacatcttcacatagtgacaggagaaacagcatgtgaaggggaatgtgccacacacttttaaaccatcagatcttgtgagaactcactatcacgagagcagcaaggggaaatttgctcccatgatccaatcacctcctaccaggtcccctcccaacactgggaattacaattcaacatgagatttggatgggggtacagagccaaaccatatcattctccccagcctctcccaaatctcatattattctcacatgtcaagacacaatcatgccttcccaacagtcccccaaagtcttaactccttccagcattaactgaaaagtccaaagtcttatctgagacaaggcaagtccattccacctatgagcctgtaaaataaaaaacaagttagtttcttccaaggtacaatgagagtacagggaatgggtaaatgttcctgttgcaaatgggagaaatagccaaaacaaatgggctacaggccccatgcaagtctgaaacccaacagggaagtcatgaaatcttcaagctcccatatcctttgattccatgtctcacatccagggcacgctgatgcaaggggtggcctcctaaggcctttggcagctctgccccatggctctgcaggatacagcccccacagctgctttaatgggctggcattgagtgcctgcaacttttgcaggcacacagtgcaagctgtcagtggatctacccttgtggggtctggaggatgatggccctcttcccacagctccattaggcagtgccctagtggagactctctgtgagggttccagtcccacatttccccctctgcactgccctagtagagggtctccatgaggactctggccctgtagcggagtcctgcctggacatccaggcatttccatacatcctctgaaatcaaggtggaggctcccaaacctcttctcttgccttttgtgcacccacagacccaacaccatgtggaatccaccaaggcttgtggcttgcaccctctgaagccatggcccgagttgtacattggccccttttagccacagccacagctggagctggagtggctgggatgcggggcaccaagtcccaaggatgcagttagcagcagggctctgggactggcccatgaaaccatttttccctcttagacctccaggcctgtactggaggggcagccatgaagatctctgacatgccctgggagacattttccccattgtcttggctattagcatttggcttcttgttatttatgtaaatttctaccactggcttgaatttctccccccaaaatgggtttgtcttttctatagcatggtgaggctgcaaaatttccaaacttttatgttctgcttcccttttaaacataagttccaatttcacaccgtctcttcatacatatgagcatatacttttagaaaaataccaggtcacatcttgaatgctttgctgcttagaaatttcttctgccaggtaccctaaatcatctctcaagttcaaagttccatacatctctagggcaggggcacaatgctgccagtctctgctaaatcatagcaagagtgaccgttactctggttcccaataagttcctcatctccatctgagaccacatcagcctggattttcactgtccatatcactgtcagcattttggttacaattattgagcaagtctctaggaagtctgaaactttcccacatcttctgtcttcttctgatctctccaaactgttccagcctctgcctattacccagttccaaagttgcttctgcattttgaggtatctttatagcagtgccacacttctctggtaccagttttctgtattaccttgttctcatactgctacaaagaactacctgagactgggtaatttatgaagaaaaggtttaattgactcacagttctgtaggctgtacaggagtcatggctggagaggcctcagaagacttacaatcatggcagaaggcaaaggggaagcaagaacatcttcacatggtgacaggagacagagagagtaaagtggggaagcgccacacacttttaaaccatcagatcttgcgggaatttactatcacgagaacagcaaggggaaatttgccttcatgattcaatcacctaccaccaggtccctcccccaacactgggagtaacagttcaacatgagatttgggtagggatacagagcaaccatatcagagggaggtaatgtattcagttaaaggggattaaaaatggctttatgcaagtatacttttccctgtaactcaacatagtgttttgacaagcaaaaattgaatgatgactgcattgtgaaaagacaaggtgaaaacaaggtagtatttgtagagttacacatagtctgatttggctagaagggaggctggagcctttcatggtggcttttgaatgccatggtgaatagtttgtgctttatttgttattgaatagcaatttgtacacttctgagctattagagtgaaatgattaagcctgtggtttaggaagaaagagcctattagggagataaatctttccctagttgtaggaagggttggaacagtatgatatggagagggtagtaatgaatgaaggaatggaaaacgagaataatttcaatgatactggaggtgcagtatacaagttggcagtagttttatgtctaggaagataagaagtgtttaggaaaaactcccaaattgtttttcctctgctcttacaccacaacaatcaacacagaggacttctgtgtccaaatgcacagtatttctccctgccaaataagcaatcagttctacagtgaacaccagctaattggctttcaattcatttctgtcactacctagagatagtgtcagattcccaacggctgagggctcagtcttggggtctgggccctccttcccactggttgtaagtctgcatctctggaacttctaccagatggcttcgagttggggtttccacaaccccctctttgggttggattaatttgctagagttactcacagaactcagagaaacacgtttactggtttattatgaaggatatgttaaaggatacaagtaaacagccatatggcaaggtctggatgccatagggcaaggtctggaagggtcccaaatgtaggagcctctgtttccgtggagttagggtatgccactctcccagcaagtggatgagttcttgctcaccttcttgcccaccttcacatgttcagctgtgaggccagtccttttggttttttatggaattttcatgacatcagcactttccccaatgggaagaccccccataggaccctctctgaaatgagggcattatgacccacagtcagaaaagtggaggaaaattagagtcctgccttggtgcagatgaaaggagggcaggagaaggtcagggatattgtttcctgaggcctaacacaccaaacattgtaataaaagactataacaagggtgatatagcttgaatgtgtgtcccctccaaatctcgtatttaatgagacctccattgttggaagtggggtctggtgggtgtttggatcataaaggtggatccctcatgaatggtttgctgccctcccctgtggtaatgagttcaagtgagagctggttgtttaaagcaggggtcctcaacccctactccatggaccggtacctgtctatggcctgttaggagctgggccacacagcaggaggtgtgagccacaggcaagcgagcattactgtctgagctccaccttctgatcagcagagcttagatcagcagcagcattagattttcacaggagcgcaaaccctattgtgaactcctcacgtgagggatataggttgtgtgctccttatgagaatctaatggttgatgatctgagctgaaacagtttcatcctgaaatcatcttccctgaccccttgtctgtggaaaaattgtcttccactaaatcagtcagtccctggtgccggaggttggggactactggtttaaaggagcctggctcctccccccttctcttgctctctctggtcatgtgatgtgctagctctccctttgccttctgccatgagtaaaagcttcctgaggcctcactgaaagcagattccagcaccatgcttcctctatagtcctgcagaaccatgagccgcaataaaccacttttctttaccaattacccagtctcaagacagactaacacaaagggctatgggagttataagccaggaactgtggacgaaaacctatttttaaaaatatagatatataaacacaaccacatacataaataaaataacaccacaagaaggaatcaaagttgcttttgaaattccaggtctggacactaggaaggatgctggtgttattaataaagaggaagagaagtgtgagagtgtctgtgtgtttgtggagatatttgctaattttttaagatgttgatatattcaccttaaggtgaagattcttgggagagctttgttaatttaagcctggcgtttaggaaggaagttagatttagagagggaaatttggggattgctctcatagaggttataatttgagctgatggataactgatatttccatgactgtgaataaatacagaaatggaaaattctgaggaaaaggcacgtagaaaatgccttagttttaggatgacttttgagtaaattgtgtaatatttcacccttatttttttaaaaaagttaaataggagaaacactttgagaaagcatagagggagaaaactaatgccttaaaacattgcctaacgcataataggagcttaaaaaaatctttgttgaatgaataattgtaacttgtttgggatataagcctatgtatagtagaaaaatgggcatattgtggagaacttttgagggagagagtggataatgcctgttcccctgccctgtgctcatagggttattgctgataccagatgaaaggacagatctgagaatattttgaacttttaaaatgttctttgaggcatatttcagtttgaggaactgaaagaaattccataagtaaggtagtatgtctgtattcagcaagtaaggtaacatgtctgcatataagcttatattctttccattttatttggtgggaattagatttgtaaagtatattgtaaagaatgtttagggtattgttatggctatatatcttttgataagtcaattctttttttttttgcctgtgctttttcccactgcctgttatatttttctcactttccttctcagtccctcactttttccaagtcagttgccattcatcttttaggtctcagtttagccatcagttctttcaggaaatgtatgctaaaattctaagactgagacaggtatttttttgtatccctgtgtatcctcctacttactataccagattacagttgcttaatttgtctgtcttctccactagaacctaaactttcctgtcatggtgttctgtcgtatttactgttatattctaccatgtagcacaatgcttggcacatagtttgttggagatgaactaaataagagacaatgttagactaaagtttacttttaaccttcagacgtagtgatttcttatcttcatgtgctgaatggtatgatactataattgttgaagttctaagaaaaacccaactataagaattgatactgttttgaggatttaaagaacacagatacaagagattgaaaatgtgctgtaggtactaatactagcctcctgctagtaggtattgtgctagccttccctcccttttcctcctctctttcaacatttgatcagtgcataacatttcttggagaggtgtggttttttttcttcccttcgttatctgtttactagggtgatgggagttaaaggtagtaaaaacttcacaatcatggttgagtgcatttcagtgtaaactttgtattctcaaccttttgtatgttagtcttttagtgaattttgggtggacagagtgtatgatagtgctgtttctttagaaatgctctctcgaaactaaaacctcttggattctgtaaatatgttacctgttgaaaaaggaaacagcatttctgcccttactttgaactaacttgatctgagataaatacatacacacatgcacgcatgtgcacacacacatacatatgcactctagttatctggttatatacaaatatacccaagaatacctaatataaacacgccctcttctccccttcctcaagtttaagtgatgtgtagttggtctaaggggtactacagctgttttgcttagcctagtggttgttcaagtgaatttaccagtgacccaattttagtctctatcatagtgatttgaaaaaaaaggccaagtaaagtcacttagtatgagataaattttctttactttcctcttcactttaagaaatcagttgcttttttaatttttttatttttttttaacctttagcagactgtattagttcattctcatgatgctaacaaagacaaacccgagatggggtcacttataaaggaaagaggcttaattgactcatagttccgcagggctggggaggcctcaggaaacttacaatcatggcggaaggggaagcaaacatgtccttcttcacatggtgtcatcaaggagaagtactgagcaaaagggggaaaagccccttataaaaccattagatctcgtgagaactcactatcacaataacagcagcatgggggtaactgcccccataattcagttacttcccaccgggtcgggtcccacccacaacatgtggggattatggaaactacaattcaagatgagatttgggtggagacacagccaaaccatatcacagacagtaagaatatatttgttacaaataaatatgggagcttaagaagatttttatgttttagcaaatgcataccaacttgaaatcaccaatttagttttagaagacacaagcgtgtgtaacaaagtctgattagcattttgaggcttgtagaataacttcagaagtttgtagtatgatcaggcacacagagtcccaagtgattcagatgcaaaagatttcttggcaattggatttctgcatgtatgtttctctgtagctactttggtgcctgtcagtaatataaccaaaaggaaaaaccaagtggaaagtaaaagtaatctgctggtaacttcaatttagttttctttttataaaaggaactctattgatgttagcactgttttaatggttttctgttgtgtagtagacagttttcatttgggattgtcaagttagttgtaaataattgtatagtttcaatgaaatgcctgtctgtattcacactaggatattttctcattgcacaaatttccatatttttctctgatcaagtgagacagattataaaacacaaaggcccctctaaggcccttcggatgtgttccagcaatatgcagcagccccccacccccttttttatttcccctgtgacagggtctctctctgttgcccagtctagagtgcagtggcacaatcttgtctcacttcaggcttgacttcccgggcttaagctatcctcccatctcagcctctcgagtagctgggatcataggtatgtgccaccatgcctggctaatttttgtattttttgtagagatggcgttttgccatattgcctgggttggtcatgaactcctgggttccagcagtcccctcctcagcctcccaaattgctggtttataaagttgggagctactgcgcctggccacagcacacatttataaaaaatgttcatgtgattccaaatttaaaatagagtgatttctgtgactttttttaattgttcacttttttaacatgcagtttcatcttagatgtatgatattgtatgtaaattgatttgtatttctaaaaaaatgaaattaagggactccatatctacctgtaagatttctcaacaaaaatttacaaagctagctgggaagacatgtatgtacttcttgaatttcctcctgctattccttttccccatcttccttagagaggcaaagaagaagagagagggagatttacttttaaaataggagaacattaaatgctttattattaatgtgttacattaagcagttttaagtcatagtatctcaagtacatactatcctttatattgcccccaacacccaaaatatacacacattgggaaaagaatgggggctctttgggggtttccttctagagttgccaggtgaaatagaatttctagtttattaatagtatggcacttgcagccccaattaatttgaatgctctataatgttcaaaaagagttttgagaaaatttcctcctaaaattaatgccttagtagaaaaaaagattggtttctcctgttctcttccccaaattagatggaaagtaaacaagactggaaaataggtaattgagactaagatgattcacagattgatcacccattttgcaacagtcataaaatttgttagtttttttgaagaagtttattaatcagtcccatatcctttgagtatcctctactcccctgtgatactggtttgatattaattaagctaatatttactgggttcttggtatccattaggtattcttctaagcaactttatatgtgttagctcatttaataataatattaagccaacattctctgaggtagacactattatattccttttatagatgaggaaactgaggctcagagataaagtaatctgcctacatttgcgcagctaggtggcagagctgggattcaaagacagtgactctagagtcttttaaccgttctactataaagcctatgtagtatttttcatttttgtatttttctttaaaggaatttagtacaagtcattaattttattctgaggttgagatagaaattaatttccctaatttacaagtgatggtaacgacataaaaaatgtaaagacttggccgtaactgtggagacagtttctgacgagatttggtatgtttagggtggcattgccatagattggaggtttcttgggtttctgttaagtcttggtcttctgctagtatgcattgtctcttttgaacaagctcagggagtgtcagcataatcatacttctttgagttctgtcagcctaaactgttttcacattcttttcacatgtcagaatttttggctgggtgcagtggctcacacctgtaatctcagcactttgggaggccgaggcaggcagattacctgaggtcagtagctcgggaccagcctggccaacatggtgaaaccccgtctctactaaaaatacaaaagttagccggatgtggtggcacacacctgtaatcccagctacttgggaggcagagacaggagaatcacttgaacccaggaggcggaggttgcagtgagccataagagcatggcactgcaccccaacctgggtaacagagcaagactccgtttcccaaaaaaaaaaaaaagagagagaacttcctatgtggacgttaaaaaagaaaagtttttgttttgttttttacattggcatggtggtttaactagatgacttataaagtatttttcaacattgttttatgagtcaacacttcttctttcattggacaaatacttttaaaacttattattgctatgtgccaggtatattctgtgttataattgccacaaatgtgagcagattgataaactttaacttagatgatgagctattgtttagtaatctcatgttacactcagagtattctcataccaccagtatgattcttatgcttatgtttctttgaggtattctagattccagttgaatttttttttaaacttatttgaaaacggtcaccagcaaatctacttttaaagagatataataaggctttgactgtgaagacttaagagtaatagtggggttgattaaatatgttttcttgtatttctttgtaattttattgctgtgactatttgtagaggcagaaagtgtagcatttttaaaaattgagtattttagacaaataaccactcccaaagtgttcactcttgggaaatgttatatctttgttattgagagtatgttttgtaaagccatatcccacctgaaataaaaagaattacagacttcagaaagttaaggtagacagcattttcttggctactggggctaattagaatatatgattctctatgcaggacagccaccttagggactctgaatctctcagtagggtaaaatttttatatttatataaaagattgtgggttaaaaaatggttgagaaatactgtttttgagtaaacccaaggactggtgtttaaaggttatatagtattttacttaggttctagaaatctgtaaggtgtctgaatcaaatcttgtaacattggatttattgtgatttatttataaaacatttaaggatcaaatcaactaagtaaatatttacaagctgatggctggataatttaattgcagtttatagtcataatcaagaattgacatgttttgctttatgtgtttgaagcttacgaccttttgacatgaaggaaattgctaacatttaggaaatagttacttatttagattaatgtctttctcctgaactgacttatccattttaatgctcagatcttagaaagtacatagatgtaaaaaatcgactcggtgtggtggctcacacctgtaatcctagcacttgggaaggctgaggtgagcagatcacttgagtccaggaatttgagaccagcctgggtgacatggcaaaactctgtctctccaaaaaaaaaaaaaagctggatgtggtagcatgtgtctgcagtctcggctacttgggaggctgtggtgggaagatgggttgagcctgggaggtgggggttgcagtgagctgagatcgtaccagtgtactccagcctgggcgacagagtgagactcccgtcttaaaacaaaacaaaacaaaaacaactaaaaaccacaaataaacatatatattacttaaaatcataagttggatatttcttataaagtagtaattgtgtaatgcctcatgtatctctgtgtatcatttcaatggtaagttcaaaagatgaaggagattaaagaaaaacctttttcatcttgacactacctaagacataacagaaatttaacaaataacaagtatataaaaatagagatttttaaaaattgtccttaattttatctttgttgggtatataaatctgctctctgggatagttctactgctttaagtaatgaggaatgcactagtttcatattctaaggataacctaaggatatcccatatattttcacaactaaataaactcatagcctgaaatttcaaaattttattctcttatgtcgttaaattatagttccttagggttcatttacgatctctggtgtaaactttccatttcagatttaaaaagtccctgagctcttgaaagttaaatttacttgtcatttgtctcaaagataatggctgaactaagattaggattttagaggaatgcagtattgattgttctttcccttcttcctctagtactaacaggttacaattatattttgtttgttaagtcgtaatggaacgctataaataagttcattattttcagccttatgcatagggctctaaataaatagcttggttttagaagaaaactaaaagtaattctttccataagttttaagtttctgtgtttttgttttatttttaaaaattaaggagtcaaaaataatgggcttttattacaacaagcttacaaaaatagtcatagtaacataatgcttttatcattggcttatatattatataaaatacatacattattacacatataagattacaaataaactttggtaaagctgaagtactatattatgttacataattgaatatatcaatgtaatatgaatgtttattgtttttctctggatgtttcaaattaggctgtaagtatctaaggatgagtttggctaaactatcaaatgtaaaaatattttatagcaattactttggagatttgttaccatgcctgtatgatacttctagtatatttctaagcatgtttctgtttatatcagtccatgaggcttttataggcatacttggtatgctagagttacagccagtttcttaagtagatcatttgatagtatgtaggtagaacacagttaaactgagagcaagaagggtgaagggacaaaggtgctatttattctcccacatgtttgttacataaatttggaaagttgagtgcaaatgtaaaatgtatagtcatggagtagattatcttagagccaaagggattaatcagcttcacgttcaaacaggaaattaaaatagcatcctttagacagtgtaattctgttttcctgtcgcagggcacaaacactaaaatggaataaaacattttatattctcataggttccatgtgccttgtgaagtcatggttcctcagtataagatcgaggtagtaaattaatcatttccatttgtctatcttttatttttctaagtaaagatctggttgcagtagtgtttatattttgaatagcaggcaatcctggaagtagggagatgggtagaaatggaagagatttatatatgagatgactaggactgagcttttagaacaaattaaagaccaagtaaatgagtattttttgagactgaggttaaattgagttaaaattggaataactggttcagagtaaaatgtaaatgtttaagttacatgtaggcatttaaaacctctagtagtatgtttttcaagtgtccatagaaattctgcacttgctatttatattgtaatatcttctctgtttttcccctaggtggtatcacggaaaacttgacagaacgatagcagaagaacgcctcaggcaggcagggaagtctggcagttatcttataagagagagtgatcggaggccagggtcctttgtactttcatttcttagccagatgaatgttgtcaaccattttaggtaagtctttattcctattatgaagccaaatgatgtagctattttgatataatattcataaatatacctgtataataaaggtgaatgactcagtaacaaataatagagaaggaagcttgttttcagtcaaatgatttaatcagtgatttagagagattcttttgaatgtttacattttttgtttaaaaacaatattgttgggcattactgtgctgatcctcaaatatatttatagtttttaaagtataaagaattacaaataaactttgagtggtaaggctaaaataaaggaattgtatacttttagactgcagaataacaaaaagtgtaggaaaccctgtttaaaactcaaattttgtgtcctttattttagcttcactattctaaaactcttcgcagacatgcacttcagtgaaacagacatataaattttcaagtacaaatattctgtatatataaacatatttacccatattgtattgtttcatttttatagaagaaattgaaaaaaatcatctaatgcatatagtgttaaatgataaaatgtttgtgtacccttggtttttagattttaaaataaggttcagtagtaccatgataccacatgtagtatgtgaaattattactgtactttgtgtaaatattgcaagagatctgtgagctccttttagccatataaaacttattaaattgttaattcagccttaaatatggaaagtgagaagaggtatctgagggtgagttttcagatatttgatggaattctgtaattgaggtttataagcctgatatgtatttcacatcaaatgcatgtatatatatgtaagagaaatagccccaagtaatttactgtgatgaagatactaataagtggtattttagtataaggatatagttacaaggaaaagagtatggaaattatggatttataatttctttataaaacttgatttttaaaattggctgtaaagatttttttatactgtattttttcctgttcaaataggattattgctatgtgtggagattactacattggtggaagacgtttttcttcactgtcagacctaataggttattacagtcatgtttcttgtttgcttaaaggagaaaaattactttacccagttgcaccaccagaggcaagtaaaatgaataaaatatctttcaaaactttattttttcagtacaataatggttttagctattgctcagtttcttatgtttattataattcaagaagtatttgttgtattaaattttaattcgggttataatgtcagaacaaaatggacaacttctttgaaaaaaaaagaaaatatttttcaataattttgtatttaagtaaccagattaaaagaaaatactgtatggtgatagcctaacaaatatttctgaatgtatgggaacaaattactgatttcatagtattaaccctgactttgctgcaagattctgaaatgccttgtgtatcatcaatgaaaggttaatgtatatgtttcatgtagtatatttaaaatgaaatgatcattcatattacgttataaaagcatactgcttatatttaaaatatgattttcataaaaacaggaacaacaaaaaagcctttctaggcactgggtatttatagtccaagtaaaaatttatttgaatgatcccatggagtttctaatgtgaatttttattggctttatgtggatatacctcttttgactttaagataaaaagactatctttttaaatctttttttttttatggtttctagccagtagaagatagaaggcgtgtacgagctattctaccttacacaaaagtaccagacactgatgaaataaggtattttataatctattctcatgtataggcatttgaaagagctagacttcgaagatttattactcttggactaggaagcttttgaaatttgaagaaatggcatacagcaaggtgaaagagcttttgatattgggtctgttggtcctgtatctctgggttggcttatttgttcagactgtggttttggatcagggtggcctcagtgaatatgataggagaaatagttaggttttattccactgtctctcacaaagtaaggagagttctgcttcaatctatatgctatgtaaatttttgttaccatgtgacatttatgccacagctataaaggataagcttctactttatgtaatgggtgaataattttaaaccttaggaatgttatagaactatgcaacatgttagtttgtggttttatttctatataattatataatttgataatcagattatctgtgtctttctataagctatttaattttctagtggaaactttgtttcttaccattaattctctcatttaattcttactgacacatttttatttgtaatgtaaactggacaggcctataaatgacaaaggaaaaaatgcatatattgaagaacagggatgaattacaaatttatgaatttaggtaattttaaaaaatttttagtgggatcatttaggacagcagttctgtaagtgtgtttcatgtaactatggggatctttgagatccatttagaaggttcatgtattagtcagtgttctctagaggagatttttttacggagaataggtttacacaatgatagatggagacagtaaagacccacaatcggctgtctgcaatctgaaaacccaagaaagccagtggtataattcagtctacatctgaagacctgagaaccaggggagcctatggtgtaaatcatagtctgagggcaggagaagatgagatgagatgtcccagctcaaccagtaaggcagcagaaagggatgaatttcttcctcctccattttttgttctgttcagaccctcagtgaattggatgatgcccactcacattggggatggcaggatactgtcctctgattcaaatgctaatcttatccagaaacaccctcacagagaaacccagaaatataatgtttaatctgggaaccctatggcccagccaagttgacacataaaattagccatcacagtccatgagatcagattattttcataacatactaagacataacttgcctttttcactgtaaattttacaatgatggtacaaaagcaatggatggtaaaactgctggtgccttaatagaaatcaaggctgtggcacaaaagtgtactgtattcttcactgttacacacttagagttaaagacagtttcattgaagagtgttgttgatgagggagtaaaaaatatttattgaatttcaacctgtgactacacaactttaatctgtatgatgaaatgggaagtatgtataaaacacttctgctgtgtaccagggatcagtgtcatgaggaaaagcagtgagttgagagctgaactagtttgttccttttttttttttgagacagaatcttgctctgttacccaggctggagtgcagtggcacgatcttgcctcactgcaatctccacctcctgggttcaagggattctttgcctcggtcttctgagcagctggaattacaggcgtgtgtcaccaagtccagctaagttttgtaatttagtagagatggggttttgccatgttggccaggccagtcttgaactcttgacctcaagtgatctgcccgccttggcctcccaaagtgctggaattatgggcatgagccactgcacctggcttagctgttacttttgtgcacaccattttcacttgagagaatgtttgacattttttgaagaagaacagagtgagtctattatttcaaggaagaaaacttagtgtttgttgccaatgacaaaatttgagttttgagtaaaaatttgaattttagacattctgtattggccatcaagagtttgacagcttctgaaataatgacttttctgatgagataggtgaagataataaagaatgaggtttttttttttttttttttttttttgtgacagtttcgctcttgtcacccaggctggagtgcaatggtgccatcttgggtcactgcaacctccgccacctgggttcaagcgattctcctgcctcagcctcctgagtagctggaactatgggcgtctgccaccacacctggctaattttgatatttttagtagagatggggtttcaccatgttggccagggtagtcttgaactactgacctcgggtgatctgcccgccttggcctcccaaagtgctgggattgcaggcatgagccatcgtggctggccaagaatgagaggttttgatagtgtataatgtgttaacaactagaagatatagatagctcagtgaactaatattttctaaaaggtcaacgcatgttgttacaaaattatgcatgggtaaaagattcatttaaagtgcaagatagaccaatagatgttattggaatgcataaagttcactgataaatagttttggattccatattacaactaaccttcaagaaagtaccactcgttgagtttttggtgtaatttcatagaatatctataattatcagaaaaggctattaaaatacttatccttttcacaactacattcttaggtgaagccagattttcctcatatgttttaagcaaaaaaatcatatagcagcaaatttaatgcagaaacagatatgggactccagcagttttcatttaagccaggcattaagagatttgcaaaattataaaacagtgatattctcactaaatttgtaaaagtatctttttcatatttttaatgagctatttttaaaggaattagtgaatattttcaaacatttgttttaaatttgaatatggtaaatatcagtagatatccatataaataaaagccatttaggatgtcatttttaagagtgtaaagaggtcctgggagaccaaaaagaaaaaaaaaatagctgatctaggaagatgggaatttaaataatactttgatgatataaatttggatttatgagtcttttaaaaagtttatacacacctgtggattttaaaataaaaataccttaaaaattaatgatttaataaagcactttagcctgttttaggggggataacacaaaataatatagaatgagttatgattagattgtattactactaacaagcttatttaaaactttttttggtttttgcaccatgaaaagttggtatagcaacaacaatgaaacttgaaattagaaatatctcttatggctacttttaactaagaaatgaaatttaccagttcatgtgcaccctccttttactcataatgattttctttaatgtgcttatttaggtggttctagaaaggaatagtttaattggttaagtggtaatgtctgctgccattcagctagtgaaatattggccatcattaagaaggattgtagaatcaagatagaatacaatattctatgattattcaaatattgagttaaatgttgtataatacaagttctgttgtctgaaacattgtccaagatacaatgaagcttgagatagcatagagaaagcagttaaagctttcaaggataggagaagagatttacttaaatttacttaatagattttgatttgtgaatattaagattgaaaggaaaattgctggaaaaaaagacaaatacagttatagatacagggttaatggtaccatccaacaaatctggaaactttgtattcagatgcattcttttaagcctgaaaggacaaattcaagaattactaatggttttatattgatgaaatacatcagcaacttgttgtttccataattgtgtggaggttgaaaacatctaggtttcagtaaaaggaaactaagttgtatatgcatctctgtactcttaaattggtaacagaaaaaaaacatacattcctttctcataatatatcccttggtacctaccactttcagagaaagaatgctgtacccattggataatgggtatctgggtgaattaaacaagccctggtttttttataagaaaaatgttaactgacataagcatctacatcatgcttatctaaaataaacattttctgaagtaactctatatcttatgtatgtatagtgtgttaattatatttattttgtgttttgattttatatctaccctacatctgaaagagtaataacattgaagcataagtttttcaattcagttttcttgtagttacaccccaaaaccttcaatatatgtacaatcagtttctgttaacagaagttgtaatttgaatctaacaataattcagtgatatagttagtgcagatactactatcaaacccattttactcatgaggtaattaaaattcagattatttattattttcaggaattgacatgtggataatgccagaaataggatacaaatttagggtgtttgactctaattccttacatttttcaatataatactatccctatcctattttgtggtatatgactattctaatctctgtatttaaaatttttaaatttaataactttaaaattgctattttcagtttcttaaaaggagatatgttcattgttcataatgaattagaagatggatggatgtgggttacaaatttaagaacagatgaacaaggccttattgttgaagacctagtagaagaggtggtaagttttgttcttttcttctcaattctagattctaaatattttataaatttggatcttgtccgtaatcagagaaagtagctatgaatacatttcttttataaaagaacttaattgataagtacaagaattataagtgctgtttgttagtatggaacataatcaggctagcatattataatacatagctgccaatattcagaaagcttgtatgattttctatgaattaaaaatatattaacatttgtgttttcttttgagacagagtcttggtctgttacccaggctagagtgcagtggcgtgatctcggctcactgcaacctccacctcccaggttcaagcatttctcgtgcctcagccacccagctagctgggattacagacatgtgccaccatgcccagctaattttatatatatatatatatatatatatatatataaaattttttttttttttaagtagaaatggggttttaccatgttggccaggctggtctcaaacgcctgacctcaagtgttccacccgccttagcctcccaaagtactgggatgacaggcatgagccacagtgcccggcctatttgtgcttatttttgttcttttttttgccgtccttttcttcctcataagtgaagttatatcagtctgatcatgaaacctcaactggttacacatgtttggttttagattctttatctttcaaatatatatataattttccagtaaacttggaagaattcatttatattatacatatattatcacatggttctacattttgaatctcgtccttgtttttgtttccatcatataatacgttatcatggtatcaattaccaggtgcatttttaataacaggtcagcatttgaatggcttttatatttcagagacaatactcagtatcaaatatattgtacattataactttggaattctccctttcctttcggatttttctagtgagatggagtggctttctgttgtcttttacagccttcaaagctactgtttttaaattatgccacagacctgataatattctgaagagtattgctcctggaagactgcagtggagaatattgttttttcctattaattctcttacctgcctattctggcaaccaaatcttgatccatagaagtaaaacatactgagtagaggtgggaaaagttgaggaaatggtgtgatacagtccatactcatagtcatatagttatttagtgaaagagctaggattaggactcctaattcctagattagtattctgtattctacagtaaaagagatatttactccatataggcaaacagtattcgtactgaagcatcttactatgatagttttcctataaaatttgttagttacaacttttagtttgggtttccctctccttgctgtaccaccatcttctccatcctgattacttcaagaaattgcactatagttgaacttttcttgagctcttggaattctggatcaaatttaacaagataacctttaaagaaaagtgaaaattactcaatgtatacagaaaaataataataacaacccaaaccagaataaggagacatgacctcacatcagtacaagggatcaaggaaaaagttagcaactcagtatgagtgaataatgtgatgtggttgctaaaaatgaatatagtaacattataaattaatagtggagtaattccacgtcatttataaacaattttcactccaatatgtagaataactttcatgatgggctttattagagggtagtgaattctttgtagattgaaaaaccatttggacattgtctagtctgtgaagatgtttcgggcattcagttagtggttagatttaaggaatttctccttctaaaattctaattacagttccccaaacacatttatactttcatgtattaactctagaatgtatgctctctgaggggagggatttttgtctctgattcactgatgtattaccattgcctagaatagtgtctggcattagtaggcattcagaaaatgtttgttgagtaaatgaatgtttctatgtttatagttttccctcttccttgacattcttgccctgatagattgccttgtaaaatttgattcatctttatgagctcagttcatatgtcatccctgtttcacagaggatttatgcctttctggagtctcttaggcaaaattgtttccttctgtatttccatagcaccttgctaattctgcattctgttacactgtctaaaattaataattgtgtaaaactcttctacaagagattaactccttttgggcagtgacacaatgataatgctattcatttttatagtttttttttttaagcctactcccttggatatagtaacattcagtgagtgtttgattttagtttgattaggtatttaatgagtgaggaccaaattgtgagaagtaaatccacatgtagttagaccatttttctccataatagtggaatgagtaacactattgtatcttaaatcagaggaatatagaataaaataaagttcaaaacatagtaaaagggggatgtcttttatattgaaagtagaagttgatgttcactttttacgggctcagaatgtcttactgaagaggtagcatttgagatagttccttcccagattggttaggtatttatctaacaagtagaaagcaaaaagtggaaagtacattctaagaacaaaaagtacaagctacagtggtgggagattggcaaataggaagttatgtgtgaccatggtataggaaccaaaaaacaattggtagtatgagacaggaaatgtagacttgagtcctgtggtaaacgacttcagttgcagaatgagaaatttgtaggcagtagagaggtgttttttttttgtttggtttttcttaatgtagggcacagctgctgttgaaactgatgtatccagattagagtggtggagtaggacataattatattagttgggctgttgtttaagaaaagtcgataagagggcctgagttagggtaatggcaacaagaaaagattaagagaggtttggaaagatatttactgaacagaaacatctttttttatataaacataaataaggatagtgtggggatatgtttgcagatacgattttcatgaattttaataaaaattgattaatagttaattatataaaatactgtcttaatgtcttccctttagggccgggaagaagatccacatgaaggaaaaatgtgagtttgtgttaattattaaaatgaaaaaaaaaatctatattgtaaatttactaattggaaaactttggccaaaaaaattgttttttaaggttttggactgacttaacttttaaatttggcttagggaactgatttctaaatattttcttaaggatctagtgataaagtcttgtttttaaataaaaggtagctgataactaaatataactctttttatcaccacactgaagactttgaataaacactacatttataacattatgaatgtcacaatttggcacattttaaaattattcatagtatttcttggttattcatagtatttcttgttttatagccacatcttttatccccccaaaataacggttcttcacaattttaataagattcagcaaggtctttttttttcataatcttcagactgattttatgtatatgtaagttttcttttgaagatctgaaccattaatcccaattctctcttactcacattttaatagactattcatctcctaatatcttttcagtacaacattttttcttatctttcagcatttagggatggaacttgaggcttgcctcaagtgtttgctttttctgttttctaaccattagaatataaaaacattcaactgactactccatttgcagtcaccttgtttaatgcttcacccttctgtaagtggaatatgtaagatatattctgagttcatttttattgtttcttgtagctacaaaatagattccattagtgagactgtaccctgctgtttgtattagtttgaagtctcctctctacctatatcaggagtttcaaattcttttttgttattttttctttttttttttttttgagacagagtcttgctctgttgcccaggctggagtgcaatggcacgatctctgctcactgcaacccctgcctcctggattcaaacgattctctgccttagtctcctgagtagctgggaccaccggcgcacaacaccatgctaggctggttattgtacctttagtagagatgcggttttgccatgttggccaggcttgtcttgaactcctgacctcaagtaatctaccagcctcggcctcccaaagtgctggaattacaggcatgagccactgtgcccagctaggagttgcaaattctaattaatgcttggaagaatcagacagacaatgtaagcaagtgaagcgggtcaagtatatatattcccagttttctttagacacaataatcttgatctttcttattttccctcgttgctagagatcaaggtacatggaactgtgtccctactgtcaaaaaacaacactgtacgtgtggtaataaatggcaactaatattcactcacggtgttagggaaaactgtgggaagtagaaaactagaaagtgtttgcctattgtaaggtaatcactttgtctagttgtctagttgatatgtgtaggaatgtgagtctagtgttgttagatccttctgattttcaaaaaaagaccataaatctaggtttttttattttagataatagcaatggaattttaaatttaaaaatataggttaaatgctagtaaacatttaaagctacatcagttttctcatagtataaaatataaatcccactttcactcggaagtctttttatctgatagcattgtcattcttccatttttcttaactttatgtaatttcttaattggggcataacttaaatttgcattgttggtttattttatgtgtatgtttgttccctttaatttcctaatatagggactgtcgcagtactttaaattctttaaagtgtcctcagtaacatctacaagtaacctttgagattaaatagatggtataactttggttgaatttctttccagctccctatttacatgatatgggcaccaagtcctgatgactttatctcttaaagtatttcttaaatgtttaccgccttctcaaatcttaaataactacattctagttcaggactttttaaatctcctgccaggatttgatataacagtaacctccaagttgatctcccttgactctttagcctcatcaaatccttttttccagtagctggaataatctacctagattgaatcacattatccttaactgccagcaggtatatgaaaaaatgctcaccattcattactaatcatcagataaatgcaaatcaaaactacaatgagatttcatttcaccccagttataatggcttttatccaaaagataggctataatgaatgctagtgaggatgtggagaaaagggaagccttgtaccctgttggtgggaatgtaaatgagtgcagttactatagagcacagcatggaagttcttcaaaaaattaaaaataaagctaccatatgatccggcaatcccactgctgggtatatatccaaaagaaaggaaatcagtgtatcaaagagacagctgcactcctatgtttcagcaccattcacaatagccgagatgtttaatcaacctaagtgttcatcagtggatgaatggataaagaaaatatagtacatatacacaatggaatactattcagccataaacaagaatgaaatcctgtcattcacagcaacatgaatggaactggcaaataccatgttaagtgaaataagccaggcacagaaagacaaataccatgtgttctcactcatatgggtgcaaaatattagaaaattaactcagggagatagatagtagaatgatggttaccaaaaggtgggaagggtagcagggaaggggggatacaatatggctgattaataggtacaaaaatacatctagatagaatgaataagatctaatttactggatatttaaaaataactaaaagagtggaatttgaatatgcctaatacaaagaaatgattatatgtgcttgaggtgatggataccccatttatcctgacttgatcattaaacattatatgcttgtatcaaaacatcactggtaccccataaaaataaacaaaatagttgtatacattacccataaaaacagaaaaaataaaaattaaaaaattgaatcttatactgattctccacctttaccttagcagagcctaaaaaatgatctgttatctggttattttgtcgtttactactcctagcacttatcatctgtagtttcctaatctccagcatgtaggtcttcaaattcataatacttttttctttattgttttagagataggttcttgccattgcccaagccggagtgcagtagtgctatcatagttcacctcaaactcctgggctcaagtgatcttcctgcctgagcctcccgagtagctgagactacaggtgtgtaccaccacacctggcaaatgttgtaatttttttttttttttttttttgtaaagatgaggtcttactatgctgcccagactggtctcaaacgcctggcctcaagtgatcctcccaccttggccttccaaagtgttgggattacaggtgtgagccattgctcctagctatttttctttatacctttgctcaagctgcttcctaggccagaattcttccattcatacttagctcattcatcacttccccctagaaaatcttcctttattttcctctctacacactcaacagtattggtacccttctctgttactcccaaaatgcctttggcaatacctatcactgtgcttattatagtttctacattgtttctatagttagggtctcactatgttgccaggctggtcttggactcttgggctcaagagatcctcctgccttggcctccgaaagtactgggattacaggtgtgatcccagttcccacgcctggcctaggagtaggaactttataagagcagggactcatctttttatcactgttgcaaaccatgtggttgaaatatataaattttatatgggaataaatgtctgaaaaatgaaacgaaaactctttagaaagagatattgccactttggcttcagactgtgtgcttatgctaaataatcttgttcatctgtaaaccctatcacttttttacccttctttttttgaatttttttcaaactgtagaagtagaggattagccttggaggtcaggtcatgtagttgactgtcctccagaatataaaaatcctgctctagcatttgtagtaagtggtcatttagcctatacttgaatgcagtatagaacctcactacttgtagtctgaactgttttagttgttgtattcttgctttatattattcaaaatttacacagggagcaccaggagatctgaatcagtgagttaatgcttggaatggtgttaaagaaaagtttaccttttcattcatgtgaaaatttaaaaattcagttatattttcatacttcaccagtaataattgtatggatcatttaaaacaatgtgaatgacctctgaacctgtcacactggacttttgagcacttatatattttagtcgtatatttactttctagcttgctctttattattaaaaatacttgtagaccctaagaagatcccacaaagtagtagataggtgatcgggaattgtcagcctggcattaagatgtgttaatcagcaagatagataataggcctttaggtaaataagaggtgattttatgtactttgatgactagtaattactttttaaatcagatatatccttttatttgaaggtaaaatttaaatacttaggttattgtatgctctatgtcttgactatgatgccttttataataatttctaaaggcttaatttaagaatacagaatataaaatacatagcaacctagtttgataggctgttagctcaaatagagttgagaacactaagtccttcttttctttcagttcttgatggtgctatccactcattcttatcacccaatcttatattctgactttcagcaaagtaagagtcaatatcttgattttatttgaggagagaatttatcagatgttataggaaaattcagaaatgaattcattaattttttcagggaagttctggagtaggctctatctgtactactcctccttccccttaccccacaaaaagaaaaaaaagacctataacagtctgttattatcaggattaaaaattgttgccatttttgtattggtaatgaaaattgtagtttatatttgatagtttctagttttactatctttagttgaaattaagtataatatgtatataaaatgtattaaaatgtaataagaatgagatgatttgattaattgcatttattttatcactttgaattaaacttactatattggttgtttaattttgatcatatgataacagcaaaaaggactttatttatatatctaatttattctctttttaagatggttccatgggaagatttccaaacaggaagcttataatttactaatgacaggtacttacatatttacttgcttttctaatgtctatttaaagagaataaaaaagtgaacaaaccatttatcatgtgttttgcctttagcattcagttagtgtttatgcatgttataatttcgtgtccagtactaagaagctggtgtttttatttatattttaaacatacatgtgttataaaatttagtcaagtgtgtttttcttttaccccaggcccctgtccacttcctcagaagtaacactaggtgacagttttttttcccatatgtttctagaagttttctgtgtctctgtgaatctttctcacccctacacatacacagacaggaacatgcaacacacttttttcatgttagatatatattgggagatgattctgtatctgcagataaaaactttcattactctcttttatggatttaaacttttcattatataaataccataattaactagtcttcagtagaacgatattgtattgtttttattcttttgctgttcagctacagcagacattcttgtatttatctttgtatacttgtggaattatatgattgagctttatttagtatgtattaattttaacatttcccaaaactgttatgcttataaatacaaagtaaaaattgacttgtattgtggttttaaccatcctgtcattgtttattcttactaaatatttaaggctgaattaatttaaataccgagcatttctttggcaaaccacatcttataaagatttcagacaagtttaagctttagtatgtaatttaaaagtttcagttcttcaaaaatgttgactattcaatagtttctatatttggtgaaatagattcttgtggtgataaccctaattatagaggtaatctgaattgttttaatccataaagcactgcattttaaattaatactttattcttttgaaagatttgagatagtttttgaagtactcaattttattgtgaagctgtaggttaagtaggttcaaaaaataagttaaaaaagattatgataatgctatatgatagtaatagagaagaaattttaaactaaaatgacattctgtcagctatttcagtgtggaaccaaaaatatgtagtttagtgaatttattgaattttggatatgtttcttttttggaacttgtaccaccaagtacttgaggtacttttgttttaagtcatacaaggttgaaaaggagctaaacttaatttccttaatacattagtttgcattttctttgtgtcatgtgctcttttgaggatctggtgggattttctctcctgagaagtacaaataagcacttgcatgcacagtcttgcatgaaattcctatcatattctagaagaaatttagagagtatcttggattcttgtcagtaagatttgttgtatcaacttagaaacactttcattttagcccatattatacaatcaatttctgtaatttttatgtttacttatgtattaagccttgaagattcagtttaaggagatttatttttttctttttactgaacatgaagttacttcataagtgccttgattggatgattggaactattagtaatttacccctcaaattatatctaataatctaagcattcattgtgctttcctaaaaacaatcaagtcctgatcttttctggatcatttgaacttaaatggagaaaaggcagagcatctatgtattatgagtcactgccaatcaaagatatcagaaatacttctctaaaattaatgtcatatttaatatatgataatttgcttctataattcctttcaggagcatacctattgaataaaatatagtgtatgtgtattgatttttgataatgtatacacatatttcagttgttttgaatctacctttataaaaagcttttggtactattttattacagttattactttttaatttttttttttttaagatgcaggatcttgctgtgttgtccaggctggtatcaaactcctgggctcaagtgatcctcctggatagctgggattatatgcatgtaccactgtgcctagcacagtcattactgtttaatgattaattgaaaacattgattaagcacagagtattcttaagcaaactggtcttcactttttagaatcttcttattacgaagatttacatacagaatttagcagttttagccagtattccctaactatgcttaggttccttccaaattaggacaggtgtagatattactgaccagaagttactgctgcaaaatttctgctctctatttttatgtattaaagctggtaagatacaccagagagatagcagacaagcaatgtggatggttgtgaatcataaaccagaaaatttgaaagaaattatcttaaaaaaaaaacaagttcctggtgaaaatttacatatgtttatgactttgaatgcactttgtaataatactacttaacatcttttcttttttatttgataattagggaaaaactaacagcttaattcttacagttggtcaagtctgcagttttcttgtgaggccctcagataatactcctggcgattattcactttatttccggaccaatgaaaatattcagcgatttaaaatatgtccaacgccaaacaatcagtttatgatgggaggccggtattataacaggtaaatcataattttttagctatcttttacttttcgcaaaaatagttgaaatcttgataatacagtattcagagtcaaaattatataaaagtttctaacttctaaaaattataagaccttcaatataatttcatagtagtcatgcccaagaattctttagacagtgtcaaatatgaatacaaattagtaacttatactttgtttccttccaaaacaatttttgtgattttaaaaattagacataagctgtttgcaacaaatttactaaatccatgtgttatctgtaggaggagcaaaatatcttaggaaaagaaaatatatcaacattattttatcagtgagatactttagtaggaaaaaaaaagtttctaaagatacctgagacttattatacagatgttatcatgtaactgagttcttctcaagttgacatttcttacatgtgattgttggtttttacttctcactttcaaagtaaactcattgtttgtcccaaaactcagaatgaattatagttacttgattaggaaaataagttaatagaagaaaccatatgatagaatgtcagcaatttttcagtcaaatagaaaataatcttcatttgtgaacgtaaaggttttcctataactaataactctctatttcctatttcagaggctggcataatcttgttctaaaatgcttatatttgcctagtttaacccctcagtaccacagcagtattctctatctgaattagaatttgtcaaactagacatttgagtgaatagagattctgtagcttgtttatctgaaaaaaaccaaaaaacaaaaacaagttcttctagttgcttgctggaagctcagttgactgttaaaagacatcaaatgtaagatgtgagtctaggcagctgtacccttttgcctacctcatatacaggttgcttgagtactttatacatgacaatctgagttctagatgtcctcactgaaaatacagctagctgcaatttgagttctttaagaatgtaatttttcccaattccagttttctggagatttagaacatacaaaataatgcactgaaaatatatcatcttcttaactgaataaatgtccatattgagatcctttttaaagataaaataatttacatgaatttatttttttgaagttcgttttgttactaacttaaacttccttatgatacatcacacaaaactggaaattcttcctacatactggaggaagtcggtaaaacatgtaaaggtagtcgcttttggttgctgaacaccatgatggaacatgaaaaaagaagtattttaagtagatttctgtccaaattattgcaatattatgttttcaaaatgaggattaaaaaaaaaaagttaaatgtatgttaatttagtggccttgaccattcccccagaactttgatttttataatttttcttccctgtgaatttgtttataaattcatcttattgtttctagttttaacattaaacttctttaaaaagccccaaattatgtgaatcaggtgctgtgaaaatgaaggattttgtaattgttttggaaatatatatttcatttcagcattaatgttagtaatgtcagaaataattcctaggaagataaatctttgtgcttattgtttattgttagatctaaatgtataaagaaagatttttcaataaatctgtcgaacacagccatactctgctgtcccatctccccattaactaaacatgagaccttgataaagagggatagtagttatgtctttcatttagaaactgttaagacataactttaatgttcctatattcagagttttaaaaaaaaaaagcagaagaggcatttaatagcaaatttaattcagcagccatttatcgacttatctactttgtgaaatatactgtacaaattctgtgtaaatacattaaagaaaaagatatagtttcttctttattagtgctcaggtttattagaaaagaaagtatggtatgcagaatgtgataaattcaggggatatataaatgcatgggaatcaataaatgagagttcagtggggggtgagaaggaagacaatggattttggctagaccttgaggagacaatattaacatttatctagacttgaagaagaagagtgcacatggttttatgtgctaaatgcattacaaaaattaaaatacagaacacagtgtctctagaaactcacgtttatttcaaaagtaagtttacattgaatatgctttagttttctgagatgtaaatctgtctgatttcatggctggaacttatatgaatgtctagaaaattctggtttatctcccctgactgtttatttcggtgtttctgcgtagagtataaatggaagagtaatttttaaaaaaactcttaagtctagctcattggtaaaaacctatctgattggttgccacacacttttaaatttgctcctggacaatctgaactgtacttccccatggtttcctgttctctcagtttatgaaaaacaattatattgtaacattgaggtgctacagtggattgattgtattttacagttactgagcccaaaaacctttgatgtttactgattttcatagatttggtgctttttgctttaaaacacatagtcatctctttagtggaatctagctatcttcaaatatatttcctgattttcatttttcttttaacaattttggatttatatggtattagatttttttattaaaaacataaaatcttgcttgttcttttaataatgcttttatttatctcattttcaccacacccctctgtggcttgtgttaaatgctgcttctggtattaagttcattcatacactactagttaacttttcaggtccttttgttttggtttttaacattacttatatttggtttaaattaactttgtagtatagggaagataacatacttgaagatacacacacacacacatatatattctaattatatatatatagaaggttaaacaaaatctgtctggagaagtgtttcctaggtggctcaaaagttcccatttgtccagtatattaaaggaaggtttaaaattccaagatttccatattcaggacaatagaatgatcttactgattatagagaaacaactttatatttaaaaaaatacgtggttcactaaaatttatattaaaatacagtatgtcattttatttttttgtaatattttcccaatatttcccaatttgtagcacttttaatcaaaataataagcttttctccctatagtgataatcctacatgtaagattagctgggggtttttttcttctttttgcctgcttttcatgtgttttatgacctgtttctgatataaaaccagtatgtgtaaatgtgataataaaaattcttaatttacctgaactctgcttcctaaataaatgccatgtttctgtgaattcttcattcttagtatctcatatatactcttgggggtgaaaaaaaaggtagacttttaatcatttcctcatttatggtgactctttgaatatggtattgttgacctggctgcccacttgatgggtatggaaaatcagaatctgggccatgtattctggcctgtaaatctatattgagaacattgttttttctaaaataatatgaatgttatgatcatttattctattaatgtatttgtgttatgtgctttgaaaaaaatttgctaattagataatccttggcaagaaagtttacacatatttttaaagattttgcagttttatgagacagattaatactagaaatttttattttaacagcattggggacatcatagatcactatcgaaaagaacagattgttgaaggatattatcttaaggaacctgtaccaatgcaggtcagtgttgcatttcttattgcaataattagcattttattttaaaatgcattttggtggtatgtttttgcacacatttgtacaattcaaattggatacaacttaaaactacagattatttagatttttttagaaagtcaactgtaagaatcttttagtttttatctatgttgattttaggtaatcaggaacaacctagtggctttttgagattagaagcagtcgtggaggaaggtaagttgcagtaggtccaggagtgagttttttggaggcaaaagtagagacagcagggataaaccacagccaggattattaaagcctggggagtaataaaaggaaataaaaaatactgatagaagaggattagggcaaaaaatggtttacactttttctttgtttatttgcctgtagttttacggtgagaggatttgagaatgtctgtatactctgagtgaaaactgtatagtagtaaagaggagagtgaagttgtatggggagatgggtggtggcaatgtcttacagacagggtcctagacaaaagtgaatagaatctagaacataaaaggaaagattggccttgagcaagagagcctgttaaatgttagttgcttaacgcttagggtgattagcttctgtttcttcctcattgcactttctgaagtatatggtagggaaatggtataacaggggttagaaaaaggtgcttcaaaagacggattaataattttcctaagtggaaaatggaggtactgttattctagggacataaaggattattaagggttttgggtacccagctgcaattgtacagtgatttgtagtgtgcctagtttcttgatgtttcctcctaacaaattcatttcacatggctatagctactacttattgcagttaattggtggggggtggggtgggaggtgaggaatcattaatctgaagctaaagataaattcaagaatcataatcttgtcacattttaacatacaggcacacttcattttattgtgcattgccttattatgtttcaaagatagttttttttacaaattgaaggtttgtggcaagaaggacgtctattgcgactgtttttccaaagcaggtgctcatttgtgtcttagtgtcacattttggtaattcttaaaatgtttcaaactttttcactattatatgttatgttgatctgtgatcagtgatctttaatgttactattgcaattgttttggggtgccatgaactgcatctgaagaagactgcaagcttaatcgataaatgtagtgtatgttctgactgcttcattgactggctggttctgtttctcttcctctccttggggcttcctatttctgcagacacaacactattaaaattgggccaattaataaccctacagtggcctctaaatggtcaagtgaaaggaaaagtcacatgtctctcacattaagtcaaaagctagaaatgattaagcttagggaggcatggtgaaagccaaaataggctgaaagctaggtctcttgcaccaaacagcaaagttgtgaatgcaaaggaagagttgttgaaggaaattgaaagtgctactccattgaacacatgaatgattaataaagtgaaacacccttattgctgatatagagaaaatttgagtggtctggattgaagattaaaccagggataacattcccttaagccaaagcctatccaaagcaaggccctaactctcttctattctgtgaaggctgatagaggtgaggaagctccagaagaaaagttggaagctaccagagattgattcataagatttaaggaaagatgctatctccataacataaaagtgtacggtgaagcaaagaaactgtagcaagttacccagaacatctagctagttttccagaagataactagcaagttatccagaagataagtattgaaggtgctaaacaacagattttcagtgtaaagaaaacatccttctatctgaaaatattatctaggactttcatggcaagagttaatgcttggcttcgaagcttcaaaggtcaggctgactgactcttttcaggggctaatgcagctggtgactttaggttgaaaccaattatcgttgactattctgaaaatcctaggagcatcagaattatgccaaatctactgtgcctgtgctctgtcaatggaactacaaagcctgcatgatagcccatctgtttacagcatggtttactgaatattttaaggccactgttgaaacctactgctcagaacaaacaattcctttgaaaatgttactgatcactgacaatgcacctctacaatcaagagctcagatagagatgtacaaggagattgttgttttcatgccagctaacacagcttatattctgcagcccatggatcaaggagtaattttgactttcaaatccttagttaagaaataatttcataatgttatgtttgcaaaaaatagtgacttatggatctgggcaaggtacattgaaaaccctttggaaaggatttatcattctagaggccattaagaacatttgtgattcatgggcagaggccaaaataacaacattaacagaagtttggaagaagctgattccaactcttttggataactttgaggggctcaagactacaagatgactttgaggaggaggtagctgcagatgtggtacaagtagcaggagaactaaatttggaagtggagcttgaagatgtgactgaattactccacttttgtgatgaaactggagcgaaagaggagttgcttgttacggatgagaaaagaaagtggtctcttgagatagaatctactcctgtgaagatcctgtgatcgctactgaaatgaaaacaaataatttagaatattctataaacttaacttgataaagcagcaagagggtttgggaggaatgcttccagttttgaaagaagttcaactgtgggtaaaatggtatcaaacagcattatagggaatttcttttgtgaaagaagagtcaattgatgcagcagacttcatttttaagaaattgccacaaccaccccaacctttggcaaccactgccctaatcacttagcagacatcagtatcaaggcaagacccttcaccagcgtaaagattatgactcactgacgtcctagatgattgttatttttttttttttttctccctccggagtcagggtcttgcgctgtggctgaggctggagtacagtggttcaactgtagctcactgcaaccttgagctcctgggctcaagcaatcctcctgcctcaggctccccagtagctaggactgcaggtgtacaccaccgtgcctagctaatattttttgtagagatagagtcttgctctgttgcccaggctagtcttgaattccaaggcagaagccttggtctcccaaaatgctgggattacagttgtgagccactttggttgccccaacagtttttagtaataaaatatttttaaattaacacgtgtacattgttagacataatgctattacacacttagtagactacagtatagttgtaaacataacttatacgtgcactgcgaaaccaaaaaattcatatggctggctttattgtggtggtctggagccaaatctgaaatacctccaaggtatgcctatattttccttcattcccgcatgctttcctagtagaatttaaggtctatgagaacagagatttttgtttgcattgttttttcccagtgcttagaacagtacctgacattagatattcaataaatattgattgaatgaatgattctctgctttccagcaagaaatacctactttacccttgcctgtattgttactaaggtcttacactttaatgtgctccttcctatcaccatgtcagtcttcctctctgcctatctaaatactattttaacatccatcttgtttcactttttgagtaattttttttttattaccgcagagtaattggaagagaagttagccagaacatataacatacacacacatatataaatatatatatgttttatatatgtgtattttttaaataacatgggtgagtgctttttagaccatggctaggatcttttttcaggatcagaggtgcctttgcctccagatgacggatcctgccatatagttccattgctgtatcctcaattctaattccccttggctctttgagttagtgattttaattttatttgaccccaaattaaatcatacatttccccatactgaatttgtacttagaattttctaatttaagttttgatcaagaccatcctggctaacacggtgaaaccctgtctctactaaaaatacaaaaaattagctgggtgtggtgacatgcccctgtagtcccagctactctggaggctgaggcaggagaatcgcttgaacctgggaggtggaggttgcagtgagccgagattgcaccactgcactccagactgggagacagaacgagattccatctcaaaaaaaaagaaaaacaaatagtatgtggcatctaataaacttgcagtatgtgttataagactgctttaagaattacttgagatatgtaatgtgccttgctcttgtgttagttttataactgaacaaacctccaattggttttgcagaagtgcctataatgctttgaatacttcagaaataattgatgctgattataaagcaatttgattgattgctacacagaaactattaagtgctatttgtagtctattattttggagcatggggtgatgaaaagttggttttagtagaagtttggggaataataaaactcactcattcttcaagcagggttttaactattagtacaaaagcaatactatctttttactaatcgccaaattgattagttagcaaatcacctcatcttccaatgaggtgaccctgtgtacccacactcaggctaagatgctggcaaaggctaagaaacagcagagtcctagctagctttgcttacttcctggaactgttaacactttttgaggcaagcattagacaaaaagggtccttttgagacaatataccccataataaaaatgccttacatttttgagcactatattttaagcactgttttttatacatattcattcatttaattttctcaacaactttaccaaggtgacactacaatgatgcctatttcaaagataaggcaactgagagctgagaggttaataacttaaatcatcctcaattcttctctttttttcttcctgtactttatatctaacctgtcaggaagatcatactgactctgtcttcaaagtatgtctagaatatgaccaccaccagaatctgccttcatctcctagtttctagctttgtccccttatgctgcatgctgcgcagcagtcactgggatccatttaaaatgtcagatcgtgttactcctctgttttaatacttgaaaatgttctccatttctttcagaataaaagccaaagtccttagaatggcatacaagacccaacagtggcagtccattaattttctgaactcgtctcttcctactatcctcctgccactctttttcactcatacttgcttctgtattattatttgtaaataagccagactctttccttccttaggatctttgctgtagctgttcactgtgtccaaaattgttttctcttggatatccactagcctcactcttacatctttcaagtttttgctcaaaatttagcaaattagcaaatgacactttacctagacaccttaattaacactgcaacttgctcaaccctgcggagcacttaccttctaacatgtagtacaatttatttatttatgtttatttttaatctttccctggttagaatacaagttccatgaggataggggtctttgatttgttcactgatgtatctcaagaactacaacagtgcctgagactcaacatttattgaattaatatattaaatggcgttttcctacattaagtgacaaagctaggatctgcaagttaagtctgtcttcaggagcttacacatgtaacttctagggaagagcttggttcaatggctgttagactctaaccaatcagattactgaatttcccttgggaggaatgtaaaaaatctaagaactatctctcaggctgagaaaaggaacacgtagagaagcctttctcctctcattgactaggacttgaaaagtgatgttgtgtttttgcccatagcatcttctagtgtattggaatcttttaggatttgtgggctagtccccactttaatatgatttttaaaagatctatatagattccaagatctatataaaatcttggaatcaagtatttaaatccaaatattagtgtggttacatgtcttaaatgacagactccaagaatgttccattctgcagctaatactaagtgccatcaccattgaactaaagatttgataaatacaaatctgtattaccaggaaagtaaagtcatcactatttgtaacatcatggtccagtgtacccttttaatttttttatattcctaagtcattttacaaataattcgcatcaccaagattaagggtataatccaaaaacaacttcattggaaaatgtagtaagaatttaaatgtagcgtacccaaatttttgttccatgttttcatgtctagaaaggtttacgtacctgaaatggacagtcttttcaatgcaactaacagttcttcacccttcgtgcacagacctggaacacagccatcttgtaaactctgattccagatttgaaatcagatacttgtctaataagttctatttgtaattactttggttcttcttgcattgtatctatcatatcaattccagattttaagtacatcactactggaatctagcttattctttcttgtttttgtattatcaaaatgcagtttttttttttttttttgagatggaatttcgctcttttttgctcaggcttggagtggaatggcatgatctcagctcactgcaacctccgcctcctgggttcaagcgattctcctccctcagcctcccatgtagctggaattacaggcacgcgccaccacgcccagctaatttcatatttttagtagagacagggtttcaccatgtcggccaggctgggcgaactcctgacttcagatgatgtgcccgcctcggcctcctaaagtactgggattaaaggcgtgagcaaaatgcagtacttttgaaaactctgatggctcataattttgttggagagtacagtgtccattgctccataattgtaaaatatttttgtttagattttaaaacaccagttaacattgatgtttataagagtgatcaatccagtgaattttacaatttctatatgtttactttcagtaattttttatacaaaggccctttaatatttgcccattcacaaatcatattaagtaaattttgatgtacatacaaaaatttagtctcatttctttttagcaaaacaggataatagaagtaatatggttcactcagtgattgagtttgagaaaattcaagtatatcatcatctgaaaaatcacagtctgaggtttatcaaaatcaattctgccatcatgataagagtctagagtgctgctgtttctttgcattcgttttctgatttttctaattgtcaaacatcttcctggatcagtttttttctctttatcatttatgagcagaaaataaagagttctgaatattttaagtatgttcaatcaaagctaaaaagacagcaaagatggccttttatgtttttacaaaagatgccgcaatactttgcaacacagttacacacacacatacacacacacccagagtgatgcagtagagattatttatttcagttatatcatcctctaggccagcggttggcaaaagttttctgtaaagggttttgcagttcatttagtgtgtccactaaagtctgtctttttatctggaagcaaccacagacagcatgttagggaatgagcatggctgtgttccagtaaaactttatgtataaaaaacaggtggtggactggatttagcatgcgtgccacagtttgtcagccctgctgtaagcaattcattcttctattttcttattattttagtaattttgtagcattaacttgggaataattctgagtaatgatgaaatagttcctaggatgatgaaacagcataatgtttcaagatagaggattatgaaaatcccacagcataacttagatttataagaggattgaatggatccatgaagtttgtaagatggactaaaagtcataaaatatgaatccttgcaaaatagtaagaactactcaaaaaggaaaccaaaaaactaaaactgagtccaattgaccttaatagtaaaattgaagattcatttattctggaaagatcatgataaaggcatcctgatataattcttttcctcaggagatttagcaattaatgtaagttctgctataatgtaacatatgcattcctaaaaatcatagcattatgcaaaattaggcaatcaaaaccacagggcttttgagaaaagtgaggttaggggtgttaacacttagaaatttcatcagggatacattaagaaagaacctaatataaatatgttgcttagttttatacatttttttttaagaaatatgtacatcctacaataaatatggcaatttaccttgaaaaaagaggtacattacatgaggaaatggccattggtagagttgaagcatgggaatgttgcagagtggcagaggaggattatctgaaatcatggttataacaccagctgtggatggatgggtgtggcatgtgacacacttagtggattgagggaactgttaggtatttgaagtgtgtatgttttgttcattctcatgtcttagttcacctggtacggttgtctgtattcacctagcatttctcacagacacaattgtgcataggcaaacatgaatttgctttatgcttacattggttcctaatctaccagttatgctgggacaagtttatgtttttaaaacatgatttgctgtaaaatataactgactgtattcgaaaatagcttattaggtatccatggaaacagacaacttattagttgttcttgggattggcaaggaaacctttctgtgaactttgttgtcggtgttcttcgaaattataaggaagcatttctgagaatttctttggaaagcaaaagatcatttatgtgttatgtgtatctagattttagtattttaagcgctttggcttttaattggtacttttatagatttttacttcatttccatcaagaatgtatgaaataattttaatgttttttaaaattcaggatcaagaacaagtactcaatgacacagtggatggcaaggaaatctataataccatccgtcgtaaaacaaaggatgccttttataaaaacattgttaagaaaggttatcttctgaaaaagggtaagttcagacttttatcattaacccatttgatagagacgttgtaaatatggagctccgaacttattgtgatatatatttaataagttttgacatgagttattagtaattgacacttgtttagagcccatatataagcattcttcaaaatttagagtgtaggtatattaaaagtctacattttcaaccagaatgtttcttctacccatggtttctttttttctttctttctttcttttttttttttgaggaactccttatggcacatggcacattcataatattgatattttacagatttacctcaatttgacataacgacattttggggaattgtgggtgggggtgtgctttataaagtggaagaattttttccttaagactgttaaagaattattccaaaacaagaattctgacaatttcatcatgatgaaatctctgaagatatagttaaggtattctcagcatttactctgtgattaaaacaagtaatataacaaaaggcatttttgtacagatttgttataggcattttctcattatgtaagaattggcatattacataagctttggaataaaaattgattgattcatatttttagaaacactaattttaataatatgtaggatttcacaattgtttggctaagagaaaacaatttttttttttaaacaggcaaaggaaaacgttggaaaaatttatattttatcttagagggtagtgatgcccaacttatttattttgaaagcgaaaaacgagctaccaaaccaaaaggattaatagatctcagtgtatgttctgtctatgtcgttcatgatagtctctttggcaggtaagagactggtttcctatttttctttcggaattgtcttaataataaaatagtacaaacaaagcaaaccaattttgagagccctaaaatcatcttctaaaagtagcagatgcactttctaggtaatttttgccttccttgcttaattgtagactaatatatacataaagtctacttcattgtgttgcacagaaatctttggcatgacatttcctgtagtaaagcatgttttgtccctgccccaacaagcaatcttttgagtgacttactttgagtctttgtcacctttcctctgattttttcacatggtttaactcagtgtacccaagagtactaggtgcactcaattctgctattaactctataagcaagttcttaagaaagttaatgttaaaaaataatcttaaaattgtcttgataggaaaaatgtatttgaaattaaaaaaaattcttatgttgacttcttggttttgaaacaatgaatataaatgtataagctgaatcctaaacatcagaagacaaatccagctcttgattacatctagatttttttctcaagaacaatggcctttacctttcaccattagtattatcagtaatccatcccagtctttttagatgtacttaccatttttattacctattgttatgattagtaagagaaaagacagttaaatgtttcaacagcttgtttttctgccgcaggatggcatttctgtgaggcaaatctacgttttatcctgttgaaatatttctcttctttaagagaaatacctgtaaaatatatagccttgtcatttcttttttcagtgtgtttaggagatcacattagtgttacttgtgattttgacagttttttaaaatgatcaaataggtttgggaaatgctgattgaacaaatagttttacttatagcaaggctttttgtagctttagctagtgtttatattgtgaatctgtaaaatagtatgaattacttcataaattcattttacgaagatacccttttttttcccctgaatactcactgatacctcataaagagttgttccaaaaaacacaaagattgcgtgaggacaggatttcttgagatttttctgcccctctttaacaacctgagaatcttaaccttcaaatgtggttgattcaggcctctgtcttttctttttagttctactctgcacccttcttgtgggttgaatccttcctcaaaccagttccctacatggtagcaaggtagcaaacagcaccagagaaagggctgtaagcattcactcccataattattaaaaaatcttgaaaacattctgttgagccacctctcaaccaatttttagttctgggttactgaggtagcaaaaggaatgggattatcctgatagaatgaggagacccttttgtgcctagatctgttgctggaaatgatctcacccaaatagtgaggctgctctacttaccatatgtatgggtgaaatggatgttggagaggcaacactattcactactaaatgtagtttattatcgtgaaaacagttaaaaacagtaaaagtagaatattttgggaacaattttattgagatcagtaatatgaaataggtggctcttgattcttggaggatgggtatgaattcagttggatagttgagcagagcttcctaaccagtgttccattaatcagtataggtgtcccctgagatactagtggttgtaaaatcctattgtagtagagatatttaacaaatgttttatatttcaaaaattataacactcgaaatcatatgatccctgtataaactgttctaattcattattttattggggcaaaagaattgatgcataacacttggagacagagagctctttatagtggctatacctcagtacttcctactttcttgttcaatcatccaggtactctgaatattactttattcacagcttcattatgaagctaccttttatgttcaagcagaaatgtctcattttgtttcttaccttttttcgattaacagagaagttaaaattgttttaattatcgtaaaatatataaggaggttcttgaaaagaacataatgaatttgatatatttttcatttttactactttataattagccttaatgtacagatgttaatttttcccaccataagggcaatttagtgactaacactggaaagtcattagactcataagataaaaaataattttaaaaaaatgtaactcacttactaggacctgaaagaaatacatttaattgctaaatttttttttaatactttgaaacaaagaaggtcctatggaaatgctagttaagtttatgactgatgatgaggcttcacgataggaacatttaaagattttatgtcaagattatatatatgtttgtctgtagacctgaattccatattaaataatataatgaaatggaggctgtaataaaatctaagctgcttcagttgcatgtgttttcagttttaggtgagaaatggaatcaaaatacctactgttggatgctgaagtatgttacctgtccaaaagaaaagttttgataaaagtttatgattataggagaaaaacttttggtgaatgattctcattttgcagatttactgaagaatcagtaaacttcgtcaaattatatgtacaatacaaaaagatatgtgtcttgacagtttatggatttaaggcagaaattcaaccttggaaaaatgaggttaaaaatgattcactaatgatacttacaactgcaattagatgaatcttaaggaagtattaagatgaatattgcaatatctgtaagattgaagaaaagctttagcattattttgatatagtttatatgaacagatgcagttagattggaagtctgttggcacaatcaaaagaaaggtccacattacacttgatggtaaaagagaaagaattgccagagtaaaaagaaggatcagatccttgaagcacaagttgaagattgtgaatgattcctattctggttagtaacaagaaaggagtttctgtctggtagggggaaagcaataaatatacatttaccacttgctgtaaggttgtagcttgcttcttgtacagtttcttgttgaaggtgacttaaagaatttgaagacattagaaaaagtctttgtaatgaattatatttaatgataccaggtctgaaacctagtatgaaaaagttatgttcatgagaactaaactcaagtctctcatttagaaaacagatttttcttttaagactgggcgcagtggctcacgcctgtaatcccagcacttcgggagcccaaggtgggctgatcgcttaagctcaggggttggagaccagcctgggcctacatggcaaaccccgtctctttaaaaaattaaaaaattagccaggtgtggtgatgcacacctgtggtcctacctactcaggagagtgaggtatgaggattgtctgagcccaggctcacaactgccaggatgttgcagtgagctgactgtaccactacacccatggcagagtgaggcccggtctcaaacaaaactaaaccaaaaacaacaacaaaaatttttttttcaaagtatgctactttattattaactattttttttaaagtgccttcctgtgaaatagagaagcacttagtgagaaagactgaatgccaaggcaaatagcattaacaaagtacatttcaaggaaatgagaagacatctgtaccatataataggacaagtagaaaaataggttgataaattatgtattaccataggatgcaaataccagaggacaaaaggggaaattataaatgaatgttaatatctttttctttattatcaaattaatgccaggcattgaacatttcctgctttgtgtacacatagaacctgatatgctgacctttagcatttagaagaagactaatgtgaaagttaacagccaccttgtgcagtaggtgattagtgcgcatgctcagcctgatgctgaacgaatgttggatggcaatgctgttttcttgcatggctttagttgcacagctgtgcaatttttccagattattttcaatattaagagatctctaagcactccatttccttgtattaaacttctaacttttaatactgcattacttagaaagatgtcttagtgacacaaagttattctagtgactatccatgtggtaattaatttttacaccatcttttcatagctggatctcactgtggtatttattgctttacatttatttatgaaaatgttttgctggatattaaattcaagattggcagttattttgccattttaaagatggttttctgccttccaacattttcgttgtcattcaaattgtttctgttttagaggtaatgtatctttgtcttttctcttagaggtaatgtatctcacacaactttctctggatgctttgagatttttccttatatttttagtgggaaaactaaaatgtaccaactataaattaaaaaaaaaattatccttaggtttgtagtgcttcatcaatctgagacctgatgttctttgtcagttttagaaaactcttggttagtatctgtttaaatgtttagtatctaatttaaacagttgttctgccacattcctttttcttcttggagtctggttaaaaaaaaagttgcactatttcccatgctgttttctgtttttcatcctttttcctctgtaccaacctatatattttcttctgatctttcagttcactaatcttccattctgcagttaaatccactttttcaggacttcattttattacatttttttcaatttagaatttccatttttttaaagatacagtttctggcaaaattcttgttacctattttcttaaacattttaattataattacttgaaagtcttgtctgtcttcagtatctgcattatatgtatgtctttctggtttttcatcttaacttttagccatttaatcctgatgcctgtagtgtctacttagtttgactaagtggtagacattgtacatgaaaaactatggaaactaatgttattgcgtccagaaagaattgttcttacggatggtatagggttagtacatcttgtaaaggctgttctatttctggtttgcccttatcatgaaggcacagcccttcaggggtctcaatggaaagcctgaaattcattcttttttctcctagcactatcaaactactggatttgtagttaattttttagccttttaggaactattttctgcttagcgtctcagctacacagccagcttaggaactggcaactgccttgaacggaaaagatgtggagaatgtcgggttaattatagtatgatcttggctcctcaaatcttagctgctttggttgttctccagtgctttcaaacagttgtttttctgttttgtattactattttaagttttatccaactagggtggttagtctgatacaggcaacatttaggattagaagtttccaattcctattttccatgattacttttaagacattctcaaagcatgaaaatatagtctttatctttaataagtgttaagcttgtcctctgtgtatttttgctatggcctcctaacattagcatgatataaaatctttaaagcaggaaacagaagtaacatttattgagttccaaaaacatgcaggcccttaataaagattttaccaatattttcaagtctagttggaaagatagcacatttccaaaatgatataaattattacctaatattgtacttacatatcaaatgatttgaaataatactaaaggaagacaagaacatttgttgtacacaactgttcacttaaactctagaacaagcatatgtatgaagagatgatgtttccattttaacaggtgaagaaaaatgatcagtttagaaaaatttgaaaatacagaatcacctacaatctccttagagataattacttagaacatttttggtctaagaacatttctagtctttttccagtgcatataaagcttttcaaattagctgtgtgcagttctagcagttcagcttcaatctgtttgtaactttatttctaatgtattttacaattaattgaaatttctttagtttacactttgaaatactgataacattttaatagtgctgacataaagttttctaaaatatatatagctgacttttttttagtaatgatctggtacaatggagtattatttctttaagaattataattttatgttaattatttattgtgagtgttttggaagctggtataaatattttgctactttttattaagcttcctaataatttttgtttttattttaaaggccaaactgttttcagatagtagttcagcactttagtgaagaacattacatcttttactttgcaggagaaactccagaacaagcagaggtaagattactgtttctcaaactacagtatacttttatgttagcccatgttttcttattaactggaatagaaaatgatcgcattcaagataaagtgacagaacgcctgaaatctaatcatctcttattttaaggaatgagatttcatatgtaaaaagttttctgaaagaaatgcaaaaacaaacacagtgaagggttattaggaatgaaaactccattttaaattgacctttaaatactctatgatgttgaggccaactgagaatgctcatttaaaatcctctctgcataaaggttataggtcatctcagtataatccaaaggtaagccagttaaccagttagttttgctaacaagcattattcttcactggttgaactccatgtctgaaaataaaagtcagtcaacacaaggaaagatattttaggaatctattctctaagccaagtcgagatataatgtctactttagattagctattaatccatgtgcagtgtccttcttatagcgtctattaagtaattgtgtgaagaaataatattttttaaaaaacactctttaaaaaatattttgcaacaaagggagaacccacctctataacaaaagtaaaaaattagctaggtgttctggcttatgcctgtagtcccagccactgggtagaatgaggcaggaagattgcattagcacaggagtttgagttacagtgagtaagatcgagacactgtaagccagcctaggcaacaaactgagacactgtctcttaaaaaatttttttgctttctttgaaccctaatatttctggagtatatggttgtattttatacaaatacagctaaatttctgcttatattctaacgaaggaacttaaaggtggttaagaagtgaaagtggctttgttggaaatataatttgccaaccctagatatgaggaagatgctcttaaaactagatcctagcgtgagactcacagaataaacctgaatgagcttacaactgaacgtcatatttcacatctttatcaaatatctcatttaatgctcatttcacatgtaatgcacataaaattttacggctatgtatccctaatttttagatgagaaaggtagtgctcaaaacattttggtaacttacatgatttttttaaatgttagaaattgagttagaaatttaaacttcagtatcctattttctaagtattttaccatggtccctctttctgaataaaatgtcacataccataatgacatttcagcatgttttgcaagcctaacatagaacattttttaatgtatttatacataatatttctgtatttccataaatggtatttccagtttttgttgatttattgggctgtgggggtctctggttattctcttctatttcaaaaagctatggtaactgatttggttttaatttgctgtaatataaagacagtctctagatattaataaagttcagcttcattgaaatagccaacaaactaaagacataattgaataaagcaatagtacacagctttccagaaatatgtaaaaaccaaagtgaatatttagatttgtttttaataaaccttagttctctccttttccccaaagcactagataaacattttaaaaatatggctgcaatttgatttgaatattaggctaaaatgatttttaaaatctaatgttatatttgagaagcttaaaaataacccaaatccccttatacatttctacctgtatcatggtctaaagtatagattaatatgcttgtcatgggatcggtcatcacattatcagttggttttacaatcagcactctccccctctcacaaagtgtatcaagttaaattccacctaagcttgcctcaagtataacagcttaattatacagttaatttccccaaggtagtatctgtttgggagaaatagtttctttaatgtaaatttgattttttggctaattaatggccactcgatgtgtttcatacataaattcaaacaaagatttatacagaattacaattgttttggttgttttattattgttattgttatgttattgttattttattattggttattgttatgaagtacagtatagtctgagaatagaaatggcagtctagagaaggaaaaaattgttgaatttgaaaaaaaaaacctaactgatgatttggaagccaaataaactagtgtatatttctttgaagtgctgtttttctttgcaggattggatgaaaggtctgcaggcattttgcaatttacggaaaagtagtccagggacatccaataaacgccttcgtcaggtgaagcttaattttcttggatttttaattgtcacattttgctctaacactttgctctttttattttatttttatctgaactgttttggacatcatatggggttaagccatgctgccacttgcttcagtagcaggaaaacgttacttctttatgaaagagaatgttctttcttagtccatgccaactgttaaaaacataagaaagattattcttccactttaaataacaacactaaaccaacacagcagaaacggttctgttgggcacttaattttccttcaaaaacttattttggcctctttcaaaaaagtagaacattgaaaagatcatcagatttatagcactaatcccaataaacttttttgggattttcattttgaagaacagcttttaaaacctactgcttaactcttaggaaatatttaatcttatttgaaactgtaacatgccctatactttgagatttgtggagagttaagctaggctttctcttttttttgcctttacaagggtaactttataacctccatttcttggcttttttctttttagtaatccctgtataattggaagaagttaggcaaattttgacattctcaaggtttaaagaaagtttagtacaatatttatttactaaccaaagtgtctcctgttctctttgtgcgaatatctgataagctgagtgattaacatactgttctactgggagtggataatggttgatatttaggtgactaaatagtccctgtaacccaaagtctggctcttccccagggaaatttaagtatacacacaatcgccatgtcttcataacattgtaacattttgtaagctatcaaaaatcagattggatttttgctaataagagcaagttgtattttgtgtgaaacttgagccattaaaatgacatttgcaggtttaatataatcatagctaacatctctcaagcactttttatgtatcagtgggcagtgtgatttagtgatttacatatactgtcagccctttctattcatgggttctgcatcagtggactctaccaaccatgggtcgaaaaaatacaataaaaagatacagtataacaactatgtacatagcattcacattgtattaggtattacaagtaatctagagatgatttacggcatacaggggggcatgcatagattttatgcagatactatgtcattttctatacgggacttgagcatcttgggcttcgttagctgccaggacagagaggtggagggtcttggaatcagtcccccacagatactgagggataactagtttgtaatacttattacaacctgtagtgtagactttatacttacatattagaaagatgaggcttagagggacggatttgtgcaaggccacacaagtagtatatggcaagagagaaagagaacctgatactagaaggtggatggtctaagttttggcatccaaactaacaaataacttagtttctttaggtttgtatcctttcctgtaaaataagaaggtaaagtcagtgttttaaaaatttttagctgtggaactcttttatagaaatagaatcttccagataagtattatataacatacgggattttaatttgagtagtgacagttgtttacttatattaataaagaattttcttcttaacttcattttctctttatcattgttttatggtagaaaaggtgtatttcattatttctccaggaatatactgggagaaataacttgtaaaataaaattgcattgtttttatcttttaggtgggaagaattattttaaatgtctgaatgttttaagtatgtcatatacaaatatataaccaaagctcacattttctgaaaaaaaaggggaaaataagtcattatttttggctttgtatcttagagtaattgcttttgaaatgtagtgcaattctagaaatctggggtaatatatatatatatatttttttttttttaggtcagcagccttgttttacatattgaagaagcccataaactcccagtaaaacattttactaatccatattgtaacatctacctgaatagtgtccaagtagcaaaaactcatgcaagggaagggcaaaacccagtatggtcagaagagtttgtctttgagtaagtcttattttatcattacattaatcattttcttttaccatattgcatttctttctgtttttttggtctctgtatctaaaccatcagaacaaggtaccatatccaggtgttctaatagcatatatatatatatatattttttttttttttttctgttgtttgttcacctttatttgtgaagtgctatgcccttggtttttccacttagttattaacatgaattagcaagtcaaaaaacatttactaacccacaaatacaaaacatttactagggtttccagtacttatttgaatgaattattagtttaggaggttaaagatggtaggaaaagtgtgtaatctgcgtgtcttctgtataccaaataataaaatatgttgtgaatctggttttaggtctagcacactgtttttttttttaaagcagaaatagggggtttatttgatactagaactaaagaaataaggtagtttgatgccaaaacattttgttaattctttttctccttgctcctttagtgatcttcctcctgacatcaatagatttgaaataactcttagtaataaaacaaagaaaagcaaagatcctgatatctgtaagttgatacagaaactttctaaaatagaaaaagcatgttttatatactttcaaaattcacaatgaaagtcttaaaatagaaattaaaaaaacagaaatgcaagtagtataatttgagatagtttctttctgtacttcttaaagtattgattatcaagaaagaatatacctaagatagaaaaagaccaatatggttcaactgtacacactgttaagcaattaagattaaaatatttagccaccctcctttctccaatgaataggaagaataaggaaatgattacagtggtctttttgtagggcttgccctcatcccttctttctactttttaggtttttcctgcttttttttttcttttgagatggagtcttgctcttgttgctcaggctgcagtgcagtggtgtgatctcggctcactgcaacctccgcctcccaggttcaagcaattctcctgcctcagcctcctgagtatctgggactacaggcgcccgccaccatacctggctaagttttgtatttttagtagagacggggtttcagcatgttggccaggctggtttcaaactcctgacctcaggtgatctgccggcctcggcctcccaaaatgctgggattacattaccatataagtaaaaaagtattctatttaaaaatttcccttaaacttgaatgtcatttattctatttaaaaatttcccttaaacttgaatatgtcacttattcacttctggtagtcaaaggctcccagttcctgtcctcagcagcacagctccttccatcctgctgctaaaacagttgacagtgagatttaccagttcacatcagggtgaattaggttaataccttcttaaaactcaggcttagggaaggaagtgatatgtattaacagatcaaagcctgaatatttctctataaaatgtttattctgtagttttttgtagtaattttagttttccattacttttacgataaaatccaaaccccatagtaatgacacagaacgaaggccataccttatatttgaagtgctcttttttcttttttcactacttttcttcttagctacacctctagatctcgtccgctcaagggttacctgtttaaagtggagttttcacctccacaggctgaattagatattatttctctgtactcgaatagcattcaccactgttaacagcacttaccagtgctgaaacataattgatttcttgccttcttgactaaactgacctctatgcaactcaaagaacacatctcaatcatctctgtactctctacctatcagagtttagtgcaccgtagacactcagtaaataaacaactaaatattgaatttgtgatgttactgaaaactcctttaatgaaaagcatttaacaccatagggaagactgaacaccaggaaaatttacttgcatgactaattatcgtgttctctttttaaacaataattgcttgtttttcttcccaagtatttatgcgctgccagttgagccgattacagaaagggcatgccacagatgaatggtttctgctcagctcccatataccattaaaaggtattgaaccagggtccctgcgtgttcgagcacgatactctatggaaaaaatcatgccagaagaagagtacagtgaatttaaagaggtattaaattatttatcagtcttgtttttgttggaattaacagaaacatttaacatttaataaaagatccattaaggtaaacatagtaattcatagcttagtagcacaatgatgccagagattttaaaccttgttttatactgtaattttggtagaaataagtagactacgaattcattctattttaaataaatttattcaatgggacatcattttaaatataagaacttgtgaaagaacatatttcttgttagtctcatggagcatgcttataatgctacgtactttaaacaatcttttaaaatgtcattttagcttatactgcaaaaggaacttcatgtagtctatgctttatcacatgtatgtggacaagaccgaacactactggccagcatcctactgaggatttttcttcacgaaaagcttgaatcgttgttgttatgcacactaaatgacagagaaataagcatggaaggtatggtatggccatgttagtgtgatacaagaaactgggtttagattttatatcaaggatatatggactctatctctgaatatactaaattgttaaattatattgcaaaataagttattctgttttccctccttaaaaattgcagttggatgtcagttctgattatgttggttactatgggaagctgatatttctaatgtaggttttggcagataagtactagaagccacaagaaggtggtatctgtgtctacatcaatggcttgactgtttggcatatttatctgtattctcttgttttttattttcttttgagatggcatctcagtcgcccaggctgcagtgcagtggcgcagtctcggctcactgcaacctctacctctcaggttcaagcgattctcctgcctcagcctcctaagtagctgggactacaggcatatgccaccacacccagctaattttttattttatttttttagtagagacgggttttcaccatgttggccaggctggtcttgaactcctgacttcaggtgatccgcctgcctcaagcctcccaaagtgccggggttacaggtcttgtttaatttttacttcttcattacacagaagctgggtgtcagctgcattttatttctaacttttatagataggtagttcccaagctgctggacacagtgcttttaatggcttacaaaataatccaccctccccctggcccacacacaccaccaagcactttgattcattaacagttcttgcttctaggttccccaaataaatagtaaagtttagaactattttcctcctcatcacaaaatatagatttgtcaaggaatagataaaatggtggtccttattttacacttgagtttatcttttctgacagcatttgtatttcattaaaattttactgaaactcagtagacatattttaagctaataaattaatctatactgggattttgtgttatatccttaattgtaaataaaccctaaaatttcaaagcatggggtcaatgggcagcaaagctgatttatggtcctaattttatcattagctgtctaattgatcttaagtcatataacaattctgagtcttcatttttccatatgaacatggcagtgttaatcccttctgttcatgatctaatgaggtaatacatatgaaagtcttacagagttaagtctgtagaagtataggatgtcattgtaattagtactttcaacgctgcacgcaaaaagcacatttaagtggctattcctgttgaggtaaaatgaattcacttaatttccaatttggtcacattaggtcagtcctttacaaataatcttctaatgtaaatatttgtgtagatgaagccactaccctatttcgagccacaacacttgcaagcaccttgatggagcagtatatgaaagccactgctacacagtttgttcatcatgctttgaaagactctattttaaagataatggaaagcaagcagtcttgtgaggtaagaatttaatgttttaataagtatttttgcaaagaacatattttaataggtaataatttgtagccaattacattttaaggaaaatatattaaatttctaaaattattcctcatagcagttacacctgtctgtaatacatttataaaaatgttctgcaaaatggacttcttaaaaaagatgtactttattttgggattaaaaaccatcaagttgcaccagaaattcatgaaaatactttgtcatttcctctactgtactaataatctatatactacttacagaaagcgtgcataagataaattgaaggttttgttagtgactcattatataacctatgtagcacttcattacatcttggtttgttcttgaaggtttttttgcgaggggagaattatgagataacctcaactaaaacaaaaaaatctttttaggattattaaagtttcagtataaattcataatacactattaagacagtaagtggaatctcacacacatattctctcattttaatggtaaagcaactacaaagaaataatatatattagatctgatataaaaatcagtttaaggaattgtttttgacaatggacactgggacctagcaaatgttaatcctgcacgaaggtgtcgattcatactaataacttgaagggaagaaattagtgatttaatgttggaaatgtggggtaatgccatagttggcctaacataaggatgacacagaagtgcagcaggtaggtagggagtctctggactttagagataggctacggaattccgacttccatagataaatgtactctgctgacactagatcagaagggttacaggaaaagttctgagaaaggtttgtgattctgcctaaggcatttgatatttttattagccattaaataagcctcattcagaaaagcttttaatcagctttttttcccctcaaataaatagaattgactaagcactgtttgcttttcagttggctaattgggaataaatggtaacagacctaccaggaggagttccatagagaaaactacttaaaaactcccattatacaaagaaaaaagatcaatacacacagagataccgaaaaatagacaacctcgaaaactataactacttgttttcctctattcatttgcatttgtcattgccaacatgcatttatattgatttattccttcttttagttaagtccatcaaagttagaaaaaaatgaagatgtgaacactaatttaacacacctattgaacatactttcagagcttgtggagaaaatattcatggcttcagaaatacttccaccgtaagtggtgaaattttcatttgacaagaaattgtgtatctatgtcttcagaaatttctatttctaaaacgtgaaagcttttctgttgtcctaatattattatactctgaaaaagtcatggttaatctttatgagatgaattgtatttaaagaaaatagctgtcttaataaaaccacccattattttcgtacaagccaatatgtctggtttgtactgtagtagcttggggagtgaatagaggtttatagtttcagatttgagattgtaaaagatatcttgtctatccatttagtctatacttgatagactaatcactctgttaatatgcttgtcggcctccagtattagtgaactcacttgttcaggtagaagttaacttaagtctaaatcttgctccccagaatttgcagctggttggttctctatatctgaaagtaaatgtcaggaagttgactgaataaattgatgataaacttagtggataaagttttccttaccccttgctaaatgcctcattacctgtggcaaaatacttttttgggtaaaaggccagttttattgaactgtggtatatttgggtaaattaagcttttggctgctaggagatcagtgttttcacttgctttctgtgttgagatgattgtgttattttggcaggacattgagatatatttatgggtgtttacagaaatctgttcagcataagtggcctacaaataccaccatgagaacaagagttgttaggtaaggctcatcaattgatttgttaaatcacatactaataggtggataattgtgaaaaattgaggaataacaatatacaattcaatgcttttttctttggcttttatgtcaaagccctgttgcatattttctaagtccagatggctcctaaactgaaagttactgtgagatttagctgccgtttgcattttctaaaaacatgaacattcatttatagtcaagtattggggatttttaaacccttacaagatgaggctaaaagttatataacaaaatctgtagctaacttcatatagtattcttcatacatacacacacattgattggcagtgagagagaagggcagtaattgaccgatttagatattaattggtttgttacaatctgtgactctgagctaatcagaaccagaacatgtagttctgaagctgtgtttcagtctgctcattgtaccataattaggaagaactgctttggcaaatcatggaatttgggagcttatataaagggacttcattatcattattctataggaagaactgctttggcaaatcatggaatttgggagcttacgtaaggttacttcattatcattattctaacttatttttccaatgaagaagcagatctgtctggagaggttaagttgaactaaggttttatagaaagctggtggctaaggcagaactaaaggtaactttctaagacccaatctgatatccttgagtcttattgtaggcttttgcttttgttaagcatactccaactaataccccaactaattccaggcaaatggaagtttaatgcgaaagcgtcatggaatacagcagttttctaataatataatttgttatttagaatatacactgtcatgtcatgctatatgtaaaataattaggcaaccattaacaccattattacacagtttgttttgaaaatgtgttaatcctgcctccaacctaaattttgtcaaggggcttctatttctttttttggggggcaggtaatatttctcttggttatgatatgacataatatttaagaactacagattctgtttttcttggcattagtggtgattgggaggaatagaaaagaattacaagcataatattccagcacagttacgtgtgagatgtaaattaaaactgttctataaatttgtaagtttcaaacaagtataactgttaagcaaacacagcaggaaattgtaaactgtttcgtgcaagagggtgttttagggcatttttgccaaggttaggtttcaggctcatagacctactatgtataattatcacaatattttcaagtaaagtttacaagattctttaaatttgggaagtccaaaattaaagacttaattgttatttttttgagacagggtcttgctctgttgcccatgctggagtgcagtggtgtgatttcggcttactgcaacccccgcctcccaggttcaagtgagattcttgtgcttcatccacccaagtagctggattacaggcatgcaccaccatacctggctatttttgtatttttagtagagatggggttagaccatgttggccaggctggtcttgaactcctggcctcaggtggtacacccacctcggcctcccaaagtgttggattacaggcatgagccaccatgcccagccaatatattagaatttctataaatgctgtttgagaagtaacatctttactttctaagagtccaaaaattagcaaacaggtacatgttcaaaggtaaatgctaagaaattgggtaatccactctaacagagaacagagattgtatctattaatctatagaaggaattgcgtaactcattattttgggaataatgcttgtctttacatggattatgtctatcaatctgtagaaggaattgcataattcattattttaggaataatgcttgtctttacatggggcaagtaagaggttaattattagtgtggattcttcttaaaaggaaattagaaattatctacatgacaacatatcctccctaccagtgactaaaggaggcagaataggagtatctatgcaagcttttaacactgacattgtcccaaagtaaaattagcagataaaatcatatatgacagctgttagtataatttttgcttttgctattgttttataatttgacaactttttaaaactttagaattcctaatgtcttgtcttaaaagtttttcaggctgggcatggtggctcaagcctgtaatctcaacatgtttagaccaagacaggaggattgcttgaggccaggaatttgaaattgtcctgggcaccgtagcgagactctgctttctacaaaaataattaaaaaaaaaaaaaaattgccaggtatggtgatgtgcacctgtagtcctaactactctaagcctgaggcaagagaattgtttgatcccaggggttcaaggttgcagtgagctgtgattgtgggccactgcactccagcctgggtgacagaacaaaaccctatctcaaagaaaacaaagaaaaaaggaaaaaagaaaacctttccagtgttctattatagacattttcattgatcaataagtcactttttctctagtgcaatggattcttatttttatgtgaatcatcaacaaaatcaatgcaaccaacttaggctgttctgtttaaataaattaagaaatgagggtgtgtgaagttctaaaattgtacagaactatgcttatataaaaagtttatttctactcctgtggtatttcagaaattcttaagattcctgaggatactactttctctaagtatcaaatgaccactagcctggaataataaatagtaagcaagacagtaaatactacagataaacaacattttcccaaagttaatccacattctaaattgggaaaagtgagtaatacattcaagaagcagatatatatattcttaaaatacgatgctttggcttactgttttcttaaagctttctgtgtctgggctttcttttattggtttagagtgaattttatgggttctatgagtactaaaaattctgtttatatatattgttttaatgtaacacattatataggtgttttctaaaaaaaaaaaaaaaaaatttccctcccattcagtggttttgtttttcttcgactcatctgtcctgccatcctgaatccacggatgttcaatatcatctcaggtaatcagcttttgatacattttgaaattcaaaatattagaattaacagtttcatactatttaagaatactcttaaatcttttttttttttttgatcatccaattctagtcatggcatatatgaagtattccaaagcacccttccttccttgtgcttgtgcttcttgggcttttttctttttgtttcttttcttccatctcatatctggtctgagatggcatgattacacacattccaccttttttctacccctatttgtgtctcaaacctttataataagtgacttcttgtagtctgcagcttggctttttcaagttgggaagagctttgcttagcccattgctagactgctgccagctagatcttcaagatcaaattaaatgatatgtacagttggaatagtattctgtgagtacttatgaagaaagcagtcctggttcctcccgttagagatttttaaagtcaccagttatatagtgtaaattggccattttaaacttcagtaaacctgatccagttttattacccatatatccattttgagatgactttcaggtgttaaaagcttctttcaaagaaaggataacagggatatttgtgactttgaatgtaataatgaaccattataaacagtaggaactggaaccatttttaccttaataatctgaagctcaaaattgtactaaaaatgttttggaatgtcttaatttttacttctatatagccatcacatctctgtaattatcttttattgctactaaagtggttaaatctataaattattaatattaagggtttgaaattcttttggagagatttatctggatgttcgcctcagacaacaccatctaaaactaggcagtcaggtagattatttatgggattttactgttaaataattaagttccagagcttatatttaatagacaccaatacttttcatttacatcctactatctgtgttccacagggaagtgcttcctgacttacctttaaaatattttaaaagtttattaaatttcatgtttttctcctcaaaataaagcagaggtcctagactttatcttgcttcttgagctttaagcgaattatttggactgcaaataatgttgggagcagggaattgctcagattgctaacctgagtaggttgaaattagctttgtgaactgtcataaaagatgtgaggagtgacaatcttttttagtgataaaggtaaagctttgaggtcctttgaaatagtatcaaccgttggaaactgctgagttttgtagtacccttttcgcaagcctagaagcactgataagcatattcactttttctcttttaattcaagttcttttgaattttatggatcataaatttttcaaaaaacatttttccaaaaacattctgagttccgaatggaagaatgggtagtagtttaacagtaaagaaatattaaagtgctaaatttataatggtttagctggaagtgctgttggacttggtgtcattagctgtgcccaattctgttacagattctccatctcctattgctgcaagaacactgatattagtggctaaatctgtgcagaacttagcaaatcttgtggaatttggagctaaggtaaaaacattttgatactttaaaatgtaatttatgaatgcaagtttgacatgataaaaccataaattgtggcttaagtaaatttttagcagtgaaatttttagcgatgaaagattatttttgttggtatgtttgtttttaaagtagcttgtttaaattttacattttaatagtggaactttaaaaaacacaaatttagccattatagaaaacgaatttttcaaggtccagtgtactcaaattctcccacttttaaacataatcaatgagtacattttaatacaaaaagtcatttaaaaatttatttcacaaacattcactgtaaatgttaaaactcaagattttatttttttaaacacctacacttaattgtactatctaaggataatgactgatattcagttgggatcatatcatgcctcctgcttttgtcacctaatacgtgacagacttcttgccatatgtggaaatagataactctttcactattcttaataatggatatttagatggcttccatttgtccctgttattgttgtaacatatattcttgcatacatttcctttcatacttactcaattattagctgaactttggagtaaaatcactaagtaaatacgttttaggcttttgctatgtgttacaagatttcctgtcagcaatttaagatacttttattgctcctcacagccttgccagaactcattgggtactatacttttttcttttttgccaattggataggcataatattttgtgtttcattattttattactgttagagagactttcatgtctttatctttggaattgcctattgaggtccttatctcattgagtttcttactgattttaaaagagtgtgttaatcttaacattttccctatttatagcatggttttaagtagtcaggattttagtacgatgagcagttaactacgtgtatggcctaggttttgaattcatctgaatctttgaggcaggttacaaataagatattttcctattgcagtctttattatattgtattttaattccctgtaatctctgctggattcaaacctatgatttggggccatgtttgagtgaatttatatataaacaatttgtgtctgccaggctatgtgttacgatttgtgcttgggtccagaattttctttcattaaaaatacccatactcctcagtatagccatttgcttatatactagaaggaaaatactgtcattatatgatttaattaattcttgtgaatgtgttgctgctgctacacctaatttataagaagtattgctacatgtatgggttttgctatattaatttggtgcaatagtaattgcagtttttgctgttaactgtaattacttttgcaccaacctaatagatcaaacagtggtttgtttctggtgcatataacagaagcattttatttttcaggagccctacatggaaggtgtcaatccattcatcaaaagcaacaaacatcgtatgatcatgtttttagatgaacttggggtatgtatatagttttcaggtactttttttaagacttctagttgatatagctgagttaacccatttaagcagcaatctttagaaagattttctatccaaaactaaaaagacaaaaagcctgcaaatttttgtctgccttcctaaacaaaaaacatatttttgtttgtaattaaaaccatttattcttacactaaatagtttacaccaaagcatacattattgtggcttttagactacttccatcattttttagggtctgtcttgcttttcatatccttttaaagctatcacatctgactgccatgacattctgttgcctccttagcttttttactttgctgctactatgtggggcgtgaagcaagacgatgacacagttctgaccaggttaaataagtagactgaaaagtcttcttttctaggaataaaagacgtggattcggtgttacacttcattcagtgtgaatatctgtgcctcatttgggccttgttaataaaataaattgtgattacaaaattacgaatgagggtattttataatttctaggaccctgcctttcttaatcaagttaaattttcatgattgaacagattttcaggtactgagtcagttttaaactaaacttattagtaattcagttcatatacagagaaaccaggaaggtgcatgtacatgtgaatagagccaggtgtaaggcatggcattagggagtgctaggattggagattgaggtgtccatgttctgtcttaatgtattcagattcagttaaaaagaccaccacaatttgtggcaaacaaatcaggaatgccgttgagtcactagtttgcaacctcaggtataaaaactagtgtatgaaaaattatggcatagctccatatttatagtgaaatttatagtgaaatggacaaaaatgctaaaagtccatcatgcttctatatgtgaactgggatatagttggtcaatcattggaaaatatttttactataatgtttaaggaactgtgtgagaagttatgccacacaatctaagatttcatactgcttagaatccaaatataatactaccatatttcttcaccacctgtataataagccaaatttatttttgaagacccacctcaattattatctccttcaggaagcttttgctgaaccccaaacatgaataaaataacttttgttttacctcctaagcatcccctgtgtatctgtgatatataattctgtgttgctatgattactttattctaaagtcctttctactggagtcagttctctgaaggcaaatatggagtctttcatcgctataaacctttaatcactgaatgtattctgagtaactgtgtttctctgtcccatagataacattgttttgcagtttttagcaatgtaaagcaaatactgtcaccattttactggtaatccaagcccttgttaaatgttattccaaggcttaaaataacactggcatttagtgtcgataataaagtacaggttgagtatccctaatctgaaatctgaaatgctaaaaaatccaaaacttgttgagcaccaacaggaaatgctatttggaaaatctccaattttggatttttggattggggatgctcaactggcaagtatactgcaaatattccaaaatccgaaacacttctggtctcaagcattttgggtgatattcaacctatactataaactttcattatagtgactaagttactttatgaaccttatctgaaagtaccataattaacactgattattcccacacattagcaagtattctgagcatagtccacagataattgcaaacctgacaggttctcattgcattttcatagtgcagttcctacttatatgcattatcaacttagacaaactacaggagcttaataatgaaatttcatctaggaattttaagtttaggctgcatttaatccagattagcagttaacctacactatttggcatatgttctagattttttcagatacaaagctaattgttaggaagccacaccccccaccccttatttttagaatagcaataatattgtacacatctgtcatgctacggaaaaaaatggaatctggctttcatgtgaatacaaaggttacaaagtctatattttaccatcattaatactgaatattatatttcaataagaatctttagaattttaagagaaatttgagtattaaaaaaattatctaatatacccaattagaatcttttcacatgagactacagagaaagatttgtatttgtaacaaaaaattagctgggcatggtggcaggtgcctgtaatcccagctacttgggaggctgaggcaggagaatcgcttgaacccgggaggcggaggttgcagtgagccgagatcatgccattgcatttcagcctgggcaacaagagcgaaactctgtctcaaaaaaaacaaaaaaaaagaagatttgtatttctaaatgcaattttacgattcccttaaagaatgtacctgaacttccggacactacagagcattctagaacggacctgtcccgtgatttagcagcattgcatgagatttgcgtggctcattcagatgaacttcgaacgctcagtaatgagcgtggtgcacagcaggtaggctttcgccagccttcattaacaatgatgtttcaaagataacacttagagagttaataaatagctgaattctggttaacatttttatcttgttacattaaatttttgagactctgcatcatattacaaaagatctcagcagacagaaataacgggccccgactaaaatgatgtacatttaatactgaaaaacatcaggttttgctcttgagtctgaatgttaattctactggaaaacagtgtaataacactttggtagcatgtgtgaaaatggctagttagtaagtcaatattgattttatttttttttctttcagtttctgtcttgtcttttctctgtcacatacagatatagtgcatggccaaagtgattctcaaactgtgaaacaaatgattattatttgggatgtttgtcaaatttcacatccagaggttctgaagtgtggccttgaaagctgcacgtctaacaaactcttagaggaatttataggtattccgatgcaagtgaaccatggcctacactttgagaaacagtagactacattgatagacttctatctgccatctgcaccaaacagatacagataaggatgtattcaaagaccagaccagaatttgaagggacttaataccaggtcaattaagatattggagatatagaacaaaatgagttacactttgaatgtcctcagctgacataagggctactgagaggaagtgaccacagggacagttttgactagtttctaatgtagtttcaggagatagtgaatgctgtcaccgcactggctaaccatttggcagggattttgtagaagggattaaagcattgagtttggtgactgagttctctacaacctgagattctagaatcctcaagtcctgtttctccccgcccctccccccgcagctttcaaaactaataatatgacttgacttgccttagatattaaataaaaaaagccttttttaaaagagagataaactgcttctgacaacatgtgatagtgtgatagttctggcctaaaaaataggagcatgccaaacacaaacaaatttctgttcactttagggtataaaaattctcttagttatgaccagaaatactcagccaatgactgaataatagagacttatgttttgaggggaattgtggtaatattttatgcatccttttgctttgatacagtttttttcaaatccaggttcccatcctgaaattgctgaccgagctttcatttattttcataccatttttcctctgtctagcacgtattgaaaaagcttctggctataacagaactgcttcaacaaaaacaaaaccagtatacaaaaaccaatgatgtcaggtagcagccttcgccccagtgttctgcatggattcagcatgtccaacatggtaattcacttcagtttaatgtctcctttgctcttgccaaaaaatagcacacttttccacattccagtgatgtgtgagctatgcaaacaaaatccaagattctgctggtgaataactatgccagcaaccttgtaagctatctgtgcaggatatttgcactatttccacatggaatcaatctttaacaacctctgagccttggtgtacagaccacctttcacaaaacgaaatgctatgactgtatcttgatatctcgaactttcaaaatatattttcagtacacccagttgccaaagttttgctgtctcttagagaaagaactatgaaatcaactgacaagaaacacattcttattgacaattgtgtataactggattgcagactgttcttactgtaactacttcctgattaggaatatgaccatttgactgttcaatgattatttgtatttacagtttccagagtttgtcattataataggaacaatctttgctgtatacttttaaaaaatactctgctatttctcttgctggaactgttgaaagaaaatatatagaatgatctattgctcatcagctttattttttaaacatacgacttattttgttgaaattgtcaaagactgtatttagatctcataatgctttgttaaatgtttacaagtaaatagtttgaattcagtaaatattattggttgttgtattgatcaatgcatgttacccattcaaccattttatagactaccaatttcttttatgttaactagaatgcttttgttaaaagttatttgttcattatttgtgctacccctttgattatgcagacaacctcatcagctgcctaacttatccatctttgaacttctgactacttgttgtatctgctggatatttagttcaactgtatagttttatttacttctgtatgtgtatttttgtgaagtattcacaaaggttaagttaaaataaaaccaagggatatcttgcataattgattacttctgtctaaaagagctaagcatttaatttatttattttcttcctccttcaggggcagtttaaaccttagcatcagagcaaggcccagggagaagctgaagctttagattagtatttttgctaatggcctcttttgaaaaggattttataaatgcaataattccttccctctcataattgtgcagggcagatagataggacatatggaacatacgtggcagaatgacattggtaatcaaagtgagtgagacaggaacccaaggaggtgttcccacagtaaggaaagccctagattccaagagcaacactttatgctattcctctaatgtataaaatacaggaaaaaaaaatgctaagggcttaaaagatgtctgcttagtagttccaagctacaaaaggcagttatttctatgggggctgctaacctatgtggcttcaatcaccgtttaacactgataccaaaaatctcaacatgtcccatgctccttttccttgaaatcagctcaattcattccattctctcccttcttggctcttttatcaaattactctcctttccaccccttctgttttttagctggacttggaccaacatagtatcccaggtggtctccttccttggttacatgatagaagacagggaggatatggattagtcaagatatttttgctgtgcactttggctcccatttatcacacctcaatctttagccatactaacctgtcattcctcagtctgaaatccttctcccttttatttaaaatcacaaacctgacttaccctgcttcttatattttaacatcatttgtctctcaagttgaaatggaaacttgttacttacctttgtaggccctctagtaactagcttgtcagtgttgaaataaaatctctcacactttaacgtttttaatggggctgggtgggaaaattttcagtgataagtgtggaccttgctctgatgccaaagtttggcgatctgaaagggaaaatgagacaaattgtgaacatcttgtaattctgtctagagcctagcagcaatatatttaactaggactgcgatggaggatttataacttttggcttcttccactctgcttttgtaaaaatctcacatcacgaattttattcctttcactctggaatgagaaaaaaaaaaaacccacaaaactcaagcctacagtgtaaagaattattgttagagagatgaatatgcatatagtaagtattgccttaaaatagatgtaactataatggtacctacctttctggaaagtacagcctgggatgtactgagactgaggaggtgtgtgtatttgtgcaatttaattagattcaggacacttgaattactcggaattccttcaagccagttttcctgaaaaaaatctggcttggtaaacagacgtccacagtttggttccaattataatagttaacacttactgaatactagtgtatgcaggtactattctaattaatcctatgaagagtaggcatttttatcttccccattttcagtgtgggaaactggcacttagaggtttaataacttaccaaggtcacatagtgaaatacagctggccatgattcatatgtaagtaatttgctgtaatagtctgtgctttcatatttttatattgactcatttcaatttgaattacatttctctaacatatttaatctgcaaaattcctagtaactgttataatctacttacacggattcacttataggatctaataggttaattataaggctgtggtgatgtgtgcctgtagtcccaattactcagaaaactgaggcagaggatcactagagcctaggagtctgagacagcctgggcaacatagcaagaccttacatcaaaacaaaattaaaaaacaaccacaactgaatatacaatttgctgctacctacttatctatactagcgtaagagtttgatgtagacagctattcaaaatcatatatctggttttttttaaaaacccatttggaaatgttttcgggtaactaaagaaaaataatattcattacccagacgactggctttcagtaccatgtaacagttgaaataccttctgcagtttaatagtaatggacaaatagctaaatatatcaggatggcattcaaaaagccatttataaaggtttctagagggcaaaacacattccttaacacttttaaagctggctactaagttttgttttttgtggtgccttttttaaaaaaagcataggtttgcctatcatattttgcttaaaaaattaggcaaatgagttgcagctttaatttgatattagtcacgatggaataagaatattcaaaacaggtgctattctagctcttttgaagatggtttattttacataaagttactgtgaaagggaaagaaaacaatagaaaagttttaatatattttatgttttcacattatactttttaaataaagttaaacgtttgatatgcttcctacttctcttgattagttagcattgagaaatcaacttcaaatggttagagagattctaccaggtcgtcatcagtccattcttcctaagaaggaaaaaaagtgtggtaaggataacactgaagcataaccagtattgtttacctcttacctccctttaagaaaatgttctcctccttttacccatgtggattacaaaagataaaccaggaaattttgtaatagttcactgttagtaatgttggcatggtctcaccagactcctccagtgaggaataaaggttatggctgtgaccttttgcctctgattattcacttatttgacttgacagatagaaaattttttttaaaagggggtaagggaaaaatccttggagaataagaaaaaaagcaaaaatgtagtatgtatacatattgcttctgctttctatgaacacaggaaggattcttcattaaataaagacagaagagagaaaaatccctttaataatggacaacagtactgtacgtaaggaagtatgcaaaaaatgaaaaaacccacaactctataatgcctgtactcttggagaataaatcttaacagtatagtcacaccagaatgtataacaaaaataacttagagttcatctttggagtaaaacatacctcctcatgtttggatttctttgagacgtaatcatcatcttcatagcctttcctcttcttcctataattaagcaactatcaataagcaatccaataccagccacagaaactataaaatgtaaaataaactagcaaggctataggcaatatcatgtatctactgaacaacaaggccaggataaatggaaaaagataaacagctatggggtagggaaaatgatacttttacaatcaatctttaaattaaatgcaattctaattaaaaccctaataaaatttttcatggaattgtcaaatctaacactgacctaggaaagagtgtgaaaaaataggagcgaatataaaaaagaacagtgttggaggaccttgtcccagttatctttaaagcacactacaaaagctacggtaattaaaagtgagatattaaacagatcaatgatcagactagataagcaaagtaatgactatgcagaaggatgaatttaatgtgtgataagaagtgtttcaagtaactaggaaaacatgaaataaaaaatgagctgggacctgctgggcacaggggctcacaattgtaatcccagctctttaggaggccgaggcgtcagatcgcctgagcccaagagtttgaggccagcctgagcaatgtggcgaaacctcgtctctacaaaaaaattaaaaaattaaccaatgtggttgagcacctgtagtcccagctgctgagaggctcaggtaggaagatcacttgagcccagaaggcagagggtgcagtgagccaagatcaagccactgcactccatcacacctggatgacagagagaagactttttctcaaaaaagcggggtgtgggagctggggcaaaaattagtatttggaaaaaagttgtgaaaaacaatagaatatatcatatataaataatatatcatatataaataagtacaatcagccttctgtatcctgtgggttccacatctgtggactaaaccaactgcggattgaaaataaggaaaaaaattctatctgtactgaacatgtacagaattttttcttattattccctcaagaatacagtataactatttacataacatttacattgtatttaggtattataagtaatctagagatgatttaaagtatatgggaggatgtgtataggttatatgcaaatacgccattttgtattagggcatctgtggattgtggttatgagcagaaagtcctgaaaccaatcccccatggatactgaaggatgactgtatatagaatctataaagcactacaaaccacaaaaatgtggccaggtgcagtggctcacgcctgtaatcccagcactttgggaggctgaggcgggcggatcacgacgtcaggagcttgagaccatccttggctaacacggtaaaatcccgtctctactaaaaatacaaaaaaaaattagctgggcatgttggcatgcacctgtcgtcccagctacttggaaggctgaggcaggagaactgcttgaacccgggaggcagaggttgcagtgagatcacgccactgcactcaagcctgggtgacacagcaagactccatctcaaaaacaaacaaacaaacaaaaaagccagaaaattgggcaaaggggataaataagcaatacagatgaaatataagtgactgttaagtatggaaagttcaatgtcccataatcaagaaaatgcaaattaaaataccaatgtgatactttttcacccagactagcaaaagctaagcattgataatcacccattgtacaatatgtatgaaaaatgcaaagaagaaaaaaacgctgcttatttcataaatatatggatatacgtgcagagaaaaggctggcaaaggtaaacaactgctaagtaacttctgaggtcatgacagatttgggttttgatcaaagggaactttggtttcacttgtattgactgacaatgacaaaacagtttttgtgtcatgaaaactaaaggtaaaataattttgaagatcaaggaaaacaaatatttagtcctaaagtagcactactcatggtagcaagtaccagagctggtccatgaacagtttccagtttgcagtgagttaagtacaggaattgtgtttcataattttttttttgtttttttttttgagacagagtcttgctctgttgcccaggctggagtgcaatggcgtgatcttggctcactgtgacccctccagggttcaagcagttctccctgcctcagtcttacaagtagctgggattacaggcacccaccaccacgtccagctgattattgtatttttagtagagacggggtttcgccatgttggccaggctggtctcgaactcccgacctcaggtgatccgcccgccttagcctcccaaactgctgagattacaggcatgagccactgtgcccggccctagaaatttttaatagcaatttgatataataattttatgactgctgaatctaataaaacttgagcttatgtttttgtcttcacttttctagtaattcattttttattgaattttacaaaagtatacatctagtgatttttttttaaaaaagtccttcgcagtttgagaagcacccctcaagtactcatagatattcagaatttggcccagtacaaggcagatggcaatctggaatacaatgtaagctatggcagttaagaattttggattatggtccattcagttacttagctagaaagggtaggattagtagttcagtggtctaatccaggggtggataaactttttctttaaagagacagtaaatattttcggccttgcaggccctataaccagtttctgttgcaactacctaacttttctgctgtatcatgaaaatagccataggtgatatataaacgaataggtgtgctacattccaagaaactgtgttctaaaaacgctaatgggctggatatgcctggtaggtaacagtttgccaacccctggtctaatcccatttcaaaatcaatgcaaaaaggacataatcagtgctgcaatacttttattcattaaagtcaacattacttctctgtaaccactctgaaaaattcctgttaccactgaaaccgaggagtgaatgaaatccaccaatttcaagttctatgctaaaacatgctttgtcgttatacctataactataataaaacaacctcatattctgcacacttcctaagtccgtagatattccccaactacaactgtataggtaaggaatttgagtcatgtgtatttgacataaaggccttggaattgctgttctggcttttcatagttatccagcagcacatattcaccaattacagaaataatacctcaaatacatcttaaatataagatgccacagataactcccattaaattttaacaaataaggtataactttaagtaacaaaatgcatcccacaggaaatagaaaatggcagtttcattaatcctagtacctgtccaaattcccaactgcttaaacacctaaaaaagaaagtttcagtggatctttcaatttgcaaagcacaaattgccaattttatggtgattttcacattcagcttacaaatcaattaagagacattaaaggtgttcttatggctagccacaagaagaaattacatggcctcttttcctattggctttgtggtcactataaagtttgtcactgaaagaagtatgccgggaggccaaggtgggcggatcatgaggtcaggagattgagaccatcctggctaacacgatgaaaccccgtctctactaaaaatacaaaaaattagctgggcgtggtggagggcgcctgtagtcccagctactcaggaggctgaggcaggagaatgacctgaacctggaaggcagagcttgcagtgagctgagatcgcgccactgcactccagtctgggcaatagagcgagactccatctcaaagaaaaaaaaaaaaaagaagtatgccaactttctctactctagctaacagaagtctggaagagcatatttgttcctcagaccagatatcacaacttcaaagagacaaaagattaaaaggacaggaaaaggtaaaaggattccttaggaagaccctgacccctgaaatcccatgagaagtaacagaacaggacagggcctgcaagccaaagaacatatgagtcacagcaggatcagaactgcacagtgaatgccgaactattaccttaatctcattagaaatgtccattcaataaagaaaatctgattttatggatcagtcagctttcctctaatgagcaaacaccaataaaatgatttacgaaccagctggactggataacagttatgtctattgattaacactgtcacattaacttacgtgattacgttaagtgcaagctcagcagaatgacatcgctccaacttctgtttcagaacagcaacttcttcagatctgggtggttcatacttctttactaagtttctcatgcctatgtggatacaaaaaaagaatttaaactgaataagcaaacctccttctcatagtaagggagctggttacttttccattttgtcataggaaacaacactcttcaaatgacatggttattctcaggatttgcatcattctgcatttcattctacattaaaatccaataagcactgtatgtttagttcaagtaattatggctctctgctgtttagcccatatcatatacagcataaagcacactataatctagcattaatttttggcaaatcctactggggtcacttcttgttcagttttaagacttaaaaaaaaaatccctaaatgatttagtgaacatgttttgttctctatcaccaaccatcttcgtagtattctattccatagacagtgggccaagcatatacttcctgttttcaaaggaaactgttattacacaacatgcaataaagggaggatgctcagtaaaaatttgttaataatcctttgctttaacaaaacgcaaaccctatacaaaaatgtccactttaggttaaaagcaaactactgtatcagtaactttataattgcaaaaacatcctctagctgatcttgttattcaactataataaaccaaagaatacaaatttcaagattaggggaatgatgagagatccaatgggcttattattactattagccagccatgtgatccaaatgactacactactgacctatttcataatgcaaacaaagcagtatttttaactgaattaatacttgtaactcaacacccttaggacagtatctatgttccaaaaattacaaatatcttagtagcattaaacttctgagtgttttatgaagagctgtttttatttcattttaaaacaagtggagcaaaataaaggtattgagaagaaatcagtaataaaactaagctatgaaatgagtacagtggaataagacctttacctactaaattctatgatcctaacagctacagtcaaatcacaattagcttttaaagtgtaccccctagtggtataactaaagacctacagtttataattcataaatcacagccatcattctcaaaggaagccctcaggatcacttcgagcagagaatcaggaaatgatacatagatgccctgaagcatcttaaattttaaaacacaaaatatataaaatgtatgcccatttactgtcatcgaaaatcaagatttcaatcttatattctactggtttaatatttaattacaatacacatttaattaacaagaacaatttacacaagaaggtttggaaacaaacatgatcgacttttaaccccaaagagtagcttagcagccatgaccaagtgtgccacggtcaagaatggagaatgctggctaatccagccaataagtaaagtagagattctactcaactctcaacaccggcactaatgacagggtttctcaacaccagcactaatgactttttgggctggataagtcttgattacgcagggctgtattagtttcctgacattgctattaaaattatcacaaaagtggtggcttaaaacaacggaagtgtattctctcatagttctggagcccaaaagtctgaaatgtttcactgtgccaaaattaaggtgctagaagggccatactctctctggaggctccagggatgaatccattccttgcctgttccagcttccgatggctgccagcttcctttggcttgcagccacatcactccaattttcaaggcaagcatctttaattctttctctgctgtcttaacagtgccttctctgagtgtgtcaaatctccttctacctttctcttaaaaaaataatttatctacaaaatagaagttccaaatttaaacattatccttaagttatttcccattacatctttttcagtgcctagtatgtttctttattctttaaaaggatcctgttgtcaatctctaaatcctttctaaatctgactctattttcactctttgcataagttctatataaatgaacactacttccttctatataccttctatttgttctagaccaatgtgtctttcatgcttccataatacagtaattcaatgaaaagaaatctaaacaaaaatctgttatatttctagttaaacaccaagagatttatttagaaaggagctttgtattggaagaaacattttgtaaagtgttctcttttacttacttttcattatatctagtaactgtgacaggcaagttctgttctctttcagcatcagactctctgataaataactagtaaagaaaagaaaaaaaaatctattgaaaacatacagcacattgagaaaacatgacatcataaattattttcctccatcctcatcaaaggcaattaaaaaatttttaaatttatgaatgtataatctgtaactcctatattttaaggatttattaccacttacattaaaagatgtttattgttcctttaagtttagtgacattcaggtacaacctttcagagggaaaatagtatgaaagcaacagtaatagccagtacttataacatttatatcttttaatatagaagcccaataaggctaaccttattttacagatgaggaatctgagttacagggatgaacaagtcatgatcttgtaacttgcccaaagtaataaagctaggaagcagcaaaactggaatctggcactagtaaggattctctattcccttaatatgaaagccattttatctatagttgcacttctgtggagtaacagacattcaaaccaacaagactaccacctaatgctttataaatctattgcatcttatttgcatcaagtccaaatcaaaggtgttaaacttacttatcaatgtgatataaaacccaaattacctgtttttctcagagccactgacagtatgaaaatataatttctatattaaaatttcagttactctgaagttttacatacctgaacttgacctatgattgataaaaggcgaaatgaacagattctcaaaatgttaaatagtttttcaaacacaaatgcaaaaaacttatttttctcttgggggtaatagttagaaaaatagaaagcaatgctttaagaactcttgttgctgtctttatccagatttatttaaattttattataaagtttggtaactgtttgatattacatcatcatcatctactgtgggaataaattttggatctgaaaatcaggaaatctcctgacaactaatccatttctggctaccagtaattcaaaataactagttttttcctttccctctcctacctaaaattcctcccatttttgtcatcttcctttatttttactcttcatttccttttgatttcttaagcataagggtcataggtttggtgctaagagttggctgactagactcattatctctgtgaagttagcaactcttaacctcaattttgaatttgaacttataatattgtggtgttttaataaaatccacaggcaataagaatacctaaagtagcagatgaaaaataaagctctaaatctgcaagaaagagaagaaaatccagaaataacggtaataatcctatgattaataatctgaggcattatccagactatgacaacagcacaggggctttcccttttgaaatcagcaataaatgtaaagctcatttccacatatcccaaaaatttgcctgtaaatcagctgtaagttaaaaacgtttggaaagcatttccctaaaggaaaaaaaaaaaaaaaaggcccaatgtctagtctctgggaatgttacgaaagcctattaaatttgcaaggagccaaaggtatggcaatttcaattttgccttcctggaattataatgaactaaacttctaagatgaaataaattcatttggaccttcactgaagaatttatagatgcactatatacaatgcttcaagattaatcaaacttttggttatttgaattgtggaaaagaggacttttgttcccttacagaatgaagtctgcaggccaggtatggtggtgtgcacctgtcaccccagcactttgggaggcctaggcaggagactactcgagtctaggagtgactgagatgagcctaggcagcatagggaaaccccaactctacaaaaaaaacaaaaagattagccaaggtgtggcggtgtgtgcctgtggttccagctactcagcaagctgaagtaggaggatcgcttgaggctgggaggttgaggctgcaatgagctttgactgtgccactgcattccagcctgggtgagagtgagatgctgtctcaaaaaaaataaccacccaacccccacaaaattaatggaagtccacatcttaactccatatacatcagtaatttacatgactatctttcctaacacagagatttatcttattcatactcctaaagtgtagtacagtgcatagtagtacatagaaggtatctaataaatgtttgcttagtaaataagtggagatataaatcactttgggattaaacgtatacatttatatacagttggtgagctgcgtttgcagagaacaggcatatcataaataaaatataaacctacaatcccttatcctagatgcagatgtgttgcgaaattcttattaataagtattcatgtcttagaaaagttatctggtgtatatattatgaaatgtgaaatacccaagtgatgtctgtaatcaggaatattaagatttctgcaagggaacacaaatattcctattaagtgaaataaaaactaaatacaatctgctctatttgctgccaccttatcaatggattctgaaattatggataagggattataatcatgtaaaatagttttaattaactttaggaagttttatcatctttcttcctcagctatttctaggaatgaaatcaagcagaacctcaaaggtcataaattgagaaacttaatatagaaactaaaaatgtctaattggctgctagcttgtgcttcagttagttaacaatatttaacttccgcgtgtcatacatgctctacagaaggggaataaagataaaacaaggcagacatttgctgcactcaagttgctcaccagttcacaggaacttctaaatttgtcatatactgatagctatatcagtctttcaaggatcacctggtttacttctactttaatcctaaatgtatcctcttagtttaacagtatttttcatgatgtttaaagatttcctcaaaaggcaatttcatttcttcttctcaccaaccatcccagccacaaagaatattaaagattacagtcagaaatgattctatgaataaataaacccagtgactgaatttgacctaagttaaaaaactaattaatacctttccatagtaattccagccctggaggcactagataaaatggcagtcagggcaatttgggaaggtgtgtataaaaggtaagcatccgtcaatgcaattctattaagaaagtcatcagctgttttcctcaaaatctctggattctccaatatgggatagcgggtctacaaagaaagtttgcaaatgttaccatttctgagggtttaaatggagtataacaacagtttaaaaattacacaactcctattaagaaatatatgctataacatatctaaagttcctagcacagtaattgacactgtcctcaatttacattaatcccttctcttggtccttttccacctgagtaggaaggggagggaagggaagctcttagagattccattgagtctaaagtagggccaagaaatacatattcccaggtaaatgcttctctcaggcaacccaggtgattcaaatgtaaggccacatgtaggaatacaccttatttttatatgaaattccttctatttaaaatttgctttcaggaagaagtaaataaaaatgaatctcgatttgattagaacacactagacttcgaattcccacagaaaaagttttagagtatgcccaagagatgtggaagacctcctatttcctgacagttcttcataccctataaaataaactataaatcctaagtcctcagatatccatatgcaacacctaaagcactaagaaagcttttctacactctgaaacaaaatattcagagtcaattatgcaaaaatgcctcacctgtgatatgacaaattcagacccactactctgaccacaatgcctccctttctaatatatttactcatttacttcacagctgttctccctcctctgaacctttgctcacttatccctctacttgctcccactcaccagtgtcctctggtcctcatttctctcctgaattccctgccccaatatgctgccaacaaatttctggcaaaaccagaaactgaacagtggttgaatccaacaaactttcgctttgcaactataccaagatttctgagggctgccagagaaaaccatacaagcagaagtctggtaatgttactataaactcatgttcattgacctcagcaaggctcttaaacactgccaagcaaccatagtatttccacagacaattgactctcctatttttcagtgactgcataaatattttccatctgtcttaatgtctttgataattctcagaaactccatcactctcagaaaactatctcttaccaaagaaaggcgctatttcctgtcaacaccaaatcctgaggcataacagtatcctaacccatgatttccccttttccactgttaagagaaagagctattattccctctaaggccagttcttataccttgcttccaaatcccatgccaacccccttccatcttactccaaagagactattttgtatttcatcttgctctcactactagctctttgcctcagtatttaaatgtgcatcagtctcttccataaaacaaaacacaacaacaaaaaaactctcacccagtcagaaacctgggggttcttcctctgtcttcatctctatatgcaatcaatcctcatgttctattgattctacctaactacaggctaagcatcacaaatccaaaaaattcaaaatccgaaatgctccaaaatctgaaagtttctgagcactgacatgacactcaggaaattctcattggagcatttcagattttggatttgggatgctcaaccagtaagcacaatgcaaatattgcaaaatcaaaaaaaaaaaaagtgtaatcccaagtacttttagtcccaaattttttagataagggatactcatcctgtatctctgaagcccaggaagctctttctgtatccacaaccttcatacgagtgaagcccagcactatcttttgcttggactcctttaacggtaccctgttattgacttaatctattctaatccattctccacgttatgcctgacacatacagatgcgcgataaatacctgatccataaggttgccaacatgatcttttaaagctgcaaatctaatcatgccactctctaaatttaaacctttcactagcttctctttgctgtattcaaaatctgtaacattgtctccacagtctagactctgccttccactctggcagcagctgtctgtgatctcttccccctgcattgctaggctctgttcaggctcttcagcacggaatggtttcttgaatttgagctttttaccagggaagtctctgattggaatgttcttctctctcctattcctactctgaattttattttaaatgatacgttctcagaatgttttccttaccccttaatctgttatctccctctaaaatatattttcccctctgtatcattgagcacactggatatatgattgtctaaaacctttagattgtaaggttcacaaaagttgagactgttcctgtcctatttctggttacatcctcaagcacaaagtttggcacatagaaggtacccaaattgagccactgatctaacatgaatgaaccaattcctgatttgattcgactcagactatccaacttctcttttagagccaaacaaaacaacttaaaaaagttgcttttgtcaatgtttgtttacgtatattattgatgcctacatagtgacttaagttcacaaacctctaaaaatataagtcacttagcaatcttctagtttaagaattttttatggtttaaatcaggcccagatccatgacaatataattcaaagttagaagagttatcttaagcctttatagtaagcaccgttctaaactctcaatggtcttcattacatccctggatgtaatgaagatcacttaaatgagattgcagatcacttaaatcagaaactctgtaagtcccacccaacaatctcagttaacaatttctccagatgactgatgatgcccactgaagtttgaaaacaactgccctagatgaccaggccagacccacaggttgtatccatgctataacaacgaggatgattatgagttttaaaattttggattcttttgttaaagaataggaaaggagaatgtagtattagtttattttacatcaagtttacctttaagtcgatgaggaagccctcaaatggtctgtaaggattgtggacaataaggtggaaattaagttgctgtataagaagtagttcatattccagtatctgttcaagtgccttctcctgtccaagaggactctcccggaggtttccaacaaactgaggactagatacattgaattcatctactttgcaggccaaaaatgcacaagtgagcctagaggaaaaaataaggaggcaggaggcagggggtgggtggggtggaagaacatgcatatactttgagaagtatctaaataatttatttctaaaagtatattctataattgcctaatattcaaaagcgactgctagacattgcaagaattgttttttaaaagacacttcctgttcacacttcattaggagacgtaagacaactataaaattaggtcaaaccaatattgccatggcattcaaacatcactgactcaatgacagtgttatgcagtacaacctaaatatctggaaaaacaaattaactgaggaataagagtactttgtataatgtagatggaagagttaaaaataaagcagtacccacatatgtaccatgtaagtatgggaagaaaagtaggttaaaggaacattgtggaaggccatcggcagaagtctctaagggcatctgaataagggactattatttaagggacaaacttgtgaaattcacctggccacttcatgctgttcagtatgagaaaacagtaagaaagctactgtaaaaaacagttggcagtgagatcaagggcctaatcttgactggtggaaatgggaatcaaaaaagagaaaacaggtacaatgtcattgagagcaaactctttgatgagtttcatactaatttcatttttaatgatagacacagcgctcagcagagagcagcaacaacagacctttgttcaactgaaatgagtatgaagctataggatccgtaaactgactggatgtgggaggggccactataaatgattctcagtctgaacaactggaagaacaaaggtgtctaataggaagagatgttagagaagtagctaatttgagaaaaacaaaatttgaatctggacaagctgaagttcacataccatcagaattactgaagtacaggtaaacagagatctcaagttctgaataaaaaaaaaaaaatagaattcaagtctaaattaccctgtattaggaagtcagttctctctctctctctctcacaattctctcctcccaaaaaatactcaaaagattataaaggtcttcttaaatgaaaacaatatattagacagacatactcacattattatcctggggtgatattccattactgagttattaagataaaaacgtttgaaatacatacaagccgtaccctaagggttaaaaaaaatatatcatcaggatctagtcacaaatgttaaatgttaaattttgtgaaacagaacttatttatggaaaggtttctttgtagagattacccagaaaaatactaatactcattaattcttctttaatcaaaacaaattgtgatgaattactacagaaatgccatagccaaaagattctttcccatcctttgcttgtctatccccagcctactctggctaatccttcctatggtcactggatttaaaaatacgtgtgtgtgtgtgtgtgtgtgtgtgtgtgtgtgtattagaaatcagactatcaaaaatgttctgaattagataaattcaggaagaaaaatacaaacgttcacagattaaccaatcttataaaaatactgacaaaaaaacatgggcaaggcaataagccttctctctaaagccactccatatttgtgatataaccatgtatccattccatgatttgtgatcactgctgccaactgaatggcagaagcagcactaccatttattgaatgtataccatgtgccagactctgtgctaaacacgaaactatcatcatgttttaatccttacaacagcttggtgaagtattactatctctacagagaaggaaactgagtatcaatgaggttaactgacttatctaggtcacacagctaataaggaacaggaatgaattcaagtaagacctgcctgtacttttaaccattatatcatttggctggaaccaatgaaataaccacttatctattttatgatagaaaaaagaatatttccttttaagtattttaaaagtttagttttgtcattatgtaaaacaaaaaattattcaccaatgataaacatgttatttaaaaataaattccataaagaagttcattaaaggattttttcttcatttgataagatcacttaaatttactgcctcattttacagttcttttgtaagaacaagccaaatctgaagatataaactaatcaagtatacctaaaactctctctgaatctttgacatctcagatgaaaaaaaattgtaaattctatggacttaatattttcaacatacttcaatttttttttcaactataaaaatggagataatttcctagaaaattattctctactgggtcgtaagctagtcacgctgtataactttaaaacttaacagacttttacttaagatatacttttatatttggtcttcacaacaaaccagtgagagaataacgtaacaacattttgaacaccctcccactctaccttttttatctttctgctttttaatctcagctacctgtttctcctcacggttgcccaccccagcaaaaaacaaataggtcctcagaaccatacatctgaaacaataaggcaatctttttcaccaaagataaaactccagcttctactaatcaaggcttaaaaaaatcttatggtatcagtttcagctggggcatatgattaccaatgatgaatgaatgcattatttcaaacatttattgggtgtcacagagttggaaaagcagtagtctatgttctagtcccagtcctatggctcattagttgagaacttagaggaaagtaatttattttttttctttctttatgacattacctgacctcaaatttttttctgaccacaaagtgagacttgaaatacttttgaagatatgatacagcaactcatgatttaaggcctgtattgaaaaatatataatgtgccaaaaactaattaattgtaactaaggtgaatttttaagacttgagtggacagggaatttagaagaggtcaaatttcacaagccaactaaaggacattatatttcatcaccactgtaacttaccacaacagatcttggcattgctggcttaaacaccgaacagaattccaataaccttttctcatagtatttgcagagtgtcatttcttcatgaggctcaagaaagactggatcattcggaagaacctttagatcaacaattacaacacaagttcaatgaattcaatgaattaaacaattgtaaaacatttttctctatctagattaaatttagtttatatatccaacgaagggtatatatcacgcctcattttctttatagattcgctaatcattacacaaaatagctgtaggaaaatatttaataaactaaaactgtaccatcatttcacgacttttcggaatgtcagctagacctttgcttcattaaagtataaacaatcatgacaggctgtgtgcacatgctcacagttgtgatatcattatttataaattaaaaagtagacagactttttaaaatatgattggaaagcttccaacatccgtttctcggtcagtcattacgtcacaagttgtaaaaaaacagcaaatgtttcaataaatttctgttattttaagctacccagtttgtggtgatttttttaaggcagcccttaggaaactaattcaggtgctaaaatcagtgatatgaaatagatgtgaattaaaggtagaaagtaaagtaactcagtatcggtaatttggaggcactgaacacttgctggagtggagcttgcaggaaagattaaaccagtccgagagctgtaacagaaggaacttggctagcgggccatagtccaaaccatcttcagtcacttggtttgtacttggtctctggtctccctccctcatccaacccattcaccacgaggttgctagagcgctgtttccagaacggaaatctgataaggttagcttcccattttaaatatttcaaaggttcctcatcctttcagtggaaatgttaaacgcctcacttccacttacaagttcccttcctaccctccccagccattcctgcacaggtactcaacttcggccacatacgaccacaaacacgtccacgcaccatctctgtaacttctgacctccctcccactctgaacggtggttctgactgcctggaacttcctttcccattttctccgcattggctactgggaaaaaccttccccaacatcatctcttgacaagtgaacggctcttgccacgcactaccttagcacactacttactctcttcttcactacgttacaaagactggttacttgtctgccattcgacgacggggatggcgttgttcgtctttgtacccacggaacctggcaaggtgctcgcttattttgatagaaaaacgcactccgcgccgcagaggcagagaaacgacggagcgagattgtcctgggagccagaagagctcccgcagctgctcagaatttagtgaccgggcaactgggcaaccgttgggaaaacctcaccttcccgttggccacggctttgcatctgaatttgcggttggcgtcagcccgcagtcttgccagctgctcctcgctggagaaggtccagtgccgcttctgactactgttgtggtacattatggaatcgtgaccaggtccagagggtctgcagacgagaacccaaacgcatcagcgtcctggcgtaaaacacccgtacccccaccgaagatctcgcggaagcctagggcgtccggctagccggcgctggcgcgctgtcgtcacgattacgcggccagcccgtacgcagttgcatttccggagcggactaggaacagaccgtatcccgggttcgttagggcgcccactgagacgtaagt

SEQ ID NO: 83 - DNA, 235147 bp, Homo Sapiens
tctttcgcgaagggaccgtctctgccaagcgcctgttggtaggaacctgcttggtcgcgtctgagggggcttgtaggtggctctggctgaaacaggcgcctgcgagagtctgtaggagggaaaccgccatggacgatcagggttgccctcggtgtaagaccaccaaatatcggaacccctccttgaagctgatggtgaatgtgtgcggacacactctgtgagttgggcggcagtggattccctgggggagagacgcgctgggtgggaggagaggaccgggagatgctaggcctcgtcttgggagcaaagggcgttgttagtttcaacactggggaggaaaatgggaaaagaaggcgttgtgactttaaatagactgtagccgctagccccgagcggctctggcctgctttgaactgcgggttctcagtgtggcatccagcagtttgtcaggttcccccttccatagccaatgagtatcccgactgtatttccaggctttgtgttgtttactgggctctggacatcgctgattaaaagcgtgggggattggagtgtttatttcatatgaaatgtttttattgaaaaagtgcgaaagtgctatgaaaacttaaaatttgcttgagtatatactgctgctatttattgtatgagttaattaaaaaaccctgtgtgtatgcccacttgtcctgatggagttcggttagactcccatcactaaaatgaagaaaacccggactgtaggtagttaattttgaagatataataatggctggcatttgagtgcacattttgtgccagacagtgttctaagcgccttaccatgaattatctcagttcattcctacaacagtcccatgaagtagatactggtatttccatttcacagggaaggaaatcgagactgctcaaggtcccttattaagtgggccttgagagaattggaacccaggaagtctgactttagaacgcccattttcaggggaagggggcagaaggagggaggttgagtttgtgtattttgaaacagggattggtcaaagtgtttcttgccagatttcttgtcagatgtggtttagtgaaggtggttctagaaagcactttgagataaaaaggtgccatgtaatggcgagcatatattcctgtagtttctttcaggtttattggaggcaaaaaataatggataatctacagtgtgtagacaaggtctcctcccaaccccccaagtgctgacaaaaatgtagagcaatgacagggtctttaggtaagcataaattgcatgattagctgtagctataattattatatggaatttattagcttacttaacttttctaattgatctttattttcctttgctttactctgcaaagaagtatagtagagctgtgattgaatgatttaagattagaagtaaggtaaaagtaatcaagaagaatgcatggaaaagggaattctacatggaaaaacactgtagatagactgtttttagagagatttcgttcaatttctctccatttttctttatcaggtttgttatggtggaacaggaaagagagtttgtttttttttttgggaaggatactaactaaatgtaatttaccagaaggatgctaaatgtaattttctggcctagcagcacttagccattcagggaagattatacgatttcagtaacataaatggcattttaattgggcaagtataaaatatttattttaattgaaattgcttttgttgtatcctcagccctttttgttaagatctaagagttaagacttttgtctaattcattctggtgttgcatttaatgtggttaatttgctaacctgttagataacaggctacattttacagtccttttttgacttgaaatgtgaacaaaatgagtgaaaagctgtagcgtattggctgagagaacaagctttggaatgagcctgtctgatttcacattctttactcttaccggctctgtggccttagggaaatgactaactctttgttagccgttcttcttgttggtacaatagagaaaatagtgctgcttgtatcacggtccttaagtattaaataatatatggaaaatatttagagatatttagtattctgtcacataatatttgtttactatatattggctattttattattattattctttgtgtggcatgggtgataagcagaaataaaattaaaacaggacttatttggcctgctatgaaatacttgcacaataatgattagctttaaatgatttcagtacactatgaaatgtgaaaatacagctttaattataaggactctgttgtaattttcttaatatgaactctttagcatgttgtctaattaatcatccttttaaagaagtactttaatctaggctaacacactgctgtttctgaatggaggagagaactcactgatttttttggcaatcatttaaaaaatttaaaattatataagctattaataataaaagcaacgtaagttattaagtgaaaggtaaaaatttctgtggttcacttctccagaggtgacaacttttaggttgtttgtgtatattttcggatattttctatgcatatacaaacatgggtgtgtttgggtagaaaactttttcttcctttagcataaacaggaatatagcataaacatatatatatgtgtgtatatatatatatttccttgcttttttcattatgtatattggataatctctctagatcaatatgcatatgttttcctcttttaacaatttgatagtagtccattgttcaaatataatttatttaccccaatttttaaaattaatatttaattatccagtttttccttggagtaagcatccataaatatgcatatatatgtacatatatgtctttgagcatttaggccagtatatcataagatataacaggtaaaaatcacaaggtaatgtccagtagtagaattgttgggtcagagtttgtggcttttaaatttgataaatatggcccagttgttctcaaaaaagattatgtcaagacaggcatggttgttcctacctgtaatcctagctacttgggaggctgaggagggagggttcgagaccaacttggacaacatagggaaaccctatcctttttttttttttttgagaaggagtctcgctctgtcgcccaggctagagtgcagtggcgcaatctcggctcactgcaagctccgcctcccgggttcacgccattgtcctgcctcagcctcccgagtagctgggactacaggcgcccgctaccacgcccggctaatttttttgtatttttagtagagacggggtttcagcgtgttagccaggagggaaaccctatcttacaaaaaaaaaaaaaaaaagatcttgtcaattatgttaccaacaactgtatggagattcctattgccacacaactttgcctatattggctaatattattttttaaaatcttgcattttaaaagatgtttaaaagcatcttatcagatgcttttctgataagaaaaacatcttggattttttttttttttttttttgagacgaagttttgctctgtcacacaagctggagtgccgtggcatgatctaggctcactgcaacctccacctcccaggttcaagtgattctcctgcctcagactcccgagtagctgggactacagtcgcatgccaccatgcccggctaatttttgtatttttagtagagacggggtttcactatgttggccaggctggtctcgaactactgacttcgtgatccagccgcctcgatcctcccaaagtgctgggattacaggtgtgagccactgcgcccggcctgagatggagttttgctcttgttgcccaggctggagtgcaatggcgtgatagctcaccacaacctctgcctcccgggttcaagcagttctcctgtctcagccttccgagtagctgggattacagacatgcgccactacctctggctaattttgtagttttagtagagatggggtttctccatgttggtcaggctggtcttgaactcccgacctcaggtgatccacccgctttggcatcccaaagtgctgagattacaggcgtgagccaccgtgtccagcctcattttggctcttaatgaaaaattttttgatagtttgttgagtttttatggcatatatttcatgggattgaatataggcatttttataatatgcttgttagtctgagaagagcaggtattattttgctgaatgattctggctcggtcttaggatgttgtaatcaagttgttggctaggactgcagtctagatttgactgggcctggagtatctgtttccaaggtcactcatgtggctcttgtcaggaggcttcagttcctccccatggactcttccatagggctacttatgacgtggcttctcccagaactagtgatatgagcggaggtaaggaagattggagagatggatgggagaagagagaaagggagggaggaagggaactggaagctgtagagccttttaaaacctaatgatagaagtgatataccatcacctctggtgttttgtagtgttataatgtgggagagtacacacaagagtgtgaataccaagagtgtgaatatcattgggctatcttgaaggctggcttccgcaggattttattaacttatttttttttttttcatgtcctcaagtagcaaagactttttggaggcaagtgataaagtgagtaggagtagtgcttcataaaagaggaactatagggttatggaaaaattaactaggagttttacttatgggagaaaatacaggagcagagaggagagaaaagaggtgaaacattattaaatacctttgtctcttagctgctagcaattgaagaagcatatttccctacttatcaatttaatctagcaaatgcacaaatgaattgattgtatgcatatagaagaagattggatttcatgttctttttttaattttttctgttcaaggatgaacattgtctcaattacagaaaatggtaattttttttctttatcaggccacctatttcaagaaatgggccttccattctgaaggcatatagaattagatggaggcagtggtatctaattctcatttaactacagcctttaataatttaatttctgtctgggtgcagtggcttacgcctgtaatcccagcactttgggaggctgaggcgggtggatcacctgaggtcaggagttcgagaccatcctggccaacatagtgaaaccccgtctctactaaaaatacaataattagctgggtgtggtggcatgggcatgtaatcccaggtacttggggaggctaaggcaggagaatcacttgaacctgggaggcagaggttgcagtgagccgagatcacaccactgcactccagcctaggctacagagcaagactccatcttaaaaaaaaattaatttctatcccaaccattcttggcaaaacctgtctctggaaattttatgtgctaaatctacttttttcatcacgcacgagacgcaaagtacaagataagcaaaatcaagtacctaccatcttgatatataaaggcaatgttttgtgatagttacttaacatctttctctttctttttttcccttttttttctgttctcctatttctctctcatttactgatgttactggatagtttatcctgaagagtccgaattttgcttattgcatctctgtgatattgttaaatatgttcttctgttctcagtatttcctctaaattgttagttatgtttaaaagttttatcagattaagtttgaatttatttgttgataagaataataagtggtgttaactcatttaatatactgatcttattcagtacctttgtgcaaattgggaaacagagccccctctgggtagaaaattaggaaaaggcacttattttaggtggaagatttagaacaggaacattctagatatattattttataattttctgttgtgataagaggatatactctataaaatttcagtcttttgaagttttctgaaagcttgcttatggtccagcatatggcctgtctttgtgaacaatcagtgtacatttgaaaagaatatacattctgtggttgttgggtgtagtgtagtataagttataaacgtggtacatattaccatacccatcttggttgatagcattaccagatcttctgtatctttattaatttattttatctactcatcttatgaattactccactatgattatagatttgtcagtttttcttgtaagttttgtcatactttatgcattttggaactctcttgttgggtacatatttgggattgttatgccttcctaatacatttctccttttatcattatgaaatggccctctttgtctcttgtaatatgctttttcctgaagattctgtctgataataatttggcactgtcagatttcttgtgcttactatttgatagtgtgcatttttccgttcatttactttaaaaaaattttttaacccatgtaatatcagtggcacaatcataaactcctgggctcaaatgatcctcctgcctcatcctcttgagtagctaggactacaggtgcatggcaccacacctggcttatttatttatttatgtatttattatttttattttttgagatggaatctcgctctgttgcccaggctggagtgcagtggcgcgatctcagctcacggcaagctccgcctcccaggttcacaccattctcctgcctcagccttccgagtagctgggattacaggcacgggccaccacgtctggctaattttttgtatttttaatagagacagggtttcactgtgttagccaggatggtctcgatctcctgacctcgtgatcctcctgcctcggcctcccaaagtgctgggattacaggcgtgagccactgcgcctggggttttttttttttttttttttttaatttttagtagagatggggtcttgctatgtttcccaagctggtctcaaacgcctgagcgcaagtgatcctcctgcctgggcctcccaaaatgtaggtattacaagagtgagctgctgtacctggcccccatccatttactttcaaccaatttgtgtctgtctctgggagactctacttcactgggtcttgccattttatctggattgacaatctctgccttttaattggtgtactagtccattatatctaattattgatatcattgggtttaagtctacatgtttccttgtattcctttggtttttttgttgttcttttgctcctttcctgccttattttgaaataattggattttttaaagtattggcctattagccggtagctttttattttttatttatttttatttttttttaaataagagacaggatctcactctatcacccaggctggagtgtggtggctttatcacaggtcactgcaaccttgaactcaggggttcaagggatccttccacttcagccaccccagaatttgggactacaggtgtgcactgccacagccagctaatttttaatttttttttgtagagctagtctctgactgtgttgcccaggctggtctcaaactcctggcctcaagtgatctacccacctcagcctcccaaagttctgggattacagtcaccttttatggccaacaattaactcctcattgttattattattattagtggtttctttcagcatatcttttatttgtatttgtgatttgttgttatttttgctttaaacagtcagttgtctttaaggaaaggtatgtttttaaaaaactacttcactgaatataattcacgtaccataaaattcacacatttaaagtgtacgtttcaatggcttttagtatattctcagagatgtacatattaccccacaaagatacctctcaccacttagccgtcacactcctcaactcccccctcccatagcactaggcaaccagttatctactttctgactatgtagattttcctattctggacctttcatataaatggaatcatacagtatgtggttctctggactggcttcttttacatagtgtaatattttctaggttcatccatgttgtagcatgtatgagtacaacatttctttttattgctgaatattattccattgtatggctatactacattttatccattcatcagttgaagaacatttgagtcatttctactttttggctgttatgaataatgctgctgtgaacattcatgtacaagttttcgtatggacaaatgtttttgtttctctcatgtatatatttaggagtagaattattggatcatatggtaactctttgtttagtttgttttccaatgtggctgtaccatcttatagcagtgaatgagggctctagtctctctatgtagttgccaatgcttgttatagttgtcttttgattatagccattctagtgggtatgaagtggtgaaatatagtctcttattttcacctatttactatctttgatattgcccttcttcctttggatctgattttatagtcatattgatttccatctgcctaaagaacattctttagcatttctttttttttttgagacggagtcttgctctgtcgcccaggctggagtacaatggcacaatctcggctcactgcagcctccgcctcccaggttcaagcgattctcctgcctcagcctcttgagtaactgggattacaggtgtgtgccaccatgcccggctaatttttgtattttcagtagagatggagtttcaccatgttggccaggctggccttgaactcctgacctcaggtgattcgcctgcctcagcctctcaaagtgctgagattacaggcgtgagccactgcgcccagctccttagcatttcttatagtgtaggtgtgttggtgaagaatatactctgattttgtttataagaaagtgtttttatttcaccctagtgtttgaaggatatttttgctgaatatagaattatgggttggcatttctttgaccatacaaaagatatcatttcattgttctctagtgtttctgttgagaagttaattttactcatatctctttctccctgttctttagattatatattttctattgatctatcttcaggttcactgttgcctgtctgccatttctaatctcatccaatagatttttcatttcttattgtattgttttggtcgtagagttttcatttttatcttttttatagttttcatttctctgatatttcccatctatatactcatcaagaatatatttttctttagttctttgaatgcattttcctttaattttttgaacatattttccattaattcctttaaaatatttatgatagtcaatcttaaggtttctgtctgtaagagttaactccttggctatctcagggttggtttcttttttgtttgtgtttttgagagagcctcactctgttgcccatgctggagtgcagtggcatgatcttggctcactgcaacctccacctcttaggttcaagtgattctcctgcatcagcctcccaagtagctgggattacaggtgcctgctaccatgcctggctaatttttgtatttttagtagagatggggttttgccctgttggccaggctggtcccaagctcttgacctcaagtgatctgcgtgcctcggcctcccaaagtgcggggattacaggtgtgagccatcacgcccagccatctcagggttggtttctattgactgcttttatttgactgtaggttacagttttctgcttatttatttttgcatgtttactactttttaattgtaggtggtatattatagagattctggattttgtatttttgtgaaaagtgttgattttaaaaattcttgcaggtagttcagttactggcagataactttgaacttgtgtaggcttggttttactctttgctagaatgatatgtggagaacccattgtttccttactttagtgtaactcaacctcacatttttaatcccttcaaaaacttgttggggcttgattttagtctttgttagggtgcacctagaatatgccttattctaggatgtggttcttactcttagttgaggcatttttgatatctcagctggatatctgagatgttaataaggtgttaatgtgatttctctgctctggctggtgggaactctaggtatacccagtactcctcaactctagtgtattttcctctcttaaccactctcttttaagccttgattggttttgccctacacatgtgcagcctatttcttggccaaggatttatgggggaatcctacatgtcttctagcctctctgccttgtggatttcagccacatcaactaccctgcattctgatctctgcctatttggcttagcacaatcactattcccttgttaaactcttgcttgctgggccatggttatggcaattgttgccatatagaaagctgaggtatttgtagggctcaccttgtgagtttcccatctctcagggatgtcctgtcctgcctgttgtctaatgcctgtaaacagttgtattatgcactttattttatggttgctcatggtgggaaggctagtctggcatcagttactccatcatatttgttagcaaaagctggccttactgttgttaagcatttacttcctcctgtagtcttgcagattttctcagttctatatgtacctcttgcttttcttttttgtttgagacagtctcgctctgttgcctaggttggaatgcagtggtgcgatcttggctcattgcaacctttgcctcccgggttcaagcaattctcatgcctcagcctcctgagtagatgggattacaggtgtgtaccaccacgcctggctaatttttgtatttttaatagagatggggtttggccatgttgcccaggctggtcttgaactcctggactcaagagatctgcccaccttggcctcccaccttggtctcccaaagtgctgggattacaggtgtgagctgttgcgcccggcccctgtttattttctttgcctcaaaattggcagtaccctgttaacattttcttttttgttgtatagttctgattacttttttgtttttactacctcagctccttccctaatatttttgtaagctttcttttcttttaatggagtgttttgaggttgattagcagtatagtgctgcagaacagcgcttagagaattggtgcctcctgtcttctgactggtaattacagtgaagatctcaagattcttctgaaggggaggtagtttgtgctttcaaacatatgtaagagttggtgttgtatgtatcttaattatccagagacaggttgaggagtagaaagaacaccaaatctcaagttagaaaatctaggctctagtttcaccatagactagcgagttataggccagccatttaactttggtttgttcacttgtttataataggtaacatccagccccctgaagctcttaaaatttgtgtaatttaatagttaattagaaaattattggctgggtgcggtagctcacacctgtaatcccagcgctttgggaggccgaggcgggtagattacgaggtcaggagttcgagaccagcctgaccaacatggtgaaaccccatctctactaaaaatacaaaaaattagccaggcgtggtgggtcatgcctgtaattccagctactcgggaggatgaggcaggagaatcacttgaacctgggaggtggaggttgcagtgagccgagaccgcaccactgcactccagcttaggtgacagagtgagactctgtctcaaaaaaaaaaaaagaagaaaaaatcagtgtagtctgtagtcttttctttgaccttgcaacattaataaaactattcgtattagctgtaatttttttttcccagtatgagggatggtgctgatcactctgcagaatatgaatacttcattacggattgcttattatatggctctaacatatattttttgcttgatcaaaaatgactattagtgtactttagtctttaagatgcagtgtgctaatatacttagttacttactgagcgtaacttatagttctttaaaactatgtttacaagatatttactaattatattatttgtaatgtttctactctcctctaattcccttctatactgggaatcctttttaaagattcatttcatatatatatatatatatatatatatacacacacacacacacacacacacacacacacacacacacacacacacacacacaaaattatgtctttttttttttttttgagacagagtctcgctctgtcgcccagtctggagtacagtggtgcgatctcggctcactgcaagctctgcctcccaggttcacgccattcttctgcctcagcctcctgagtagctggactacaggtgcccgccaccacgcccggctaattttttgtatttttagtagagatggggtttcaccatgttagccaggatggtcttgatctcctgaccttgtgatctgcccgccctggcctcccaaagtgctaggattacaggcgtgagccaatgcgccctgcccaaaattatgtcttaatgatgggtatccattctgagaaactcatgttaggcagttttactgtgtgaacatcatacagtgtgcttatggtgtagtacctggtatagtctattatatacctaagctataaggtgtagcttattgctcctaggctacaggtctgtatagtgtgttactgtacggaatgccataggcagctgtaacacaatggtaagtttttgtgtatctaattatatataaacacagaaaagttacagtaaaaaaggataaaaaatgatacgcctatatagggcagttaccctgaaaggagtttgtgggactggaagttgttctgggtgagtcagtaagtagtgagtgaatgttaaggcctaggatattactatacactactgtagacattataagccctgtacacttaggctacactaaatttataaaaaaattttctttcttcaataataaaccccagcttatggtaacaattttactttataaatttttattttcttttgaactgtttgactgttttgtaatacctagcttaaaacacaaattatgcaggtgtacaaaagtattttatttatgtccttattctataagacttaagctttttttctattgaaaacattttaaggccaggcatggtggctcacacctgtaatcctagcactatgggaggccgaggtcggcggatcatgaggtcaggagatcgagaccatcctggctaacacagtgaaacaccgtctctactgaaaataccaaaaattagccgagtgtggtggcacccacctgtagtcccaagctacttgggaggctgaggcaggagaatcccttgaacctgggaggcagaggttgcagtgagctaaaattgcgctactgcactccagcctggacaacagagcgagactctgtctcagaaaaaaaaaaaaagaagaaaatattttaaatttaggttttccttttttttgagacagggtcttgctctgtcacccaggctggagtgcaggggcatgatcacggctcactgcagtcttgacatccctggcttaagcaatccttcagctgtagccttctgaatagctgcgactccaggttggcgccactgtgcccagttagttttttgatttttagtagggatgaggtatcattatgttgcccaggctggtcttgaactcctgggctcaagtgatcctctcgccttggcctcccaaagtgctgggattgcaggcgtgagccactacacgtggccctatttttgtttttactttttaagctttttcattaaaaatgaagatacaaacctacacattagcacatacattagcctagacctacacagggtcaggatcatcaatatcactgtctcccctctccacgttttttctcattggagagtcttcgagagcaataacatgcatgaagttgtcatcttctgtgataacaatgccttcttctagaatacttccggaatgatctgctgaggctgtttcacaatgaacttttttttttattagtagaaggagtacactataaaataacaattaagaagtcacagtatcgtaaatgcataaaccagtatcgtagtcatttattatcattattaactattatgcactgtgcataattgcatatgctatattttcatacgactggtggtacagtaggtttgtttaccccagtatcaccacaaacaggtgagtaatgtgttatgctaagatgttaggatggctacgaagtcattaggtgataggaatttttcagctgtattataatcttaaggaacagacatcattgtatatgtggtctgtctttgaccaaaatgtccttgtgtagtgcatgactatatatagttttgaattttggaggaaatctatccagatttgtacctgcaggtatcagaaagtttcatagcatctttggctttgtgaacattctctttccatggaagttatgttctcaaacttgtattccaagagtcaaacaggtgaagctatctattggacattcaaacttatttgttaaaatgcaagttattttattctgtaaggatctaaagtagtagttcattagtttcctttagggatacaaatacaaatagaaatggaattaattttttctcattgctttttttctgctgtgggcataaaaatattatgtctaacaaatatatactgacagtatgattgcctgggttggaatcctaggttcgctacttattattagctatgagatttagggaaaattactgattcttattaaaactttttctcatctgtacaatgggttcactagtagtgataccttacagttactatgaagattagatgaggcacagttcgagtaaatttaagaattcaagtaaatctatgaattcaagtaaatttactctataaagagttattttcagtagtctatgtgcaaaaaatatatagtttttcagcttaagtttcaggaatcttttggcaatttattttcagtttacttagcaacttgttcctgagacagcaaatagaatgagaataattgagtgaaaattaaatgagattttaatgattttcttcaggtttcaaatgtgttaagcctattttccaagaaaaaaataagacaacagtaatttactagttgttggtgtttactaataaacgtatttgcagtctttctcagacactcaatacattttccaggccagtgattccaaaacttacctcatcctaagaatcatctggggtgcttctttaaagtacagatttctgggccctaccatagtctttcgaggtggggaccagtattttatactatctaggtaaattttgtggtctaagagggttgaaaacacagttctggggaaacaacagtgaatgtggcagacatggtttctgcccccattacttttatagtgtcttagttcttcttttgagtcattaaaaataaattcgtttttctttctttctttttttttttttgagacggaatctcgttctgtcgcccaggctggagtgcagtggcgcgatctcggctcactgcaagcttcgcctcctgggttcacggcattctcctgcctcagcctcccgagtagctgggactacaggcatctgccaccacgcccggccaatcttttttgtattttattagtagagatagggtttcaccatgttagccaggatcgtctcgatctcctgacctcgtgatccgcttgcctcggcctcccaaagtgctgggattacaggcgtgagccactgcgcccagcctttttttttttttttttttttttgaaacaaggaggaaaaggaaagtttatagttatagaaatattctttgtagttaagatgtgaaagtgggctttattgttaaataagctattttttaaaaaaattactatttgctaaagaaacataaatctgaaatcttgcagcctgattttagctgttctgctgatttaggaaaaggtcctttggggaagcaaatcattttggttggttgggtacaggttttgcaaagttagcatcaggggaacaaaaatgtctgggtgataccaaatatacaaatgttgtacgtggttccaaatatggaaatggttttgtctaaagcagccactgaagagaaattatctaaatattagcccctttaggaaagtggaatgtgttgtctgatttggctctcaggcttagtatgaaagtttgtgcaaaagtacagcttacaaaatgctatttgttttattaaaaggattgataggaagttgacatacttagttaatttaaatttggaaggagctcagcaaacatctttctagttgtattttatgtctccctccaccttcttttttttttttaatcaaatggggaaactgaagcctaagaaaggatatatggttgcatagcccacctggacagctccagtctctttttttgtgtgtaaatcccattcagaaattaaatttcaaaattaattttcaattacattttgattacctgttgactaaatacatttttttttactgtaatgcaactgggttgtaactcaaactcatgcataagatgaaaaaactacaatattaaaaatcattttgatctacttagaacaattttctctttatattttattttctagggtgctagcttacgataaaaagcatctttgaatattcaataatgatatttttcctgatattgtatttgccacatctttattttttattgatgatatataagcaatgacatagtatttggtttttgaggtataatcagatgtcaactaggaagcctaaatgaattgtattgttgatgcagtgaaatgatttgtaggataacttattttatagtatttttatttttcatatttatttttaaagaaatatagattatttacatgtacaaacaaatatatatattctctacaaaaagataagaaaatttaaaatttaacagactttatcagaaatgtttggagtgttaggttttcttttcatttactaagttggaatatgtaaaaaaaaaaagaattttgagatgaggacaagtgattgtatacctcactcagtttttttagaacacaaatatgatagtggttatatcattgaaaatcaatgaagcctccatcaatatggtgcagtgcctctgcaccactgatttatatatatttaatgaacttgctgttctaatttcaggtaactgaagcaaactgcatctagcactaactggtttacttataaacaattcagctcattaaaatataaatatcttgaaatttaccaatattagatataatttctttataaatagttctactgtgtttacttcctggtgttaactgacatgtttctaaaaaaatcatcatattttggtactgtttcagataatgttaccaaaatatgttgttttatttgatcttatttcttgctactgatctagaatggatttggaatagaagatatgggacaaaaaagctttcaaaagtgatgggatttatgaagtatgacatgccagatgctgtatttttgagatctattggagcataagtgaggaccagttaaggatctatttctatattctttgggattaggaatatagtttttaatatttgcattttttaaaaaatgtattttaaaatagatttattttaagcatgtctattatgttttattgaaaaaatgccacaagataatattaaaaaatgttttgacaaaagaaaaaaattatacataatactttcacagaggagttcttttaatttttatcttcttatttgtatgtgtgtgtgctgtgtagtctcagctgctctggaggctggggtaggaggattgcttgagcccagggggtcaaggctgcagtgagctatgagtgtgccactatattccagcctgggtgacagagtgaggctctgtctcaaagcaaacaaacaaaaaacactttggagaatgctgttttaagttttgactcagtaactaattttgtaagaaatttcatattactctaccattgtactacttattattattattttttgagatggagtctcactctgttgcccaggctagagtgcagtggtgtgatcttggctcactgcaacctctgcctcctgggttggagcagttctcctgcctcagcttcccgagtagctgggattacaggtacgcaccaccatgcccgactaatttttgtatttttagtagagacagggttttgccatgttggccaggctagtcttgaactcctgacctcaggtgacccacccaccttggcctcccagagtgctgggattacaggcgtgagccaccgcacctggcttgcactagttatttattgctgtctaacaaattatcctaaaactaaatggcttaaaataacaaacatttattttctcacggttcttgtgcatcaggaatttgggcatggctgagctgggtagttttggctcagggtgtctcatgagattgcaatcaagtttcagctggggctctattcatttgaaggcttgactggagttggaggataaacagttgaccattaaacaacatgagtttgaagtgtgtgtccacttatatgtggatttcaaaaaacaaaacaaataagaattgaaaatacagtattcacagtatgcaaaaccccatgtatatggagggctgactgtattaagctcactcatgtggtttttgtcaggagtcctcagttctttactgttattttttggctagaggtgtcagttctttgtcacatgggcctctcctaaggatttcttcagtgttcgcacaacatagtagctttcttctcctcaggtggatgattcaagagagagacaaacagaagccacgatgtcttctatgaacatcattcagacaccatcgtttctgctgcattctgtttgttcagagtcctaaatacagctcacattcagaggaaggggaattgggcttccccttttgatgaaagaagtataaagaatttgtggccatatgtaaaaccacaccaaccacatatgtatatttatcactggaataccttgaatccaagagggctcccagtgatttttgtctcctactttttatgtccttgcttagtttctccctgattgtatcagggttgcttgtataaccaatcgaatatggtagaagtttctcatttccaaggctaggtctttaacaaagactttgtggctttccatgtggttactctctatgttcttgggcaacttgctgtcatgaaagacagtttatgtgtcgtcagcagccttatgaagttccgtgtggttaagaactgagaccttctactaaccgccaagtcagtgagccatcttagtcttcagtcccagtcctgtcttcagatgactgcagccccagctgatatcttgacaaataagctgctcctggattcctgacactgagaaattttgtgagataataaattgtttattgttttaagctgtcaagcttggtggtgttttgttatgcagcaacagataactaatagaatcccttcatctttattaaaacaaaaggcacattgccaaaagctgtacacatattagggattttattttttttttaataatagggagaaatttcttcttttttttttttttttttgagaccgagtctcgctctgtcgcccaagctggagttggagtgcagtggcacgatcttggctcactgcaacctccgcctcccaggttcaagcgattctgctgtctcgctctcctgagtagctgggactacaggcgtgtgccaccacacctggttgattttttttttatttttagtagagacggggtttcaccgtgttagccacgatggtctcgatctcctgaccttgtgatctgcccgcctcggcctcccaaagtgctgggattataggcgtgagccaccgcgcctggcaatagggagaaatttctaagggcgcatgttcaacaagccattgtcattagagaagtggcttttgttcagaggcatatgaactacttttattcagaagtaatcaagggggaatctagtagtattgtaaaggtaaacattttaatatcatgtaagatgtgataataatttagtgtttttagtgagaatcctgtaagcttcctgtcattgactaaggtctggattacattctataacgcatgaagtagcaatttgagaaactaattctttataaaaatactttcaccttgttaatagatttgtttctgtaagtaagaaatacagtggagttgaatcttatgtggaatttgtatatacgtattttttttttccagagacaaaatctcactctgttgcctgggctagagtgcagtggcatgatcacggctcactgtaacttcaaacctctgggctcaggaacccttctgcctcaacctcccaagtagctaggactataggtgtgtgccaccatgcctacctaatttttttttttttagttgcccaggctggaatgcagtgaagtgatctcagctcactgcaacctctgcctcccaggttcaagtgattcttctgcctcagcctccagaatagctgggactgcaggcacgtgccaccacacctggctactttttgtatttttagtggagacggggtttcaccatgttggccaggatgttcttgatctcctgacctcatgatccacccgccctggcctcccaaagtgctggtattacaggcgtgagccactgtgcctggcctaattttttattttttgtagagacagggtcaggctttgttgtccatactggtcttgaactcttaggctcaagccatcctcctgcctcgtcctcccaaagtgttgggattgtaggctagtcactgcacacagcctggaatttgtattctaaagtcatgtaaagcagaaaatatagtgaagattacccttaatattaaggatcagaaattgtccatatgggtaaataatttttcattaaacctagcgcagccagttttccttccagcatagtaataaatcagtattcctcacctgaacagcagatgaagtaattggctcttgttttggcattatactgaaaagacttacctttaaacactgtcatatatagtccaataagatgcttgtcctaggagaggcattgaaactgagtgcaacagagggaacagcagagtgacatctctcattttatgattactctggggtatagagatagtcactgagaggagaggctggggaaatgggaccgctttctaaaaatgtatctctgtctctttttgctgaacatatataagtgaatttgtgtaagtatgcacatgatgtgatgccattgtgtaatgcttctgaaacgtaaatacttgtctttttttgggaaatgtagactttttatttctttcattatgatgcttagattatttgatagcctatttaatggactatgggataagaaagattgagttttgttaacttacatatagcacaatgtgggaacctctgttcataacgagctgtctatgtcattaaggaaagtttcagtgatagtacacaaccatacacatttgttgaacatatgcattaaagacagagttatattgaaaaaagtttagaatagaacttctgcattttggagtatgctacacttgtctggaaaagttactgtcagataatgttttgttactcttggaacatgcgttattgtacatgaaattctgaacttttatagagtatgagctaagaagtgcttttcccattactaaggaggctgaatattcaagagtgatcatggaagaattttaaaaaatagtatatttttatacttcacagtgtcttatggattgcttaccatttaacagttaagctggaggatggaaaaatcttgatgtaagtggtaggaacttctgccaactggaaatcaattaaaatgaaaataaagcaagtataaagttttagtgttactgggaagataccatttgactcacaaaggtgtcattcatgtgctctttctggctatatacctgtggcctaaagctgtggtcttttggggatttaattattaatacagaaatgtgttttacaaaatagagccatgtctattttgatgccatatagtttctttttaaaatgtataaatgcccttgcgtttttttgggcaaaatcaatcatgctgtcttgtatttggaggtaaatgacaacaggatattcacttccagtttaagtagtagcctacagtttctcttgaatttagtttttggcttggttaaaccattagtgtatttgacctggactagaacttgattttaagatgtcatcagctgtgagttcccaagtgactggctctcacatttcactgagagagaacaggctatttgacttgttagtttgaagaaatcatatgcaactttctggtactgcagaagttgttcagaaacataacacagagtactaagaagctaaaaatttcctgtttaaaactaacggtgtatggagtaatttattttgtggaatctggagggattggtgtttgagatggaaatacatactgatctgacagtttcttactcttatttacctctttcctcagtttttggtgataattccaagttatattaatatatagactgtatcaagccactatgaaaattttatctaaatgcagttccagattttgcagtattttagtgcatttttttttattgtccacacacacccacacacaggctagaatgtttgacattttctggtcatcaattgagacactgaaatgtcttgtttgataaagttatattttgtttcaaagatatttttaatagactgttcctaagcatttgaaccaaacagcagctatgagcttagggctttagggcaagatttcctagaatatcattcatgttactcctagtttacatcagaatataggagacaaactataatttagtttcagttaatactttccaaatttttacccctgtggcatttgtctgagaaatactgatgagtcacagagattccctttctgtccttaactagaacatatgtagaataggaaataggagaaaactgttcatgcatttccgtgcttttaggtttttttctgctcttggcagtgtattgattctgatgctttacttattttgtaatttttattttatgacttcctgtgtacaaggagttgatgatgcaaagttgaatcagaggtaatttttgccctgaggtctcattgctaagtatggaagatagacaaacaaaatgttacaatacactacaataattgttatgatgagtgttgttggaaccatctaaggagcataatttagatggtagagggcagtgggaccaacaaatataccagatattcaaataagaaatctgaggtcatactatatgtactaggcttatttctaagccctacgaagttgtgcccataactgtctccttaataacttccaaattacagattttatcctattccccttgtagtctatgtcttccttatctctacttggacttttttttttttttctttttgaggtagggttttgctttgttgcccaggtgagagtgcagtggcaagatcatggcttcttgcagccttgacttcagggctcaagcaatcctctcatgtcagcctcctcagtagcaggaactacaagtgtgtgccactacacctggctaatttatctttttgtagagacagagtcttactgtgttgcccaggttggtctcgaactcctgggctcaagtgatcctcccacctcagcctcccaaagtgctgggattacaggtgtgagccacgttgcctggtccacttggactatttcaactgtctcctggccgaggactgcttcaagcttaattaacatggatactgcttactaccgcccactcctcccaaccctccaaaaaaaaacccccaaattcagaaaacaaaacaaaaaatagtcttccccttttaaccatgatacttcctgcttaaacttctttggtggtttcttgtgtcttccaccaatgcttctcacattttaaaaagtaacattaacaatggaggaaaacaaatttgtacccctagtttgtctggaggtgcaactagaagtgtcgctttgaaagcccctttgaagttttggttgaccttaaaaatgcatgtaagattttaattttttaatattttctgttagtattaaaacaaaaagtatatgccttcctaattttttatctcatacccctaacctttgcataaaattgatgttttaggaagacgcaccacgttttcctctggctttatgtaatccctgacacacagaccccacatcatcctgtagttcagtattttcaaactgtgttgcctgagagatttcaaactgaaactctgagagattgtttgaggcagctgctcattgtcatcccttaaactagagcagtctccatttatctgtttacatattaggtttctgggtaacatttagtatgaagaaagagttctgttattaaagaaatataagcctgaaaaatgctactgtaatatatgctaaaaatccaaattccttagcttatcatgtaaagatttttctggtctggtctctgcctattttacttttctttcttctctctctcctcagcttccagcacctttcctagagattgaaacttgaaacctgagggtgaaattaattttgtttggccctggagtgttggcttgcacagcatttaaattaaaacaaaacaaaaaatgaattagttgccaacatgtaaaaatgaggagacatcatgtaaaaatttggatctctcagttttgttgaaaaactgctagatctggtaacattttggctccatattctcaacagcatggagttgatgagtagccatcattaacatgagatgcattctttagttggccagtttgatgaatgttggaaattgttgatgctttgaatagaaggtataccaataaccttctcaaaaggagacttttcctgttgttgtttaaaaagtaactttctacatgccatactatttattgcaggtatactgtacttaatctttgctttgtaagtgttagttaggcctaagttaaagaaattagacttataagtaaaactgctttatgcataatatttctctagtggatgatttgttaataaaatcatatctagccttaggtcaaatatttataatcattctattatttaaaagaaatttttttaaattataagaacagtttttacttatttaaagttctgttctgcccagagagcatagtataatatggaagtaggtcttctgattagaatttatttaagtagtagaaaattcaagccagcttgggtagggagaatatgaagtgagagaaactgaaatgtgaaagattaaagttgcaaacagttttggtacaattaaatatatctattccaagtggacaatataaacttatgcattaatgaaatgatatggtcatattatttgaaatttgcagaaatggaatcatactatacctttacctttttttttcagttagtggtagattttgagtatcagcatatgctttacctcctttttagcaggtaatatttctttatatggatattgcttctgttgatggaaatttagaaatatgaaattttgatagctctttctaatttttttttaaagtgcactggttaattccctgcaacagtgtacaaaagtgcctttcccccaccacacttgcgtaacatgcaggatttcataaaggctctattagttttaactcactggggttacaattaacacctcactgcctttcatatttgtgtttagcagcaagtctccaatatgattgtaagaatacagacataaagcattttttttcttaatgtttgtgctttaagcaaacacacaggttaaagttttcatttaacattatttaactttctgagcaataaaagtctgaaagaaaatttagaaatacaattgtatgaaatagctattgtttgtaagcactttatccacctcttatttctgtaaaagagtcatattacaattactatgagatctattctttgggcagctggaaagcaggacaaggaaaaatcgttctcctcttgtctggtagaaagtacattgtgccctctggtaccagacttgggcttattcaaaggctaatggattccacacaggtgagtcagtcttttgtgttcttaccaggtgcattattgattttcatgatggtagcctaggtgttctcattcaacagcagctttagcaaagtctccaaaatatcacaaagaaaaccaaagattttgcacattttgggtgcaagaaaatgaatttttctcaactcttttggccattgtactttttttcttgctagacgcttatgaataactcctttggaaaatgtattaatatgtaatgtgtttacttctttgtttttgggcatggattgtgtgtcatgatctatttatttaatttagagtgtgaagcaacgtgtactggcttgtggtacttttttttgcccacagactgagttaagttagggttggaagggttccctgttgtagaaggttatccacataccagattctaggaatagtcaagttcagatagtcatctggggtcaccaatcatttgatattcacttggcccttaaatcacaataccacaatacatttgagttttaactaagacaaacatttcagggtaaccttcaagtaggaactctttgaacagtgttctctaagtgaaaactataatttacctgagagcccttaataattgaggagaagaaagtgacttttaaagtttgggattatctaattttcaggttttcaaattgtttatttttcaatccttagcactaaggtagtagcttaaactatgacagcactgaaaaatttatgttgatgcttattaaatttagatattttcaaaaagttgcaaagcagctctctttgtttaggttatatttcctttattgcatgtttctttttagggttatgttttccttttacagtcttcactgctgcttttattcaacaaatatttgggtaagactatgtgccaaacatattcatagttacagaatgatcttatcttttgccctagtaattaggtttctttccttatcaagtgtaacactaattaaatgtgttatgagctgctttccctttcttatatcttgttttgtaaataatggttttgtttaaatgtgttatttagttatttaacctattttgtgtggtttgacagtttttagcatatataaattaatgtcccggctgtaagtgggatcaaactatctagatctgtgaactggtacgttctaattctagtgctttatacattgcaacattaaaaaatcagatattcattttttctttttcccatgttttactgattctatttttcttcaagtttcttccttcttttcctattacatcaatcatctgctcttttaacacagcaaattgctgctttgatttgagtcagtgacttgaagtttgggacaccataatcatctctctttgtttagaaatctcatcccaaaatctcaggaggaaaaaaccctaaagaattatttgatgtatttattgctttctgggcaagactcagcttcatgaaaaaatttttagggaattcttttctgtaatatcttatgatggattataggtggtttcaaatagattatcaggagagtgaatgatgggaagtatgtaaagacactgtggccaggcacagtggctcacacctgtaatcccagcaatttaggaggtggaggtgggaggatcacctgaggttaggagttcgagaccagcctggcccactaatgtcatctctactaaatgacatctctactaaatgtcatctctactaaaaatacaaaaattagccaggcatggtggtggatgcctgtaattccagctacccgggaggctgaggcaggagaatcgcttgaacttgggaggcggaggctgcagtgagcagagatcacacctctgcactccattctgggcaacagagcgagactctgtctcaaaaaaaaaaaaaaaaaaaagacattgtgtggtaaaatgattatgatattctttttttttccttcccttacattatggtattttgtcagtaatttttctatatgctaaaccaaaaactaaattgtgactaccacttggccggaaatttttactgagctcagtggtaaatttatataaacaaaataaagaaaacataatttcttgtagctcagtttgcagtttggtttatcagttgttgtacagagatagcttattatcatgtatggactttaaagccaaaaggaaccttataaatcatctagtacaacttcttaattttaatagataaaagaatatatttttcttttaaagctgtttcagcattgaaacactgcagattcatacctggctttttctccagttaaactaaattagggaagttaagaaaaaagtcatgcgtagggagttaatttacacaattttcattggtgctaatggaaatttcttactgagattcaaaatgatcacacttatctttatcatttatctttaattaatttatagatgaaatggccattgctgcattgctggttaggactttttaataaatgcagcagctacaacctatatcattttaaatgaataattaaagtggagtggtttattattttccagcataggtacatataataattcctttgaatcatatgctctttatgctggaagagatctcagagaatatctagtccatatttttattttatagatgaataaaatagggtacagagtgattaagtgacttgtctaattttccctgactaaagcattttatgtattggactccattgtaatttagtaaggttagagaccttaatgttctttcagttcaattttcactcggttaaatcccagtttatgaatgtgctgtgtgtatcgtctgccttcctactctagtgtaagtcatcaagcagtgaaaactcagaatttttggtgagtaataattgagcacaattatttctctaaacctatcattatctttaatttggaactacaatgaccaggaagcagtgttagtctaagcataatttaataaatccatattaatccacctggcggagtataacattttaacataccttttagatccacagtgatggaaaaatgattaaattacttattgtcaaaacaaagggctgctttagatatggttatttaataaactgttttgcttcatgtaaactagttttgcttaagcttcagagatatagtcacatggatttatctttccatgacaattgcttactgtctgggtttatgtttaatgcaggtattggtgacagtttgtaattcttgagtcattgcctagcatggaaaatagttgattttgctagctatacacagtactgtcttttaatgatcactttttaatgcggttaagcctgacttaattgttctctttttagagtgttatgtaatatttgttagtggtatgatatatctgttaaactacttatatatgtaaagtgaaaagtttatgtgtacatgttattttctgcaataatgttgaagctcaaaaataaaaggggttatatacttatgtacttaaaatacataatcctggtgtagccctctttttctggaagatcaatgccatttttcttcagtacattctttcttttctcttgtttatgattttgtgtctgctataccagtgactgtttttgtctatcagatagtgaagctaattgtcttaaagcttatcacaaacagccagaagttaatgggctatttgggttggaacccatacttttggtcccttgttttaccttaagtatgaagaagacattaaagcattagagttgaattgaagaaagtagggaagatttgagacagatttagatggtaaattgagaggatttggtgattctgtggctgtgagggtaagaagaagcggtctaagataattctcacattctggattttgatgcccaagtgaagaatgtaattttcaagattcagtgaaatctcttctggaacaaggcaaggaatgtgtatacgtaaataaataggcaaataaataaattagcaaatggtagtagctgaaatggtaggtctttggagtctggcctgattataaaaggaagtgtaagtaggagtaagctgtaattaggagaaaaaggaaatataaaggattggagatctggatgagatcaaaggggcagtgtgtataatgagggactgagagctcccagttcagaaggttgtgaccagagtttggaatataggccaggcgcggttgctcatgcttgtaatcccagcactttgggaggctgaggcgggtggatcacctgaggtcaggagttcgagaccagcccggccaacatggtgaaacccccgtttctactaaaaatacaaaaattagctgggcttgcggcgcatgcctgtaattccagctacttgggaggctgagacatgagaatcacttgaacctgggaggcggaggttgcagtgagccaagatcgtgccactgcactccagcttgggcaagtgagccaagatcgtgccactgcactccagcttgggcaacagagactccatctcaaacaaacgtctcactcataagtgggagttgaataatgagaacacatggacacagggagggaaacatcacacactggggcctgtcggtgggttgggggctagttgagggatagcattaggagaaatacctgatgtagatgacaggttgatgggtgcagcaaaccaccatggcatgtgtatacttatgtaacaaacctgcacgttctgcacatgtatcccagaacttaaagtataatttaaaaaattaaaaacaaagtttggaatataactaaacagtctgatgctatgtctagtgctggagaagctagtgacaagaaagctgtataacacacacaaaacatgtttggaaaattaaaaaacaatagagctttcataagattaaaataatcattggaaaacagaggcctacccagactagattattgatgatggcttctatttatggttagactgaatataaaaatcttatacctctaggcaatctaagacatacagtactgtgttaaaaattttgagcttttatttgtcatatggttgtgactctagcagaggttggatatattctttattaaagtgtagaatcctcaaaatctgcctctataaatttaaaacctataatcttagaaatatataaaatcttgacttataaaattaaatgtataacttaaaaatgattaattcttttaaaatgaaaattttaactttctaatttctcttttaagtgatttttaagaagatgatttagataatgtaaaaggattgcatctgttaaataacaaactccactgggtgcagtggcttacacctgtaatctcagcactttggaggcctaggcgggtagatcacaaggtcaggagtttgagaccggcttggccaaggtggtgaaaccctgtctctactaaaaatacaaaaattagccaggcttggtggtgggcgcccataatcccagctacttgggaggcgtagacagagaattgcttgaacccgggaggcggaggttataatgagttgagataaagccactgcactccagcctgggtgacagagcgagactctgtcaaaaaaaaaaaaagaaaaaaaagaaatacaaattactcccccttactccttttttgggtattcgtcttgttttaaaaatctttttgtggcctggcgtggtggctcaggcctgtaatcccagcactttgggaggccaaggccggtggatcatgacgtcaggagatcgagaccatcctggccaacatggtgaaactccatttctattaaaaatacaaaaattagctgggtgtggtggcgcatgcctgtaatcccagctactcgggaggctgaggcacgagaattgcttgaacccgggaggcagaggttgcagtgagctgatcgcgccactgcactccagcctggcgacagagcaagactccgtctcaaaaaaaacaaaaatctttttgagaaacttttagatatgggacaattaatgaatatctaatactattcattgtatgactagatttcattttggggaggcttattaatataatttaattattttgaacaacaagatgaattgggtaggtgtttgttagaacttcaaatacattatagttgaaaacttgaaacagtaatacaaatgcaagaataaatattcttttagaaataggaaatggtttcagataatatggagaaaatataaggaaacaattcaataataaaaactattgtttgtaagtaaatcaagtttgagagtttctgctttaataagttgttaaggtttggattcagagatctgtttctcttatagtaaacatttttaatataggaacagctcagggaaatggtttccatatgcttcttgaggtgttaacaatacacttttggattggaaatgcaatataaacctaaactacattctggaaggcaaagtggaggagcatttcaatggtaatatgtacaagaaacccttgtgctttgtagatttgtgacttatggttttgtgagttcctggaacattcaggttactctgcaaacctgtagtctaacataccttgctttgtctggccagcttactgccttagtctggctcagtatttctttttactacagtttgtccatctgggatcttttttggatactctacacttgtggggagaattgaggccagttttggggcctattttaagggacttaagatacatagaggatggctgaagaaagtaaataaaatccaagtggtaattatatctgtgagacccttccgggttttctaattgatcttggaggcaagaacagttcagttttttttttaatttaaatttaaattttatttatttatttattttgagacggagacttgctctgttgcccaggcaagagtgcaatggtgtgatcttggctcatcgcaacctctgcctgctaggttcaagtgattcttctgcctcagcctcctgagtagctgggattacaggcgcatgccaccacacttggctattttttttgtttgttttgagatggagtctcactctgtcgccaggctggagagtagtggcacaatctcagctcactgcaacctccgctccctggttcaagtgattcccttgcctcagcctcccaagtagctgggactataggcacacgccaccacacccagctaattttttttgtgttttagtagagacggggtttcaccatgttggtcagattggtctcgatctcctgaacttatgatctgcctgcctcggcctcccaaagtgctgggattacaggcgtgagccaccatgactggccttattttttgtatttttagtacagtcagtgtttcgccacattggccaggatggtttcgaactcctgacctcaggtgatccacctgcttcgacctcccaaagtgctgggtttataggcgtgagccaccgcgcctggcccagtttagttttttgaattatggctaacttcattcctgcttgaggttgagtgtataatattattgtattactcatttattaagagctccggaatgtgtctgctcataaataggtggttgtcttcaatagtatttgcaattttgaagagttacatgtttaataactttctccctggttgacttttaaaggtcttggttgacttcttaaaagttttgttttggttttaaatgatatgttctacagaaacacaaggacaaattacaaaggttttaggagttatatctctgaacaggatttttctaacctttctttcaggtaatatcaaaatctttcaaatggaggtggagaagagggagatgagaataacctgggagggttttaaaaattactactacttatacagaaatgtttactgtgtcctaggcataatgctgaatgctctttattcgttatctcatttaatctttataataactctaattggtaggtattgtaaatatccactttttatggatgagggaattgaggcttagagattctaagtaacttgcctaaggaaacaaactagtaaatggctcagcctagattcagctaggcctcattgatgacaaacctttgcttctgaatcaccatgccataatacactttgtataaaccctttttgtttttctcctttatatcagaatgtggatgatggcaacgctatgtgcattttcaaaaagttaccctactcctaagattataatgttgagtttacatttttaagttatttttttgcatacaaaaagtgtatatataatatgtatagtttaatgaataatgaaaacaaatcaaatgcttgtgcactaaccccctgggttgagaaatagggtattactggtaagtttgaaccctctatcttttttctattatattttctcctcctcccatagaaatgactacttctttgaattttgtcattctttttcttttcttcatagattggccagatattgttggatctctaaacagtatactatttagttgtggattctatataagtgtatacattatatatttgtgttcttttttaagatatattttaaaaaatttgaaacaggatcttgctgttacccagggtagagtgcagtgggacaacataactcactgcaactttgttctcctgggctcaagtgatcttcctgcctcagcctcccatgtagctgggaccacaggcatatgccatcaggcctggccaatttttttattttattttattttttttcagatatggcggtctaactttgttgcacaggctgatcttgaactcctgggctcaagtgagccttctgctttgacctccctaagtgttgcgattataggtgtgagccactgcacctggctaagaattattttactgtggtaaaaaacacacaacatgaaatttaccattttaactgctttaaaaattaaaaaaaaaatttgttttttttagagacagggccttactccgttgcccgactggagtgcagtggcaccatcaaggctcactgcaaccttgaattcctggggtcaaatgatcctcccgtctcagccttctgagtagctaggactgcaggcacatacatggctagtttttaaaatgtgtttttaaaatgttttttttgtagagacagagtcttgatatgttgcccaggctagtcttgaactcctgaggtcaagcaatcctccttccttggcctcccaaagcactggggttataggagtgaggcaccattcctggccaccatctttacctttatttttaagtgtatagttcagtagtaagtatatttacattgttgtgcaatgaatctctagaactttttcatcttgtaaaactgaaattctatacccattaaactaattttcccttcttttctgccctttgcctttgacaatcactttttaactttctgtttctgtgattttgactggatacttcatacaagtggaattatgtagtatttgtctttttgtgactgccttattcactttgcataatattcttgaggttcatccatgttttagcatgtgacaggatttccttttttaaaaggtgcataatatttcattatatatatatagtatccttatctattcatccatcagtggatatttgggttgcttctgcctcttgactgttgtgttaatgctccaatgaacatgggtatgcaaatatctctttgagatcctgctttgaattctttggaatatttacccagaggtgctggatcatatggtagttttattttaaagttttttttaggaatctttacactgttttccataatgattgcaccattttatattcccaccaaaatgcacaagagttcttaatttatatatttgttattttcatatattctgttcctttcacatattcttttcaaatattctgttctgctcaaatatgttttgaaatattaacccagcagtgggattgtgggatcatatggtagttttattttcaatttttttaggaatcttcatactgctttccaaaatggttgcgttattttatatttctaccaaaaggcacaagggttcttaatttgtatatttgttcttttcaacttactttgttcattcagcattgtgtttatgagttatatttttgatattcacaatgttaatgcacatagttgtaatttgttcatttccactgttatatagtattccattgtaggactgtactgcattttatttatccattctgctgttaatggacataggtattgtttccaaatttcttttttgctataggaaattatactgctgtaacattcttgtatatgtccactggtgtatatgagttatggtttctctagtatatatacgtagaataaaactattaggtaataaggcatgtccatttttaactttactaggaaatgccgttttgttctttaaagaggttgtacagtttacactcctatcagcagtatggagggtttttttgtttgtttgttttgttttttacatctttgccagcatttggtattgtcagactttaaaattaaaaaaaaaattcagatgtgaagtggcattttactgtggttttaaaatgcatttccctgattgtttccccttttcatgctttttggtagtttctgtttcctcttctgttaatgcctgtataaggtgagaatttgtccactttttactctcccttctgttacttctttttcacgaatttatggtagtggctcatacattagtttgcctgcttttgcctttgtccctatagtctgctttcacacacagtggccaagaatgagccttaaaataagtaatttatgttctgccacttctgtattctaaactctgtagtggctcctcatttcatgcagagtagaagccaaagtccttatagcgtcccttctgtcttacatgatcattctccagcttctctgatcttattacaatccttgcctacctcactctctctactatcctgagcacttttcaccctgccctacattttcttctttccctagctcttctcttctaacactacgtaatttatctgtccatgttagtatataggctctatgagggcagggatcattgttttgcttattgaagtattcctaatgcctcaaacagtgcctgctacatgatgggcacctaatgaatatttattgaattgctttgaattcggtgaaaaagtgtccattttctatgatgggtaaattttctttgaaggtattttagttctctgaataataggagttttctgtaaaactaaacaataatggagagcaattttatgcttgctttcagttgtactggaaggtttcattttcccttgttgaacacttgtttagatgaattaaagagcgcatttttaagggctctaagattatttttgattatgagttttattacagggtaatcactagggaatttaaaattaagatcaaaaccatactcaggaggctgaggcaggagcattgcttgaggctaggagctcaaggctgcattgtgctctgattgcaccactgcctccagactgggcaacggagtgagacccccacatctctaaagaaattgacataaataaattaaaagatgatgaattggccgggtgcggtggcttatgcctgtaatcccagcactttgggaggcggaggcaggtggatcacctgaggtcaggagtttgagaccagcctgaccaacatggtaaaaccctgtctctactaaaaatacataaattagcccggtgtggtggcaggtgcctgtactctactactgtaatcagctactctggaggctgacacaggagaattgcttgaaccaggaggcggaggttacagtgagccaagatttgtgccattgcacaccagcctggacaagagtgaaactccccatttcaaaaaaaaaaaaaagccaattcttggctttccaaaaaaaaatcaaaatcagatatttagattagaaactcaggttgcattagtggtttcatcacaggataacctcatttcttgttaatcacaaagtatataatcttatacgtctaaaagtaaaaagctagtctgagatttcttgattgtgttgtagtgaaagaggaagagttccagagtgctaggtagaaatgaagagtaatcccaaggctttgaggtgtctgaataagcaaatgaagtaaggaaggcaaagtccaagagctgctgttttttttttttaattttttaaaacatttatttatttatttatttatttatttatttatttgagacagagtctctctctgtcgccgggttggagtgcagtggcgtgatctcggctcactgactgcaacctctgactccctggttcaagcgattctcctacctcagcctcctgagtagctgggattacaggcacacgccaccacatccagctaatttttgtatttttagtagagatgggggtttcaccatgttggccaggatggtctcgatctcctaacctcgtgacctgcccgcctttgcctcccaaagtgttgggattacaggcgtgagccaccacgcctggcctgttttttattttaataagttgaaattgtgatagactgtagagaaactttgagagttggagttgttatgtttgatgtagtgagtggaagtattttactaaggtgttacattcattcaaccactatttgcaccaaaacacagggcttgagataccaataatgagcataacaaatgtgatcactgtgttcatggaataatatatttggggagacagatattaaacacaaaaattaagaaatataagattcttgattttgataagtgggccataaaaagcaggatatatatcaattggggtttggtcaggaaagcaaaaaccaccctagatatttcaagccatgaagaatttacttcaggcaattacaggcttacaaacctgttaggaagggctagacagtaatgtaagagaaactgccccattcagaaagtcagaaagaacaggaattgttgaaaaactgctgctgctgattccacttgtctcttatgtttgaagcaggtggttcacagaagagtacctgaaagctgtgagtgaaacctaatgtgtcatatgctgatgcccatgtgctgtcctttgctgttgaaggaacagtaatgcttctgttgtctttttgccttccaaagcttttcagatgtttctcaagatgttctcaagaggtagaagcaaaactggagctttggtcttagggattttggaaaatgaatgtagtttccagatttctagtccctgggaagagcacagaatgatgaaaatggttttaagttgccaagagacaatctggcataattagctatgagagaaaataacagggtcatcaattttagattggatggtaaaaaagtcctctttaaggaggagatattgtctgatggataagatcttttaaaagacagatcaatttctaacaagaattttggctgttttgtggcacaagtggaggaagacttaggagtagggataatttttccagtaagagtctttctaaagaggtgacatttgatttgatacttgagtgatgagaggaggcagccatgggaagattgggaagaacagaatgtatggctgagaagacaaatgcagttgccctaaggcttgaataaccttggcatgttggaaggaaagaaagaagagaggggtagaatgataggaatgaagctgaagagttaggtaggggtcaggtcatgtagtatcttcaatggtgtggtaagtcatttgtattttatgctatttaatatgagacaccattgggtcatgaacaagggtgagaaatgagctaattttcattttaaagatacgattttggctgttctgtagagactacatttggaggaagaaggtgggtaagtgttggggataagtagtcgaagtaaggagaacagttgggaaatcttagcagtacttcaagtaataagtgatagtggcatataacagtgcaaatggccaaaagcagatgtattttagattgtattttagatgtagagtcatcagtcttggtattaattagatgtgggtaattaggaagtggaaaaatcaaggaagcctcctaggtttttggcattagcaactatgtggattgtgtgacatttagtgaaataggaataactgggggaggagcagatagagcagtatgaaataatcaagtattctgctttggacttgttatgttttgtcattgtttaggagtcaaaacttgtcatgttttgtcattgattaggagtcattgattaggtggttggttgagctgagggatgagatcagggccgtaatcagatttgggaggcacatttacagctgtttagactggatatgatcatttgtagggggagaagaatgcccacgacataactctggaacacttcaacttttaggtggtttacagaggagaagcagccagaaaaagaaacagagaaagagagacaggtaataggaaaactagttaagtgtgaggtcacagaagtctagagaataaagtgttcccagatggaggaagtggtcagttaatgctgctaagaggtggtattggatgaggacagaaaattcttctctgttaattaactattggctttggcaagattgaggatattggtaaaattcatgagaattgtttcagtggaaagtcaggaataaaagactaatcagaatgagttaaagagaatgggacatagcagtatagacaactcttgtttcaggaattttgctgtgaatgggaatggggaaattgggtagtagctgcaaaggaatgtagagtcaatttaaaaaaatggttgttgatattaaggtatgcttgcattccaataagaatgattcagaagaggaagaaactcataatgcaggagaagggggagataattataaaagtaaaatacttgagtagggattaggaagtgggatatagagcataactggaggggaggtattgacttgtagataacaacagagatatttttttcattttaacctgaaggaatgcagttaatatggttatagaaacaggtagattgatggcattggtgtttagaaatgagattatttttgtctctatagtatgaggctaggtcactagctatgattgaggtgagaatgggaaatgtgagaagtctgaggagagagaagaaagtatgaaatggttcattcagggaatgggaaaatgactttaattaaaaattgtagaaggaatgtctggcagtgttgagtcttcatctgagatctgtggtgttaattttagtgtgaataattttagtgtgaacttcagtaaggttatgagatgtttttcttcagcaaaatttagctgctcagatacagtcatggactggtagatagatggcttcaaccatagatggatcaggtggaacaacagtggagaggagcaagtgagttaaatgcatttgcaaaggattggttttaattctagatgctgtaatgtatgcttgtgtaaggatgaggttaggaccttgagaggggtgataaatagggaaaagtagtagtgtcagtggatgggagctccttgtgaggtcaaaggatagagtagtggtatttaatgcaagtcatctgaaaggagagggaaaggtgttcagagagtgagatgctagaaacagacaacccagcagagagatatatatatattgataatgacaagattgcaggctgaaggtatgagggtgagtgacttaagtgggatggggcaagagatcattggagtgaggcagtccaaggaattaaatgtctaggataatgcctggcttatttatgaggatgttcaagttgccaaaaatgatgataggtatagtggtgaacagggagaccagaccatataagccagatgctgaaaactgtcctggggggggaggagcagatacttttaggggaggccataactgaggataaagatggtgggattccagaactagtatcactgattgaagtgtctgcaatatgagtatgtattacgtattgagaatactttggatcatattcactataagtggttccagagggtgatggggaggacatgagaatacagtgattgtgatcatggcaggaaaaaggtgtacaacatttaaatttaaatggacttgtatagtgttgtggttttttttgttgttgtttgtttgttttggtttttgtttttttgagacagagtctcactctctttgcctaggctggagtgcagtggcatgatcattgcctgatgcagccttgacttcccgggctcaggtgtttctcctaccccagcctcctgagtagctgggattacaggtgcacaccaccactcccggctaatttttttgtatttttagtagagacaaggtttcgccatgttgcccaggttggtatggaactcctgggctcaagcaatccacctgcctcagcctcctaaagtcctgggattacaggcgtgagccaccatgcccagcctttgaatagtgttttaggaagttaatttgagtagttgggagaaggggaaatatgcttaaatagctttaggaaactagctctctaggtaaggtatgtgtttctctttgtataatcccattattgacactctactacatataagattttgtttttggatgggtgcagtggctcatgcctgtaatctcagcattttgggaggctgagttgggaggatcgcttaaggccaggaatctgagaccagcttggacaacacagcaagacctcgtctttacttgtaccccacctctccccccccaaaatttttgtttttcagtctattttaaaattttgatgtagcataagcagtccaaataaaggtatttgatttaatctcatgtattttctgcatacttttaaatttacaattgttttctttaccttcatattggatgtttttttaattgcttgtatggctagcctgttgaggtcctctttttgcttagtccccccattctcattccataatacatattgggaaaagattataataaatattgggaaaaggttatctctacactgatacctttcatgtttacatctttgtttaccatagagtctgctcttgtgccatcaaagtatctaactgaatataaaacatagcattaggagtatctatcttctatagatgctatctatagaagcatcttctagtggaaagattaggatgagaacaaagtagaccataacaagtataatagccatacaaatagctagatggttatgcttagttggctgaatttaataggctgggttctggagcaaaccagagcagtctgagaattcatttctattggcaacaactgaaggaatgccaggcagactttgaaatctgtgctgggtctaacttggtgatagtgggtttgttttgattcttttaagattctgagtcactattcagcccagttactacttgatgcttgctctgctagtcatcttcagtgattcagttttggctgcaaacctatgaagaattattggtcagagtgaaatgacattgaaatctggggacctaaagtgctatgacctactcttgttagaatggggaggggtgtatgagactcagataattataataaatagagttctggcccagatttaactcacagtgtgtctctgttatcagagtcctttctctggttcctagttttgtaattggaatcaacatacatggtagttggcagaattctcaacttggctccttgaccagtttggttaagtgctttcctagtgggggaagatcaagtggaagcctctaaaactgtaccttccctcaccttggaagggacagcatttcttctagtttgggattaacacatattctgggtccacatgtttgctttttctgcccataagtccacagccagcaccactatctgaggacttacagagtgtttgatccactaatacgggatcttgagtaatattgtctcttaccaagagtcgcactttacaggaaagatgtgtagcagtgggccaaagttcatgaatccactggtcttaactcatactgctccacctataatcctctggattgatagaacagttgtaatgggctcataaaggtacaactgagatgccagattggaggtgatcctctacaaggatgggtttcatccctccagaatgcttggccatcatatggatattcattatattaagtatcctcaacaggtaatatgtacacgggttcaacaaccaagggatggaataggagtggtctcatttactatcatacccaatccttacttgaggaatttatgctttccattcatatagctttagaccctgtgggcttagaggttcttgtctccagaagtagaaatgccctactagggaacagacacaatgagagttccattaaattttaagccatgcctgctgtctggtcactttgggctcctcttgccaaaatcactagggaagaaaaggagtcaccatcctggtaagggtaattgactctgatcattatcacggtatggacagagaagaatatgtctggcattcaggggatccgctgatatgtctcatggtgttcctaagcccattattttaataaatgtacaaatacagtagccattgcctaaaaagggcatggtaaccagagtttcaaacctcttagataaaaggatctggatcgctctactggcaagctgcttacaccagcataagtgctagcagaggatgaggggactctaaagagggatgatgatctgttatggccaggaaatcaactacagcattgggactatagtttgtcttcttctcttgaaagtttcccgtggaaacaaaataagtagaatccttaagaagctgtttccggctgggcgcggtggcccacacctgtaatcccaccattttgggaggccgagcaggaggatcatgaggtcaggagatcaagaccatcctgaccaacatggtgagaccccgtctccactaaaatacaaaaaattagctgggtgtggtggtgcacgcctgtaatcccagctactcaggaggctgaggcaggggaatcgcttgaacccgggaggtggagattgcagtgagccgagatcgcaccactgcactccagcctggcaacaaagtgagactccgtctcaaagaaaaaaaaagaaaaaaagaaaaaaaaaagaagctgtttcctgctagagtgaacttactctaagaagcaagtggatggtctttacttttgaaactcttggcggggaagtgctgttggagccgctgtggttgctgtccgtgtagtgaaagcgcgtgcctttgtttgtgtccctggccatgtgtccctggccatggcgctgcagctctcccgggagcagggaatcaccctgcgtgggagtgccgaaatcgtggacgagttcttctcattcggcatcaacagcattttatatcagcgtggcatttatccatctgaaatctttactcgagtgcagaaatacggactcaccttgcttgtaactactgatcttgagctcataaaatacctaaataatgtggtggaacaactaaaagattggttatacaagtgttcagttcagaaactggttgtagttatctcaaatattgaaagtggtgaggtcctggaaagatgacagtttgatattgagtgtgataagactgcaaaagatgacagtgcacccagagaaaagtctcagaaagctattcaggatgaaatccgttcagtcatcagacagatcacagctacagtgacatttctgccactgttggaagtttcttgttcatttgatctgctgatttacacagacaaagatttggttgtacctgaaaaatgggaagagtcgggaccacagtttattaccaattctgaggaagtctgcctttgttcatttactactacaatccacaaagtaaatagcatggtggcctacaaaattcctgtcaatgactgaagatgacatgaggaaataatgtaattgtaattttgaaatgtggttttcctgaaatcaagtcatctatagttgatatgttttatttcattggttaatttatacatggagaaaaccaaaatgatacttactgaactgtgtgtaattgttccttttgtttttttggtacctatttgactcaccatggagttaacatcatgaatttattgtgcattattcaaaaggaaccaggaggttttttttttgtcaacattgtgatgtatattcctttgaagatagtaactgtagatggaaaaacttgtgctataaagctaagtgctttcctaaatcagatgttttggtcaagtagcttgactcagtataggtagggagatatttaattataaaatacagcaaaggaagtctaaatattcagaatctttgttaaagtcctgaaagtaactaataatctataaacaatgaaatattgctgtgtagctccttttgaccttcatttcatgcataattttccctatcgaatcagtttccaattatttgactttaatttatgtaacttgaacctgtgaagggatggatatttgtactgcttgatgttctgtgatacagaactcttaaaaatttttttttgtgttttataaaatcaagttttaagtgaggaaataagtttgttaaaaacaaaaaaagaagcaagtggatttgtgtggtgtaatttgcctgctcatataatccactcatttttctatagcatcatttattgatttgtagaacctctttatatagtatgaatattatcttttatgtatgatgaaaaaattgttttctagtttgtggcaagtcttttaatagtattgtgtttcccctcccacttatgaaaagttttaaatttaaaattgttgtttttagagatgatggggtcttgctgatctcaaactcctgacctcaagtgcttcttcagccttggcccccacaaagtgctgggactacagatgtgagccaccacacctggccttaaattttgataaaatgaaatttatcaatctcctttacatggtttaaatttttttagttacttttaggaaatttctgccctgatctcgtaattatattctcctataatttgataaaagtttaaagttttctctttgatctttagtcatttgttcataggggatttctttttgtgtatagggtgaaagatagggatctagtttttttctctccttatctagaagcatctctccttatctagaaagcatttatttagtgtctcaagtatttatttagtagtcatttatttccacattgatttgtaatactacctctttcctatgccgtatttccatgtatgcatggattttgtttgtgtgtgtgtgtgtgtgtgattttttttttttttttaacagaagtatacttgttccttacagtgtgctgttatgttggtggtacatgaatccatagacatcttcctggaatgtcaattttacctaaagaatatgaaaaagattgagtaattgaataactggtaactatttgaggacatttttcaatgaaataaggctgtttgaattatggagtcaaatagaactttcatgaagttttagctttttaagctaaaacgtgatacaatttgaagacatgttgagcttatgggggaccatttgaggccatttccccaattttccaggaagttcattctttatcatttaagaatactgtggtagaaaagggtgagaaggactaccttacatggactgtttttattttttgtcaaaacgttgtgtttattgttccatgtatacactgtgtgtattgatacctttattttttttgtgatctctgcctggaatgtcatccttctttcatatttcaaggccagcacatttttcatggcccagctcaattcaacctatttcttgaatcctttaacagttgtaatccttgttactggctcctttgaaatctggtccttactgggtattccttgtattaagtaatatttctaatggctaatgtttattgagagtgtactatgtgtctggtatatttctaagcattttacctgtattaactaatgtaaatctcatcagctctgaaagctaggtttttacccctatgtaggtattctttttatttctcacaaggaaggaaacagaggcacagagaggtttaataatttaaataaggaaaagcaggcaaactggcttcagagtctgtgcccttaaccagtatgctctgctccctctcagttgctcaataaataattgctcaggaatgaatttaccacttatattaacacttagcagacataactttgttctgttgttttatgggtgtgttctttcctaactatataatacatccctgaaggcagggataaaatcttatacttctttatagtatggctttatatttcatacttcattagacggatttactacttataacaaatccctagtagatgttcgtaggtgatgataatgaatttggtatgacctttagatttgccatagagtaacataaacctaatcattcattgtcaagtgggtctaagctttctaataagacctgttggtttgaatactccagaaccacagataaataacactatgagatctcctggttctgaagctgtggggtttggctagacctgtaacattctattcagttggtagagagatccccagagattaggtgacagatttctggcctgcacttaaactatgacctggacaggtcattttgtcttgctatctgtaaaaggagaaaatcatatttagtgcagcttttatttttaaatcatggtctttatgtagaccatgctttttagaagcaaagttatgtaccttcaaagtagcatattctcttactttgttataataatacataccattatgttggtacaaatttggaagaatgtattattaccagcaaagctgtgctctagcccaggctggagtgcagtggtgtgatcttggctcactgcaagctctgcctcccaggttcacgccattctcctgcctcaggctcccgagtagctgggactacaggcacctgccaccacgcccagctaattttttgtattttcagtagagacagggtttcaccgtgttagccaggacggtctcgatctcctgacctcgtgatctgccttccttggcctcgacctcccaaagtgctgggattacaggcgtgagccaccgcgcccggcctttagttttacttttaaataaagagcaaaatatttacgtattttttgagatagggtcttactctgtcacccagggtgtaatgcagtggtgcgatcacagctaactgtatctccaacttcctgggctcaagcgatccttgcacttcagcctcccaagtagctgggactacaggccactatgcccagctaatttacttttattttttattttatttatttaatttgagatggagtcttgctctgtcgcccaagctggagtgcagtgacacaatctcggctcactgcaacctccgcctccgcctcctgggttcaagccgttctcctgcctcagcctccctagtagctgggattacagatacgtgccaccatgcctggctaattttttttttttttttttttttttagtagaggcgaggttttgccatgttggccaggctggtctcaaactcctgacctcaggtgatccacccgcctctgcctcccaaagtcctgggattacaggcatgagccactgcgcccagccacccagctaactaaaaacattttttttttttttaaatagagatgagggtcttgctgtgttgctcaggctggtcttgaacccctggacttaaatgatcctcctgctgcggccttccaaagtgttgggattatagatgtgagccactacacaaggctgaaaatattttttcccccgcaagacagagtcttgccctgtcacccaggctggagtgcagtggtgtgatctcagctcactgcaacctccgcctcccgggttcaagcaggtctcctgccccagccttctgggattacagttgcccgccactgtgcctggctaatttttagtagagatggggtttctacatgttggccaggctagtctcgaactcctgactttgtgatccgcccacctcggcttcccaaagtgctgggattacaggcatgagccaccgtgccaggcaacgaaaatactctttttacagttagtttctggaaagtgtaagaattctttggtcaagtggaaaggacttgataaatgtgtagctatagctaacacttttttttttttgagaacgagtctcaactctgttgcctaggctgcagtgcagtggtgtgatctcagctcactgcaacctctggctcccaggttcaagcaattcttgtgtctcagcctcctgagtagctgggactacaggtgtgtaccaccatgcccagctaatttttgtatttttagtagagatgggatttcactatgttggacaggctggtctcaaacccctgacctcaggaggcctcagcctcccaaaatgctgggattataggcatgagccaccacgcccagccagctagcactcagtgaacatttactatgtatcaggaattgatttaagttcttttacctataataactcatttaattaagttgattgttgggtggccatttgattttttaaaaggtttccatttccccctctttattagtgtaattcaaaaatagttgtcaatactaatcagaaaaataaaaaattacaaatataaaatataacttaggttttgaaacaatctggggaacgggtctcaaacttgtctgttattttattaattgattttccctagtgtttattagggatttaaatgattaattgaaaatgttagcaaatgttgagcaaacattgatatactttgctttcaagaaaacaaaaatgagaacattgtatttttagaactatttcaccttgagttaagcattgcttgtcataaaccaaatacagttcttgccttcatagccccacattctctgtatggatcttctggaattttctgttgttgaggtaggagatgatagtttattctcacacatctgctttatatagcttatataatttagtctataattatttgctagtatcaactgtttttaattgattcacaagaatgtatattcttgtactcatcaaacatttgagggttcagctttgcatttgacaaggcacctggcatagtactgagaggatagccaactgtttagcttaaatatttgaggacctaatgaatagaaatagcatcttgactagttgttatattttattctatttaaaaggtcataataatggatgcttgataaatattgacctagaagaaatagtttaaaaaatgaattatatatattttttcatggcctcttaaaaatagtagaaaagtacaaactgttgtggatatgaagagtgaaataatgaaaataaacccagtgttaaactctaagaaatagaaacaaaatataattaagaaaaattgaataaaataaataatagaaaagtagaaattagtaaattggaaaacacacaaaaaattgtgaaattcaagtttctttatagtgattctttaaaagggcctttatacaacttagacaaacatgtagcatttctaatcaagagaaagaggtagaaaaacaaaataagaagtgaagagagagctagaacaatagtaacagtggaaaatttaaaaaatattttagtactaataaatgagaaaatcttaatggcttgggtagtttggggaacacttaaattatgattgcattcctttgagttcatttgttcattataagcaatcttttattggtcacatgtaacagtggttctcagactttttggtgttagtaacttttataattttaaaagttattgatgaccctcaagacctcttatttatgaaagttatatctgttaacatttatcatattaggaattaaaatttggaaactttgaaatgttcatttattcatcaaaaattataaacctattacatgttaccacaatgtatttttatgaaacataactatattttccaaaacaaaaaaattttgtgagatgagtagcattgttttacatttttgcaaatcttttaaaaatgcttggcttaagagaagaaaactagattctcacatctgcttctgtgttgagtctgttgtatgttttggttgaaataaatgaagactatctggcatctatagatacctatttggaaaagggataagcattttaataatagccttttcaggtaattgctgacattgtttttggacatacttagttacatgtatttttaactcctttgaatcatggtggaagtaaagacataccttatttagtgcagtggcattaatggaaatcagagtattagttgaatttgcccttcctttccccgaagtagaattatagtaaaggtctgtatgcaaatgctagcttggtttagtgggacatcgttctttcaagtctccaaagtcctgaatgctcctgtggccatggtgctttcccttattactcgtatgcagacatacctcagacatattgctggtttggtttctgaccaccacagtaaagcaaatatcataatacaacaaatagcacaataaagtgactagcacaataaagtgtgtcacacaaactttttgatttcttagtgtgtatgaaagttatgtttacactatactgtagtatattaagtgtacaatatcaatatgactaaaaaacagtgtgcataccttaattaaaatatactttactgctaaaaattgctaacaatcatctgagccttcgaaagtgactataatctttgtgctagtagaaggtcttgcccagatgttgatggctcctgactgatcaggatggtgattgctgaaggttggggtggccttggtgatttcttaaaatgagacaacaatgaagttcgttgcatttattgactcttcctttcatgaaagatttccctggagcatgtgatgctgtttgataacatttacttactggaaaattcctcgcaaaattggaatcaattctcaaaccttgccacagctttatcaactaactgtatatgttatttctgaatctcttgtcatttcaacagtgttcacagcatcttcaccaggagtagattccatatcaagaatcatccctaagaagcccaaactcctcatttgttcaagtttgatcatgagattgcagcaattcagtcacatcttcaggctccacttctaattctagttctctcgctgtttctgccatatctgcagttattttctccactgaagtcagaccctgaaagtcatctgtgaggattggaatcaacttcttccaaatgccttttaatgttaatattttttatcttttcacatgaatcacacatgttcttaatggcatctagaatggtgaatcctttcaaaaaggttttgaatttgctttgcccagatctatcagaggaatcattgtctgtagcagctacagcattatgacatgtattacttaaataacaagacttcaatgtcagaattactccttgacccatgggcttttgaatggatgttgtgttagcaggcatgaaaacaacattcatgtccttgcacatatccatcagaggtcttaggtgaccagattcattgtcaatgggcagtaacattttggaaggaatctttttttccgagcaataggtctcaacagtgggttcaaatattaagcaaaccatgctgtaaatagatgcgccatcattcaggctttattcttccatttatagagcacaggcagtatagatttagcataatatttaagggctttatgatttttcaaaatgacaaatgaacattggtttcaatttagtcatcagctgcactatctcctgaaaagacacccttgcctttgaagctttgaaaccaggcattggcttctcctctgtagctatggaagtcctagacggcatcttccaatagaaggatgtttcatctgcattgaaaagtctgtttttcagtgtagccaccttcatcattatcttagatagatattatggataacttgctgaagcctccatatcagcacttgctgcttcaccttgcacttttatgttatggaaacagcatctttccttgaatttcatgaaccaacctctgctagcttcagacttttcttctgcaacttcctcacctttctcaacctttataggattgaagagagttaggtattaggatctggattaggttttggtttaagggaatgttgtggctggtttgatcttttatccagaccactgaaactttctctgtataaatgataagactgttttgctttcttaacattgtgtgtcattggcgcagtgcttttaatttccttcgaggacttttcctttgcattcatgacttggctaactggtgcagttggcctagcttttgggctatctcagcttatgatacaccctcctcaggaagcttggtcatttctgtcttttgatttaaagtgagaaacctgtgattgtttttttcacctgaacacctaagagtccattgtagggttattaattggcctaatttaaatattgttgtgtctcaaggaatgggaggtctgagaagagggagagagttggaggaacagtcagttggtgaagcagttggagtacatacaacatttattaagtttgctgtcttatatgggtgcttttcatggtgccctgaaacaattaaaatggtaacaccaaagatcactgatcacataacaccatgtcagatataacgataatgaaaatgtttgaaatattgtgagaattaccaaaatgtgaaacagagacgtgaagtaagcatatgctgttggaaaaatggtgccgatagactcattccatggcagcgttgccacaaatcttgaatttgtaaaaaatgaaatatctgcaaagcccaataaggcaattcgcaataaaatgaggcatgcctgtaattgtcagttctcccagtctgcagtattatttctgaagcccttcataaagttagacagacttttccctccaatttctagcttttaccttgtttcctcaaccatatccctgaaggggctttgagcctctaatgtcttaaatcttaacatccagcactatcacatgcacaccctttttagctatcaggatgaaactgttcatcagtggcagaaagaatggctacagaatagtccacatatttcagaaaatgttcttggcttagagcatttggaatatgatgtgttattaacacatgctggctaggagtatgtagtataatttgttgagctgttgctcattggctgaaagcttacgatagtattcaaagtatgcttttgtaatagagttactttttctttctttttttttctattttcaccatagtatatgaatgtttatgcacaaagttggtgtatctgacacagacagaagaatattggttttgagtatgttgagtttgaggtaacttgtgggatatcaaagagtaattgtgcaatgggcagtgtgtaataggaatttaggagagatttttaggctagaaatagatacttaggatgattattttcataggtcattgtaaaaattgtaagaataagatagaaggagaaagtgtagagtatgaagaggactgtaaaagggaaataaatcttgggacccccaaaatcactaagctaaagggaaaagtcaagctgggaactgcttagtgcaaacctgcctcccattctattgaaagtcattcctctgaggctcatctgagacaaatgaatctctgattgcttcctctgccctattgtttatgtaaaaatgcagattcactgagccagactaaattgtgtattcagtggaaggctgatcaaggactcaaaataatccaaccttttgtctctcatctacttctaacctggaagcccccacttcgacttgtcccaccttactggaccaaaccgatgtacatcttacacatattgattattaatataaaatgtatgtcatgattatcaatataaaatgtataaaagcaagctgtactcgaccactttgggaacatgtcatcaggacctcctgagggtgtgtccttaactttggcaaaataaacttcctaaattgactgagtcctgtctcagaaatatgggattcacagggtaatggtgaattcttactagttatatgattttaagccagttatttgacttctccatgcttagtgccctcatctatgtagtaaggaaaataatatctacatcatatcgcaaaagccctaattaatgttattttctttctatgttccttcatatatttccaacctctttctagaaaatatttatagtgttattccataaaggatttaaatttggcttaggagttttctggcaaaggggcaaaaaggaaaactggatagattccatggtccttgctgtctgtcaggaggatacaaacccatttttttgaaagtgagtttttctggcacagctttatttaattattaactctttccttttcccttgagtacaaatatttgtttttacacagctccgtttttctggctcagaatggacttaaatatactatttgaatttgtaccttatattatttgcttgttagttgaaaattgctatgctaaatgataatagccaacagaagattgattagacattaattttgagttctaagataatgaaaaaatgggtaaacatgcttttttaaattttgagggcaatatcttttcttctgaaagtctactatctcttcataatgttttaatacctgctcccaggccatcacttctctacctgtggatgaattcttttgcttcatattccaaaagcactttgttgaggtagtttatataaattttttctcaggatttggaatacatagattctgagttcccttttaggtatcaagtgattcatagcaatttagcctaaaggtatgaaaggactgatgaggaaatttaacagcaaatattccaaagtttaaattgagaatgccacataagtaaatgtaacacattcctattttagttgctgagataaatgagaaatgattatcgtagacaaagttaactggatcccgtggctaattggcttgaaatccatgtatgcaaataagtaagtctctacttttattaagattgtataccccttctatcaaaagttattcattttgaggtcataagttttttaaaattacaaatatctgggctttaagaaaatgtgaaacctttttaaggtgaagattcaattggttactttctggggactaaaacttgtagaatattcttttaaaattccagtttaattcccacttgaaagctgatatcatcaactcatggtgacggttaggaaggagagaaaaataagaaaagaaaatgtctaatattttgttcatcttctttgggccagtttagttgaaaaccctaaccatcacatataaatagtttatttgggaaaaatgtattttgagttccaagtagctaatttgtaagcaaactattggaacaaagtctatttgtaaattgactgccttttctaaaatgcaccaggtgttatttttttcatgtgttttccatgaatccttaaacgcatttcattattggatgttgataatattttaattaactggtgatcatttaggtcatttctacctctaaaatttctatgattcggttagagcagagatttttggcaaatgatttagttgaattaaggtttctaaagttttaatgttcaaagatatggcacttcaatcaatattttcttgtatagacaagttaggtttattttgggaggaaattttttaaaaaataatatcctgcttctttcttacagaatttagtacacatgggcttaaggaagaatttattgtaaaaataaaatttttcttttacaatgttattacttgttttttagctttcaagaccataggtttctgtttcatttttaaaagccaaggagctaacgaagaatggaaagtgctgataaaactaggttacttcacagaaagtcttaagtatagagtttttgacaaactatgaatatttcttttaggccagtatgttttaataatatttgaaatttgacatggaatatagttgctctttaaaaagtaaagtgaacaattgactaaaattttgacgagaatattcttgataaaataaaatctgctaaaaatatgtcattcagagagaaaaaggatgtcattctgatttttaaaaacaaaaaccataaaaatatttttggaaatggataatgactgaaaatttgggcttcttcagcagatttttctgttttctgcagaatgtaaagttttatttgaaaaaattcctagcactcctagaggcaaaagattgcccatatactgctgttttggttgctctgttgccagataaaatgaactagcaattatcaactactacttcttcttcttcttctttttttttttttgaaacagggtcttgctctgtcgcccagactggagttcactggtatgatcacagcacactgcagcctcctgagtagctcccatctcagcctcctgagtagctgggacgcaagcgtgtgccaccatgcccggctaatttgttggtgttgttgttgttgttttttgcttgtttgtttgtttgtttttttgtaggaatgaggttttgccatgttgcccaggccagtctcaaactcctgggcccaagtgacctgcctgccttggcctcccaaagtgatgggattacatgtgtgagccactgcacccagcctatttttcctgttattttatttatttatttatttatttttggatataggtcttgctttgtcacgcaggctggagtgcagtggctaatcacagctgacagtaaccttgaactcctgggctcaagtgattgtcctgcctcagcctcctgagtagctaggactacaggcatgcaccaccacatctagctaattttttttaaatttttatattttgtagagggagggatctagccatgttgtctaggctggtcttatattcttggcctcaagctatcttcctgctttgccctcccaaagcactgggattataggcgtaagcaactaggcctggcctgttcttttttttaatgattagtttttatatatgtattttgtaaatatgtagaaaaagatgtggccacacaaacactaaactcaacagtagcatattacccgtgggaagtgagatacagaacacaatgaagtagaactttgagttatttttctatataattctatattttataagctttaaagaaaaaatattcttttcacagttaaaattagaaatggaaaatgttacgtaggaaaataaactgcaataaaaaattttaatactatttaaattattatgacaaggcagattataaaaagtggagatgtacaactgattttggaaacaatatattatgtctaatatacaatataacgtttagaaatattaatgttctatattaccttgctgactaaactattgattgagtctaatctccaagaccttgagatatattaatgttatttgtggctctgtaattttgactattttggatagatgcttacttataaatatctttagttagtatagttgtaaagtttgcctgttttcaccttccatggatgggtttaatttcctctaaccacaaagaatagtgaaaatgcaccactctgaaacttcctaagtccagagtggtttatctggggtttagttgatcttgctaatgacactatgatctttggaatttttccctgttattttttagtgacactattaagatagaaatataggccaggagtggtggctcatgcctataatcccagaaccttgggaggtcaaggcaggaggatcgcttgagcccaggagttcgagaccagcctgagcaacatggggagtcccagtctctacaaaaaaataaaaaaattagcagagcgtgacagtgtgtgcttgttatcccagctactgaggagcctgatgtaggacgattgcctgaatctgggagggcaaggctgcagagagctgtgacaacttcactgcattctcaaaaaaaaaaaaaaaaaaaaaaaaatatatatatatatatataaaataggtatatatatacatatgtgtgtatatatatgtctgtgtgtgtatgtatatatttaaagatcaatgttagtattttactaataaccttaaaaattcttatttttcttattacttttcttatttagcttattctgtaagttaaatacacacttggaagaaatcaactcttccctattcattagaatttctctttttccctttgtcttgtattcatttttttgttttgtgaagtttacttagtgagtacttagcgttaggcactgcggatagagaacaagataggcaacattctgtctttatgaaatatactgtacttccttgtctaggagacagaacacagaaataaataagatgatgtcagatattgccaacaaaaggagtgattaggactgtgtggtcctaacacatatggaattgggcaagattacacctggaggactacaaatgtttaaatatttatcaaaacattcgaatatttaaaagttataaatcaagccacatccttggcccagcctgatttcctacacagcatgttgagttgccagcagcctataccctcaagactcagaggctaaaggaactgctctctcctcccatccatctttgtaacctgcctgactgagtggtagtatggatctgttggggtagggcagggatgattggggtggtacctagacccatctaaaacagtatattaacagatcccaccaagtccccaggaatctggttatagagaggtttgcctctccagttcattgttttttcaactcaagtcttctaggaagttgtaagcccttcttaatgttgcactaccagaaaaggggatgcaggtatctgggaaacctggcttgcctgggaattcggtttgctttatttggggcaacgaactttaaccgaataaagcttttataagcagccactctttctgggatttctcatggcagaagttgtgttcattttctccctcacacatactggagcgctcaaagttctttatcctctggccagtgaggcctcattcagctagcacctctttcttgtaattgtcatttgctcagttgattactgaactttcaaaagacattcttacaaggaaaggaagaaaaaaacatctgttttagtgcttggggtatatagggctctctaaagagcaggcccctggcagaggcttctcttgcccaggtctatggatgatattgggactggggatggaggtgaccatacagtagccttttacatgctctttgacttctccctatcctgctcttcttcctagtctctcactcaatttgttttaatttataaatttgtttgatctgtaaaactaaactggtatcacttgggatacctatatctgaaaagtaagctccaaatgaaaaagaacattttccagaaagttttttggtaagattttaaatagaagtgactagttttcaagtctcactctccttatcccataggggcaaactattcagatgtgttgtagatttgaacattggcttaaatgttatgttttatttctgtccttacagctgtgaaagttgtgtagatttactgtttgtgagaggagctggaaactgccctgagtgtggtactccactcagaaagagcaacttcagggtacaactctttgaagatcccactgttgacaaggaggttgagatcaggaaaaaagtgctaaagatgtaagtattcctgctcgaatgattcagtcaacaaagaggactttaacaattatgtcagtaattgattattatttgctcataaatgtggacagattagcaagtaaataactataaattcatttaagttcttagagaactgagtaatattatttatctttgttaaagaagagcctcttgattgatggcttcattattcatttgtatttattctttgattaataaacatgtattgagtacctactatgtattgagtacctactatgtgtaaacactactatgtgtaaacatgttatgcatgttaagcagtagttatgaagtgatgagtaaaacagctatgaactctgtcctcatgagacttaccatacagtagcataggatagcaaaaagacaaaaaaacaagtaaaccaaaacaaatgttatttattatagattgagaatagtgctatatagttagtgactcagtgttgctgtggtcaatgatgtcaggtgtgggcagaggaggtaacattaagttgaagtttgaaggctattagagaaaattacgtgttagctatagtttattttggtatgtgtatttttgtgtatatagatatacacacatgggcatagtaaatatatgtgtgtatatatgtatatatatacctatatattattaatctgtctttttcatttacaatttaggctttactctttactctttgttaatagttttgggtttccttttatctgttattatgagaaataattgatatgtttatttttatttttggtggtatacatttcaacccaggtaaccagtgttttagcagcatctttctaggtacataaccaataatactttatcaatccgcctagcggctcttttattgtttgtataacttctgcaaggtagtctcttagattttgatctttcattggtaattccttgcaatttactgattctttacaggtacattacaatatatacagattttcttgatccagtattttttagactatgtcatgaaaaatggaggagtcgcttcaattttttgtgttttggaaattagtgaatcccttagaagtaaataataccataatttccaatgttatgtcttgcttaagctcatttcccaatctttcaagctcccaatttatctttccctgaagtcttaacaaggattttgcatattgtaccattttctcctgatcctacttcttctccgtagtcataagaatttaagaattgcatttttggtctggttacaaacctggtgtcaagaaaaacagtgttttaggctgggcgcggtggctcatgcttgtaatcccagcactttgggaggccgaggtggtggatcacttgagatcagagtttgagaccagcctggccaacatggtgaagtcccatctctactaaatacaaaaaacattaagtggatatggtggtgtgcgcctgtaataatcccagctattcggggggctgaggcagcagaattgcttgaaccagagagatggaggtagcagtgagccaagattgtgccactgcactccagcctggacaacagagcaagactccatctcaaaaaataaaaataaaaaaatagagaacgatgttttacacagtaagcaattcttttccatgtatcatatatgaattaggtcagaacaagcaaaccagttagataatattaaaagcaatgatatgtaatatgtagatttcttttttcttttcttaaagatacaataaaagggaagaagattttcctagtctaagagaatacaatgatttcttggaagaagtggaagaaattggtacgtttttaatttgatgtatgctagcctataagaccatgtgcttttatcttttaaatgcttaggagaacatctcacataaaaacctcttaacaggttttgttgtgatagctaacatttacctaattactttcttttgcacttgagtcatgtttgtcaaattgaaggcatacttaagtaaagaacctatttaatattgtcttttaggaaaaatatgtttaatagagatagtaacacttcatagctggggaggaagactatatgggtacatgcatctgtgtgttgataacatattagagtagtttaaatgaatggaaaacatattctgatttttcaaaaatggggttcctattaaccatatttatagtgactaaagccatatgtttatcattatttgtgcttctgtggatatagtagtcttaaagtactttgaagcagttgactgttgaagtggcattctattaatcagtattattctggaatcagaggttggagtaatctttgtgccttttctttctgatgtgtttagtcaaaaggaagattttatcaagaaaaaatgatttcagttttcttaaataaaatttcagagatgttaaaaactttggaagttgttatatgttgatttaaaaaataatgctgctttttaaacttgcagtaattattactaagtgcgggtttggaaatgacacaaaggttatatactgtgaacattagaatgagactatgaggatcaaacagcaatcatttttattctttcaaacttaataggtaactgtactcaatatttactattaaaaataagattataataaaatggatcattctttagaagatttatatatgataaacttaacaattcagattcctgaggaataataaatattctaattcctttaatttctttactagaaaatccagaaaatctttttgtttcaactgttacctgaaacttttctcatatgtctaagttcatttgttatgccatagcaaaagcatgtggaaaacataatttagggtttctctgggatctttcagtgccataagagccactgcttttccattctgcatgtactcattgcactttgtatgttatcttagcaatcatgagtgactatggattttagctgaaaagatggtagaattgggagtgacaaggcaaagtggaaaagttagaatgtagactgagaagaaaaaccagaaagaaatctacaagaactgggcaagtatgaaggtatgtagaaatctggctctatatagatactaagtataggacaagctgttggatagcaattgggaagaaaagtagcttacatatattctaaaggtaatgtgattagtcaaaagtctggtcaagcaataaagggaaaggaaattataggtgttgcagtacaagttgaatacatggtcacaattacaagcaggcagtcaggataactaaaagaaacatatacagagaaggtgaggaataggtttaggggatgaactacaaggagatcttgattctgggattaagattctgactgagctatgattaaaaaaatatatatatatatatacacacacacactgcatatatatgtgtgtgtgtgtgtgttgctccaagataaagtaatttgaaggtgtggacaacatggggcccataattggtactagaattgataggcaagagcaagtctggatattgggggtatacaacatgtaatgctttctttaccaaaatatagaagctgtggctcagaccatttaatttgaaagtgattctgctattatgtgtattcatgaaggactgtcttcagttgcagtatcgggaaactctcttaagcaacctccacttaattgtctcattgaagtaactgtcattccccagttcttccataaaaggtactcactgatacccacagcataatgaatgcattgtgaatgccatcaaccttcttatgccagttgtacttgttattgtagttatgtagttatgtaattaaatacatatttaatattatatgtaatttaaatatttaaagtgtgtaaggttggggaaaaaattgtaaaactctagaaggattctgtttctcaggtttttaagtcacttcttaaaaaatggaaattggccaggtgcagtgactcgcgcctgtaatcacagcactttgggaggccaaggcaagaggattgcttgagcccaggagtttgagatcagcctggacaacataatgagatctataccaaaattttaaaaagtagctgggtgtagtggcacacgtttgtagtcccagctacttgggaggctgaggtggatctctgaagtctaggagtccaaggctacagtgaaccatggttgcgccactgcactccaacctaggcaacagagcatgcccatgtctcaaaaaaccagaaaacagaaaaggaaactgaacaatatagatgacagttatggcctatataaggaagaagcaaaactctaaaatctagaatttgctctatgtcattaagttagagaatgactatatacttcctatatatgttttaagttaaagtatttgaagagagagacaggtgtatgtgtgtgtttctctcctttaacaaacttatttaaatgttcaactataaatcctcattgtgtttattaaagagtggttctactctatttaaagatattgatgatttttgggaagtaacctcttggatttatagtttattttctgaacttcagttcaattcagcaagtttttaaattatgttatgtgaactgctttatggatggggatatgtggtatttgccctcaataagctcagactctaaagggggagataattatgttaactaataactataatgtaatgtgataagtcttataaataggcatttataaaatgctatgggaatacagataaagcaattaacctagcactgggaaatagagatgtggtttggtgacattcagagaagagatgacatgtgagtttgatcttaaaagaagaagaagagttaaccagatagaaagggcttggaaaaacatttgtaacaaaagaaaaaggcaccgagatagaaaaatgttgagcatgttggagaatgagcaagtagtctgttataggtgggtaaaacatgagggatgactaaaaatggggcctgaaaaacaggctggattaaggaggccttagtaccatagacaacaaaagcaaaaatagacaaatgggattgtatcaaactaaaatacttcctcacaacaaaggaaacaacagagtgaagaagtaatctacagagtgggagagaatatttgcaagccagaaatctgataaagggttaatctccaaaatatataaggaagtcaactcagtagcaagaaaatacttgattagaaaatgggcaaaggacctgaatagacatttctcaaaagaagacatacgtatggtatatgaaaatgtgctaaacaccactaatcatcagagaaatgcaaattaaaatcacaatgagatatcatttcacatctgttagaatgggtattatcaaaaagatgagataagtgttgatgaggatatggagaaaagggaatccttgtatgctgttggtgggaatgtgaattagtacagccattttggagaacagtatggaagttcctcaaatactaaaaacagaactaccatatgatccagtaatcccacttctgggtctataacctatagccctattcacagtagctaagatatggaatcaacctaagtgtccatcattggatgaatagataaagaaaatgtggtacatatgcaccatggaatacttcagccttaaaaaagaaggtaattctgtaatatgcaacaacgtggatcaacctggaggacattatgctaagtgaaataagtcagtcacagaaagacaaatatggcatggtctcacttatatctggaatctaaaaaagttgaacttagagaagtaaagagtagaatggtggctaccagaggctgtgggatggatggtgggtggggaaaggggagctgtatggagttaatcaggtaaacattggagaataggcagtattttttattattttgttgcctaaggatatgaaatttcaattagacaggaggaataagtttttgaggtctattgcacagcatggtgaccataattaataataatgtattgtatatttcaaaattgctaaaagagtagattttcaatgtccttgctacaaaaaaataagcatgtcaggtgatggatatgttaattaattagataaaatagttccacagtgaatacatatatcaaaacatcacattgtaccccatagatatatacaattattatttgtcaactgaaaaaaaaagagggctttgtaaactgggctgtcagttaagattttatcttgtggctaagaggagatactaaagagtgagaaatgacttttcaaggggccattacagtaatttggatgagaaataatgagggcttggagtagatagtcacagtggggatagataaagaggatattttagacatagaatattcaagtggttgatttgatgtaggaagtgtgttagagtaggcaaagataaattcaaatattatgacctgaccccatgcagttgtatggtgttaatcaggtaaacccgggagaataggcagtattttctattattttgttttgttgggtgaagcgtttgcagaaatgagagataaagtgaaaactttagttttagaccttttaagttttgttagagtgtggctccaccacttagttgtatggcattgttcggtttgtcatcatataaataaaactttttttttttttttttttgagacggagtttcgctctgtcgcccaggctggagtgtagtggcacgatctcggctcactgcatcctccgcctcccgggtttaagcaattatctgcctcagcctcccgagtagctgggattacaggcgcccaccaccatgcctggctaattttttttttgtatttttagtagaaacgggatttcaccatcttggccaggctgatcttgaactcctgaccttgtgatccacccaccttggcctcccaaagtgctgggattacaggcgtgagccaccgcacccagcgaaaacttcctgtaaaaatcttgtttcaatagctttctattttgtgttgtattcatatttttaaagatagttagatgtctgtgatatctgtattatttgtgttaatcagaagtataaaatgttaatttaatggacatttactaagtaccagactgagctgtacacacattatctcataatttttgaaactctaagagacaggcatttttattcctattttgcatctggagaagaggcacagagagcttaagtattgtgcccaagactgcattgctagtaaagaatggagccaaattgtaaatataggattttcttactttctgagtctagaacatggagttctatggaattattagagatgagagaaaaaaagtagtttggggccatattttgaaggatattaaagacatttgaactcgatcttataggtagaagggtgctgttgaagataaacgtttaaatctggagtaagaaaactagaattattagggtgcctcagagggtcagtgtttgaggattcataaattggagattgaagtaattttgttgtataaatttcattatgaatcttttgaatatgaatataaaaatgaaaacattataattttaataatagcatcaaacattttcaatagaaggggcacacatgaagatggactttcttatggcattaacaatagactcttttctgtggttatgacaatctatacataaaattcttgttccttatggctccagagattatctcaaaggtttattcttagtttcataatgaacagattattcttttggtgcaaaacagattattcttttggtgcagagaatacttatcttaaaagggtgagaaagtcctaagggctttaattataaattctggatgtcaaaaagacttcaaaattgtacgtgaataacattaaatctttcagaaaatacaataggctttttgtttgcttttaatacttgactaaaggcaggtcaacatctaagctaaaccagtaaacagataaagggtcaaatgattgttatagcaaattagcttctattcctttttcttcacggctattgtaccaacctgattcattgggtatgaatgagacctgcttcatctgaaaacttttaaaatagtaattcgcttttatggttcttttcttactttttaaaggaagagacttgtattatctgattatgatttgcatttattattgctgttacctttgcttctaaattaaaatctgaaacaaattattttactttttttggaattcataaagttttcttttttaaatttttatttattcatttattttttagagatagggtctcactctgtctcccaggctaaagtgcagtggtactatcatagctcgctgtagcttgaaactcctgggctcaaatgatcctcctgcctctacctcccaagtagctaggactacaggtgtgtaccaccacacttggttaatttaattttaaaagtttttaattttatttttttggtagagatggggcctcatgttgaccaggctggtctcaaactcctggcctcaagtgatccagaactcataaagtttttgataagcataaaagaaattgcttatataaaaacagattaatttcacttaggatttaagtttgcctatttctgggctctatttaatggaaaagttaaaatcagtagtaaactgtctagtttgctaataaacagtgttttttaaactgttttgaacatactagtagagctctacatgggatatcaatttgaccgcttacttttcagtagattcataccataagaaaccaagataatttagtcctgtccttttgaaccttcctcctttgccatgttcaaatcagtaattataaaggttattttagttaaatctataattataaaagtaattataaatgttgggtattagtttattttttctctcatgataattcaacaagtatttcttgagcccttaccagatgagaagttttttcttttttctttttttttaaaagtagacttttttttagtgaagtttcagattcacagcaaaattgagcaaaaagtatagagaattcctatatatctcttccctctacatgtgcacagtgcacagcctcccccattattaacatcctgcaccagagtggtacattgttacaatcaatgaacctacattgagatatcattatcacacaaagtctgtagtttacactaggattcatttttggtgctgtataccctatgagttttgacaaacgtataataatgtgtatctaccattatatcatacagagtcattttaactgtcctaaaaatcctttgtgtttttctgtgtgtttattcctccctaccccaacccctgacaaacactgttctttttagtttttatagttttgacttttccagaatgttatatagttggaatcatacagtatgtagccttttcagattggcttctttcacttagcaatatgcatttaaagctcctctgtgtcttggctttatagctgatttctttttagtgctgaataatattacatttttttaaatctgctgaaggatgtcttggttgcttccaagttttggcaatgattaataaagctgctgttaccattcatgtgtgggtttttgtgtgaacatgtgttttcaattcatttggataaatacctaggtgcttgattgccagattatatgatagagtatgtttagttttgttagaaactaggaagctgtcttccaaagtggctataccatttcacattcccaccagcaaggaatgagagtccctgttgctccagatctgcaccagcattttatgttgtcattggagttttgccattctaataggagtgccttagaagtagtggaagtgataataaagatgaatcagacctagaaactgccctcaaggaacattctaataggtcagacaagatgtgcacattgaaaataattatacagggtaggaagtgggtaaatgccagcagagcgatattagacaatgtattgtaagcattcagggatggagagattgtaactgcaaagtgtctcataaggaggagctggtcattaaaatgggtatagaagggtgagtcatatgtggatattcactgttgttctgggttgaggttggtactgagatgagccctatgggtagggaacagtttaatcacaggtatggaaatgggaaagtgtaggggcatacaaatgcagaggactgctaggtagcagtggttttcaggcattgagagaaatgacacaactagttttgtaggcattgtagataaaagttcaggtttggaatcagatagcctaggttaatggctgggcatggtggctcacgccagtaatcccagcactttgggaggccaacgcgggtggatcacttgaggccaggagttcaagaccagcctggccaacatggtgaagccctgtctctactgaaatatacaaaaattagccaggcatggtggtgcatgtctgtaatccaagctacttgggaggctgaggttggatctggtagatgttgaggatggtgagagttgtgaaagatcattggatttggttgcttagaggatggcctattaaatacaagaggtagattttgagtggttggtaaagatagtggaatcaccattttaactaaggatcagaggtaactttttgagagtgctgcttgtctggagcctccctctgactgttttgtgtcaggactagagtgtgatttatgaagattgtcccacattgcatcctagccagattccctgacttattttctttcccactttatgttaaaaaactggagaagttgctagaggataattgcttctcattttctctcaattcttccagatttaaaattgcgtatgataaaactgaatagacttttgcctttatacctaaatgagcctggattttcaacagtgattatgataaattgatgttctgaaataagttggccttttgagaagaaaaaaatgaaattatagatcaaactggtcatttgagtctgtttgatggctttactcaacaaaacaagcaactctgtgttggtcctccggtgttacttttcaactcttataagctattaaaggaaagagtgagatggggaagcaatctgtagaaacccaagggatagagcagagttatttagggtagatccgtcttgtttgtagggcaagaagcaggaagcagtggtaagtaattggagaaggggtggaagggctaataatggatgtagaaagattacaagggaagctaaaggaggcttgaattgaattatggaacaggagagtcttactgatatggattcctccatatgagtttatatatagcaagaaggtctttttttaattgttcagagtattatagtaactttgatttacatatggaaaattagaagggaatatggcattcataattcaaattattttgagttggaattataaaaagagagttgtaatttacagaaaatttagtagtatctaaacatgtctcagtggttctcttaagaaattcttttactttaagttttggtgccagtttatcctttatttttcttcttaagttccaactcctttatttcatacgtttctagagctagactacaagggaagtaattcaagcctgtgtctactcatgttggagacaattggaatggggataaaacctgttttttgtttgatataaattataaaaatatatgattttttaactctttttttaaaattctgattcttgtagtagattccagacttactctttatattaaaaaaatttaaacaatttttttatgcttttaaagctagagaggggactataaaaatcagatctaagcacatatcttaggttttctggagtgatcctgacatttaggtattttgtgcgagtcagacagtctgtccttgtgtttggcttggaaaacatgtttgccgtaactagagctagtctctaaaataggtagctgattaaaaggtcacaaatagagctataaagaatgacaacctaacaaatgagtcactgtggtatttgttttttattgtctactcaagatttatattaaaaatatttttcatgtcatcgtttcctttctaatgcagttttcaacttgaccaacaatgtggatttggacaacaccaaaaagaaaatggagatataccaaaaggaaaacaaagatgttattcagaaaaataaattaaagctggtcggttgctaagtattttcttcttattttgtcttagaaacaaatgtttccacatgatactttaaaaagccatcttcctttaaaccagttacatttatagaaaatttagctgaaatttagaccagaaatatgaatatatgctgtataggtatgtaggtaggcaggcacacattactgtagcaaaaaccactttgacagcattatgttagactgtgctttcttaaggaagtggatccgtaagataggtgattgttaacgctagttttatctgcctgtataatcttctggtaagtgagcatttggacagtggtcacaaaacactggaggctcatttttatccttggacattaatttctctaaaggagagagaaaacccagacagacggtgatggagctaccaagagggagataaaacaaaaacactatttattagaaactaaaatgaattcatgattagatcagaggaacacatttgtaaactaaggttaactttggtttctcaattagttaccttttttgttttaccgaaagagtaacattgctagatataaatatgattttggtttgttttagttgatctcatgttgaagtttgttttgaaaatatctcaggagtcattattattatatgtattagaatgtattctataaagaaaaaattgtatgcatgcaaaggagcaattgtctaatttatacactttagctatcatttctatagtacagtttggctttctagttgtaggggaaagcagaggtaattacgtttgagatactttatcaggattttgtaataatcagtgaaaaggatacaagtatatttggatcacatagcttatattttcattttgtatttagaagagacttcctccttgtagtcttatagtgttttatatcagcatttctttcctgctgtaaaactctcaatgaattgatactacattttcattccattcatagctagcctagctttcttttaaaagtatcttatttctgagagcatcagtatgtcattaatgttactctctttgcctagtaaccttctctgggaacatcagaagatacatgcaaaataggtatgcgtaggtaaaatgtttcattaaccccaggtgttggtattacagatgtgagccaccacttttatcatgaaagggcgttacattttatcaaagccttttcctgcatgtattgatatgattatgtgattttaattctttattttgttaatgtatattaattgattttgtatgtcaaaccatctttccatcccaaggataattcctgcttggttatgttgtatgatccttttaatgtgcagttggattcagtttataagtattttgttgagaatttttgcatttttgttcatcagggatattggctcacagttttctttccttgtggtacctttgtctggttttagtatcagggtaataatgctggcttcataaaatgagtttggaagtgtctccctcttcaattttttagaaaggtttgagaaggattgatattaattcttctttaaatgtttggcagaattcaccactgccgctttttctctgttaggaggtgtgattactgattcagtgtccatactagttctaggtcttttcagatttcctgtttcttcataatttggtcttggtaggttgtatgtttctaggaatttgtccatttcttctagattaactgaagcgtaatataattaagtgttggtgtataattgttcatagtagtctcttatgatccttttatttctgtggcatcagttgtaatgtctcctctttcatttctgattttgagtcttctctctctttcatagtcttgcaaagagtttgtcaattttatattttgaaaaaacttaattttgttaattttttctgttctttttctgttttctatttcatttatttttgctctaatgtttgttatttattttaatcctttgttctgcttactttgagctcagtttgttattaaatttctagctccttgagatgtaaagccaggttgttatttgagatctttcttctcttttaaagtaggtgtttatcacaagaaacttccttcttagtactgcttttttgtatccctcaagttttggtatgctatgtttttgtttttgtttgtcctgaggtattttctaatttcctttttgatttcttctttgacccaatgattatttgagtgtattgtttaattttcacatatgtgcatatttgtgaattttccagttttccttctgctattgattcctggttttattccattgtggtcaggaaagatacttggtatgatttcagtcttcttaaatttgttaagacttgttttgtgacctaacttgtgacctatcctgtagaaagttctgtgtgtgcttgggaagatcgtgtattccgctgctgttgagtagaatgttctgtatatttctgttagttgttataacagaaatatacagaattataaagttgtttaagactcctatttccttactgatcttctttctgaaagttccatccattactgaatgtgagttaagtctcctactgttactatattgctgtctatctctcccttcagttgtcaatgtttgctttacatatttagttgtttataattgttatatctttctatatgttgatccttttatcattatataatgttctttgtctcttttgacagttttttaattaaagtctattttgtctcttattatgctctttgtttcagtgaatggtgccagcattcatccaagtgttcaatccatatttggtcagtctttatattctgttgatgatcactccttatcatttttaagcctcatccccactctaattagattattactttatttagggctcttatttctattctttcttttttttttttttttttttttgagatggaacctcgccctgttgcccaggctggagtgtaatggtgtgaacttggctcactgcaaccttcatttcctgggttcaagcgattctcctgcctcagcctcccgagtagctgggattacaggcatgtgccaccatgcctgactaattttttgtatctttagtagagacagggtttcaccatgttggccaagctggtctcgaactcctgaccttgtgatccacccgccgtggcctcccaaagtgctgggattacaggtgtgagccgctgcgtagggctcttatttcttatctgggttatttgaatatacttctaactagtcctcctattgtcagtcttgaacccaattgatctttatgtataccttactgcctctagtcatctttctaaactcatccctcaaattcccttaatatgttcccagtggccttagtatagcaaaattccactagtatggtataacagaatagttgttttatttaatagtaacgtgtctacatgaaataaagtaaattctattttcttcaatatggaattgctacattattaaataataagtgactagtgtgttttatgcttccaataaagaaagtattagagtgtggtatatgattgctcttggctcctaaatttattccacgccatatataaatttttgttttagactcgagaacaggaagaactggaagaagctttagaagtggaacgacaggaaaatgaacaaagaagattatttatacaaaaagaagaacaactgcagcagattctaaaaaggaagaataagcaggcttttttagatgagctggtatgtattaatgctaattgtgattgtaaaaaacattcttcaggatttacctttcctagtaggctggatgatggcatttaaagggcttttccacagtgtttgtaatctggttcacctttagttttgttggttatgtattgatatcagtgtatttattgctgaataagaggttgccctccatccacactgaacaatatgtttttatgctcacaattctgtgggttaggaatttaagtggttcttttgggcttttctgcttccctaatgtattctcaggacacctctccatgtggttttgatagcgacaggaggcagccaaatgcctaggcagatagggacgggtacccagagaaaccccatctccatgttgaagacagtttaaaacctgaaagccaagctacaagttaaatccttggaccagattgagaacttgtcctcctgtttggtgtgctttcctctgattgatccccactcttcacctattttatgtatatctaccctttcctaattggttttctacactgtcatgcccatctttgagtagtgtcttcacttcaaccttttttgcttactcataagctaattcagcacattctcctcatcctgtgcctataaagaccccagactcagtaagtagaggaagagacaacctgacttcggggaagacgacttgctcttcctgtcccctctccagctcccctctctgctaagagctgttttcatcgctcaataaaattatcaccttcgccatcttttaaccatccctgtgacctcattcttcttggatgccagacaagagcttgggacccaccaagtgtgggtacccagaaaggctgtcacactggcactttgcccttcctggtggagagcagctgccctaggtgacaaggccagaagccaactgagctgccaacacactgttgtctgatggcagaactaaaggagcactgtaacacttcccctggggctttggggttgtgggccccctcacctgggcactgccatgttccccttgaggcaacatgcctggtctggctgtgggccccacgtagagtttgcttctgtgtccgtgcctggggcggatggctgggtcctgcacttgcttgcttgtgtctggtctgactgcgggccccatgcaaaacttgttcctgtattggtgcttggagcagctggctagatctgcgctgactcacccacgtgctccctcccacatagagttgagtgcagtgggtctagtagaggggagtccttaccgtgaatctagtgaaggggctgactacatcagaaactgcatcaatttctgtaacagtgtgattgtacttctcacatgttggctcagggttacaagagagaatatcccaagaataaggaggtagaagatgctaacattttagggcttgggctaggaaactggcacagcactgattccaccatattagtaaaagagcccactcagttacaaagggaatggatatagatctcacctcctaatgggagtgtgatggccatctttagtccacacagtatgtactggggaaaactatgtttttctagaatttggcataatataaattcatttgggatactcagtctctatcccaatgtgagtttagtgataagaattatgaaaatgactttcattttcatattgtagtttgtcttacccttatgcctatttatttatatcatgccaactactatgaaggatttaaagtgatttcctagataagagtattgtttgtggacatggcactacttactttgtgtaactctaagaacgatgttaaaatgaggttctagtatattttacttctatatttttaaaaagatttttgtttaatatccattttattttcagatgagagagtgacattataactgagatgagccagtatattcttgatagattgtttatatggctttaagctaactgactaaaatacattgtttctgaagcacttttctcctgattaatactatttttctaataatgagctcattttggctccatgctgaagtttatattgactgtttactttgtgacaatatattttatatttttgcataaaaaaatagtgtatttttgcttgaaagaaatagcggggtttttgcaaattattgttttccagcaattagcttcctaggtagtcaaccttgttagataatgacagtaataataactaaggtttatgaagtgtttcatggatttattactatattatttgatacttataaccctgtatgatattgatgacttcacaaaccggaaaatcttcctctccaggaaagtctttttgcattcttctctttccctttatgttcatataatttatttccctgaggcttttgtgtttgtgtgtgtgtgtgtgtatgcagtgttaatacacttaactttcttgtctagttgataatgctattatcctatgattggggaaaatatgtatatatgtgttcttctactgtgcttttgccaaaaaagcatttaagtcagttaaccaggagtaaaaaaagagaaagcaagattacttaaattataaggaggtgagaaactaaaggaaaaataagggtaagggcattcatgaggcttagatagaaaacactgtcataaaactctattttctatgactggaatgtgaatttggctctaaaaatgaggacaccagcatattaaatagaataatgacgccttccctagcaactttcattagttctttcttgaaactattaagtggcaggtatggctttaacagtgaaatgacatgttgtattttatatttttgtagctgtttggtgagaaattaaaaactttaaaaatgaattagtaaattgatgttactaattattagtatatagttactaattataattgttttattgaaagattcttccccttatcattttatacaaagagttacaggctcttttttggataatgcttctcttctatataattaattgaattaatcccaaatatagaactttgatagaaaatatgcttttaacattttatgttccatctaataaaaaaagtttttagattttattttgaggttagccagctttgcataacaattattcttgcatattctttttccctttttttttttgagatggagtcttgctctgtgccccagctggagtgcagtggcgtgatcttggctcactgcaacctctgcctccctggttcaagcaattctttgccttagcctcccgagtagctaggattacaggtgcctgccaccatgcccagctaatttttttgtatttttggtagagatggggtttcaccatcttggccaggctggtcatgaactactgaccttgtgatccacccgccttggcctcccaaagtgctggggttactggtgtgagccaccgcgcccagccgcatattcttttagtctttaaagtactgttttgctgcctcattgagctgctattgacatgaagctcccctttgattcagtgaggcatgaagcaagatgtgaaactaccattgttgtacattgtgtgtaatctggagttaatattgatttttgtgagttctttctcccacttcctgttttcttcacctgcaagtcattactgcacatactttcctcagtgtttagatcatataacatgatgattaaataattcttagtaatttactgtattcattagtgcaattaattacaacagattggtttagaataccactgcagtttgaatttctggttttcatttttaaacttatttttagattttgttatgtttatttttcagtctttatacaatgttataaatgttaaaatactttaaatttttatgactaatgaattcattaaatttatttttatcctcttgaatccttattaactaagtaaaagaacgtatttctttttctgtatatgttcatgtgtgagattttgtttaaaaaacaatagcatttgtaaatatgtctagaagcttaattcttataattaatctctggacctaatttacacaagtactacttattagaatttttttcctcctgtttttggttctggtctttgtgccaaaagtcactttttaaccttttaaaaagtatttgcattatattatactgtatgtgacgggattttaatgttatggtcttaatgtttatggcttagtatttgcagtaatgttggctaaaaggtccatttatttaatcctaactgtaaattcaattttaaaaaagtttggaaaaagatttttaaacaggtcctggcttattaaatctttttatattcctgtttgaaaattcgcttcagtttatgtcttaaattttgtatgggctaatattgttgtcaaacgcagtaggtgatttttattagaaatattgtttgccagatggcttgcttaaagtcagttaaaataatcttttaaaaatggtcattataaagcttttaatgagtattacaggcagttcttactaaaatttctttaaatattaaacagtgtgccttcaggcaattaatacaggttagggaaccttttaaggtaaaatgtaatgcaaagaatgaaataacttgaaaggctaaatctgcatgttagatattccccagagcatgcatgtttcacatagtttattttactccattaatattttttgttgttggaactcctacttaattctagtttaacacttagtaaggcttccaggcttcaaaatttgagtgctaaaatagaataaagtaggttggaactaaattctgtgcttcaatatcaaaagtgttttagatccttagaatgtttgtttttattagatttcagctgtttaccaagacactttaacattcagttccttttatgtgaatgtgaaaccaggattaaaacaagctaaagtcttgactagcaactttttttttgaagttaatacgttgcttttatgtaagaatttttgctttttaaaggaaataccagttaaagaagagcacttgaattgatttagagtataaattgaaaagcaatacttttaactttttagctaaggaaatttatttttcttttgttagtttctacatgtgaaaagatagaatagcttttaaaagatatttttttgatcacagcccattaaaaatgttctttaattttatattttattataaaattcttaatgtaaatctagaatagctgcaaggaatcttagcaatacagttactcatgcattactaatgctttggtgtagaatataaaaggtattctagtatattctcctcgtactatatttcatcacttttccttcattattgttaaagccaggtcttaatgattttgctccttaataagtttacatcttataaataaataaaatttgtgttcttccatttactattaaaagttttaaactttgtaacattgctcttgcaaaacacttctattataaaatcttgatgtgcaactttattctaggacaattctattgaattaagttgcttatttgagttatttctatactgtaaccttaaaccaattcctttaagtctgttaattaaccacatttgtgcctaaaaaattattaagttgctagatttggaaagaaaattaaaatctgtatgtttgctttgtgctgtgaaatgttaacaatagagtttcttcaggatcaaattctgtgtagtcactattttaacatctatagcctctttgaacaatatgttttagcacattatcctggtataggagataaaaatgtatttgaccttcatctctgtttatgatacagaaaattctcaatctctctctctgcttgtgtgtttgtgtgtgtgtgtttgtttgtgtgtgtaggaaagagagagagagatctcttcttcctcctggtacgtccttctgcatatgtttttggattcttatttaactgaaaactcagaaaggaaaatgtctggatatcatttagtttagaccttaactccacagcactttaaagatgtaagaggacttcttgttaaacagaataaataacagtctacatataaaaattagtaatttgcttatggtattaaaatgtgtctgagtgcttataattaatatattaaaatgtttaactgtcattttgttacttaagttagaaaacatagacttaaattttaaaagtaagttagtaaaggagaaaataaatatacttttggttgtacttacaatagtttcattgtgcaaaatagaacaaggatcatttccaaacggtctcaggtgaaatctaatgggaaacaatttcaaactggtctaaatttactggtaaaaagaatgcgtcttagataaacatctgatctaagttatagtactttgtactactctttttgtgattagcttatttttttcgttttaataaatgtggttggtttgctagttgaaataggaacttttaatgtggattttataaaaatacttgtttgcaggttattttgatttatgaatctacaacagccttttcttattatggaatgttaatattttttgtaaagtgtcctccataatgtgaatatttagtttgacatgaaatgcttatggaaaagacataatttaaaataaaagtcttgttgtttttagttttccctttttacatttcttattgaacttgaactattcttacaggagagttctgatctccctgttgctctgcttttggctcagcataaagatagatctacccaattagaaatgcaacttgagaaacccaaacctgtaaaaccagtgacgttttccacaggcatcaaaatggtaagccttattttaattgcttgtttgaaagatattttttcaaggattatgctttataattttacacgatttctatagtaaaccgaaatgttcagatgtttaagaacagtgtctgatctagttttaggtgtctggaaatatggatgggtgcagtatgaggaaagtgaaacaaataattttcagagtatacaacacaatttttttgtatgtgaattgggtttgtatgactttcttactctacttacatttttaagcttgtagtgtagaaaaaaatttataaatattgtttggagagtagttaccatctgcagatatgaaatgggaaagcaaatgtatcaattagtgttttcttctaaacagtcttcttcacatatatatttttaaaaactctgaaagccatttttagtttctagactgatgaatagattaatttgggtttcaaaaaatttattttatattgtattgttatattttattgtttattttagcattcaagggaaagattttataagccaatgatgtttttgtatacttttacaggtttttttttttgtttagaaaatatatactttggcatattaactttaacatgtgtttaatatttagatgtttgagatgtagccactctaaatatgtagcattcaaattcctaattatcttttaaaatagtctcattagagtagtataaaatgtggttagaaaagataaatgtttgaggtgatggatatctcaattaccctgttttggttattacatattgtatgcatacaggtatcaaaagtaccacaaaatatatgcaactactctgtatcaattaaaaactggttttaaaaaagttgtggcagcactacaaagtcatggttacggatttggactttgaatccaaacagacctgagttcaactctcaacaacccatttatccagctgcttgacatgaacaaattactttgcctttccaataagcctttttttcccatctgtggaacggtgatgataatactgatctcataaacgtgttgggaaataatgtgaacaaagtacacagtatagtacttggcttattgtaagctctcaataattgaggttagtttttattgataataacgagttgataacacaaatggctatactaattccctaaatctttacctagtttttatatacataaaattcatttttatacatagttttaaaattcaagatgatggaggttgcagaatctttgtttggcttttatcattatatgcctgcatttcaaagtcagtgttaatgacatgcaatattgaagtggtgggagtttactggtaaaagaccagtaaactcagtaattttcaagaataaagtctagtattcagatgacacaatgtagctacaagcctcaggaatgtatcccctattgtaaattgagcatgatgagtatgcaagaacgaatgcctcaaaacattatcaaagtatattttaaattagagataatactctaattttaagaggcaaaggaccgtttctttcctttgacctcaatggataaagtcatatttaattttactgttgcttccactttagcaaatgtgtagcagctgctcctattttctagttctcttccttttatagtatatataatattaaaataagatctggcttacagtctaagtagaagatacaagaactcatcttaagtcttttgcaactttttttttttttttcagttgctgactatagaatttgaaaatctagatacttcggtattaagttggctctacttttaaaatttatcttgaatttacccacttctctccacctcttatcatcctaggataattgccatcatttctttagtggactatcacagtaacattccacctggtgtctctattcatctgtgtaccccataatctagtctataagcctttgggtggtttcctaaataaatgaatgatggtaaataaacaatattaaacaaatcagctcatcacctccttgcttactatcttcctatgtcttcccagtacacttagaataaaattcagaatattatctactttctcacctctgagaaagtgacatttgtactaagaagtcaatggtaaaatggagttagccatgcaaaaatacaggcagagaaaagagcagtaaagaaggcctaaggtaagaaacagcattttctagaaacagacaaaagatactgttaagagaatactttccctactctgccttgctccttatgctcaattcacactgaccgtttgactattctatctaaagtatctttctcctgcccccatccacattatgttatgctttttaaaattttaatatagagacagggtctcactatgttgcccaggctggcctcaaactcctgagctcaagtgatcctcctgccttggcctccaaaagtgttaggattacaggcatgggctaccacgcctggcccatgttatgctttttaaccctttataacatatatcactatcagaaagtgtcttatgggtacactgtttaatgtttatctttaccactggaatataaattctgtgtacctagaatgatgtttgtctctagtacctatttaatgaatgttcactgtggaccttcattaaatatttttaaatgaatgactgaatcttacatattaggctcacatttaatagaatgaagatcctgaagtactttcaagtttctgtgactttatggtgtttactctgtttggaatatacttaactgcttatgaaaactttacttataatttatgcatcgatcaagtgtgattttcatgaaccctcttttgtgtggaatttaattgcatattctgatgcttcccctaacattttatatgtacttttattatatattgtagctcctgccttgtattgcaattggctattttccatgccggtctcattttagatgagcttccttaaggacacaatgtgttctgtggcataactttatgtgttcttgtggggactaaatattgtactatgtaattattcaaaaaatttttttgaataaattattctcatttttcttaacttcagagcattttgctttgccattgggagattcacatttgggtcaagaagaatttgatgcaatgtacagccaaaataaaaaaattgtttttatagatatatctaaatttccatcactctatcatatttttacattccattaccaatgagaattacaaattatgtatttctcttcttctgtgttcttatcttttaatttttacctgtggtatgttttgaaatttatataacctggctagccctcttagatagtcttagtgcttttctttggcctaaagagaggcagcatcagatctacaaccttttttcacctagacagaatagttgctggtggtctttctgtgtttcgtaatgttctatttatttaaaaatgaaatgaattggaatggcgagatgtaaaagtttttgaagatcactgattaataaatctgctaacctgaacatgatatgaacaaaatactctgcaatgtatttccttgaggagattaggaaatatatccattgtggcaaagttgcttcagcagcatactttttaaattatttatttattttaaatttatttttagagacaggatcttgttctgttacttcaagctggagtgcagtggtgagatcctagctcactgtagcctacttctgggctcaagccatcctcctattgcagcctcccaagtaactgggtttacaggctcacaccaccactctgggctagtttttaagaatttttttttttttttttggagaggaggcagggtatagttatgttggccaggctggtcttgaattcctggtctcaagcaatcttggaacgcctcagccttcgaaagtgctaggattacaggtgtgagccagtgtgctcaggcgggagcctactttattttttattttgtttttgagatggagtcttggtctgtcgaccaggctggagtgcagtgacacaatctggactccctgcaacctctgtcccctgggctcaagcgattctcccacctcatcctccccagtagctgggactacaggtgtgtgccaccacacccggctattttttgtaattttggtagcaatggggtttcaccatgttgcccaggccggtctggaactcctgagctcaagccacctgcctgccttggcctcccagagtgttgggattacactgtgcccggctgaggagcacacttttaatgatgaaagaagtttcaatctcagctcatcttggagcaaatttaataaacctccctctactctgccttttaaagtattggatgaagaggtgggtcttacaccctggctttaaggtcaacaaccttgaagactgacaaagggatcaaattctaaaactgaaaactcactacttggagtactctccctttagctatccctgaattctgtgagagcttgttagcagcagtgctctctgtttatctgattacttttgagtggggattggggagggggaatgtgttgcacagattttctttttgcctgaaggggtatcttaccctgagtttgtttgtaataatgtttaacattctgctgcaaggcatatagatttggagaggaaaaaaaatttctatctttacattgcctttatgttcttctgaatgtctttctctgagtggtatttaagacttctattacctttaattttctttcttgcatcattaccttttatatctaagaaatcactgtacttgtgggctgggcatggtggctcacgcctataatcccagcactttgggaggctgaggtgggcggatcacctgaggtcaggagtttgagaccagcctgggcaacatggcaaaaccccatctctactaaaaatacaaacattagccaggcttggtggcaggcgcttgtaatcccagctacttgggagactgaggcaggagaattgcttgaactagggcggcagaggttgcagtgagctgagattgtgccactgcaccctagcctgggcaacaaagtgacactccatttcaaacaaaaacataaacaaggctgggcgcggtggctcatgcctgtaatcccagcactttgggagggtgaggcgggtggatcacgagatcaggagttgaagaccagtgtggccaagatggtgaaaccctatctgtactaaaaatacaaaaattagctgggcacggtggcaggaacctgtaattccagctatttgggaggctgaggcagaagaatcgcttgaaccagggcggcagaggttgcagtaagctgagctcaagccacagcactccagcctgggcgacagagtgagactccatctcaaaaaaaaaataataaatcaccattcttatgagattgtgataaatataaaaatgccaagctttgatttgtaatatatgaatatttttcttttccttttatgtatctattcatttttctccccaactgcccatccagctactttctttgaattttaaaattgcctaccttgtttgtcatatgtgtactagctattaggttataaacatcttgagggcagaggcttcatattttaacatagttttatatgattgtggctatgtaggtacttaaataatatcagatattcatgatcagtttcaaactttcaaatgttggaagtattaacacatcttgaaataatgtaaagacaaatactactcaataaggaactaccaaagtatttgaattaggaggcaataaagtatagaagaaagaaaatgggcataacaggattaaatcccagatttaccgttattagatatgtttccatgggtaagatattgctttactcttctgagtttgttttctcatttgggaagatgagaaatgttaacttcatatgattgtttagaatattgaaatctatacataaaatgctaaagctggtgcccaatgtatgctagccatgtggtaaatagtaataattagcaaccataatgttaccattaatgtttgttatttttcgtagttagatatataaatgaattattttataatgcccttgaaccaaatgctgaatattgttataagtattctgtcacatacttaagttatattactctcaatgtgtgttaaaatattggatcacttacccccaccccattggatcaattccagatggataatagaaaagtaaaacaataaaaacatccttaagagagtgggaaaaaaacaagccacaaagtgacaaaagttatttacaacatatgtaactaataaaaggcttagatccagaaggtataaataactcatatatgtgatctagagtctggaacaggcatttctaaaaataggatagccaatcctcagcctcattagtgactggtgaaagaatatgtagattaaaatcacaacacagcactaaatacccactagaatggctaaactggaaataaaaatcacagttggttcaagggaaaggtaaaatttagaatggcatagtatttacatgaattcattagtgtcaattttttactgaatgtggagactgacacagaatacagatgaaagtctaaatgtttatgaagttaagtatttttatagtctttagaaaaatcaatcctgaatgaaggatgaaaagtaacattaagcaactatatcccaggggttgattttgttgaacgcctgctataagccagcatagtctggctgctggatatgcaagaatacagacattacttaagaatttgtgacctatgatagttcttttttataataagtattactttctgtttttatatcttcataaaatagatggtattcctatttttacaaatgtgaaaactgagtctttgagaggttaggtcacatttaaaagatgatgctgaaactcattctctttctattacatctcatttaattaatgaaaatattaataaacttacacattctgattcaggtgtcctctgagagctaagatttgaactcttgtttctaatagtgggctgattgtatgacctaggtaatttaaggggcaggagtcagcataataactttcttttcctgatctgctctacttaaaaaaagtcaaaacacaaaatgaagtcggatgtgctcaacttggagaggaaccaaggaaggatgtataaatatgattaaggtttctggaaatagatcctttgagatgtgacagaaaagactgaatttatttgtttaataaacctagagaaagttgaagggttcaaaatgggcataaaataatgactaagaaatgaggattttattattatatattcacataggtagggttcagtcagtcagtgaacatattttgattaggaatattatgaaggttgtgccggatttattatttgaagtatattttctaggaattaaactgtcagggagtggagtaatgttaggcatagggtcttagagaaattaatgtaatttgtgacttcagaatttaagaaggttctacttatcactattttatgcatgaataggagaaatttttttttttttttttttttttttttgagatggagtctcactctgtcccccaggctggagtgcagtgatgtgatcttggctcactgccacctctgcctcctgggttcaagtgattcttctgcctcagcctcctgcttagctggaactacaggtgcatgccaccatgcccggctaatttttttttgtattttcagtagagacggggtttcaccatactgaccaggctggtcttgaattcctgacctcatgatccacctgcctcggcctcccaaagtgctgggattataggcatgagccaccgcacccggacagaaacttcattttatagattattgtgccctctgtgtggtgatagcttttgaactcttaaagtgagagctacaactttgtttcttggccaggtgttagttattttgatctatttggttcaaatcctgtcaatataattatgcagccttctatttctttatcattttacaaatacttctaattatttttacttagcttatggttatggttactattcttcattacatcattcttagttgaaccagtgaacagacctcaaagttttttttttccctgattcattactagataatttgtgtcaataaatatccatgcaagtaaatcttagtcttttgggaacaagcgaaggcacattggtcatctcataaattaggattgagattctacggctgaggatctggtgcttcttcattctattttgcttgtttgcaaactgaaaataaaatgagtcacaaagataacctatggatgtcaaaagataattgtttttatgtcaaaagataattgttttatggatcacaaagataacctatggatgtcaaaagataaaagtacttaaaaacaaaagaattgtttttaagtacttttgatagtctgtggttggtttggggagtagtatggagaaacataccatgcattaacaaaggggaaaactttttaagtattttaaccctgatgtttgaagagtttaaaaaaatattatctatgggtgagccagaagggagcagagtactcatttgtgatataaattgccttttctgagtgcaacagatagtatttagctgttcgctttcaagcattgcatattcctctgaactcattggaagatctaaccttgataaaatatgtgagttatagaaaattaatacccgttcgtatctgaaaaagaaaataaaaattacattgagcagtcagttatgtcctgtaaagccataagtttgtgccaaacagcttaggtgctttaccattttgccaaagaacaaaaaacaaaacttgaccaggtgttattaatttattctatttttaatatataatttgcacttaggtagtaaatcaagtataacaactaaagaagtcatgtgccctttctcaagtcttgtgatatgcacatagcattaatttgaatctataaaggtattttgaaatgtaaatcaaattaataatagtcttatcagatcttattatggcatataattaactaggtgagtatcaggtgattactttctcttagcttttaaatgtctccagttatgttatttcactaaagttagcagtatattctaattttcacatggatatccctgaagagttacatgtaagtaaatagaaatttggttaattccattctattttaaagaaaatggaggttcttaaaacttaagataatccttggtgagtattttaatgtgacctaaataaaatttttatgaaatgaatagcttcatgattaaaactgtaaatttgaattttgttatttcagaattgtttaaaacaggtcgtccttattatattattagaagtttgaattgtggcttctctactatatatactaattgtttggtcttgggcaaatcactttacctctttaagccttaattactcaactcttaaaaaagagattatgcctacattatagagttcctgagtattttgtgaagtaattttataaaactctcaggatgcctggctcgttgtaaagatactaagtataaataggtatagatacaaataaaaactataatagcccagtaaattgtgattgaaggtagagtttgtgacttataactgttaattttgtaccgtgtagtttttactagttattttatctatagactcctatatagtaggaaaaaaacaactcattttcccctgctgcacatatccagcacagaacacttttggtcaccaaaatgtgttttttttttttggttgttatttcgttttcttttctgtaccacaccaaccatttctgcagcagacaccaataggatttcctacagtttaacccaattctgacactaaccggaattagtgcaaaccccactgggtaagatcccagtaccacacaactgctcccaacttcagacatcaatcgaaagctccaggtggtaacctgtactgttgactaactggctataaattgaaggttcccacgatcccttcctgtggttcaattatttgctggagtggctcatggaactttgggaaacacttatgtctactgatttattataaagaatattacaaagaatacagatggacagctagatggaaaagatgcatagggcaaggtatgtgggaagggacgtgcatcttccatgccctctcggggtgggctaccatcctagcacctccatgtgttcagcaacctggaggctccatgaatcctgtccttttgggtttttatgggggcttctttcctatagccaagattgataaatgactggccactggtgattaactcaacctcctgcccctcacctctttccagaggttggtggaactgaaagttcccaacacactaattacaaagttggttccctttgcaataagcccctgttctgaggctatccaggaccacccagccatcttattagcatacaaaaagacaccattttggagactacaaacgttttaggagatgagtaccaggaaatgggatgaaaaccatttgtatttcttatcataaatcacaatattacaagccccaaatgcctagtaactctttcttatatattcctatatttctaggtaacaattcaattgttctatggatatttaaatgaaaacactgaaatatttagtgtcaatagttgggaaaattcacaaataatgaattatactctatgagttttatgtaatattctttcctttaccacggtaaaggaaaaattgttaatagtcaaactgttggcttcagaatttatggcagtggttgaatttattccagaaaatttgtctcatgatctgtctagacatgagcataggcagaaataatgagtctggattttcagttatatcagttactttgtaatgaggacaaggtaaaatcagtattctatgagtggtgggaagctttgattcctttagtcccactgagggtaacattaaaggtgcttgcaaatgcagaaatattcttagcctaggatgtagaaataatggttttctgcttaatttatgaaacaaacattttcctacaaagtattctacatactgtatactgcattgcttaatgtaatgaggcagatttcagctttatagataattatattgagtgccaatctgcctatcagtagagttttatcaagttcctataacatttgcaaagcagtggttgctgttggtgttgcggatatagtaattttacaagaattagaattagggaaaaagaaggaagatgtgtttcaatcagtctctgaacattaactcacttaatcgtgaaaactatcctgtagggttgatagtggtattctcatttatgaggagtggagtatggaagacttaaattaaacctagagaaaagtagagtttcagaaaaatggaaaggacgaaggaatttcacatttaaaaatgagtatgtggaagaattgttagcaaaagaatggagggtatgaatttagccaagtttattccatagttttcagtcaggaattttcttctgatgaacttgcacactaatttcaaaacacacattcattctttggttcctagaaggttatatgaaattcagatacatagattcactttgatgtgttagagctttttactagttagtgatctgttgaataagttaagggacactaaaatttagtatttgtaaatgttgaaataaattttctttttttggtgattgttttagagctatgattcagtattttcctgagaagtccggctgccacaaatgtttgggaatcttataaggctccatctgcaaatgctcatgaccagatatttcctgcgatgatttttaatgtaatattttaatttttcagctaagcagacttagttttcctttggaattttatcaatgcaccatcagtattgccttgagttaactgtggtttttgtgttactattatgtaggaaataatattaggtttttctttggttgatcattttgttatataattcctatacaatttttattgctatttattttggtcctcaccacttcttctgcctttttttttttttaaatcacagattgtttatgtatcagaatacaatttgccacaacttcaggggctgtggttaagtttgaaaaccaaggattacattcagttatttttgcatactctctaactttcttaaacatactcaactgaatggatacattcccattctgtcagtgccgtgcctcctgttaacatttttctacactagaagctcttcccatttttgctgagagagtgtctggcatcttctcccagcctccattcctaatgatggctagagctaagaatgtattgctgctttcttttgttccttttttttttttttcaatacttttaagttctgggatacatgtggaggtttgttcttgggatacatgtggaggtacatggagatacatatgggatacatgtggaggtaagttcttgggatacatgtggaggtttgttacataggtatacacgagccatggtggtttgctgtacccatcaacccatcatctacattaggtatttcttctaatgctatccctcccctagctccctgcccccagcaggccctggtgtgtgatgttcccctccctgtgtccatgtgttctcattgttcaactcccacttatgagtgagaacatgtggtgtttagttttctgttcctgtgttagtttgctgagaatgatggtttccagcttcatccacgtccttgcaaaggacatgacctcatccttttttatggctacatagtattccatggtgtatacgtgccacattttcttcatccagtctatcattgatgggcatttgggttggttccaagtctttgctattgtgaatagtgctgcaataaacatatgtgtgcatgtgtctttatagtagaatgatttataatactttgggtatatactcagtaatgggattgctgggtcaaatggtatttctgattctagatccttgaggaattgccacactgtcttccataatggttgaattaatttacactcccaccaacagtgtaaaagcattcctatttctccacaccctctctagcatctattgtttcctgactttttaatgatcgccattctaactggcatgagatggtatctcattgtggttttgatttgcatttctctaatgaccagtgatgatgagctttttttcatgtgtttgttggctgcataaatgtcttgttttgagaagtgtctgttcatatcctttgcccactttttgatgggattgtttgttttttttcttgtaaatttgtgtaagttccttgtggattccagatattagccctttgtcagatagatagattgcaaaaattttctcccattctgtaggttgcctattcactctgatgacagtttcttttgctgtgcagaagctctttagtttgattagatcccaatttgtcagttttggctgttgccattacttttggtgttttagtcatgaagtctttgcccatgcctatgtcctaaatgatattacctaggttttctttcagggtttttatggttttaggtcttacgtttaagtctttaatccttcttgagttaatttttgtataagttgtaaggaagggatccagtttcagttttctgcatatggctagccagttttcctggcaccatttattaagtagggaatcctttccctattgcttgtttttgtcaggtttgtcaaagatcagatggttgtagatgtgtggcgttatttttgaggcctcttttatgtttcattggtctatatatctgttttggtaccagtaccatgttgttttagttactgtagccttgtagtatagtttgaagtcaggtagcatgatggctccagctttgttctttttgcttaggattgtcttggctatacagacttttttttttggttccatatgaaatgtaagtagttttttctaattctttgaagaaagttaatggtaccttgatagggataggattgactgtgaatttctttgggaagtatggcctttttcatgacattgactcttcctatccatgagtatggaatttctttccatttgtttgtgtcctctcttatttccttgagcagtgatttgtagttctccttgaaaaggtccttcacatcccttgtaagttatattcctaggtattttattctatttgtagcaattgtgaatgggagttcactcatgatttggctctctgcttgtctattgttgttgtataggaatgcttgtgacttttgcacattgattttgtatcctgagactttgctgaagttgcttatcagcttaaggagtttttgggctgagatgatggggttttctaaatatacaatcgtgtcatctgcaaacagagacaatttgacttcctctcttcctctttgaatactctttatttctttctcttgcctgattgtcctggccagaactaccagtactatgttgaataggagtggtgagagagggcatccttgtcttatgccagttttcaaagggaattcttccagcttttgcccattccgtatgatattggctatgggtttgtcataaatagctcttgttattttgagatacattccgtcaatacctagtttattgaaagtttttagcatgaaggggtattgaattttgttgaaggccttttctgcatctattgagaaaatcatgtgttttttgtcattggttctgtttatgtgattgattatgttttttgatttgcatatgttgaaccaaccttgcatcccagggatgaagctgactggattgtggtggataagcttttggatgtgctggtggattcagtttgccagtattttattgagaatttttgcatcaatgttcattggggatattggcctgaaattttctttttttgttgtgtctctgccagattttggtgtcaggatactggcctcataaaatgggttagggaggagtgccttattttctattgtttggtatagtttcaggaggaatggtaccagctcccctttgtacctctggtagtattcagctgtgaatctgtatgttcctgggctttttttggttggtaggctattaattactgcctccatttcagaacttgttgttggtctattcagggaattgacttcttcctggtttagtcttgggaggatgtatgtgtccaggaatttatccatttcttgtagactttctagtttatcttcgtagaggtgttaatagtgttttctgatggtagtttgtatttctgtgggatcagtggtgacattctcttcatcattttttattgtgtctatttgattcttctctcttgtttattagtctggataatggtctatctttttcgttaatcttttcaaaaaaccagctcctgtattcattgatttttttgaagtgttttttgtgtctctatctcctttagttctgctctgatcttagttatttgctgtcttctgctagcttttgaatttctttggtctttcttctctagttcttttaattgtgatgttagtgtgtcgattttagatgtttcccacttcgtactgccataaatttcccttttaacattgctttagctgtgtcccagagattctagtacgttgtgtctttgttctcattggttcaaagaacttctttatttctgtattaatttcattatttacccagtagtcattcaggagcaggttgttcaatttccatgtagtttggcagttttgagtgagtttcttaatcctgagttctaatttgattgcactggtgtgtgagagaccatttgttatgatttttgttcttttgcatttgctgaggagtgtttaacttccaattatgcagtcagttttagaataagtgctatgtggcactgagaaggatgtagattctgttgacttgaggtggagagttctgtagatgtctgttaggtccactttctctagagctagttcaagtcctgtatatccttgttaattttttgtgtttttgatcagtctaaaattgacagtggggtgttaaagtctcccactattgggagggagtttgtgtgggagtctaagtctctttgtaggtctctaagaacttgctttatgaatctgggtgctcctatattgggtgcatatatatttaggatagttagctcttcttgttgcattgatccctttaccattatgtagtgcccttccttccttccttccttccttccttccttccttccttccttccttccttcctaccttgctcccgccctccctccctccctccctctctctctcattcattcgttcattcgttcaaagtcagttatatcagagtctaagatttcaagcctggcttttttttgctttccatttgcttggtaaatattcctctatccctttattttgagcctgtgtgtttctttgcacgtgagatggatctcctgaatacagcacactgatggttcttgactctttatccaatttgccagcctgtgtcttttaattggggcatttagcctgtttacatttacgattaacattgttatgtgtgaatttgatcctgtcatgatgctagctggttattttgcccgttagttgagcagtttcttcatagtgttgatggtctttacaatttgccttgtttttgcctgtaccagtgttttctttccatatttagtgcttccttcaggagctcttgtaaggcaggtttggtgatgacaaaatctctcagcatttgcttctctgtaaaggattttatttcctctttgcttatgaagcttagtttggctggatataacattctgggttgaaatttcttttctttaagaatgttgcatattggcccccactctcttctggcttgtagggtttctgcagagatccactgttagtctgatgggcttcaagggtaacctgacctttctttctggctgcccttagcatttttccttcatttcaaccttggtgaatctgatgattatgtgttttggggttgctcttttcgaggattatctttgtggtggtctctgtattttctgaatttgaatgttggcctgccttgctaggttggggaagttctcctgaataatatcctgaggagtgttttccagcttggttccgttctttccgtcactttcaggtacaccagtcaaacgtaggtttggtcttttcacatagtcccatatttcttggaggctttgttcattccttttcattatttttttctctaatctcgtcttcacactttgtttcattaaattgatcttctatctctgatatcctttcttccccttgatcgatttggttattgatacttttgtatgcctcacgaagttcttgtgctgtgtttttcagctccatcaggtcatttatgttcttctttaaactgcttattctggttagcaattcctctaaccttttttcaaggttcttagcttccttgcgttgggttatatcatgctcctttagctcagaggagtttgttattatccaccttgtgaagcctacttctgtcagttcatcaaactcattctctgtccagtttgttcccttgctggtgaggagttgtgatcctttggaggagaagaggtgttatgctttttggaattttcagcctttttgcactggtttttcttcatctttgtggatttgtctacctttggtctttgacgttggtgacctttggatggggtttttgtgtggacatcctttttgttgatgttgatgctattcttttctgtttgttaattttccttctaacagacaaacccctctgctgcaggtctgctggagtttgttggaggtccactccaggccctgtttgcctgggtatccccagcggaggctgcagaacagcaaagattgccggctcttccttcctttggaagcttcgtcccagaggggcactggctagatgccagacagagctctcctgtatgaggtgttgttaaacccctgttgggaggtgtctcccaatcaggaggcacggaggtcagggacccacttgaggaggcagtctgttccttagtagagcttgagtgttgtgccaggagatctgctgctctcttcagagctggcaggcaggaacgtttatgtctgctgaagctgcacccatagactccccttccccaaggtgctctgtcctagggagatgggagttttacctataagccccttactggggctgctgcctttctttcagagataccctgccaagagaggaggaatctagagaggcagtcaggctacagcagctttgtggcactgccaaacttccctgatgctttgtttacactgtgaggggaaaatcacctactcaagcctaagtaatgatggatgcccctacccccaccaagctcaagtgtcccagttcgacttcagactgttgtgctggcagtgagaatttcaagccagtgtttcttagcttgctgggctccgtgggggtgggatccgctgggctagaccacttggctccctggcttcagccccctttccaggggagtgaatggttctgtctctctgtcattccaggcaccactgggttatgaaaaaagaaactgcagctagctcagtgtctgcccaaatggctgcccagttttgtgcttgaaacccagggccctggtggctaggcacctgagggaatctcttggtctgtgggttgcaaagaccgtggggaaagcatagtatcttggctggagggcaccgttcctcacggtgcagtccctcatggcttcctttggctagggaagggagttccctgaccccatgcgcttcctgggtgaggcgatgccccatcctgctttggctcaccctccatgggctgcactcactgtctaaccaggcccagtgagatgaaccaggtacctcagttggaaatacagaaatcacccgccttctgcattgatcttgctgcaagctgcagacaggagctgttcctatttggccatcttgccctcttttgttacttttaatcagagcctctcctagatgctgccatggtagtttggagcctccactgagtccctactttgctgtctgtttccttttggtctcagagtggtctaggacttatgactcttaggatatttagctcagaggtgttaaatattcttaaaaggagcaagagcttttagctatactatttaagattctgtgggttaacaaagcattataagacggttcttaagattgagaatttttagtaataggcttctaatgaacacatgaaagacctgtagcctttgtaagttgggaaattcctataggaatctctagtaatgcttctcttttattcctgatattagtaatttatgacctctcacttttttttccctctgatcagcctggctagaggtttatcagttttcttgatctgttcagagaaccagtttccagtttttgctttcattgattttttttttcttttttttaggcagtatctcactttgtcacccaggctggaaggcagtgggggcgatcactgctcaatgcaggttctacttcctgggctcaagcagttaccctgcctcagcctcctgagttgctgggactacaggagggcaccaccacacctggcgaatttttttttgtttttaggagagacaggatctccttatgttgctcaggctagtctcgaactcctgagatcaagcaatcttcccacctggcaaagtgctgggattacaggcataagccactacactgagccctgatttttttttcctattagtctgttttccattccattgatatttggtttttattatttcttttcttctctttaattaagatttaatttgctttatttttctagtttctaaaggtggaagggatggcagcagcagtcactgcaaagacaccagctgcagtggggaaggtatggctggcgctgccctgtacatggagccagtgggagctgggaacaggtgggagtcccgccccattctgagatggtggggcaggagccctgtgctcctgctggcagctgcagctgcccacctgtggttgtggatctgggcatccctgcactctcgggggtctgggaagccccactgcccctccaggcttggaagcgcctgctcctgctgcctggccttttcctgctccctgagcctgttccagggtagagcaagttgggccaagcctgggtgtggtggcagcccagtggggtgtgcccatgcttggggcagcactgacctgccagccccctgtcacctcagccccctctggactttggggaatgaggagcatgagagggaggccgatgggtccctctgtgtgaccttgcaggtgcccctcccacaagcagagtgggtaccctggacaacatgattgattgtggcaggaggcagatgggcttctgggtggaaaggggtgagtccctgatgaaatcctacattcaagccaggaacagtctgaagcctggggcctggcctgtcagttctgagtggaatcagcagccccagagtgagaacttactgtgctctttatgagcctgcccgtggccacccatggaccaattagcatgcacttacttccttttgagcccataaaaatcccagacccagccagactcacacagacgttgggactaccagctgtggaaaggagctatccactctgctgagagctggacacttgtctagatgacctgcagagaggagctacccccttccagtctcctcagagctgttcttttgttcagtaaagctcctctctgccttgctcaccttccagttgtccacatacctcattcttcctagatgtgggataaaaactctggaccaggtgaatggcgggactgaaagagctgtaacacaaacaggactgaaatacgtccccctgctcaccatgtttgggggtgatgagaaggagagaagagctgcagctctgcaggaaacccagacctaggagctcccagagccagagctatgacaccctctttggggctctgtggtttctgttatctccaagctttccagtgtcaccatgttcctcttgtccagacgtgggtgcctgcagtggaagccacttgcggtgcatctgatccagcctcaggcttgcatggagaaagtgcctggagctgcccaccctgctgcagcagctggcatgcctggctgtgcgctcttgccagaccctgcactcactcatgcacccgtcactgctctgtgccagactcgcctttggcaggtgtgggatctgggctgatggcatgagccgtgcacagcgtatcaggccgagggggtggaatgagcccagcgggcccaagaaaacttgcacaaaaggtgccaccagccacagaggtttccagctggaaaagcggcatcctgcggatccctagaaagaaacttagattattgatttgaggtttttccaagttttaaattacagatattaaatgttatacattttcttttacgtgtttctttagttacatctgcaaaattttgacatcttgcaacagtttgagtcctctgagaagcagatgccaacatgggtttaaatgtgcaaaaaatctattagggaaaaatgcctgtgtgagaaaatgaaaagggagctgtaggagactaagagagtcatcagactctgatgtaggtttgaccccaagttaagaaagaacgagggtgggtaaaagcatctcatactacagtgtatttctaaggaaagtggtaagttgactggggagttcttgtgccagagttttctgtcagagaagtctcatatcacccaaccagggaactacattagtattcctgccttactcagtcattggctggaagcagcccatgggaatcatggccttggtgtaaatgcagagatggattgcagagtgcagcagctggggcccttgatcccagtccttatactccatcatagttgttattgagttctagttactatagtcaaagaacatatgttaaaggatttcaaaaatcttttattaagattttttttttgagtcagagtttcattcttgttgcccaggctggagtgcaaatggcatgatctctgctcaccacaacctctgcctcctgggttcaagcgattctcctgcctcagcctcacgagtagctgggattacaggcatgtgccaccatacccggctaattctttgtatttttagtagagacgggatttcactgtattagccaggatggttttgatttcctgacctcaggtgatccgcccacctcagtctcccaaggtgctgggattacaggcatgagccaccgcacttggcccagatttttaaaaattgctcagagtgtggtctgtcttggtgaatattgttttgtgaacttgaagataatttctatttggctcttaggcagaatgttttgtaaatgtcagttaggtcaagttacttgatgttaaaatttcctgttttcttactgattctctctctctctctttctctctctccctctctccctttccatttccttttccctttccctccctttgtatctcccctttctgtcctccctctctcacacctttctctctcactctctgtctctcctttgtctattatttttctagtctatattttatgtgtgtactttaggtggctgctattattaagccttcaatttcagtgatcttctgtagtgtctaagctgttatttatcttatttgttatgtttttcattttaaaattgtgtgtgtttttaacacatacaacacataaagttgtgtgtgtttttaacacatacaacacataaagttgtgtgtgtttttaatctttagatgttctgtttgggtcttttttgcacctttgatttctctcatcattcatatttcttctctaccttcatgaacatgtggaatatatttatgctagctgtattaatatccttgtcctgctaatttcacatttctgtcctttctgagtctgcttctattgactgatttttttttcctgaagtgcgttacatatttctgtctttttggaatacctggtaatttttggtattccattaaatattataagactttggggatgcagttaagttagctataatctattatatccttgcaaatcttgcttttaagcattgttagcatgtacaagaacagattttaatgttaggctaatttagctccactttcatggtgatactattctgaagaccctatctgatgccatatgtatttattgagaggtctttttaccttgtttattgggaatatatgaactgtttctgtatgagctttgagaattgtttaatacgttgctttccaggttcatttcttggtgttcagtaatttccactcatgtgcagctcaaaacccagacaaaagttgaggacatcactgtgaaattctctagagcagaggtggacaaacggcagctaactgactaaatcccacctgctacttgttactgtaattaaagttttattgtaacatagccattctcattcatttacatatatttttctgcttttacattataatagcatcattggatagttatgatgcagatcatatggcctgcaaagcctaaaatacttatctgctccttacagaaaatatttgttaactcccactttagagttttttctctgtgtggcattttcctctctggtaatctgccctgcaaattatagctgccctgggatccctgaagtctgattttcgtctccttgattcctaggctctgtttgggttacttctctatgtattatagcctggaaatggcccccatgcaggaagccagggcaatcaaagggttcatttcatttgtttttcttcccttggggctcacagttctgtactggctgttactcaatttctggaaaccattgattcttattttgttcagttttctagttgcttaagtggggaatggtcaatctggtcttgttattgtataatggtcatatgcaggagaagcagcagaatattttgagacttgtttttgttgttttgtatatcaagaattagttgctttatattgctatgtaatattccatttgtttgaatataaatgctcctcaatttatttgatggggcatgtctagataaacccatcataagttgaaaataccataagtcaaaaattcatttaatatacctaacctgctgaacatcataatttagtataggcttccttaatacaagtactcagaacacttacattagcccagcatcatgagagagcatcctattgcatgttgctagcccaggaaaagatcaaaattcgaattacagtttctactgaatgcctgttgattttgcgtcatcatgaagtcaaaaacttgtaagtcaaaccgtcataagtcagggaatgtgtgtatatctgtttagcaattctcttgttggggaatacctgagctgtttatagtttttgactattactagtaaagcagctggctgggcacagtggctcatgcctgtaatcctagcactttcagtcatatttaatgttgtcaatctttttaattttagttattttggtgatgattgatagtatctcattgtaatttagatttttatttcctggagaactaatggttttcagcattttttattcattcgtttgccttttttcttttcttttgggatggagtctcgctctgtcgcccaggctggagtacagtggcgcgacctcagctcactgcaagctccgcctcccgggttcacgctattctcctgcctcagcctcccaagctgctgggattacaggcacccaccaccatgcccggctaatttttggtatttttagtagagacggggtttcaccgtgttggccaggctggtctcaatctcctgacctcgtgatccgcctgtctcggcctcccaaagtgctgggattacaggcatgagccactgcgtccggcctcgtttgccttttttatatctctttttgtgatgactctattaaaatcttatgtccattaaaaaaattgagttgtttgtgcttttactattgatttgtaaaatgttttacaatgtgttgaacataagtcctttgtcagacatctgttttatgaataatttctcttgtctgtggctcactttttctttttcttagtaatgttttttgatgaactgaagttataaattttgatgaagtcagatttatgaatgtttttcttttaaggtaatttttgtgtcctatctaaggaaccttttccttcccccaagtcacaacgataattctcctgtttagaaactttgtagtttttgcatttatagttgggttcctgatccatcttgtattaatttttatgtatggtatacagtacctgtttgggtttcttttttgcatgtgaacatttagttgtatttgtagagaatacttttcttcattggattgctttcacatatttggtgcctttgttgaaaatcaattgactgcatataagtttaggtctatttctgttttccttattctgtttcaataacttatcttgattactatagtaattcttgaattaaggtagtataagtgttccaattctttttctttttcaagattgctttttgcatatccttaacattttagattcagtttgtcagtttttacaaaaattcttggtaaaagtataattgatattctgattggatctatagatcaatgtggggagaattaagatctaaaatactgagtcttccactacatgtacatggtatgcttcatttatttagggcctctttatctcagcaatgttttgtagttttcagtggtttgtgttagacttattgtcatttttttccctaagtattttatgtgtgggatgctcttttcaaggaaatagttatttcaaatctcattttctattgcttaatcctggtatgtatatttttacattgggcttgcgtgcgatgagcttttctattttacttattgagtagtcgtttttagattttttaggattgtttatataaacaattgtgttaactgcatttagagacagttttacttctctgccttttatttctgttacttgccctattgcagtgccttattccccacctaagagagaaatcatttagtcttttgacattatatgtcatactagctgtagaattttcatgaatgtctttcatcagattgaggaaagttccttccatttctagagtactgaaatttttgaaaagttatgagtagatgttgaattctgtcaagtgctttttctgtgtttattaaatatcatttttcttctttatactgttagtgatttaaattgattcatttttatatattaactttgcattcttgtgataaattctacatggttatgatatatgtgaattcaatttgataatatttttattaaggatttttgtgtctgtattcatcagggatatggctctatacttttcctgtagatgtctttgtttagctttggagtaatataatgtttttatcagtaatgctagcaatggttttgttagcgtcattggcttcacttgaaagtggggtctactaccttatgtttgaaagagtttgtatgaaattaatgttttttttttatgtgtttctatagggttcagtagtgaaaccatctgggactctaatttgtttgtatataggttttttataaactcagttaaaaaatctactcagcttttctctattttttttagtaagttgtatttttcaaagaatttgagaatttcatctaaagtgtatttgttgacataaagttgtttataatattttcttaattctttaaatgcctataagagttacactgctaatttttagcaaattcccagcactctgcctttaatcttgattagtctaggtagatgttgttgatctagtcactgaaccggttttttcttaaacagttattgaagtataatttacatacaataaaatccactcacattaagcatatgatttaataattttttagtaatattaaagagatctgcaaccataatcttgttttagaatagtttatcacctgcagaagatgccttgtgatagttgatagttacttctgctttcactccgagccctaggcaaccacttctctactttctgtttctgtatagttatcttttttgacattttctataaatagaataatacaaaatgtagtcttttgagcctagcttctttgacttagtgtaaagtttttgtgcttcatccttgttttagtgtggctttgttagactttagtatgaggataatattgaccccataaaatgttttggaaaatattcccttgtcctctgctttctagaagagtttctgaaccattggtattattttttcttgaaatatttgatggaatttaccagtgaaccatctggttttggcttttattaatgagaggatttccaaatactgtttcaatttctttactaataataagcctattcacacttcctttttctatccccgtttctttttccttcctctcttttccctccctctcttcctttcctccccttgcctccccttccccattctcctattcctttttctttttccttcattccttgtcttgatattttgagtattcctagaaattggtcagtttcttctaagttgaatttctgtagggtcaggatcacgttcactcttttatttcttattttggtagttttgttccttctcttttttttcccttggcacatcaacctagcggtgtgacagtcttgttgatcttttcaaagaatcaaccttggttttaagaatttttaaaaaattttttttgatttccatttcattgatctccattctaatatttatggttgtccttctgcttataagctttgctcttcttttcctaatttcttaaggtggaaacttgggttatttatttgaggtctttcttcttttctaaaaataggcatttaaagctataatacctctacatactgcttttgctacaataatatgttgtattttcatattcatacaattggatacatttttaaattttttcttgtgatttcttgtttgaccatggattatttagaggttgttgttctaatttaattccactttggtttgagggcatgctttgtatgatcccaatttttaaaatttaccgttacttatgttatggccaaatatattttttattgtggagaatgttccacaagtacttgaaattttattctatatttgggaagaatgtgttagatgttagttacatcatgttgcttgatggttatgttgaagtcttctgtgtccttacagattttctgtctagtttgtctatcaattattgagtggagttttgaaatctctgactattattgttgaattgtttatttctctctcaattctgtccagcgttgcttcatgtattttgagactccttttgtatgtttataatttttatatcttcatgatattgacccttttatcattatgaaatgcttttgtctctagtaacagtttttgtcttaaagacttgttttatttgccgggcacggtggctcacacctgtaatccccagcactttgggaggccgaggcgggcggatcatgaggacaggagatcgagaccatcctggctaacacggtgaaaccccgtctctactaaaaatacaaaaaattagctgggtgtgttggcgggcacctgtagttccagctactcaggaggctgaggcaggagaatggcatgaacccaggaggcggaggttgcagtgagccaagatcgcaccactgcagtctggcctgggtgaaagagtgagacaacgtctcaaaaaaaaaaaaaaaaagacttgttttattttagtacagctacttcagctctcttatggttattgtttacattgtttatcttgtttcacacttttgctttcaacctattttatatctttgattctaatgtgtgctggatgtttttcatttggatagtctttgtttttatagtgttcaagctatttacgtttaatgtttgttttgtatatttctcatggtgctttttgttcttctcttcctcatttattgctcttttttgtgttaaatagatattttcttgtgcacatttaaattattttctttttactatgcatatttttaagtgtttttatattggttgacctagggttacaatatgcatattgacttattacaattgacttcatattaatactaattcagtgttagtaatatgtagaatatttaattctgtatagcttcattccttttcctctcctggagagtgccattgtcatatgtattatattttatatgctgtaagattaaccatacagttttacaggtttttttttgtagctgttttgtaaatttgttaagaggaataaagagagaaaagtttttattcagtcttttagatttgtctatgtaattacctcttgagtattcttcatttctttgtgagaatttgagttactgcttggtatcatttccttttagcctgcaggacatctttactatttttacagattcctcagtctttacctgggaatgtctttattctgcctcagttttgtagggtagtttatttggataaagaattcttggtttagtgtttttcttttagccgtttgaatatatcgttccactaccttctgacttctatggtttctgatgctaagtcagctgttagtctcattgagggtccattgtgtgtgataagtattttctcttttgctgcttttaagattttctctttgtgttcatctttctgtatttttagggcccagcagggctttaactttactaattttgtcaccctttttgggctttagcatgaactggtagtttagattttcattgtgttttaaaaatagttacagcctgaatttatttttatatgattccctcaagttttatataattttcctcaagcttttattgccatgtaattcaataatacctctctgaggaatgactacttaagcatctttgttataagaaatggtgataccgtgttaatttttttgttttacttcatgttgtggcgttatgtactgttgctttcagatttttttcttgcttcatgggatttcataaacatatcccctatagatgtatttactctatatatgtcacataaaaacacatataaaaataaggcttataataattaaagtattgacttttctggaggactatataatcttaataagatgttttccttttgataaatattgaatgataatctttaagactaggtaaaagataccatagtatatttagtatttgcattgagacatgtattagtctctttaagagttaatgtctataaatatttaactctggactatgtcactgtcaagtaatattttgggctagagttccccactgagtatctaattttgttgccttattcttttagaagtgttactgtgagcaatagccaggcaactgaaagaaagaaggtgagtgggacccaaaaagaaggacaaaaacagatggaaaggaaataaaataataagaaatttcttaaacagtgtttgttttggatagttttcttgttaagcacatggaaatactttgcacatttgagaatcactgacttacatgctattttggagaaacagcaaatcactcatgtaatataaacacaattatagatttctttgctgtaattttttcatttctggggcttacttttccgtaagatacaaaacgttccttcttacagatcattgcttaacaatatatttggaggattgcaaatttaaattgaatggtacaattaatgcaataaatgatagatattcaaaatttctgaatcctgatagtcttgttgagttatagtctgctctaaagatgaatgttactaatgagaatggactttttagtatacgcctaaagtcaatataatgaagtgttttgaactgcctgtggtcctagatttctaatatgtctgttattatactaataagatcttaagactgaagagcattttatagtattcagtgaacttgcatgtaaatatgcactgtggatattattaattcccttcttttttttacagatatgatcactaagcacaggtggacagtggaaatcagagtgagagtatatggctgtagattctataattctttttccattgtaccaccagtaaggaatttgatacagaaaataatgttagatactgaacaaataattttttcttcggtaggaggtcctatattgctgttgtgtatccttagtttctttctttctttttttttttaaatggggtgtcactctgtcacccagtgtggagtgaagtggcatgatctcagctcactgcaacctccccatctcacgttcaagtggttctcccgcctcagcctcctgagtggctgggattacaggtgcctggcaccacaccaggctagttgttgtatttttagtagagatgggatttcaccattttgaccatgctggtatcaaactcctgacctcaggtgatgcacctgcctcagcctcccaaagtactggaattataggtgtgggccacctcacctggccttatttagtttctttaatgaagattattgatatgatatggctgtgtaaaatagtctttttatttctgtattattgattttcattttagaaattagatccacaaatgtaattacttctgatgcatggccttttatccttgaaatggtaaataacacatactttttcattgctgttacccattctagcaaagtttcactgttttatcaaaggtattcaagttattttccatgttctgcatagtagtaacatgtacttttccactaggagcatttgagttgagaatgagaactaatggggaataattgtagcctcctgttactatgtttcatggcacaaccaagagacttttttccttgcctttatacagaagataggcagaatagcagtgagataggtgttgggttttaatgtttgagagcttcaaattctggctctgtgagttatgcttttgggacttgggcaaataaccttattcatgcttggaataaccttacagtgtattgtttgtgagaataagataatataatgaaatgctcaatctttgagcagccttcttagatgttgtcaaatgcaaagatgagttcctccatggataacatggtagattaacttaaaaacaagcaaataaaaagaaaccaagaacagcaacaaagtaaaaagaaagagagtgattaggtgactggctccaaatataagataaacatttcttaaatctggatgtagaatctgccaaaatgttaagttgtcaaaaaacaaagggaaaatgatctgttttaagccataaataggctaatcagaaataatgacatggtctggtaagaaatattaatgacttttaaagtcattaaaggattacttaaaggataattgcattttccagataacagggaacctaaaactaactttattcttttttgggttcatactttatgggaatttctattaagcagattatcatctagtgaatacatgaaaagacaaacattggtctggtcatcaagtagaattactgggagcagtaaacaagaatgtaaagtaagtcaaagccttggatgaactcatccaagttaagaaacaatctggtgagatcttgattaaaattctgctgttaaagaagctgcttaagtacttatgaatttgtacttctttgtactaccatggtgattaatgtcaatgcatttttctcggcaaggatacacaggcatatctggttttcttttgcttttctttattgtgctctgcagatactgcgtttttaaacaaattgaaggtttctggcaatcctgtatggggcaagtttatcagccaccatttttccaacagcatattctcactttgtgtctctgtgtcacactttggtaattctcacaatatttccaacttttaaattattattattaatatttttattttactttaagttccggcatacatttacagaacaattgcaggtttgttacgtaggtacacatgtgccgtggtggtttgctgcacctatcaaccaatcatctaggttttaagctctgcatgcattaggtatatgtcttaatgctctccttccccttgcctgccacccaccaacaggccctggtgtgtgatgttcccctccctgtgtccatgtgttttcactgttccgctcccacttatgagtgagaacatgcggtgattggttttctgatcctgtgttagtttgctgagaatgatggctttcagcttcatccatgtccctgcaaaggacatgaactctttcttttttatggctgcgtagtattccatggtgtatatgtgccacattttctttatccagtctatcattagtgcgcatttgggttggttccaagtctttgctgttgtgaatagtgctgcaataaacatacgtgtgcatgtgtctttatagtagaaggatttataatcctttgggattgctgggtcaaatggtatttctggttctagtttcttgaggaattgccacactgtcttccacaatggttaagctaatttacactcctaccaacagtgtaaaagtgttcctatttctccacatcctctgcagcatctattgtttcctgactttttaatgattgccattctcactggtgtgagatggtatctcattgtggttttgatttgcatttctctaatgaccagtgataatgagccttttttaatgtttgttggctgcataaatgtcttgttttgagaagtgtctttcatatcctttgcccactttttgatggggttttttttgttgttgttgctgtttttttcttgtaaatttgtttaagttccttatagattctggatattagacctttgtcagatgggtagattacagaaattttctcccattctgtaggttacctgttcattctgatgatagtttcttttgccatgcagaagctctttagcttggttagatcccatttgtcagttttggcttttgttgccattgcttttggtgttttagtcataaagtctttgcctatgcctatatgatgaatggtattacctaggttttcttctagggtttttatggttttgggttttacctttaagtgtttaatccatcttgagttaatttttgtataaggtgtaaggaaggggtccagtttcagttttctgcatatggctagccagttttcccaacaccatttattaaatagggaatcctttccccatttcttgtttttgtcaggtttgtcaaagatcagatggttgtagatgtgtggtgctacttctgaggtctctgttgtgttccattggtctatatatctgttttgttaacagtatcatgctgttttggttactgtagccttgtagtatagtttgaagtcaggtagcatgatggccccagctttgttctttttgcttaggattgtcttggctatacaggctcttttttggttccatatgaaatttaagtagtgttttctaactctgggaagaaagtcactggtagctcgatgggaatagcattgactctatgaatttctttgggcaatatggcctttttcatgatattgactcttcctatccatgagcatggaatttctttccatttgtttgtgtcctctcttatttccttgagcagtgatttgtagttctctttgaagaggtccttcacgtcccccttaagttatattcctaggtattttattctatttgtagcaattgtgaatgggagttcactcatgatttggttctctgcttgtctattgttgctgtgtaggaatacttgtgatttttgctcattgattttgtatcctgagactttgctgaagttgcttatcagcttaaggagtttttggggtgagatgatgggattttttaaatatacaatcatgtcatctgcaaacagagacaatttgacttcctctcttcctattcaaatactctttatttctttctcttgcctgattgtcctggccagaactaccagtactatgttgaataggagtggtgagagagggcatccttgtcttatgccagttttcaaagggaatgcttccagcttttgcccattcagtatgatattggctatgggtttgtcataaatagctcttgttattttgagatacattccaccaatacctagtttattgaaagtttttagcatgaaggggtattgaattttgttgaaggccttttctgcatctattgagaaaatcatgtgttttttgtcattggttctgtttatgtgattgattacattttttgatttgtgtatgttgaaccagccttgcatcccagggatgaagccaacttgatcatggtggataagcttttggatgtgcttttgaatctgtatattcctgggcttttttcacatagtcccatgtgtctttgaggctttgtttgtttcttttcattctttttttctaatcttgtcttcatgcctcatttcagtaagttgatcctcaatctctgataccgtttcttccactttacagattcagctattgatacttgtgtatgcttcacgaagttctcgtgctgtgtttttcagctccatcatgtcatttatattcctctctaaactgggtattctagttagcagttcttgtaactttttgtcaaggtttttaactttcttgcattgagttagaacgtgctcctttagctcagaggagtttgttatttcccagcttctgaagcctacttctgtcagttcatcaatctcattctccatccagttttgtgcccttgcttgagaggagttgtaatcatttggagaagaagaggcattctggtttttggaattttcagcatttttacgcaggtttttcctcatcgtcgtggatttatctacctttgatctttgaagctgatgacctttggatggggtttttgtgtgtgggtcctttatgttgatgttgatgttgttgctttctatttgttagtgcttctaacagtcagtcccttcttcggcaggtctgctgcagtttgctggaggtccactccagaccctgttcacttgggtatcaccagtgaagcccgcagaatagcaaagattgctgcctgctccttcctctggaagctttgtcccagaggggcaccgacctgatgccagcctgagctctcctgtatgacgtgtctgttgacctctgttgggaggtgtctcccagtcaggaggcacgggggtcagggacccacttgagcaggcagtctgtcccttagcagagctggtgcactgtgctgggagaattcctcttgtcaggatcagctgccctcttcagagctggcaggcaggaacaattcaatctgatgaagctgggcccatggtcaccccttccatcaggtgctctgtcccagagagacgggggttttgtctgtaagcccctgactgggctgttacctttctttcatatatgccctgctcagtgaagaggaatgtagagaagcagtctggccacagctgttttgctgtgctgtggtgaattctgcgcagttcagacctcccagtctccttaacactgtcagggaaaaccacctactaaagccacagtaatggcagatacctctccccgcaccaagctcgactgacctaggttgacttcacactgctgtgctggcagcgagaatttcaagccagtggttcttagcttcctaggctctgtgggagtgggacttgctgaatgagaccacttggctctctggcttcagccccctttccaggggagtgaatggttctgtcttggtggggttccaggtgccactgggttataaaaaaaacctcctgcagctaggttggtgtctgtctgctcaaacagctgccccattttgtgtctgaaacccagggccctggtggtgtaggcacatgaaggaatctcctgatttgcacattgcaaaaaccgtgggaaaagtgtagtatctgggctggatagcacagtctctcacagcttcccttggctgcgggagggaggtcccccagctccttgcacttcctgggtggagcgatgccccacccttgcttctgttcaccctccatgggttggacccactgcctaaccagtcccagtgagatgaactgggtacctcagttggaaatgcagaaattaccttccttctgcgttggtctcactgagagatgcagactgtagctgttcctgttcagccatcttggcccctccccccaacttttttattattatcatatctgttgtgctgaaatatgatcaatgatctttgatgttaccattgtaattgttttaggctgccaggaaccacacccatataagataggaaacttaatcgataaatgttgcgtgtgttctactccaccaattgccccatctctcatctctctccttctcctcaggcctccctattcctttagacacaacaatatttaaaataggccaattaacaaccctacagtgtcctctaagtgttcaagtgaagagaacagtcacatatgtctgactttaaatcaaaagctagaaacgattaagcttcctaaggaaggcttgtggaaagccaagatagccaaaagctagtcttcttgtgctgaacactgagacaaattgtgaatgcaaaggaaaagttaaaagtgctactccaaaagaaacgttcttgaaggaaattaaaagtgctgctctagtgaacacatgaatgataagaaaatgaaacatgctcattgttcatatggagaaagtttcagtggtctgggtaaaagagcaaaccagtcataccatattcccttaagtcaaagtctaatccaggttgtaatccctaactctcttcagtcctatgaagactgagagaggtgagaaagctgcaggagaaaagtctgaagctagcagaagttaattcatggaatttaaggaaagatgccatttctataacataaaagttgctacccggaacaacatatttttcagtgtagattaaacatccttctactgaaagatgatgccatctaggatttttgtagctaaagagaagaagtcaatgcccggtttcaaagtttcaaaaggcaaggctgctgactctctttttagaggctaatgcagctggtgactttaagttgaagccagtgctcattcgcttttttttttttttttgagatggagtctcactctgtcaccaggctggagtgcagtggcacgatctcagctcgtggcaacctccgcctcctggtttcaagcgtttcctctgcctcagcctcctgagtagctgggactacaggcgctcaccaccacgcccagctaattttttgtattttagtagagatggggtttcaccatattggccaggctggtctcgaactcctcacctcgtgatccgcccgcctcggcctcccaaagtgctgagattacaggcatgagccactgtgcccggcctcatttgccattttgaaaatcctagggtctttaagaattttgctaaatttactccacctgtgctctaaaatgggcgcaaccaagtctaggtgacagcgtatctgcttacagcatggcttgctgaatatttgaagcccagtgttgagacctactcttcagaaaagatttctttcaaaatattactgttcattgacaatgcatctgatcactcaagagctctgacagatgtacgaggagatgaaggttgttttcaaaatgtcaacattactagttgatattttggaagtttcggaagaagttaattccaacccccatggaaggactttgagcagttcaagacttaagcggaagaggtaactgcagatgtggtagaaacaataagagaactagaattagcagtagagcctgatggtgtaactgaattgctgcaatctcatgataaaacttgaatggatgaggagttgcttcctagggatgagcaaagaaagtggtttcttgagatagaatctactcatggtaaagatgctttgattatttttaaaattacaacaaagggtttagaatattatataaacttagttgataaagcagtggcagtttttttttattattatactttaagttctgcggtacatttgtacaatgtgcaggtttgttacataggtatacatgtgccatgttggtttgctgtccccatcaacttgtcatttacattagttatttctcctaatgctatccctcccccagccccccatcccctgacaggccccggtgtgtgatgttcccctccctgtgtccatgtgttcgcattgttcaactctcacttatgagtgagaacatgcggtgtttggttttctgtccttgtgatagtttgctgagaatgatggtttccagcttcatctacatccctgcaaaggatatgaactcatcattttttatggctgcatagtattccatggtgtatatgtgccacattttctttatctagtctattattgatggatgtttgggttggttccaagtctttgctattgtgaatagtgcctcagtaaacatacgtgtgcatgtgtctttatagcagcatgatttataatccttttggtatatacccagtaatgggattgctgggtcaaatggtatttctagttctagatcctaaaggaatcaccactctgtcttccacaatggttaaactaatttacactcctaccaacagtgtaaaagcattcctatttctccacatcttctccagcatctgttgtttcctgactttttaatgattgccattctcactggcatgagatggtatctcattgtggttttgatttgcatttctctaatgaccagtgatgatgagctttttttcatgtgtttgttggctgcataaatgtcttgttttgagaagtgtctgttcttatcctttgcccactttttgatggggttttttttttttttataaatttgtttaagttctttgtagattctggatattagccctttgtcagatggatagattgcataacttttctcccattctgtaggttgcctgttcactctgcagtggtagtatttgagagaattgactccaattttgaaagaagttctgtgcgttaaatgctttcaaacagcatcatgtgctacagagaactctttcatgaaaggaagagtaaatcaatgtggcagacttcattgttgtgccattttaagaaactgccacagctagtccaatctttagcaaccaccaccctgatcagtcagcagccatcaacatccagacaagaccttccaccagcaaaaagatgcaatttgctgaaggttcaaatggttaacattttttagtaataatgtattttacattaagatatgtgcactgtgttttagacataatgctattgcacacttactagactatagtagagtataaacatagcttttacatgcattaggaaataaaaaatgtgtgtgactcactttatggcaagggtctacaaccgaacctgcaatatctccgaagtatgcccatatctgcctttcgtaagaattgtgtatactagaaagtcttaagggacaaggaatctgtagagaagtaaagttctggttaagcttttgtgagattattactgtgtttgtgtgcattaatagatacattgaattttgtccttgtcacatatatttcatctgtcattcatgtaaggtgtatacttcagtggatttatttggagacccaggcatatctcttgcctattttggtgctttggactatcttggtaggtcttgagatgtctagccataggtaaggatattggcatggggatttaaaaattcagtggttggtaggattggagatgatctttaatattatgtctacttctgagattccatgaatttcattatttatagacattcacattacccaggttttctgtgcctttccaagtcctcatggaattcctcatgctactctaatttgagtcattgtgaaagatgttagtgacttttgagaatcagatttttacattgggaaatatgaagatgaaaaaaattggcccagataatctctgttgacacttactaaaaatttaaaaacattaatcaagacaaaaaatgagaagtgaatggttcttaactcatttctttaaacgcactactgttttttattttgttcaagaaaaaaagtttcacaattttttttaagcaatagtataatcagaaccagaggtctgctgagtaaaatcatgcagttcagtctctttcctcttgacaccttactgataccaggaagttttgattgtgttatatgtaggttggtgacttaagatcaggcatcactcttaaaactcatagtaggtttgagtggagtgttttcaattaagagcttattgatactatgttatgggaatatataacgcctgggaaagttactaagtgctgggtaagaatgcaaaagacaaaatgcgaaaaagctataatttaagaaattttaaatttttgcccaaggctaggcttaactttaagaaagatcaagttttctctcctgaattgttcccagggcctgagactaaatttatgataattaatgtgttttgtatattgtcagtcttaaactgtaacatcatttgtaacattgtttctgcaggaagatgccttgagttctaactttcaggcttttggaagttagtgattttatcttgtaatattaaacaacagtctgtagagatgtgcaaaatattccctctcttcctgcttctcttcctgttgatgatgatgatgaagtaataatagtgggtagcattttgtagacagttcttttatatcctttaaatttatttatttaattctttacaagtaaaactgagacttttttctttttcttttcttttttttttttttttgagacagagtcttactctgtcgcctaggctggagtgcagtggcgcgatctctgctcactgcaagctccccatcccaggttcacgccattctcttgtctcagccttctgagtagctgggactacaggcacccaccaccacacctggctaattttttgtgttttttagtagagacggggtttgaccttgttagccaggatggtctccatctcctgacctcgtgatccgcccgcctcagcctccaaagtgctgggattacaggcgtgagccaccatgcccagctgagacttttttttaaagttatttttgctcaaggtagagctaggatttgactgttcagaactctaaagccccatgcttttaacattgtgttggtctaagggcacatttaatatggggagtcataggctgatagtgtatatgcttgtgttcttgctggtgagaagatatatagatgggaaagctgttgtggtatgaagaaacaaaataaatatagaataagattgttctttaagttatttgttggttaacctgtagttaactcattacttcaccaagaatagttttgggtattatggaaatcttgaagcacatgtatttcaaaatgagttagaggccttaggcatttaaaaaataccaccagtgctgacataatatgagaacatagtgtaggatcttgaggcttttttttacatatttaatgaatcttttatagatattatcaatttttatcttgtctcatgtagtgcagattaatattatgaatatagttggttagtaatttccatgctaatttatatctatttgaagatataacacttgaaaaacacttaaaagtaattgcttttttccaaaagattgtatatttccagaaaaaatgttttctgttttagtaataaatgtaaaaacgttcaaactcatgaacatttacatgaattcattggatatagggagactgtattaaggatataaattatttaaaacatcttccttagaactggaacaataaggttatgttgttcaaaatgttaaagtttaaagaaagaaatttctttgttaagggaagacaaagcatatttggcactatgtatgaacatgcctgttttgctcactgtggagctcccaatgcctaaaatcatgtcattaggtttttttcaccattaaaaaaaatcagtttaatattgaattatttttttaaaaaaatttgaaaaggtctacaggcatcttaaaaattgtctgtacacttgctattaatgaaaaaattagaagaatttcgagcaagaaaatattcacctgaatcaacatattttagtgtccttaatgttgagcaattagctgataagctagtttgaacctgactttcaggatagaatacttttgaggttgtatttgtttttttgctttcaacaaggcaagtcttgatgctagatcaattagcaaatcttgaagaattaacttaaatggtgtggtaattcctgttattagagatatttcttagaactcatgaaattcctccctcccacatgatatcagatgtgttgagttgagaaagttgctgggcagcagtcttgtatatcagagtccagttcaaagttgttagaatgagaagtgtttttaaaatgttatgggaatgcccgaattacaattgaactttgaaattaaaaagaaaacacaagacagtataaaaataaagacctatgagagtgttgtagcaagttgggctttttgtaacctaccgtttaaaatacagatctttgaaggcaggtttttactaattattttattactttgctcttgctaaagacagcaaggcaagtaattatcctcagatctgaagattaaaagtcttatgatttttaaataaatattaagcaaggagagtaatttttataactgttagcacatatgctttgtgtgctagctttttcctaatgtaaaataaatctgaatatgccatacgattggtgacaaataaaaaactctttgtgcaattaagagaaaatctgtttatttaagagctctcaaaggttgtaaaagattatacttggctgtatgtgaaggataaatgttgtgaaataatgccccttagttccccttttataataaatctcagctgtgtgttcagcacaagggctcagtgccaaaaagaacaggttcaacttgtccgtgaggatttgcaccacagtaaagtgcacaactgcttttgtagaggtcattgtggaggtcagggcatgtacagttgaatgaaagcaactttagaaacatggtagatcatagagttacttgagattcaaaaatcaatgttaacttaaaacattaaaaagatggaaaatcataagaaccttcaaatatatttttatctttatctacatatgttaatatgttttcatacagattaaaaataatttctttggcatcttgtgctagtatagttttaaggatcttcaggatattttataattgccaagatttggaagcgttgactattttaatatttgttaaattctttagagtgttcacataatgaaggtaggatatgatggtggtagaacaaagtgtgcagggatatgtgcatggtgggagtaaaggcaggggagtgtggatgagttttaataaaaatatgggtgtaatctggaaaatgtctctacaagtcatatttatcttgagtttgtgatcgaaagattcgaaatttaacaacaacaacaacaacaacaaagaaaatgcagtcttatacagtatgattctttttcctaaatatctcaaaaatacttttatacatttgtgataaatagaaataaatgagaaatagaatgtggagaggctgtaagatcccaggactccagccagtgcattgagtttcatataaagaatacctgaaaagatataactaagtagatgcatagcttacctggggttatattttatctagagctgtacttcatgactcttttctcgtttctttttggtgactattttttaaaaaatggtgatcatagcaaaatgacaggcaaccattggtttcagtgtggggattaattagtaatctttagaatgtgcttcagcaaatgcagctgattggcagtagcatctgtctcaacaactgacggaatgttagtacttttatcaagtaattttcagaagggctccaaagctgttttactaaactctctcatatgaactgctttctttgtcctctagggcattgttttactaaatatacctatccatgaattaactaattagtgaaaggagggctataaaattgttatttttttaattttaaaaaatggacacaaatgtgatagtctgtgtattcttgtatttgtgggaccaccactatgctcactgatcacacacctatgttctcagatgaaaaatttataaaggattgtgattttgctgtattgtttttgtagttcgtctcataaaacatgtctcttaattatgaagagtgatttgttaaagtacaataaactgtgatttaaaggattgattagtatagtcagctttctagaaaggcaatttacttctgcattgccaggaattactcttcttagttgaaatagcctttttactaaactggttcatatttcaaaggatatgcagtttaacattcattaacagacaagccatcaattttatattgtttgaagaaaatattatttttgcttgttataaaaacaagacaacttctaagtgagtatctaatgaggttgtagcacatctcagtaaagatgaaatttgccttaatctgaatgtgttatggaaaaattgagtgtaaatattttctaaaaatgaattgatatgctttaatgaactagagtagctttcatttaaaaagtacttatatactaatgtttttttaaacaaatgagcacattatatttaaaaatgtttaataaatataatatattttaaatgaaaatttaaatagatactgttaaatgcttgaaaatagggacagttgtggtggtatactttctgctatatcttcacagtgcctaacatctaccaaatgtttaataaataaattttcatattttagttctataatagagaagtgctttgtggattttagcaggatagggtttaaaatctgagtaggttacttggtcttggagagcttcagtttcttttcctgtaaaacaggtaaaacatacttacctcaaatgtgtatgtaatgcctaacacagtgcttggcacatagtagatgttcagtaaatatttctgtatcattttagtgcaattgcactgttagtaatccattccatatctgcctgactttaataaaagacaatttatgtgaaatttcaggtgagaagggtatcaagtcagtgtcttaaatattctgttcttttctgcattttagagtagatttaattgcatggtggttttatgagtgtgatagcggtggtggtggtgtttgtgtgtatgtgcatttggtttggggaagttagattgggatggttagagtattcatagtgtttgttgtttctttttaggacagaagaaaggtaaaatcagtgacagtctggcttaggtcttcacttattttctacaatgggaatggcaaaacaactactccttctgttgttaaatgacctcaaatagaacgaggacatttgttatgtaggtttttttggagatagggtagatgattagagggatcattttaaaacatttcttcattcatgaaacaaatattcctgatacataccaactactgtactaggcacagaagagtcaaatctaaataaaatgtggtctcttaaattattcagtctctataatggcgtaaagaaacttctatcttttcacggaaaaatatttctgctttagaagactactaatcttacatggtatttttgttttgcttatgtaatagtagtagtatttgtagataattttatataaagccatttctatattacattaggaaatttggacttatgtataagttgtcattgttggataaagttcacttatagtgccaagttaggaattcttggaaattatttttgaaattagtaaaagaaagtgagctaaaatgctctatgcctgaaagtttttacagaaaatttcttgcgaatactgtttttcttaaaattaatgcagactcttttaaaggaggcaggttttgtctaatcagatagtctccttgatgtttttcttttctgatctttttatagaaacagatatggtttgctggacactatgtcctcttggcaacaaatggtagtttggtaataagacaagcatcagagaaataatgtaaaaataatacttttcaacattgtatcacatttatcagtgcccaaggaaaaaataaaacctataacaacaaaaacaaacaaaataaacaaaatatttttcttgtattttgcttttcctttaagctactggcatatttccctattttcatttgtcttataagttaatgaaaataatgtttgcctagtgtttcttcttccttccattccctctttgtattctggcttctgttttcaccactgtactgaagctcctctgggtattgaaattccgttcactgggaacgctctttcttcccctccatttcagggctgtttcagccttcagaggttctcccaaatttcatttcttccatgaactctgctgaatgaaaattcaaatgcttgtcatattcagtagaatcatatcgtacatgcatttaatttgcttgaattcaactaaagttgaaaacaacaaaagtagcaaaaatgcctctcttctccaaggtaaagaaaaattttgaaacagcatagatgccaaatgtaagccacctacttaggtgatctgttccaatgctagaggagaaactagctgagttagatttacataaagagattaaaatatgcacagaacaatgtacagtatactttataggcaatttgagggatttttgaggggttattttgacctttttttttttttttttttgccttaatctaactttagaacggaatccttgtgcatgtcacagtatagctgtgttgaactaagtcagtcatataatttaggacccttctaggtaacactttgatctttctcaaatgtttcacatgtggaactaactgagggaaaatgactagcttagttcctttcctatttttatttttgcatttttcagggagggaaaaatttgtacgaatgaaattatagtcaaaacagtttaaagcagagggagacaatgctgttccttttatgttttgtgttctcctgtagttttgagactcatgcctttctcaaaagtaattgcatgtgaccacaaatatatcactgtagttagtgtctatatgagccttattagttctaagccaatacaaggaatttataggaatgcttattaaatatccagagtttagttgtaattatatattatttgaggatctttaatgatactaaccttttactagtgatcttttaatggaagatactatttcctaatttttttccaaccttttcaaaattggttacttttcatttttgaagttcttaaggaaaaatttatattgatataataagaattctaaaattagagttgaaatattattaaaggacatttttctgtgtggaacactaattagagtatgtgtttaaggaggagattacaaatgaatttggctaacaaatctttaaggaatttcactgtagtaaacagattttgatgagtttccagggctaatttgctagaaacattttcagagacttggcttgccaagtgaagatgtatttagagccattttatttctaatgttgagcaagaaacttaagcccttagctagatagttatagaaatttgtctttgatgttttcaagcatatcatgtgtatttgagtagaactgaacgttgctgaagagctagaaaaatatggtgctgtgtctgcaggatgaaacctctttttttattttgaagaagccagttttagaagaaaatttttgtgaaaattggtaatctaactattaggcatcacattttaaaagacaaagagtgctcttaaaggctgatttgtgcaagtatgtcaccattagaatgcttaaaagagcctaccatatatgtatcttttttaccgttatattctgcttattcccaaacatacattcagaaaaagaatgtagtctgatgattctaatagagttgggaatctgggtcttagtcttgtgcatttttttctactggctgtttctttagtatatgtagaatcaaattactttacattaaatttgagggaaattttatgtatttttatgatacattgtgagtcagtggcttatttccacttagtggtcatgaaatgatagcaagttagacttactgtttcagtctcctcacttatacactccccccttcctcattgcacatggtgaaaatgaaacatagagaaattaaatgttgcacctcagttcattctagtttagagacagtgccaggagaagtacatagttacatctcagcctgtaggccctgtccctcatttgtctttttactgtttactttacattttgaaagaaattagagaaaaatcatttatatggggaaaaatgaattatacttgccatgaaattgtgtgctaccaggaagttattaccatgcagctgctgcagtgatgacaggctgacatcaccctataatgaccagaacagcatagtataaaaatctctctgcttgcttctaaaataaattgaaaacaactgaattaccaaagaaatgttactcagaatgaacagcttatagacagtgccaggtatattctttaagtactctatcccattgcaaaaatatgtgtaggcacacacactattagaaaatatattcacatccatatacatatgtacaaatagacatatatgtatgtgtatatacatgcatacacagcacacatgtccacacatatttaaattattagaacattaccaaaacagaaatagtcattcagaattacttcaattgattttctaaaaggctgcttggagatactttctttggaaatagtcactagaattacagtagtttaaagctaccagaatgaaatattctggtttctgattccacttagtaaggtaacatattctgtagaatttgacagatttaacattgtgagaggactcagttcatgaaacaaacactaccatcttttttgttgttgttgtaattaaatgaccctaagaaataaaagtggaatgcacagtctcactgtaatgtgatttactaggatatgagctccctgagggcaggggcttgatctgttttgtttcctgatgttcttttcagtaggtggttatatttgttgtatgaatggatgatgaatgccacagagtaagcacaatgttttgttatttgaaattttgttaaaataactactaagatgtctggaaaacacattcacagcctaggatgaaaagcatccattgactgtaatgaataagtgaaaagaaaaaaataatcaaagtctagagaaggtagaaatttatttcttatgtactctcatagtacacaagactatgtaacaaaattccaattgtttacgcttagtaagagcattttaaaatttatggaaacgtgatcatcttgcagttgccttagtgttcatactattacatcacatgacaacttttttatattgtgttattttatacatatatatatatatatatttttttttttttttttgagacggagtctcgctctgttgccaggctggagtgcagtggcatgatctcggctcactgcaacctccacctcccgggttcaagcaattctcctgcctgagtaattgggactacaggcacacactgccatgcccagctaattttttttttttttttggtattttaatagagacggggtttcaccatgttgcccaggctggtctcaaactgctgagctcaagcaatccgcctgcctcggcctcccaaagtgctaggattacaggcgtgagccactgcacctggcctatattgttatatttttatattattcgttaattcaacaaaatattgagcagctttttggtgccaagctgctcagtgaggtacctatgacagtgagcatgagcatagggccttacactctaatgggagacagattcaaaacagacaattacacagagtttaacaggcttacagggcttattggcaaatatgttgaagatgagggtagtttgatggataaatgtcattaagcaagatagatcaattaaaagagttctgaatttaaaattgtgttaaaggatttgcagaatcatttaacctatcggcctaaattgtcagcactttgtaattacaacctcttctatggtacttaacagaaaaccatatactgattggtatagaactggattttcatgtttagtatttttattattgtttatctcaacaatctatatactaattgattatttttattgccattttcattaaataataatgtattttctttaatagtgttattctaaatggtttgttgcattctaaatgtgtgtttctattttaacatagtatgtgtttagagttaacacaaaagatactctgctctttatttggtgagaaagcataatgataatatttgtagtgtatagattaacagacaaatcttagtaaattataaacaattttttgtagtagcttttaaactttctaagaaaagttaaataatacatttcagattattaaaaatacagattattaaaaatactgccatgtataactacccgtgtcagcatttgcattgttcttccaatgttcctatgttgctctatatggaaatgagctgaattttagaaaaccttttttctcataagcttatattttttgactagcaaatgatggaaatatagggctctaagctatattttagaaaagaaacaggttccattttgttacattgtagaggaataaaaacactaattatatatactactgaatgtacagtttgcatgcgtttccccccaggtatgggtattacctaaagttgcatggttttctgtggttcttctcactacatttttacttttaaagccttatttctttatcaattatatgacaacagtaacaaaaacagaaagggctttagttttgtgccgtacttttcaaagtcaggaaaatgtacctgaattacttaatggtatttttcaagactcagtgctaagacctcactctttatatattcccccacacccatttcttattcttgtgaccttgcctgtcattttgatgctgatagcaaaatttcttttgagtttattttatatttctagctgcctttactgaacatttctacttggatattttataggcagcaatggtggattgatttaaaccaccatcttaaactctttatttttaatagctttatcaagatataatttacttaccataagaattacttatttaaaatatacaatgtattgattgttagtaaatttacagaattttgtaaccatttcagtaatccaattttaggatgttttcatcactccaaagaggtctctgatactcatttgcagacacaacacattcacacttctagcccacagcaattgttaatctactttctgtctctgtaattttgccctttctggacatttcctagaagtggaatcatgtaatatattggtccttcacatctggcttcttgtagcataacgtttttgatgttcatccatgttgtagcatgtaccaatatttcattcatttttattgttgaatagtaataaaattcagcatattgtgtgaatgtttaataaaggaattcatattcatactatatgaatgtaccaccccattttatttatccattcacaattggtggacatttagattgtttccactatttggctgctattaatagctgctatgaacattcatgtacaagtctttgtgtggtcatatgttttcatttctcctgggtagatacttataagtggaattaactaagtcataaagtaaatttacttgtcactttaagaaaaactactgaactaattttcaaagtggctgcatcattgtatactctcatctgcagtgtccatgggttccagtttcttcacctctgcactaacactttttattgtctgtcagtttggttgttgtcattcaagtgagtgtgcatttagtgtgcatttttctgaatattattgatgttgagcatcttttcatgttcttattagccatctggtcttttaaaatcttttgccacttttaattgggtcattttgtctttttattagtcaattctaggatttttttttttttgacacagagtttcactcttgttgcccaggatggagtgcaatggtgcgatctcggctcattgtaacctctgtctcccaggttcaagcaattctcctgcctcagcctcccgagtagctgggattacaggcgccggctaccacgcccagctaatttttttatttttagtagagatggggtttcaccatgtcggccaggctggtcttgaactcctgacctcaggtgatccacccgcctcggcctcccaaagtgctgggattacaggcttgagccactgcacccagtctctaagaattctttataggtagtattctgaatttgatcgaattataaaatatgtggcttgcaagtattttcttctggtctgcattttgtctttttaaaattttctctttttattagtatgttttgcattgctatgaaggaatacctgagactggataattcattaaggaaagatgtttatttggctcatggttctgcaggctgtatgaggaagcttttactcatggtggatggcacagggggagcaggcacacgtggcaagagagggagcaagagagaaggaagtacctcttaaaaaccagctctcacgtgaactaatagagaatttgcttattgctaaggaaggacacaaagccattcatgaaggctccagtcccatgacccaaacacctcccactaggcctcaccttcaacatgaggattacatttcaacatgaaatttggaagggacatgcatccatcctacattactcttccacctttccctttcctagttttcctgcctctgttaatcagctctctctggttttcacattttgcttcccacctcagctatagcagattgctaccgattcttgcagttttaattataattattattcttttttctcttcccccccattattactcagatctagaccatattactttaaccttaatcactaaaatagctaccgacttgacctacttgattctaggctcttctttctttggtgctattatatttttctttgctgtaaatacatagccattttttttttcaaaactaacaaatattccatgatctattttaaacattttataatgaaaaatttcaaaaatagcaaagttggaaaataagacaatgaatactcacatgcctaatacctagattcaataatctgtaatattttggtattacatcacacacacatacacacacacacacacacacacacacacacacacatatatatatgcactttttttcccctgaaccgttctaaagtaaattacaatttccatgaaattttacttttaaattcttcatctggcatctctcactgaccttttcctgcataggacattctcatacataaccataatgccataatcacaccgaacaattaacagaaattctctaatatagcttaatacccagtctatattcagatttccccaattgttgccaaaatgtttcatggctgttttttcccttccaaattagtactgagccagtgactctcactatgtttattaaacatcttaattctgtcttaatcttgaatagctcccatccactttatactttgtcatctttattgttgttgtttctcgtgacattgacctactgaagaaaccaggccacttgtcttgcagtatgtttttttctgattttttctctgtggcattgttcaatagtagtttttttatagccataaatataaaacatacccattttatacccattttggacaattcagaaaatagtgcaacaaagataaataatttcatcacctagggatagtttttctttagttttcttttgcagttgcagatttactttattttattatgttttatttgagacaagatcttgctctgacactcatgctggagtacagtggcacaatcacagctcactgcagccttgatctcctgggctcaagtgatcctcctgcttcagcctcctgaggagctgggactacaggtgaacaccaccatgcctggctaatttttttttttttttttttgtagagatggctcactatgttgcccaggctggtctcaagcacctgggctcaaactatcatcccaccttgatctttcaaaatgttaagactacaggcataagccactgtgcctggctcttaggcagattttaaaaatagtttagagcataatgatcatgtacttaacattttactaatttctctttaaacatgattttaaatggctgcacactgttttatgttataattgaactgatgtttacttaaactgatgtttacttattgattgaacatttagtttccttttagtttttgacaatataaactgtgatgaacagacatgaataagaatttgattatatttctcattgctttcttataaattattacagatggtattactaggtcaaaatatgtgaagattttaaaggtttactaaattgcttttcatccagaaagcaattccataatttgctctcttaccagcagtgtattcacgctctcttttcatattaaacattatttatttatcatttatttagtaatatgctggagataaaacattctgacattgttttgacagttctgatttcttacccatttgagttcaaattagccttggagtattttctagctgtaatttaagctatctatactgattcattctctgcccacccttctttctccatattcctgtctctgctcaggtttacttattgtctcaggacacaacatactgctctggtaatatcgctgtcctccccattgccttgcttttgtagactttgtcctctgaggtctggcacaagttgcactgtttcattcttccatcttttattgattcttcctctcaatattcttcctctcaatattctttttcttcctattctatctttttctcccccttgatattctatctttttttctgttctgtctttttcattcttccatcttttattgattcttcctctcaatactctatagcacttaagtctataccataccatttggcacccaaccaaatttaattcaaatataacttataattagtatatcatgcactttgagttctttaatttgaatcctcctttttctgataatttagaataatatctatcacccttactgtttgggtggaaatatcaccaataagcacttttcatctaaaaaacttttaaacacccttttcctcccagtcacttaaaacccttaatactttctcatgtgacctgttaagccattatctgctctgttggtgattttaaaaatttaaaaaacatatcaatgagtgtaagtcattgttctctaagttctgccccagctttaggcttgagaaccatggcatctatctcatgagttttttccgagggaaagatagatggaatgttggaagggcagtttgtgtgtcatttatgaactttgtcttatcgtacttatggcaaacagaactaccactgagtaatgtttatttctctctaaatgttatagttttaaaaaatactcctttttgagcctatggtattttatgtacctgagctactagaatttatataaaaaattggtttaaaccacctaggatttacttacggccattaaaacttttaaattgaacaaccatgattatattatttaaaaataggatattaaaaggcagtgtgtggaacccacactgggcagtaattgagagatctaactctatgtgaccttagaaaaatttacattttgaggataatagcttccatatccacaaaatgaaggtgttaggggaaaaaagcacaggctttacaatctgacagacttggcttttaatcatcaaactgccattaactacagtatgatcttgctcagtcacaatatctaacccccatttcctcattcataaagtatgattaagtaccattaatagtacttaatcgtactttattaaatagtaacgtttcatgaaattattgtggatgctgagatatacatacaaaaccctttagcatagtgcctagcacagaataaataatgttaactattcttattcagtgacctttttggctattgtaaatgatgtccccacaaacttcagagaagactttgaattataagacatcataactttagtaatttgggtattgttgctaatgtttaggtaatgattagttttagtatgttgttttccagtgcaattacttaagaaagcttgtcttccttaagtattatcttccttggaaggtaatccagctcttgaaaatacccattctgtgtgagcctttctggaccttgctgtctaatttctgaaatgcacacggagtgttggtgagactgtaaatgtacttctttaattgtcacagtatttttcctttccctcacttaccctcctctcttttactcctctcccctcccttttacccccatagctaaaacatgtgacaccaatgctggacattttttatcaaatggcaggagaatttagtgtctgacaatttatgaagaagacactttgaaatagggatgtcagaacaagtctcaaaatatcccactcaggcactgtcttcttaacctatgcaatgctctctgaatcattggtctgaaattggattattctatgatagtataagatttagcttaacagtttcatgtttatttagaaaggctgtggaacatggaggttaggggttaaaatactatgaatgaaatttctgacattacactttttttctctttttcctgtgtattttaattctagcaaagcaaatgaggaaattagaatatccaaaactcatttaaaaaaattgtggtaaaatacatgtaacataaaagttcatgtaatcccttttaactgtacatttctgtgacattaagtacatccaaattgttctgcatctatcaccaccgttcatttccaaaaatttctcatcttcctcaactcaacctgtacccatgaaacactaactgctctttcccatgttcctagtctatggtaaccactgatctactttctgtctccatgaatttgactactttggaaccttctattagtggagtcatatactttttgtccttttatgcctggcttatttcatttatcataatatcttcaggtccatccatgttgtcatatgtcaaaatttccttcctttcaaagactgaataatactctattgtatttatgtgtatatacacaccacatattgtttattcatttattccttgatggacactgcgttgcttccacatttttgctactgaaaataatgctgctgtaaatatgcattggtgtacaaatatttctttgagaccctgctttcactttcgggtatatacccagaatccatccaattgttggatcatgtggtaattctgtttttaattttttgaggacgtgccataccgttttccacagcagctataccgttttacattcccactagcaatgcacaagagttcagtttctctatatcttcacaaacatttagcattttctgtttttctttttaataatagccatcttaaatagccatgggtgtgaagtggtatctcactgtgctttgacttgcattgccctaatgactagtgatattgagcatcttttcatatacctattggcaatatgtatatcttatgtggtgaaatctctgttcaaatccttcgcctgtttttggtgaagtacttttgacattacagtgtcagaggtgcctattacaacgtgcctgtaaactagctaggatgatgctacatactattgaacttgttgaagagagaaactgtaatccagatgcaaggatcttcgatggttgtttctcactgctacaattgtattttatgacttttaagtcatgacttttaccttttttaaaataataaaatagataatgtgtactgtgcatccaacttagtaatttaggggaaaaaggaaactaagggatgtagcaacaaaaaaatttataaactagaaattggaggaattaataactgcaagaatggtttataaaaagttatgaaatagagaaattgatagaactataccaagaaaaacaagagaactagggttaaaatcagcaaacacagactatataaaatgtaggtatttttataaattagaattctatgcccacgtggatgatagatatgtaaatctcaatgtaatgatatatacctgagtggcactttattttgctcaaatatgatctgtagggtctttgtattttagttatccagtagttctttcttctcagaaaaatagagtggatgttttcatccaatttagttttcagcataaaattttcttattttatttgtatatgtgtgtgtgatgtgaaataaatacacatttggtaagttagtttgatatcatgtaaagacttcagagaatagatatttatgtggcacaactttgcagagaataattttattagctttcttccctaatttgagctttcaaaaaaaacaaaaacaaaaacactgattaccgaaaatgtcaaagttgtttagtaaaaatagaaaaatgtgaggatagactatgcttgtacacaagggaactttaaaaagtttgtggaaaatggaattaaaagataaatataaaaaatataaactttagttctcaatataagctccatcaggaacaagacacttttgtaagcaatgataccaggcatttagttcatccctaaataactgagggtcctaggaatttaactatgtcagcgaaatctttttttattattattactgaagaaaaatgggttccttttacaaattttttgaggttaggaaacaaaaagaagtaagaaggagccaagtcaggactgtaaggtggatacctaatgatttcccatggaaactcttgcaaaattgcccttgtttgttgagaggaaatgagcaggagcattgttgtggtggggaaaggactctggtgaagctttcctaggtatttttctgctaaagctttagctaactttctcataataataagcagatggtattgtattttggccctccagaaactcaataagcaaaatgccatgagtattttgaattgtgaattttttgaattgttgctatgacctttacttgtaaccagtccacttttgctttgactggactacttccacctcttagtagacattgctttgattgtttttgtcttcagtactggtaaaggcatgtttcatctcctgttctttgaagaaaggcttcaggatcttgatcacagttgcttaaaatttccactgaatgcactgctcttgtctgcagctgatctgggtgcaacagttttggcacccattgagtggaaagtttgcccaactttaatttttcagtcagaattgtgtaagctgaaccagctgagatgtctatggtgttgcctattgtttctgctgttaatcatcagtccttttcaattagggcatgaacaagtttttttttttttcctcacaaattgatgcagatggtctgccactgagggcttcatcttcaacattttcttgctccttctcaaaatgagttatccatttgtaaactgctgatttctttggggcattgtccccataaactttttgtaatgattttgccattcttccatccagtcttcaccatagatgtttgttcttttttcaatttagtagaattcacattgctctgataggagcttttttcaaatggtcttatgcttctttgtgcttccaactaggtgctgttcagacatgttataacaagttaatacaagtttgttttggtgcaaatgtttttaaaatccatgcatagtttttaaataatatgtatttttcataaactttttgaagtctcttgtatttgatgacttctaccatggacattgaacaactatactgtttaacgctaaatctgaatttaatgatggatttggttttcctcttttaaatcatgtgtaaatgactattaattctattatgtgggttttggttatgctgcaatgcattgtacccatggaacagcacaactaatggctaatacttctaatgtgaggaatttaattcatctttaaaatgattataaataagtagcaatatgaaaataataataagaggtattaagttccttcatttttctaacagggtcaacatatttcactggcacctattcacaagcttgaagaagctctgtatgaataccagccactgcagatagagacatatggaccacatgttcctgagcttgagatgctaggaagacttgggtatgtgtcctaaagaactttacattgaggagctgatatgtgggacttattgctgttcttaactgacatgttaacattcttagattttcagtttatagaactttactgttttgtgaaaaatgaacagtactcaataccaaattgttttatttagtacattaatttttctgtggacttgttaggtctcttgagattgagcctggaatacattcgttcttttagaagtctgtccttggcagccatattgaaatggcgtttattttcagtcatgagtgtttttttcttttttaaagaaattggggcttaatttagttagtagtaagccaataaaaatatgaattgggctccttgccatgaaaaagggtagatttactcattgtgcactgtctacagtgaaactacatttatgagccatgagccatgaaatatattttgttgaaaggtataatgtaaggctggccctgtggttcaacagtcatattatatatatccattctggaaatgaacctgggatcctggcttttgtgagggatggagagatggttatagtctctctcatgggagcaagtgggtatttgtatacttgaaaagcgcaggcacagatgttgctagatggagcaaatcatttcttggtctgattttaaaatgtgaactattgaatgaaaggctgatccagaaactgttgttgcttaacaaaagaaaatagtggaaagaatatactgtgaaaaaaaagtgggtaaatcgagtccaagaaactaaaaagcaatagaaaaagtcagagaccccaagaacaaaaacaagaaagatgaaacaaataataaaacctacatgcatcttcaaaaacaaaaccaaaatctggaacatgttgcataatattttacatgtgaacatcaaggctccaaggtaaagttacatttaaatgatatttaatatcttaaggctaaattttattcagttctttattctcttaaagtcctacagcctgcaagcatgaagccaacaggatgtaaaacaacctaaaaccccctttgagataacagatttattaaacaattgtcttaaatgctaaaattgaagtttgaagagatagacaatattgcgttttataatgtaaaaagttatacatgatgtagacatttatttcttatctcttacaaagagccagaatcgtgtatctttaaaataaatttacttcaaaatctttacttttaatgtccgtgaagttcacgtgtttaaaatagtactcctctgttactaggttttgcattttccaataattttgtcaaaatttttcatatacagattttcttatgtccgggtagctttcttctgttcctagaatgttgaattattattatttttttcttgagacagagtctcactttgtcacccaggctggagtgcagtggtgcaatcttggctcactgcaacctctgcctcctgggttcaagtgattctcatgcctcagcctcccgagtagctgaggctgcaggcatgcaccaccatgcctggctaattattgtattttttgtagagacagggtttcaccatgttggccaggctggtctcgaactcctggcctcaagtgatctgcccaccttggccccccaaaagtgctgggattacaagtgtgaaccactgcgcccggcccatcttttaatatactgaattcagtttgctggtgttttgtcagggattcttgcattagtgttcataaaggatattggctcatagtgttttctagctttattaagatataattaaaaaagaaaaattatatatatttaagatagagaagatttttttaagtattaatttttgtgggcacatagtaggtatatatacagtgggctatgggagatattttgatacaagcatgtaatgtgtaataatcacattaaggtagatggtatatccattacctcaacatttattctttgtgttacaaagaatccaattatattattttagttattttcgaatgtacaattaaattatgattgactatagtcaccctgttgttctatcaaatactagttcttggccaggcgcagtggctcatgcctgtaatcccagctctttgggaggctgaggtgggcagatcacttgaggtcaggagtttgaggcaagcctggccaacatgatgaaaccccgactctactaaaaatacaaaataatagctgggtatggtggtatgcacctttaatcacagctacttgggaggctgaggcaggagaatcacttgaacctgggaggcagaggttgcagtgagccaagattgtgccactgcactctagcctgggtgacaaaaacaaaaacaaacaaaacaaaaccaaaaactggttcctattcattctaactatttttttttctacccattaaccatccccacatcctctcccacctcctcactacccttcacaacctctggtgaccttccttctactccctatcagttcaatttttagcttccacaaataagtgggaacatgctaagtttgtctttctgtgcctggcttatttcacttaacataatgaccaccagttccatgtatgttgtttcaaatgacaggatcgcataccttttttatggctgaataatactccactgtgtatatgtaccacattttctttattcagtcatctgttgatggacatgtagattgcttccaaatcttggctattgtgaacagtcctgtaacaaacatgggagtgcagatgtcattttgaaatactaattccctttcttttgggtatatacccagcagtgggattgctggatcatatagtagctctatttttgttttttgacaaacctcgaaactgttctccatactggttgtactaatttacatatccaccaacagtgtacaagattttcttttttccacatcctctccagtactcgttactgcttgtctttggataaaagccatttaaactgggatgagattctatctcattgtagttttgatttgcatttctctgatgattactggtgatgttgagcatttttacatatgactgtttgccatttgtatatcttcctttgagaaatgtatgttcaaatcttttgcccatttttaagttggattattacattttttcctgttgagttgtttgagttccttacatattctggttaataatgccttgtcagatgggtagtttgaaaatattttctcccattctataggttgtctctttgttcatcgatttcttcgctttgcagaagctttttaacttgatgtggtcctacttacctatttttgctttagttgcctgtgcttgtgggggtgttcctcaaaaatctttgcccactccaatatcctggagcgtttccccaatgtttaattttagtaggttaaatagtttgaggtcttagatttaagtgtttcatcctgatttgatttttgtatgtggtgagagttaggggtctagtttcattcttatgcatatggatatccagttttcccagtaccatattttgaagagattttcttttcccaaatgtatggtcttggcacttttgtcaaaaatgagttcactgtagatgcatggatttgttttgagattctctattttgttccattggtctctgtgtccatttttatgccagtaccatgctattttagttactatagctctgtagtatttgaagtcaggtaatataattcctgaagttttatatctttaaagtttctttaaagatagctttggctattctgggtcttttgtgattccatataaattttaggaattttttaatttctgtgaagaatgtcattggtattttgatagagattgcatttaatctgtagattgctttgggtactatggccattttaacattattgattcttccaatccatgaacatggaatatcttttgtgtgtgtgtgtcctcttcaattttttgcgtcagtattttatagttttcatagtagagatctttcacttatttggttaattcctaggtattttattctagctattgtaaatgggattactttcttgatttcttttttagattgttcactcttggcatatagaaatgctgctgatttttgtgtgctgattttgtattctgcaactttactcaatttgtttatcagttctaatagtttttttgtgaagtctttaggtttttccaaatataagatcatatcatctgtaaacaaaaataatttgacttactcctttctgctttggatgtcctttatttctttctcctgtctgattgctctagctaggactgccagttctgtgttgaatagcagtggtgatagtgggcattcttgctgtattccagatcttagaagaaagactttcagttttcccccattcagtatactagctgcaggtctgttatatatggctttcattatgttgaggtaaattccttttatacccaggtttttgagggtttttaccatgaaagaatgttgaattttattaaatgcttactcagcatcagttgaagtgatcatatggtttggtcctcactctgttgatatgatatatcatattgattgatttgcatatgttgaaccatccttgtattcctgggataaatcacatgtggtcatgatgagtgaatgatctttttaacatgttgttgaattcagcttgctagtattttgttgaggcttgcaaacactatcttataacccattattttaagctgatgacaacttaaggttgatagcataaacaaacaaacaaacaaataagcaaaatcaaaactagtaaaaactctacactttaactttgtccccttgctttttaactttttgttgttctatttatatcttattgtactacgtcttgaaaagttgtagttattatgtttaattgatttatcttttagttttcctacttaagagtagtttatctaccatgattacagtgtgggaatattctgtgtttttctgtgtacttaccattaccagtgaattttgtaccttcaggtgacttcatattgctcattaatgttcttttctttctaattgaagaaccccctttagcatttcttgtaagacaggtctggtgttgataaaaaccttcagcttttgtttgtccgggaaagtctttatttgtttctccttcatgtttgcagaacattttcaccggatatactattctagggcaaaagctttttccttcatgccagtctcttctggcctataaggtttccactgaagagttcgctgccagacatattggacctccattctatgttatttgtatattttgtctttctgcttgtagaattctttatccttgacctttgggagtttgagtgttaaatgctttgaggtattcttttttgagttgaatctgcttggtgttctgtaaccttcttgtacttgaatagttgaatattgatatatttctctagatttgggaaatgttctgttattctccttatgaataaacgttctaccctcatctctctctctgtctcctatttaggccccataactcttagatttgcacttttgaggctattttctagatcttttaggcatgcttcattgttttttattgttaattttgttttgttttctttgactgtattttcaaatagcttatattcaagttcactcttctgcttaatcaattctgctattaagagactctggtttttgtttgtattttcttgatgattagtgatgttgagcagcttttcatacaccttttggccattcatatgttatctttggggaaatgactattcaggtcctttgcccatttttaagttgagttatttggttttgtttgcctttgagctattcaagttctttatataatttgggtattaaccctttattggatgtatagtttgtatagtttgcaaatatattttcccaatgtgtaggttggtttttcattttgttgtttatttcctttgttgtctagagctttttagtttgatgtagctctatttgtttattttcagttttgttgcgtatttggtgtcttatccagaaaaccattgccaaagttaacatcaaggatctttctcactatgttttctcttaagaattttatggtttcaggttttatttttaagtctttagtccattttgagttgatgttttttaatatggtgtatgataagggccagtttcattcacttgtatgtgtatagttctctcagtgccattgactaaaaatattagcctttttccattgtatgttttcatgcccttatcaaaaattagttgactgcagatgtttgggtttatttctgggctccctattctgttccaatgtgtatatgtttgtttttgtgtcaataccatactatagctttgtaatattatctgatatcagcaaatttggtgtttccaactttgttcttccttttcaaggctgttttgttttttgtgggtattttgtggtttcatgtgaactttataatttttttctgtttgtattgaaaatgccatgagaatgttgatagggattttgttgaatctgtatactgcttttggtagtatggacattttaacaatattcctctattcttacggacatgggatttgttgccgtttatttatgttgtcttcagtgtttcatatttttcagtgtgtacagctttgacctcctttgttaaatttgttcttaagtatcttaatctttttgattaatcttttgattagcctttgaaaaaggctaatgtaatgttttgattacattacattaaaggctaatgtaatgttttgatttttttcagatatatcaatattagtataaagaaatatagctgatttttgcatgtctgttttgattacaaaaaagctaatgtaatgttttgatttttttttcagatacttcactattagtataaagaaatatagctgatttttgcatgtctgttttctatcttgctactttattgaattcattttctaattctaactttttggtctaatctttatgattttgtacatataggatcatgtcatatgcagagaggcataattttacttcttgatttcctatttggatgtattttatttttcttgtctaattgctctttataatacttccaattctatgttgaatgtaattgatgaaagtggacgtccttgtcttggggtcaggcaaaaactgaaaacttttcctctgttgattataatgttaggcataggcctttcataaatgacctcaattttgttcaggacattttattctaaacttattttgttgacagttgttatgaaaagattttgaactttgtcaaatgctttccctgcatatatattgagatgatcatgtggtttttatttttcattctattgatgagttgtataacattgatttgcattttttttgttgttgttgttacatatcagagctgtttttttttcttgtttttgtttgttttttgtttttattttattttattattatgctttaagttttagggtacatgtgcacaatgtgcaggttagttacatatgcatacatgtgccatgctggtgtgctgtacccattaactcgtcattgagcattaggtatatctcctaatgctatccctcccccctccccccaccccacaacagtccccagagtgtgatgttccccttcctgtgtccatgtgttctcattgttcccacctgtgagtgagaacatgtggtgtttggtttttgtccttgcgatagtttactgagaatgatgatttccagtttcatccatgtccctacaaaggacatgaactcatcatttttcatggctgcatagtattccatggtgtagcagaactgcaggaaatagagacacaaaaaacccttcaaaaaattaatgtatccaggagctggttttttgaaaggatccacaaaattgatagaccgctagcaagactaataaagaacaaaagagagaagaatcaaatagatgcaataaaaaatgataaaggggatatcaccaccaatcccacagaaatacaaactaccatcagagaatactacaaacacctctatgcaaataaactagaaaatctagaagaaatggataaattcctcgacacacacaccctcccaagactaaaccaggaagaagttgaatctctgaatagaccaataacaggctctgaaattgtggcaataatcaatagcttaccaaccaaaaagagtccaggaccagatggattcacagctgaattctaccagaggtacaaggaggaactggtaccattccttctgaaactattccaatcaatagaaaaagagggaatcctccctaactcattgtatgaggccagcatcatcctgataccaaagctgggcagagacacaaccaaaaaagagaattttagaccaatatccttgatgaacattgatgcaaaaatcctcaataaaatattggcaaaccgaatccagcagcacatcaaaaagcttatccaccatgatcaagtgggcttcatccctgggatgcaaggctggttcaacatacacaaatcaataatcataatccagcatattaacagaaccaaagacaaaaaccacatgattatctcaatagatgcagaaaagcctttgacaaaattcaacaacgcttcatgctagaaactctcaataaattaggtattgatgggacatatctcaaaataataagagctatctatgacaaacccatagccaatatcatacagaatggacaaaaaatggaagcattccctttgaaaactggcacaagacagggatgccctctctcaccactcctattcaacatagtgttggaagttctggccagggcaatcaggcaggagaaggaaataaagggcattcaattaggaaaagaggaagtcaaattgtccctgtttgcagatgacatgattgtatatctagaaaaccccatcgtctcagcccaaaatctccttaagctgataagcaacttcagcaaagtctcaggatacaaaatcaaggtacaaaaatcacaagcattcttatacaccaacaacagacaaacagagagccaaatcatgagtgaactcccattcacaattgcttcaaagagaataaaatacctaggaatccaacttagaagggatgtgaaggacctcttcaaggagaactacaaaccactgctcaatgaaataaaagaggatacaaacaaatggaagaacattccatgctcatgggtaggaagaatcaatattgtgaaaatggccatactgcccaaggtaatttatagattcaatgccatccccatcaagctaccaatgactttcttcacagaattggaaaaaacttactttaaagttcatatggaaccaaaaaagagcccgcatcgctgagtcaattgtaagccaaaagaacaaagctggaggcatcacactacctgacttcaaactatactacaaggctacagtaaccaaaacggcatggcactggtaccaaaacagagatatagatcaatggaacagaacagagccctcagaaataatgctgcattatctacaactatctgatctttgacaaacctgagaaaaacaagcaatggggaaaggattccctatttaataaatggtgctgggaaaactggctagccatatgtagaaagctgaaactggatcccttccttacaccttatacaaaaattaattcaagatggattaaagacttaaacgttagatctaaaaccataaaaaccctagaagaaaacctaggcaataccattgaggacataggcatgggcaaggacttcatgtctaaaacaccaaaaaaaatggcaacaaaagccaaaattgacaaatgggatctaattaaactaaagagcttcttcacagcaaaagaaactaccatcagagtgaacaggcaacctacaaaatgggagaaaattttcacaacctactcatctggcaaagagctaatatccagaatctacaatgaactcaaacaaatttgcaagaaaaaacaaacaaccccatcaaaaagtgggcaaaggatatgaacagacacttctcaaaagaagacgtttatgcagccaaaaaacacatgaaaaaatgctcaccatcactggtcatcagagaaatgcaaatcaaaaccacaatgagataccatttcacaccaattagaatggcaatcattaaaaagtcaggaaacaacaggtgctggagaggatgtggagaaataggaacacttttacactgttggtgggactgtaaaccagttcaaccattgtggaagtcagtgtggtgattcctcagggatctagaagtagaaataccatttgacccagccatcccattactgggtatatacccaaaggactataaatcatgctgctataaagacacatgcacacatatgtttattgcggcactattcacaatagcaaagacttggaaccaagccaaatgtccaacaatgatagagcggattaagaaaatgtggcacatatacaccatgatttgcatttgttaaaccaaccttgcatcccaggcataaatttacgtactcatgatgtaaaatcttcttggtatgttgttgattgcatctcttcatctgagatactggcttttagttttcttgtagtctctgtctggcttttatatcagaatgtatagtcagggttctctagagggacagaactaatagatagatgtatatatgaaggggagtttattacggagtattgactcacacgatcacaaggtgaagccccactatacaccatctgcaagctaaggagcaagggaggaagccagtccgagtcccaaaatctcaaaagtagggaagccgacagagcagccttcagtctgtggccgaaggcttgagtgcccctggcaaaccactggtttaagtccaagagtccacaagccgaagaacttggagtccaatgtttgaggacagaaagcatccagcatgggagaaagatgaagtctggaagactcagcaagtctgctctttccaccttcttttgcctgctttattctagccacactggcagctgattaggtggtgcccacccagattgagaatgcgtctgcctctcccggctcactgactcttgttagtctcctttggcaacaccctcacagacacacccaggaacaatactttgcatccttccatccaatcaagttgacattcactattaaccatcacacagagtatagaatgagttagggagtgtttcttcctcttcacttttttagaaacatttgagaaggattggtgatagttcttctttaaatgtttcatctaggttacccagtttgctcatagttctctcatataatcctataatccttttaatttctttagaattggtaataatggctccactttcatttctgattttagtaatttaagtcttctctcctttttccttagtctatttagcatttctgattttactaatttaagtcttctctcgttttttcttagtctgtttagctaaagatctggtaattttgttgatctttttgacagaatcacctcaatttatttatttttctcttttttctattctctattttgtttatttctgctttaatcttcattattttcttttttctgctagttttaggtttagtttgttcttctctttctagttccttaagtgtaatgttagattgttgatttaagacttttcttgttttgtttgttttttttttgagacaaagtcttgctgctctgttgcccacgccagagtgcagtggcatgattcagctaactgcaacctccgcctcccatattcaagtgcttctcctgcttcagcctcctgagtagctggaatttacaagcgtgcaccaccattcctggctaattttttgtagttttagtagagaccgggttttaccacgttggccaggctggtctcgaactcctgacttcaagtgatctgcccaccttggcctcccaaagtgctgggattacaggtgtgagacactgtgcttggtcagatttttcttgttttttaatgttagcactcatagctataaattttcctcttagtactcttttgctgtgtcccatacgttttggtatggcttgttcttgtttttattcatttccaactattttctaattttccttgcgattttttttgaaacattggttatttaatagtgtattgtacgatttctacaaatttgtgaattttctagtttttcttccattattggttgctaacctcatcctgttatgattggggaagatactttgtatgataccaattttttaaaaatttattaacacttaaattatggcctaaaatatggcctgtcctggaaaatgttccatgtgcactttagaggaatgtgtagtgtattttcttgtagttgagtatagtgttccatatatgttttttcagtccagttggtttattctattgttcaagtcctctgttttatttatcttttgtctagtttttctatctattattgagaggggagtattgaaggctttaactattattgtaaaactctccctttggttcatatgttttgatggtctgttattaggtaagtaaatattttaactaatatgttatgttcttttgtcttatgaacacttaaagttgaaaatctgttttgcctcatattagtatttacctctgttctgtttttgttactattcgcatggaatagcctttttcattcttttacttttaacctatttgtgattttgaatccaaagttagtttcttgtagataacatatagttggatcatggttttatttattttttatgtattctaccaatttctatcttttgattggagggtttaattaagccacatttaaagttattactgataaggatggtcttccatcattttttatttgttttacatgtgccttatagctttttctcccttatttcctatataactgttttctttgtgtttattttttagtgccacattgaaattctttgcttatcctctattgtgtatattcttgagctattcttttgtcattatgatgattacatttattatcctaagttgtagcactctgaatttatacaagcttaacttcagtaacatgcagaaactctgcttttaaacagttctgtcctcaccccttttagttgacagcaccacagaattacatctttatatattgtgtgtccaagattattaataaattatttttttaaatgtgttagtttcttaaattatgtagaaaacaaaatgtgagttataaaacttagtaataatactggcttttagactaatttttttaaaaaagatattagtctcttaaatcttacaatgttataccttttgattatcttttttacttacacctcttgtatgctctattttgtgctttttaattttttaaaaaagtttgttttaaaagttaggataatttctcttgtcccatcttcaagttcacttattcttctattttgcccattctgctgataaggccatcaaaggaattctttttaatattgcaatttttatatctagtattttcattcactttttaaaaatgattttcacttcttaaattccctacctgttcatacatattatccaccttttccattagatcctttaagttattaatcatagtattttcttaactcctcctcttatctttgggtttgattctgttgactgttttgtgtcctcatgatacatttgttttcctgtttgttttagttattatttgaatattggacattctgtatgacagaatagtagattctgagataaataatatttatgcacagaaatatttacatgcctttttctgctaggccattagtgtcaagagctgagtattctgtattttgatcttggttttggttttttgttgctccagttcctatcaatgtaccacaggcttcaaattcatctagtcacaatttattgccaccttgcttttagtgtgaggcctggagtgctggaaggagttttctaggttttcttgttctaccctctagttttcaacaggctctgtaagcctgagccacagagggcttctctcttggtgttgctcccctatagtagattgcccttgctttttacttagaataagtcttatggtgggaagaaggtttttcttgcttctccttttccaacgttagtcataggaggacctgtgtgcctgaggatcaggatggtgctttcttagtgttcctacttctttcccagaggccaacaatttgtatctgttacttcagggtacaggtggcttttctgtccctccccagactcgcaactgaagtttgtcttgttttgttgcaggtggggaatcttgggcacagggctgtttcctgcctctcccctagacttatgctttgcatcagtgtaggaccctaggtgtgagttggtttcctgcctttcctcagtggttggtttctctttcctgtttcaatgtaggactaggaatgcgggcagtaggttttctacccctcctccattggcacccaatctttgctcctccgtagcagtggaggcttggatgttttttttttttaaaataatttatttcctcttgcatttagtgcttcattattgctgattttattgggtctgtttcatggaatatcctcctcatctttcttttttagtcttctatggtggtggtacttcttagaacatgaagatttaaataagggttagaattccctgtaaagtaggtttagcctgattgtctattttttcccagtaagttattaaattaaataaacttgggcaacactttgtttggagccctttttgtgtttctttctgcctttacctctatgggttggagttttaaatgtaggatgtgtcctttagataaggtataaccttagtgttcttacttttcccaagtttttcatacttaacatctgatttgaagggagggaggagcactttttgtgtgtttgtgtgtgtgtctgttggtggtggtggtggtggtagggccttcatcaagcattgaatatttataatacaattagttccaagatcctagaagtagacttttgtctttgtccataaagactgtacatacattttatatctacaacagttaaaaaggcaaattgttacgattacaaataaacatgtatacacttcaagcagtaaatcttggccgtaacagtttcttttagccatctgtggctaaatagtgaaggaatttagataattagtagtgatatcagaattgctaaataatttgttttttttggtccaggaactatttatctaccaaaatagaatgtgtaactcatacttcccttctcttcagtcttctaccttgacaaagggattacattctatacagaggactttagttattagagccaggattagctcaagctttctctttgttgatatattgtggccttatacttagatatgtgccaaagtaaatcctaaattgagttcttgtatcagaagttaactttcttttctggaattattatctgaagctatctgctttcttattgtttttcttattactgtagacctaaaaatatatttttacctaactaaatttttagaaacatttagaaaggaactgaagaagttgctttgtgaagtgacttttcaaagaatgatttgaggtgctgttcataaggtatgaggataaggtatcagttttgtaaagctgtaatattttcacattcatcctaacagttgtccatgtcgttgctagaagattacatctaataagctccagttatccctttacaatggtctttcccccaacccaaaacttctagcctctagtgctctctcctttcctttccttattgtaacaaaatttccattttatattctgttttcctacaaagggaactagtttaatttctctagaggcaaatagagaatacatcaattatctcagccatgtgtggtagctcatgcctataatcctagcactttgggaggctgagttggaaggattgcttgacaccaggagttcaagaccagcctggtcaacatagtgagactctgtctcaacaaaacaaaacaaaacaaaacaaaagaaatcatctcgtttccgttttccaatatctgcgttgaaactatgtgacatggtgaagttaagagtagtacagtttttttgtagctacaccttatttgtttctaaaatgtggacacaggcactttcaagataattttaattatgtatttttgggagtggatgacataaggtcttgggaggcattggtctcccaagaactatatttttgttcttttataaaactttgataaggaataaaaccaaaagaatactgcgttgagatttttaggtgattgttactgagatcttttcacaatgaagttagttaaactagagaaatagatgaagaatatttgtgaatttctcattcacagggtatcattagtaaataattataactcaaattgtactggcagtactcttctggtgtgctcaaaacaatacataaacatgttttattctgtgccagtgggagcaagcagtgggaaaacttaactgctaattgaaattccctagattatggccatagtggttagtttaggaaagtctaattgattgtcaatgtgagactctctttttaataatcatctagctttctagttaatattttactaccttccactcaaagaagagttattcccttaattgatacaaatcatgagcatttgtgacacaactagattcatccatttcaagttattaatcaaatataactactgtcttcttttttctttttgaaatggagtctctattgcccaaactagagtgcagtggcgtgatctcggctcactgcaacctccgcttcctgggttcacgcaactctcctgcttcaaccttctgagtagctggaaaaacaggcgcacaccaccatgcctgtctaattttttgtatttttagtagagacggggtttcaccatgttggccaggctggtctcgaactctgaccccacgtgatccacacgcctcagcctcccaaagtgctgggattacaggcatgagccaccgcgcctggccataactactattttcactaagtatacaagtgatttatttaatgtgagctgttcatttgtgaatgattatggaaataaaaaaaaaagacttgttggcaaagtgttgaatagataactttattgttattattttatttctttcatgtactccagcagataaagataatgtaccttctgaacctactcttaaaattcccaagaaatcaattgacagattagttataagtaagaaatttaaaacttgattttaaacatttataatttatatccgcatgattttttgtaaattttggtttggattcttagaagttcatatcacattttaatgaatgtttatgagtaaatttctgtattactcaaatacttgaatagtgaaaaataattaaaaattacagagtatttaaggtagatataaatttgtcatatatatggtttcaggcaaactttgataccggccatgaaaatactacatgatgaaatatttaagtagtttcatataagagttacggttttattaaaagcactgctagtttatatttatgtaaatatatgcattatgtaaatacataatttatatatatctttaaatttctgtgtaaaataatcatatgtaaagctgagaagtaagaatgacttctctaatatgatatttcagaatgcctttctcagttttatgggaatatctattactttcattctatgacatgttgtgacatttttatgataaaatatctttatttaaggtgtgtattcttaaattttccttatgcatgatttaaatgaagctgtttgctaccaaaattctgcagaatgaaatttttttcttttactgatacataatattttacatatttatggggtacatgtgaatatttttacatgcatagaatgtgtaattatcaagtcaggatatttggggtatccgtcaccttgagtatttattatttctatgtgttggtaacctttcaagtcctctcttctggctacttagaaatatataacatattgttgctaactgtagtcaccctagtctcttattgaacattagaacttatttcttctatctaactgtaagtttatactcattcactaacctctctttatttttcctttccgccctcacacccttcccagcctctgctatattctagtgtctatctccatgagatcaagtttttatgtgagtgagaacatgcaaaagttgtctttctgtgtctgatttattttacttaacctgatgaactccaattccctccatgttgctgcaaatgacgtggtttaattcctttgaatggctaaatagtaatacattgtgtgtgtgtgtgtgtgtgtgtgtgtgtgtgtgtgtgtgtgtgtgcgcgcgccacatttttttaatccatttgtccatagatggatacttagattgattctacagtttttgctattgtgaatggtgttgtgatgaacatgtaagtgcaaggtgtccttgatatactgatttcttttcctttggttagatacccagtagtgggattgctggatcatatagttctattttaattttttgaggaatctccatactggtttctgtaatggttataccaatttgcattcccaccaatagaatcctcttttctctgtatccttaccagcatgtgtaattttttgtctttttaataatagccctgctaactggggtaagatgctatctcattgtggtttatatttgcatttccctgatgattagtgatgttgagcattttttcatatacctgttggcatttgtatgtcttcttttgaaaaagtttctattcatattctttgcctactttttaatgagattacctttttttattgttgaattgagttctttgtatattctagatgttaggtccttgtaagatgaatagtttgcaaatattttctcccaatcaacatcttgtctcctcactctgttgattgtttcctttgctgtgcagaagtttttagtttaacatagttccatttgtctatttttgttttacttacctatgcttttgaggtcttagccataaaatctttgcctaaaccaatgtcctcaagtgtttcccctttgtttttttctagtagttttatatcatctggtcatacatttaagtctttaattcaccttgagttgatttttgtatatggtgagagataggagtccagttacattattctgcatatgaatatccaattttcccagcaccacttattaaagaaggaattctttccccagtgtacgtacttggtatcattgttgattattaattggccgtaaacatgtggctttatttccgggttctctattatgttccactgatcttgtagaatgaaatttttatcttaatttcatgtagagcttgtctttatactgctttgtggtagctacaatgctctatcacaaagcaatacaaagatatagatgcacgtacttatttctgtcttatgttgacataactggcataagttctgtactatcaatcagcaaactttaaaaatgatttttaactgtgaaggtttaatgtcctgagtcacaagacatgataatatctattattatatcatcagtagtgaaaataattgtagtagttatgatgatattgaattaagtcagttaattagaacctgatggtaattagaagaaaatttcttgcttgatctctattagcagagaatatctaactattattatatcatcagtagtgaaaataattgtagtagttatggtggtattgaattaagtcagttaattagaacctgatggtaattagaagaaaatttcttgtttgatctctattagcactattaattttgttttcttgtgtggccatagactgcattcataaaaaccaacttgctgagcaaaagtaattgattatcacaaatctattactcttattggcaaagcaattaaaaaatctatgactcttgaagaaatagaatagggtccagttcacaaaaatacaggtgtacctcattttattgcatttcgttttattactttttgcaaatattgcaagtatatcaatgctgtttttccaacagcatgtactcacctcatgtctgtttttcacatttggttaattcttacactatttcagacttttgcatgattttatctgtgtggtgatttgtgattagtgatcttttgctgttactattattattgttttggttgccacaaactgtacccgtataagaaggtgaagttaataaatgtgtgtgttctgactgttcttctgactggctgtttccccatctctctctctctctctctctctctctctctctcttaccttggacttccctattccctgagatgcagcaatattgaaattaggccaattaataaccctgcagagggttctgtgtgttcaagtgagaggaagggtcacatgtctctcactttcaatgaaaagatagaagtgattaagcttagtgagcaagatatgtcaaaaaccaaaataggcaaaagctagacctcttgtgccaaacagccaagttgtgaatgcagaggaaaagttcttaaaggaaattaaaagtgttgctccaatgaacacatgaatgttaagaaagcaaaacagcctgattgctgctatggagaaagttttagtggtctggatagatcgaagaagcaagaacaatcccttaaaccaaagcctaactttctttaatcctatgaaggctgagaaaggtgaggaagctacagaagaaaattctaaagctaacaaaggttggttcatgaaatgtaaggaaggatgccatttccgtaacgtaaagtgcaaggtgaagcagcaagggctgatgtggaagcttcagcaagatctaccaagatattgatgaaggtggctactctgaacacagatttttcaatgtagatgaaacatccgtctattggaaggagatgccatctaggattttcatagccagaaagaagtcagccacttatggtagctcacacctctcattccaggattttgggaggctgaggcaggcagatagcttgagcccaagagttcgagagcagcctgggcaacatggcaaaaaatacaaaaattagctaggcatggtgatgggaggtagctactcaggaggctgaggtgggagaatcacctgagcctggggaggttgaggctgcagtgagccatgatcatgtcactgtactccagcctgggtgaccctgagctggagtgtagtgatgtgatacagtgagagcctgtctcaaaaaaaaaaaaaaaaaaaaaaaaaaaaaagtcaatgcctgtttccagagcttcaaaagcaagtctgactctctttttaggagcaaatgcagctggtgactttaaattgaagccgatatttatttgccattttgaaaattgtagggcccctaaaaagtatgctaaatctactctgcctgtgctttataaatggaatgaaaaagccaggatgacagtgtgtctgtttacagcatggtttgctgaatatttgaagcccactcttgagacttactgcttcggaaaaaagagatttctttcaaaatactgctactcattgacattacatctggtcacctaagacttctgatggatatgtgcaaggaaatggatattgttttcatgactgctagcacaacatccattctaaagcccatggatcaaggagtaattttgacttttcagtcttgttatttaaataatatgtttcatagtgctatagctgccatagatagtgattcctctgatggatctggatgaaacaaattgaaaaccttctggaaacaattcattactctagaagccattaggaatatttgtgcattaggaatatttgtgatccatgggaggaggtcagaatatcagcattatcaggaatttgaaagaagttaattccaaccccatgtttgagattttgttggaagaagtaaccgcaaatggggtgaaaatagcaagaaaactagaattagccgtggagactgaagatatgactgaattactacagtcttataataaaacttgaacaaatgagaaactgactctcagggatgagtaaagaaagtggtttcttgagatggaatctgctcctggtgaagatgctgtgaacattgttgaaatgacaacaaaagatttagaatattatataaactgagctgataaagcagtgatagggtttgagaggattgcctctaatttttaaagaagttctgctgtaagtaaaatgctattaaacagcattatgtgctacagagaaatcttttgtgaaaggaagagtcaatcaacgcagcaaactttattattgtcttattttaagaaattgctatgacctccccagtcttcagcaaccaccattgtgatcagtaaagcagatatcaacatccaggcaagagctttcatcagcaaaaagattaggactagccgatggcccagaggatcattatcatttttcattaatacataatctatttatttgggattttaactacatttgcaaaatcattttttatatataatataatcacagcaatgaagactgtcaaattgatggtcctatttatacccaaggactgagaattatgcaaggaatggatacaacggggtagaatattgagggccatgtctaaattctgcctactacaagcgagataggttttctcttgctacttatctttctcaaaatattctaagcatttttatacatttatactttgaagtaaactttgttggcaaaagcaacaaagcactccataattgtttcaaaatttgtgtacatttgaaaatttttataaaatactgtgaatcaagtaatgaaacatcaaaagccaccaacaacttagctaataagatacatccatccccctatatagtaatcaaacaccaatccttttgggattgtacctggaatttaaacttacaatctgatcagagaagaatgggcatttaaaatatacttagtttttatatatatcacacatttcttggaaattaattttcattatattctacttttgatgctgttgtgataaagttttcatcatgctttctaactggttcttgctgttatatatgaaaactattaaatgtaattttctacataatattttactgaattctaatagtttctatacctagttctattaggtgaatatctgggtttttatctaggagtcagtcagctgaaaaaaaattttttttcttttcaatgctatatttgtgactttaggtttatattttattgtattttggctagaacttgtagaacttttagaccaagtataattctaataactgtagtttctttctgtttttttttctggtgaatgcctcaagtgtttcatcattaagtattatattcgctgtttaagtgtttttttgtatcacatatatgtattttctaaatcacaatgaaggaattgcatcatgaatatatattaaatcttcgtcttcacatttaattttattgaatgcttttatgcatctattgatgtagtttttgaacctaatggtgtataatattattaaaaattttttcaatagcaagtacttcctatattcctagatagctacctacctaaaatagcgtttgggaaaggtagaatttcagctgaaaacttcaagttcaggaaatttgttttaaatggattagtttacgttctaccagtgaaaaataattgaggcaatctataatactttaaaaatcttaacacttaagaaatttaaatttaatcagctatatgaaagcataattcacatacaataaaatacctattttattgtatattccaatgagttttgacaaacacatccagtttgtaaccaccagcacagccacgatatagaatatttgtataatctgctttcactgtgattgtgcttttttctggaaatcacttagaatttttacatatgaaagtgttacttatattccaaaatttccatgagagaatgtggcattctgtatactgctttttggtcatagtctttaccttcgtctttaccttataatattgacttattatatatggattgtgtaagaatggtgaaaacgtagttgtttcatttaagttttgttttgtttttgatgctacccatgtaagtttttttttttttttttttttctttttgatggagtttctctctgtcgcctggctggagtgcagtggcacaatcttggcctactgcaacttctgcctcccacgttcaagcaattctcctgcctcagcctcccgagtagcggggactgcaggcacccgccaccacatctgactgatttttgtattttttagtagagatggggtttcaccatattggccaggctggtcttgaactcctgaccttgtgatccacccgccttggcctcccaaagtgctgggattacaggcgtgggccactgtgcccgaccttaagtttatatgttagttttacagaaagtcttggggcatcagaaaatcaaagaatgtggaaaaatacaaaaatcacaaaaaaactgcaatatgcatgtgtatataacatataatttatactatacttggtggtaattatgaaaatattactaaattaatttttttttctggttatgacagcaaaatgtctttagtatttgtttttttgtttgtttgtttttgggggcatttaaattagaaatgaactcacatatctaacatgaatctttgtgcttaaaattctaacctggctctagtcttgcaagttttaaatcttttttatgcagttatggaaaaaatatgtttctgcttgaagcagttgtcaaacaatcttctttcatcaacagtcagacacagggcagctgaatgaggctgtttagtctagagtgaatgctcatgagattacaaggtcactgaggaaatataattgtgtagttggttccagaatagttttttgtagtgaggacttaaattataacatcaatttaaaaatatataaaatgagatatattctaaaattaatctcagaaagaaagcactaagttaaaaaaagtaaattattacaataaaatgttttaatttatatttttacaggacccttaaaaaagcagattcaatttattattggactttgtttacttctcccgtatcgtggtagaattcagtagatcccgtggatcttatttaaaattgtctccattgggaaatgaaacctcattgtatagctcaggttaactgagaaaacaatagattgttcagcagttcctttttttttttttttttggacggagtctcgctctgttgcccaggctggagtgcagtggcatgatcttggctcactgttcagcagttcttttacttttgttattcatttggttgtcggttagcaaatagttatgaagtgcctactgtgtgccagttactgttctgggtgctgagaaaacagtagtgagccaaacagaggagtaaatgtctactatcatgaagcttaaattctcctgtaataaaaccaacaataacagtacattattgaatctgttaagatgctgttagatgtttctatgaaagatctaacatttgagatgaaacttaaaattcaactgtaataaaaccaacaataacagtacattattgaatatgttagatgctgttagatatttctaatattagaaacacctgttagatatagcagataaaccagggttttccagagaaagaatcaataggacatttagagatacataagaggatgttcatgtttggaattggctcacatgattatagaggctgagaagtcccatgatatgctatcagcaaccaggagaaccagggaagttcatagtataactcacgctgaatccaaaggcctgagaattaagggagccagtgatgtgactctcagtttgaggttgaaggcctgagaatggagacttagcgggggtggaggtgaaagtcatggagtatgaaggcccaagaaccttgagttatgatgtccaaggacagagtaaatgtcccagctccagaagaaagagtgaatttacacttccttcgtttttttgctgtgttcaggccctcagctggattggatgacatccatccacattggtgagggtgtatattttgtactaagacttttgattcaaatgccaatcttttctggaaacaccttcacagacgcacccagaaataatgttttaccagccatcaggagatcctttagcccagtcaagttgacacataaaattccatatgataattagtactttgaagacaaataaaggataaaaggatggatagtgattggagtagtgtgctatttttggtgattgaaatcttttgtaagatggtattttagcaaatacctgaattagcaaagaaatgagtcatttgatatccttgggagagtcagcaggaactgtaaatgcaccagtgggaatatgaataaggaagaggaaggagtgcagaatgtctggagcaggagtaaatatagggaatggtaggagaataggttcagagaggtagcaggtttttatgtaagggggcaggctagacctagttgatgatacaggtctttatagaccatggtcaagacttgggtttttactttgaaggagatgcgaagtcataggagaattttgaacagaagttgccataatattactttcatctagaaaggtctgtcatcagagagtagatggtgggcaatggtggcaaggggcagcgtgaatgcaagaaaatttgcagtagtcctgctaagatggtagtggcttgtcccagcatggtagcagtatagttcataagaaagtggtcagattatggatataattttgatagcaggggcaaaataatttttgatggattggttaaggggggtatgaaaaagagaagattacttccaaggtttttatctgagcaaatggttgctcctagggttttatctgaacaacaaagctgcaagcaataaggggttgtgttgtttatagagattttttaaaataataaaactgaataaaagtctttttaaaatgaacatgtactgacagttctaaacaatgttggttttcaaatactcgtttctgaaaaaatcttttgttggtccaagttctcaaaaatcactgtaattacttttaaatctaatagtatatatgtaagctattaacatctttatttctcgttctttaataacattttatgtatgcagaaattagttcagagaactttgagttttacaatcatccccaagctccacctttccaccccccaaccccaatagccacaaacttagctatatttagcctcactcaagagtaaatttatatggttttggaatttttcaagctcctttctaacaaaatttctatttttaactcccctatggtactacatattgctgagttagtacatttgaagtaaacagtgttagctcagtgattataaagatgaagaaacagctggacacggtggttcacacctgtaatcccaacaccctcgaggcaggtggatcatgaggtccagagttcgagaccagcctggccaacatagtgaaacctcgtttctactaaaaatacaaaaattagccgggtgtggtggcacgcgcctgtagtcccagctactcaggaggctgaggcaggagaatcgcttgaacctgggaagcagaggttgcagtgagctgagaccatgccattgcactccagcctgtgtgacagagcaagactctgtctcaccaaaaaaaaaaaaaaaaaaaagatgaagaaacagaacttaggttctgagaagttttatttgtgtttaaagttttcaattgtggggacatttgaaagttcctagaatcaggcctaagcgggcagatcacctgaggtcgggagttcaagaccagcctgaccagcatggaaaaaccctgtctctattaaaaaaatacaaaattagcagggcatggtggtgtatgcctgtaatcccagctactcacggggctgaggcaggagaattgcttgaacccaggaggcagaggttgtggtgagccaagattgtgccattgcactccagcctggacaacaagagcgaaactgtgtctcaaaaaaaaaaaaaaaaaaaaaaagttgctagaatcaattttaatgaaacaaagattgcaacagtattgcactttctagaattaattgtgaaataaaattttttatattctgccaaactcatccttatcactaagatatttcctagttatctgaatatctgtttcttcagataagaaacttttgtaattaaaattaacaaaaagtattctccaggtgactatgagcagagataaattgatgaatctaactataacatctattgaacataactatgtaaaaacaaccaattttaatgcactcattgacaaatctgcagaagtcaaagctcaaaacaaattataatgtgatagtccattttgtgcttataaattgtgccatttttaaaaaattaatagatattttagtttgttacttatttctttcatgatataaagattattttacgtttaaatttttttattggaataattatgtgtacaaagtgctataaaaggaaagcctcactgtgtgctttttctggattgttatttttttctttattttttatttttattatactttaagttttacggtatatgtgtacaacgtgcaggtttgttacatatgtatacatgtgccatgttggtgtgctgcacccattaactcgtcatttaacattaggtatatcttctaatgctatccctcccccaaccccccgaccccacaacaggccccggtgtgtgatgttccccttcctgtgtccatgtgttctcattgttcaattcccacctatgagtgagaacatgcggtgtttggttttttgtccttgcgatagtttgctgagaatgatggtttccagcttcatccatgtccctataaaggacacgaactcatcactttttatggctgcatagtattccatggtgtatatgtgccacattttcttaatccagtctatcattgttggacatttggcttagttccaagtctttgctattgtgaatagtgccgcagtaaacatacatgagcatgtgtctttatagcagcatgatttataattctttgggtatatacccagtaatgggatggctgggtcaaatggtatttctagttctagatccctgaggaatcgccataccgacttccacaatggttgaactggtttacagtcccaccaacagtgtaaaagtgttcctatttctccatatcctctccagcacctgttgtttcctgactttttaatgattgccattctaactggtgtgagatggtatctcattgtggttttgatttgcatttctctgatggccagtgatgattagaattttttcatgtgtctgttggctgcataaatctcttcttttgagaagtgtgtgttcatatccttcacccactttttgatggggttttttgtttttttcttgtaaatttgtttgagttcattgtagattctggatattagccctttgtcagatgagtaggttgcaaaaattttctcccattctgtaggttgcctgttcactctgatggtggtttcttttgctgtgcagaaactctttagtttaattagatcccatttgtcaattttggcttttgttgccattttttttggtgttttaaacatgaagtccttgcccatgcctatgtcctgaatggtattgcctaggttttcttctagggtttttatggttttagatctaacatataagtctttaatccattttgaattactttttgtataaggtgtaaggaagggctccagtttcagctttctacatatggttagccagttttcccagcaccatttattaaatagggaatcctttccccattgcttgtttttctcaggtttgtcaaagatcagatagttgtagatatgtggcattatttctgagggctctgttctgttccattggtctatatgtctgttttggtaccagtaccatgctgttttggttactgtagccttgtaatatagtttgaagtcaggcagcgtgatgcctccagctttgttcttttggcttaggattgacttggcgatgcgggctcttttttggttccatatgaactttaaagtagttttttccaattctgtgaagaaagtcattggtagcttgatggggatggcattgaatctataaattaccttgggcagtatggccattttcacgatattgattcttcctacccatgagcatggaatgttcttccatttgtttgtatcctcttttatttcactgagcagtggtttgtagttctccttgaagaagtccttcacatcccttgtaagttggattcctaggtattttattctctttgaagcaattatgaatgggagttcactcatgatttggctctctgtttgtctgtgactggtgtataagaatgcttgtgatttttgtacactgattttttatcctgagagtttgctgaagttgcttatcagcttaaggagattttgggccgagatgatggggttttctagatatacaatcatgtcatctgcaaacagggacaatttgacttcctcttttcctaattgaatgccttttatttccttctcctgcctgattgccctggccagaacttccaacactatgttgaataggagtggtgagagagggcatccctgtcttgtgccagttttcaaagggaatgcttccagtttttgtccattcagtatgatattggctgtgggtttgtcatagatagctcttattattttgagatatgtcccatcaatacctaatttattgagagtttttaagcatgaagcattgtcgaattttgtcaaaagccttttctgcatctattgagataatcatgtttttttgtcgttggttctgttaatatgctggattatgattattgatttgtgtatgttgaaccagccttgcatcccagggatgaagtccacttgatcatggtggataaactttttgatgtgctgctggatttggtttgccagtattttattgaggatttttgcatcaatgttctcaaggatattggtctaaaattctcttttttggttgtgtctctgcccggctttggtaccaggatgatgctggcctcatacaatgcattagggaggattccctctttttctattgattggaatagtttcagaaggaatggtaccagctcctccttgtacctctggtaaaattcggctgtgaaaccatctggtcctggactttttttgattggtaaactcttaattattgtctctatttctgagcctgttattggtctattcagagattcaacttcttcctggtttagtcttgggagggtgtgtgtgtcgaggaatttatccatttcttctagattttctagtttatttgtgtagaggtgtttatagtattctctgatggtagtttgtatttctgtgggatcggtggtgatatcccctttgtcattttttattgcgtctatttgattcttctctcttttcttctttattagtcttgctagcagtctatcaattttgttgatcttttcaaaaaaccagctcctggattcattgatttttttaagggttttttgtgtctctatttccgtcagttctgctctgacttagttatgtcttgccttctgctagcttttgaatgtgtttgctcttgcttctctagttcttttaattctgttgttagggtgtcaattttagatctttcctcctttctcttgtgggcacttagtgctataaagttccctctacacactgctttgaatgtgtcccagagattctggtatgttgtgtctttgttctcgttggtttcaaagaacatctttatttctgccttcatttcattgtgtacccagtagttcaggagcaggttgttcagtttccatgtagttgagtggttttgagtgagtttcttaatcctgagttctagtttgactgcactgtggtctgagagacagtttgttataatttttgttcttttacatttgctgaggagtgttttacttccaactatgtggtcagttttggaataggtgtggtgtggtgctgaaaagaatgtatattctggtgatttggggtggagagttctgtagatgtgtattaggtccgcttggtgcagagctgagttcaattcctggatatccttgttaactttctgtctcgttgatctgtctaatgttgacagtggggtgttaaagtctcccattattattgtgtgggagtctaagtctctttctaggtctctaaggacttgctttatgaatctgggtgctcctgtattgggtgcatatatatttaggatagttagctcttcttgttgaattgatccctttaccattatgtaatggccttctttgtctctcttgatctttgttggtttaaagtctgttttatcagagactaggattgcaacccctgcctttttttgttttccgtttgcttggtagatcttcctccatccctttattttgagcctatgtgtgtctgtgcacatgagatgggtttcctgaatacagcacactgatgggtcttgactctttatccagtttgccagtgtgtgtcttttaattggagcatttagcccatttacatttaaggttaatattgttatgtgtgaatttgatcctgtcattatgatgttagctggttattttgctcgttagttgatgcagtttcttcctagccttgatagtctttacaaattggcatgtttttgcagtggctggcaccggttgttcctttccatgtttagtgcttccttcaggagcttttgtagggcaggcctggtggtgacaaaatctctcagcatttgcttgtctataaaggattttatttctccttcacttatgaagcttagtttggctggatattaaattctgggttgaaaattcttttctttaagaatgttgaatattggcccccactgtcttctggcttgtagagtttctgccaagagatcagctgttagttagtctgatgggcttccctttttgggtaacctgacctttctctctggctgcccttaacactttttccttcatttcaactttggtgaatctgacagttatgtgtcttggagttgctcttctcgaggagtatcttagtggcgttctctgtatttcctgaatttgaatgttggcctgccttgctagattggggaagttctcctggataatatcctgcagagtgttttccagcttggttccattctccccgtcactttcaggtacaccaattagatgtacatttggtcttttcacatagtcacatatttcttggaggctttgtttgtttctttttattcttttttctctaaacttctcttcacgcttcatttcattcatttcatcttccaccgctgataccctttcttccagttgatcgcatcagttactgaggcttgtgcattcatcacgtagttcttttgccttggttttcagctccattagttcctttaaggacttctctgcattggttattctagttgtccattcgtctaatttttttttcaaagtttttaacttctttgcaattggtttgaacttcctcctttagctcggagtagtttgatcttctgaagccttcctctctcaactcgtcaaagtcatgctccatccagctttgttccgttgctggtgaggagctgcattcctttggaggaggagaggcgctctgatttttagagtttccagtttttctgctctgtgttttccccatctttgtggttttatctaccttgggtctttgatgatggtggcgtccagatgggtttttggtgtggatggcctttctgttttttagttttccttctaacagtcaggaccctcagctgcaggtctgttggagtttactggaggtccactccagacccggtttgcctgggtatcagcaggggaggctgcagaacagtggatattggtgaaccgcaaatgctgctgcctgatcattcctctggaagttttgtctcagaggagtacccagccgtgtgaggtgtcagtctgcccctactggggggtacctcctagttaggctactctggggtcagggaccctcttgaggaggcagtctgtcggtgttcagatctccagctgcgtgctggaagaaccactactctcttcaaagctgtcagacagggacatttaagactgcagaggttattgctcttttgtttgtctgtgccctgcccccagaggtagagcctacagaggcagtctggcctccttgagctgtggtgggctccacgcagttcgagcttcctggctgctttgtttacctactcaagcctgagcaatggcaggtgcccctcccccagcctcgctgccgccttgcagtttgatctcagactgctgtgctagcaatgagctaggctctgtgggcgtaggaccctccgagcctggtgcaggatataatctcctggtgtgccgtttgttaagcctgttggaagagcgcagtattagggtgggagtgacccaattttccaggtgccgtctgtcacccctttctttgactaggaaagggaattccctgaccccttgcgcttcccgggtgaggcgatgccttgccctgcttcggctcaagcacggtgtactgcacccactgtcctgcacccactgtccggcacttccctgtgagatgaacccggtagctcagttggaaatgcagaaatcacctgtcttctgcattgctcacgctgggagctgtagactggagctgttcctattcggccatcttggctccccagctttgaatggtgtgtctggattgttatttttaatttcatggttattacagaaaataatttagttgtgtagaggcacagatatggtaaaaaaaaaaatctgttctggctgtctaatatgctatgtatgcagctgcctaatagagtccactctggggatggacttctgtgttgtaggtagcttctgtgttgaccaaattatcttaatttagtcataaaaaattctacatcctatttggttacattattttaagtaggctatagagccttagggagatttaaaaaagatatccacaaacttaagtagtggtcaagataggtcctatatagaaggttaaaagaagtgcgattattgaagctagaatcaaatggctatactttgggagagcagagtgaacatgggtagcaaatcaaattttagtttatgagggatttttgaagggaataatgtttttggaaggaaaattaccaataagatggcaaaatgtggactagatgaccagccagcgttggctgattattctgaaatatttcaaggtgagagaagatgctgattgattctatgtaggtttgttttttatttgaccgagagcaaggtgctatttcaggtaatttttaatgcagattgctgttcctggattctgcttgtctcagtgtaactttttttactctgcccagcttctaaatcttagctttttgttctactatttacctctgtatttctaaataacatcatcatactgcagttccttggtttccaattttatagctgtctcttgacttcctagtatgagaaatgaagatttagccatctaaaacctcttctctacccttatttcacttgccctattatctcttaatgcaattatattacgttttgaaaattgagtcatcttccctatattcatggtgaatatgaaaatcttattttcagctgagccacatattttaaacttattgtgtttcttagatttcccataatgattgccatgtttttggtgtctcttcacatttttcctttggctttaatcagcaccttgttcacctcatcaaaccctaaaatctaccctatctagggctacggaatatgaaaagaaaatagaatctcaccatttgttgcctcttgctttgtttcagcctccttacccaatgtaggtgttacttcctggtagttttattaatagcttagtctctcctgtccttgtgtttgaaggcatgcagtgtagctgctttgctaatttgtgatgggtttagcatcagattttttggaattggtacttttaaaatgttttaaaaatatcctgccaaagaatggttagctgtctttagatttaagtgaaattcagtcaactttcatatctcatgccttgaattttacctcaaacttaacttaaaaagaaagtaaaggagtcagaagcaatagtattcttactgtcctgtttactgcattcatcggttcccagctctgcataccagagcgggagaggagttgcaagacacatttggacagctctcatctccctacaactgagtcaacagcaggagggtatttcttggagcgctgtggtaacttttccatgaagcaggtcttcttccttaggaaggcttagttgttgcctttatcccctcatttgttacagttaacatctatagcctgatgttggctctatcacttccatctgttttatgagcttgctactgttgttgctttgaaaggtggttttgtttatttgttacaaataatttatccattatcatcttaaccctcaactttaacatttaaaaatgacatattgaagagctgtattatcagtgttttttagactgtaggttatatacatttttaaaaatagaataaaataaaaagtaaactcaccaagggcattatataaatgtaagcattgggccaggtgctatggctcacgcctgcaatcccagcactttgggaggccaaggcacaaggatcgcttgagcccaggagtttaagaccagtctgggcaacataacaagatctcgtctttacaaaaaatgtaaaaattagccagggatggtggcatgcatctgtgttcccagctacccaggaggctgaggtgggaggatcacttgagcctaggaattcgaggctgcagtgagccaagatcacaccactgcactccagcctgggtaacagagtgagaccctgcctctaaaaatttaaaaaaggccaggtgcagtggcttatgcctgtaatcctagcactttgggaggcggaggcaggcgaactgcctgaactcaggagttccagatcagactgggcaacgtggtgaaactgtgtctttactaaaatataaaaaaattagccaggtgcggttgtgcatgccagtagtcccaactagtcaggaggctgaggcacgagaattgcttggacctgggaggcgggggttgcagtgagctgaaatcctgccactgcattccagcctgtgtgacagagcaagactctgtctccaaaaaatttaaaaaaattaaaaaacaaaaataaaaacaaaaaataacctgtaagcattggcttttaaaacttttgtaaaacccacttgtagtgggtttttatgtaaagtatactgttaattatggtaagaaaagtttgagaaatgctgccctaaacacatagaagaagtcaccgctcaaattgtttctaaagtttagggaacatacttttaaggtctaagggaaattatgtatgagcagaggttggcgtagcctcaggcaaatggagaggtcctctaacttctttcttagggtaggtacagtattgtaatgcttcatggaattttcagtttctaaccctcattttaccaggaaaaaatagtcattcctatttattatctaggtccaatgaacccctttattaaataattttacattgtttttatgaataagcagtgtataaaacaattttattagaaaatttaacagatttaaatatagcgcaatcaaatttttattccatatattcttggtttagatggtgtctgtactcaaaattggcagtgcccttcgaatgcaactaaccactcatcagtggtcacacatgaacatgggacatatgcaacttgtatatgttgaatccatatttcaaatacatctctaatagatttgagttttgttttttttttgtttcttttttgtttttttttttatggagtctcacttttttgcccaggctggagtggagtggcgtgatctcggctcactgcaacctccacctcccgggttcaagtgattcttctgcctcagccttccaagtagctgggattacaggtgtgtgccaccacacccggctaactttttgtatttttaatagagacggacggagtttcaccatgttggccaggctggtcttgaactcctgacctcaagtaatctacccgctttggcctcccaaagtgctgggattataggcgtgagacaccgtgtctggctgagcttgttacttcttctggttccacttgcatttgtatcatcaaaattcaatttggattcaggctttcaaatacatcagcaggtttaagcttatcattatctcttactctttttgtctttgcttgatcaaaatttaaaacctttgaaaactttgatggcttgtaatttggttgaaaagaggaccaccatcttttttattccataattgcaaaagattctcacttttagatttgtgaacaccagttagaaggatcaatccaattaattgttcttttttttttttttttttttttttttttgagatggagtctcggtctgtcgcccaggctggagtgcagtggtgcgatcttggctcactgcaagctctgcctcccgggttcacgccattctcctgcctcagcctcctgagtagctgggactacaggcgcccgcaaccataccgggctaattttttgtatttttagtagagacggggtttcaccgttttagccaggttggtctcgatctcctgacctcgtgatccacccacctcggcctcccaaagtggtgggattagaggcatgagccacagtgcccggccaattgttcatttttacatgattttctcccttccaaatacctttatgtggacacttgccaatatcatttatacacttaaaaaatgtatcaactaaattatggtgcacaaacatcataaaagatgaaaggatgttgacacacgtacttttagcaaaatggatggtcaaggttcttgttccaaattattgtggaatgaaatctatcttgtttaatgactatccagatgagaatatatatatatatatatatatttttgtccttaaaaatacatacttgagtgactgcaaatgggcatgagggatctgctttgaagtgatgaaaatgttctgaaattgggttgtggtgatgattgcttaatgatgtaaatttactaaaaatcattgaattgtgcacaatatattggtaactcatagatttttgagtttgggaagttttttgttttgttgtttagttacatgttaggtgaaactaaccaagtgaaggggcaagagaaggcagagagatggtgctatacacagctgatatagggttggaggctgaatgctacacaccgagagagacagacacacagacagtctgctcagcatgtcagccaggcagcattctgggacttggacagttggttggtgtgccagagccggcaagaggtctggctcagagctggagaggaccaggaaccctggaggctccctggtccaacgtcctggttggcatctgcagcagcacctgggctcagctcagatcactcagggtcttgtgggcaaatttgggtggcagaaaggctgcctcgtgcacatctgatttatagtatttcagttatgtatgttccaccagcttctgtgtcagctgtcgcacggactcccagaacttggtgcttgggttttgctgcacatcatgaagctaatctggccactgcggtaggtggggatggtgcagtaggtgcagcccaccatgggaaagagtggcatgcagaattgctgcgtctttttggtgaggtccaggtacagccactggcagtcacctgggcagcagagaatgccatgcttctttagggctgccctcctgaggactgtcttcatgaactggtagtaggattccttgaagaggtttttagcaaggcagtggggtctgaggagtcattgataacactgaaggcatcctaattctgtttcatgaattcaaacccatcacccatgtgtaagttcagctttgagcaaaagtagccaacagctttgcctggcaggaacttctgagagacttggatgacatccttatcattctcacattggaccatagacttcacagaggggtactacctcaccttgcacaggatgcccttgttcctgtcctcaataatcaccgccatttgtaggttggggtggctgcagagaggcaggttgactataatctcctggtaggagaacttgttcctctctgtatactggatgatgccatccaacgccatcatgttgccataggtcttactgcagatgacaaaggtatcctagtactgtgagcactggtcgggggcagctgctccacctgcagtgacaaggcatgggtgggccacagactgcatgtcttgcagaatcagtcctataaatggcagtggggccagaggctgggggcggccattggggctgggcttcatggcaggtgatccacagcactgtgggaccagcagagcccaagcccaccaatagagtttggggagattaaaaaaaaaactttgaaaagattaatctaggctatcattatctgagattttacttacatgattatttttatcatcacaattagtgtctagagggctactttctgcatctttacactcttatgatccaccttatattcacctaataataatgaaatgtctttgtcttttttttcctttccattatggattgaaaacagaaaaatcttgattttttttgggacagtctcgctccgtcgcccaggctggagtgcagtggcgcgatttcgtctcactgcaacctctgcctcctgggtgcaagcaattctcctgcctcagcctcctgagtagctgggattacaggtgcccacctgtaatcattacaggcccaccactgtgcccagttaatttttttgtatttttagtagagacagggtttcaccatgttggccaggttggtctcgaactcctgacctcaagtgatccacctgcctcagcctcccaaagtgctggaattacaggcattgagccacgacgcctcgccttatattctcttaagaactactttcaagtagagatgactttattttcattaagtttgtagaaattgtatttctatttagagagactaatttttgtttttaaaaggaaaaacaatcaggagattgagttgttaggaaattattagacatgtatagcttggtgactctttcaacctttcaaatgtaaaacatgttggcttttgggttaaagtactctggtaatttatcgttatcatgttctatgattgtaacctaagtctctcttcttcttctgtctccttattaactgagatataattcatgcttttaatttctctaagtccttctaccatgaattttctagctaaattaaacgtaggaaacaatacaataaggaaaacataaacctaagaaatattagatgttacataaactgttggagattgtcattcactcctattttcagaaatagagattatgataatttaaatttgaaggagaattcatacaatataatgtattaagacatgttagcgttttctcttgaggtctctcccagttatcttggagtcacatgtatctgttaaaataaataaattcattgggtattccccattgtaaaagtaatatatgttcattatagaaaaattttgaaaatataagcaaacagaagaaaaattaccatgtttctactgttgagttattgatttttataatatagaaaatcataagccataagtggtctctgttcttaggaaatataaacccatcacccctatgctttttttcttggcactttattaaatgtcacctctcttcctcctgctttggagtggcactgtcttaagttaggaagccactgttactactccccaaacagttcagcagatgaaaactagatagttggttctgttggtacaaaataaaaatatatttaaactttgtttctaataatattaaattattttaacacgatcagaatgcccaaagtagtcattattctgacgtgaaggtaatgttgccatggttttttgtttctctttataactggttttaaatgtaaaaacataaatcctaaagaacaggaatggaaaatggggatggttttcatttgctacaatttcctgtgagacatggctctaaacaagacccatatttacacaactcaatatagttttacatacagtgttgtattcagcacattttaaaattctttaatttcacttttcagtcattggtttaatactttcatagtaaatttgtttaataacactaggtgaagtttgaaataatttttgaataattttacagtagaaacaccagttaaatcacccttttggtaataaatgtcggaaaaaaagtaattatttttgctgccactgcaaaatcaattgtgtaactgttctttttaaactgacttttacattactaaattttaaacactcctgtaacttgtcagaagcaggttttggttaatagatattttcagtgatgtaatgggaacttttggcagtgagtcagaatataatggactatgattaatgttttaataagtagttttctattgctcatgatgtaaaggagaaatggtttcctgcttggatggataggagaatagcaggtgtgcatatagtgtttttaaaaaagaattgggatacttttcttagagtaacattaacatttttattcggttaaaatttattatagagatgcatatgttaccacagaaatctgaaattgatttggaacaataaaattaggagatgattaccaatgttgtagttaaatcttttattttttggccttttgttttctttgaagctttaacttgaggtctctgtagattgatcttggttcttactataagctgtaaggaaatcagggatctctacagggtttgatgtttctgaaataaatttcttaaaacttctaggggagggagaggggacaaaaagaaaaaaaaaactttcaagtttttctcttaaggctaggaaatacagattgttagtcaaatggaatagtgatcaagtaagatttctccattgccaaggccacaagttcaacgtataaactcagtagttcagaaatttggaaagttaaacccaggagattttgtgtcagtcttggaatctgagaaagtttataaagacaaactggaagaaatattagtataccagacttgaaggtttgattcacagtttgctttcatttttttgtgatttaattttggcaacttatatgcagtaagtatctgttattttgttgtaggtgaagagtcctagggctcagtagatacattctacttgggaatggtactttactaccatagatactttctttcccatatttgtgaataaaattgagcatttgttcaaatgtacactttcctggaataaagtttatggtttttattcctgtctcaaagggatcctgattcccaatagaggacctagagtagtggtctcaaaccatatatcagaatcacctagagggttttctaaaacaaagattgctgggccgcaccttcagagtttgtgattcagtagggctagagtgagaccccagaatttcatttccaacaagttcctaagtaatgctgatgctgatggttaaggactatactttgagaaccactagcttaatcttcgttaatagccttctagaccttttttgttatattgcatatttttgttattatacatatttaacaaaaatgcttctgttacatttgctacctgtcttaacctactatatcttatctttacattttatactttacattaatactttaaatgatacatgtttatccattgcatcatttacagtatttcataacataatttatttaaccagtcttcaattagacatttaggtcagttttcatttgttgtttttataaatagaatcttgctaaatttttatgtgatcttctaattatttcattagcaaaaaatccctggattaacggatggacatggcatggcacggtggctcacgcctgtaatcccagtactttgagaggctgaggcaggcggattacttgaggccaggagtttgagaccagcttgggcaatatggtggaaccttgtttccacaaaaaataaaaaaaattagccaggtgtggtggtgtgcatctgtaatcccagctactctgcaggctgagaacccaggactgcactccaacctggatgacagagcgagactgtcttaaaacaaaacaaaacaagataaaaacagtagatatatttataaggcccatttgaggtgtaagtgacttaacatccctggcacttgaacactaatgaatattatgactgccactttaaaggaggcagaagaagtttaaaaagtaaaacaaaaagtttgtttcagaaaacaagcattttacctctgtttcaaatagtctaatttttttagtgatgaaaacttctgagaccagtagatgtttgtaaataaaaaacatttatggcagtctttgtaactgtaatgaaactggtagagagtaataatagcctgttttttgtttgtttgtttgctttgggggatatttgcaatacagtttattgatatgtcacatacatgtaaagtttataattcaccccagaatttatattactaagtttgtgctagtattaaagagcttttcaaattcagtgcctgtttaaaaaaaaaaaaaaaaaaactgtactccatgccttgaaaatagcaaaactgtgatatagattaaggtggggaagcatttttttttctatttagagctataataagaaaaaataaattgagacagtggtttttaatttgaaaaagagaaatgaaatatttattcatctacttttaaaatggagaaacaataatatgtatgtgaaatctttcttctgtactgtaaaactagctacacaaataacatcaccctccctgactctcaaaataaaatactaaacccatacagagaaaactactctgaaagacagctccacagatgaggtcactgaaaggtgtccaacattggggatgttgggtaaagcaaggcagggaatgggtgagtgagggcaaaagctgacaacttggaaacatattaaaagtaggtactagatcaaattcagtctgtcctgttgcattgcctatttctagaacgcatatttataacatgaattagctcacacatgaatggtaaatagtggaatgatatctgtataatgtagattccatattgtagaagctattttgtttgcacatgatttttcccagtaagtaaatatgttacattgttaattaataatagcagctgaactcagatacagttggctgtccattcatgggtccacatccatagattcaactaacggcaaattgaaagtatttggggagaaaaacaatagttgggcctacattgaatgtgtacagacttttttcttgtcattattccctaaacaatacacgacaacacctatttacatagcatttataatacgttgtattaggtattataactaaccaagtatatgctccctggtgtccaggggggtgaaaaataaattaaataaataaagtatatgagaagatatgcacaggttatatggaaatacagtgccattttatataagggacttaagcatctgcagattttggtatcctgggggtggggttctggaagcaatcccccacagatgctaagggatgactgtatatggaaacaaaaacacaatgggatgcatgaagccacagaggagtaaagagagtgctgtacaggatgtctagttataccatgttcttccttttggcttagttttgccatgcatcctgtcttggaagtgctacttgtggaattcttcccaagttttgctcattttgcttgtttttataacttagcaaccttatcccttccttacacttccttccatcaggttacattcacttttttcttacgtttcttataaaacctatatttactgtatcatctgtttatttggaacttaaccaagctttaaaaaatcaactgtgttaatactttttggaggaataattaatgtttttgttgggtccctggttatgttatctttcatgtctggcttctttcatgtttttgagatttatattgtagattttgtgtggactgtccccgatttcacttctaacttttaagttcacatttggcagaatataagatctttcaagaaaaattatgttatcacagaaatgccagagtaatgttatagaactctggatcatagagtaggtcagtcagaagcactttagcacatagaattgctcagtgtaagaggagatcttttgatggaaattcagtcatgattgtggactttcatcacaatactgttcatttggccctactctctggttagaaatccctagtagttaaaaggtcttctccagttatgaggtaaactcattacctcagaaatcacccttattctacccacaaagagttgttgaaagagatatgaaaaaaacaaaatgcgcttcctactctcacacaccacagtcaatacttctgacgacaggtgttgtggggttttccccccacacaccaaccaaagcagttctccagtccagtagacaccaactgggcgtcctctaattcagttctgttctgacactgtctatctgaagatagtatcatataccacaggttaagggctcagtcccataagactgccctccacttcagatgccagtcaccagtagtaggttcttacctatacttccgaccaaaccagatataaattgggggttcccacagaccattcgtcagttttgattaatttgctagggcggctcacagaactcagggaaacactttacttatgtttatccaactattataagggatattacagaggatatacgtgaacagccagatggaagaggtgcatagttggggagcacagagcttccatgccctctgacatgccacgcacccgccacggatctccacaagttcagctgtgcagaagctcatcccaactctgtcattttggatttttatgaaggcttaattatgtaggctctgttgattatatcattggccattggtgattaactcaaccttcagcctcctcccttccctagaggtcagagggtgaggctagaagttccagcctgctaactgcatggttggttccccttgtgaaccaaccccatcctgaggccattcaggaacccataagatttgcttccttcaaacaaaagatgctcctattacccaggaaattctaaggcatttaggagctctgtgtcaagaaatggagtcaaagaccaaatattagaacaaaagattctccttgccaccctatctataagtttattagccctgtgccagggactgtgggcaaagaccaatatgtatggttcttattatttcaaagttaatttacatgttcaaaaggaaaactatatcttctgacttgatgtgggccttcttgagatacatctcctttatcagaggtcatcctttgggacctattgcttatttggccctgtaaaaggcactcagcctgggatactgtttgaggtttagactcaagacaaagggtagacatgcagagtctatgatgctctacccaatttcgttaattttagtgtgctactaccaaagacttaaagctacttttaaaaactttattgaagtaaaatttacataccacaaaggtaacgcattttaaatatatgattcagtgatttttggtaaatttaccaagttgtacaaccatcactacaatcagggccaacttcatgtatgtgtaaccagtacagtctcacagggccccatgcccagaaaggagccctgaattcacaagggtgccctgtacttggagtttaatactctgtggttgtcatcttgaattcttaataattttatgtttagatttatcgttttgtaagtaaagtctgatgggacaattgaacatgctctaggggctttgaaccacgtattcttcccaccttgagacatgttttcgaccaccttctttctgtttctgctcattgttgctgcctctacccacggtgaggctgtggacacagggaaggtcaggactggatgtatgtgccttgtgtgcctctgagggtctgcatttacccaatgagtatctcatgactgagggatacagcattaaatagcaaataaagtaccataacaggtcaagagagagaccctagaagaaaggaaaaaaatgttttcctgctttttaaacaaagtgcctgcattttattttgtaccaaacctgactacagtccagttttagaaccttcgacaaccccaaaagatccatcatgttagtttatagttagccccctttcccatcaccagacttgggcaaccacttagctcttttttgtctccacagacttgcctattctagacatgtgatacaaatggaatcataagtatgtggtttttgtgtctggtttctttcatgtttctgaggttcatattgtagtatatatatccatgtttcatttctttttattgctgaataatactccattgaatggatatactacacgttatctatttgcttatccattcatcagttgatggactttttgattattgccactttttggacaccattaataatgctgctataaatattcatactgtttgcatgtatgttttcatatatcttggatatatacttaggaatgaatgctggatcatgtaacaaatttgtatttaacttttcagaagctgccaaactgttttataaagtggctgtacattttacattcctactggcatgagggtttccattttccacatcctcagcaatgtttattattgtcattttgattataaccattgttgcgagtaaaaattggtatctcattaatttgtctttccctcatggttaatgatattgagcttctttttatgtgtttattacccatccatatatcttctttggtatgatgtctgttcagatcttttactcattttaaagttgggtcatttgttttattataaagttacaaaaagttattttttgattatgtgattttttaaataaaaaaattaatagttaaaaaaagaatgtcattttacaaagcacttgccatatatatatatcttataattctttatatattctggatatcagcattttattaaatataatctgtggctgggcacagtggctcatgcctgtaatcccagcattttgggaggcctaggtgggcagattacagattacgaggtcaggagatcaagaccatcctggctaacacggtgaaagctcgtctctactaaaaatacaaaaaattagccagtgtggtcgcatgtgcctgtagtcccagctactcagaaggctgaggcaggagaatcacttgaacctgggaggcagaggttgcagtgaggcgagatcatgccactgcactccagcctgggtgacagagtgagactccatctcccaaaaaaaaaaaaaaaaaaaaaaatatatatatatatatatatatatgtatatttatattttgtaaatatgttttcctagagtgtggtttgttattttattttttaatgatgtttcttgaagtataacacattgaattttgatgaaattcagcttaccaattttttcttttatggatcatgcttttggtgttgtatctaagacacttttgcctaaccaaaggccaagaagatttcctcttatgttttcctgtaaaagttttgtaatattacctcttacatttgggcctcagatccatgttaaattaatttttgtatgtggtgtgggctaaaggtccaagttcatcatttttgcacagagatacccaatggtcccagtaccatttgttgaaaagaatattctttcctcactgaactccctttaaaaccatgtgttttgcctattatccccagtaattcctagtataagcaaagctttttgattatcgagtcctgaacgttttcttgacctggggaatattgccttttcttttcctgaattacacatttagctgtgagcctatctgtaataataatagtgagcattagacagaagtgtttgttaactctgaggaatttctaattttaaataagaaaattatgaggaaacattttatatctttcctgtcaatttataattaaattttgaaataagtatttattattactgttttacatctagaagggtctctgattcccaagccatgaaacattctgacaggaaccaccctctttcaacctaaaacaaacaaacacctaaccttctaatgccaaaaggtcttaattttatttcactctttaaactcaaattgtttgcattcagaggtcagaaaaatataacatgctttggtaaagtaaaactggcttccttaattacttttccaggtcaaaaagtagaggtcattgaggcagtgtttagttttagttgtgttacaaacactatcatcagtcaattccagagtatttgcttaagaggatatcctccttcgagatctttattactaaagattcttcttccgtctttattattattattattattattattattattattattatttgagtctatttccttctctagataagcttttctaagtctgggaacatctcttgttcatttttgtttctccatctcactatactctaccctgtcccctcatacctcatcccacaatgccttgatggcacagatgttctgaaatgacttcttaaactgaagagaatttaagagatataatggagagaagtatgatattgccaagtgccaagattctccttccttctgaagtatattaaatgtaattgtgctgggtggaagaattatgaagaccaattagccataattcctctttcaaaagctgacagtctggaaaagggagattgtcatataaacaagacataagaagagagggtcaaggaacatttcatagagatatggacattcaacttcattttaaaggataagtaagagtctcctagtagcatgaacagaacattccgtcagaacagaaggattcagagatttgacagaacagggtgccttgagggaaatgtaagtagttcagtctgactggagcacagggtttgtaacataaagtgacaagaaactagttaggatcaaatcatgaagaatcttatttatcatattaagtattttgagtaatactcctttccccctttttgttcctgtgtgtcttaaatcaaggttgaaaaccactgctatctcagtaactaggctctgaaccatacactcttagtaataggtagctatggaagacgtttaaataattgagatattcagatttatattttagaaaaaatacttctgaaggcagcagtatggatcatgtatttgagaagcctgaagtaaaataaagtgccaaaataagagagttgtaagcagtgaggatggagttgagggaatggatttgagactgaagggatagaattgaaaggacttggccactgacttcaggtgcagggtaaggaatgagtctaggaaaattccaaggtttttggcttgagtgtctggatggctctgtgatgactttcatagggttcaggcttccttcagagttttgcacagcctatagaatatgccacttagacacaagtctttgtgtgagagctgcagcagggatctgaatgattaaggcagctgctcaggcttgctttctcactactcacttttgttgcctgtgtcagggaaaggccagggagagaaataattggggacagggactgcatttattctgctgccagagagtatgtgcagctgccgcttccttctgattcaccactaccacttgccacagcagctgggctggaccaaaataggtagactgtaaaagattctgtgataacaaagcccattgcagcactgggtgtaacttgaaatgttttttattcatatttctctaacttttttcttatttcaaaaatatgtctgtagatacatatcgtagacctgaattgtatatttaatatgtaagacccttaatatttttgatttagtcagtgtgggagaatagtactacttactttaatgcatatatatatatgtgtgtatatatatggtgtgtgtgtatatatctataacctttgacactctgaaaagagctgcttaattgtcaaggtagaagattttaaaaacatcctcaaagtttttttttaaaaaaacaatggtgaattaattatatactcccttagatactgagcctactttttaaattttttaattcagtcattttgagaattaagtgtgttatttgtccattgaattaagtttgtgtgtaaatatttgccatttctagaatattcatacttcttactcttactaattttttctgataaaaacttcatattataaggatgttagttttaatcaattttatattatcaagttttctagtatatgtctttaatttttgcttgtacaaacctatatattaggttacattagagttctgttatcttttttcttatgtaagtttagtctaaaataagactgacatactagtttttaattcgctcatatttcttaaatttttgtttcatttgtagtataaaatcacttttttagagaataatatttagtttttcttctatccttgtaaaactacagcagccttaaattatgctataggtgttcattgttggttcatcataaaataattaacacttgcattccagaactgtaattccacttagtacagcatttcatttcatttttttaaaagaggtttccatttttagaaaatttggaggttttttccctcctttaaagacatggttaaataatgattaatatagttcaagaaactgtcttacgtggagtgtgcaggtatttcagctctgtttttttcttttctttattctttaaatgttagatagattttagtttaccactttagaaaactatttttaactgtttttatatatttatatatctcatactgaatgccaggtaagaattttattctgcactactgacattaattcccaatagttaaacataatagatgaccatacagttgttatctatttcttatcctgtgctctaggatttatcatttttaaagctatgtgttagagatcatacttatttctgaatagctaaatatcagtgtttttgcatcataatttggtgtatactgtgttacattttcagaaaatttgatttgataaatataaccataatcttaaaaacaaaactttgaagatatatgaatcactttgtaaataataataatatgcagtacagtgtaggagttgagagaatttttggaattatattgcctgagttcaaatcttggctgttttgcttggtttataaccctaggcaggtaacctacctaacattctgtgtctttgtttcctcctttatgaaatggagatatctaatggggttgttttgagtactaaatgaggtaatatatggaagagcctagaatactgactggtagaatattgaagtataatatagaaagtccggtcccttagaatctatttgtattatactgattttaggtctattgagattttctacctttcctttctctcctttttttcttcttctaatttgatcaattaggcatatcgacacaatgataaattgttgtattgccgttcttccgtataattttggcatttagttcagtgtagcatttatttcctaattattgaaataaaaattcagtttatctttaaggaagactacttggttttctgatgttttgaagcaaacaaagtagcgggtaagatgttttgtcccagtgattttatttgtgctcttaacaccaagggaaagtcacaggttaaattcttaaaaagaatttaaggaaaaatgtaaagaaaataagggagtacatgattgacaaattatcccatttatttatttaataagaattttagtttttaagaaaatgagatgtccttcctttgttatttaagtaaaaagcataatcacatctaaaacatggatctagacaatcccatagctattgacagtctgaagtcctacccataattgtttgttttccttgtttatctccctgctctaattccgtactatggtattcctttgagaggctctgtcccaccctttgttaccttgtatatagaattttttcacttaaatgaattccccagaaaatctacgcacattgtctggaagatttaagggttaccaggagggatcatattacctatgttaacctaaaaaaagacactagagaaaattatctctaaatatgtttagttttcttgggaatgagaaataaggattataaagtggaatggatgaaagggcaagctacaagtgcattcagtgagggaagagtaaagggaagcttttattagccaaaaggtagagatgtacataagctgcttagaaagagagtttattggtttcagaagttcaaagtccaagttgttgacaattcattcgtagagatgctgttactgggcaagtgttcttccaagagcaacttatctgagttactgccgtcctaaagaatatacagtgataaaccttgtcaaaggcaggagatgcatatttcttacagggattttaggacatcactggaaacagacatgtaagcatgagcctcctttccttggtgccttcctggccctattttgtctgggtctgaaaattgatttcatcctggtatctgcacctttacacccaactgtaaactatgaccatgatatggtttggctgtgtccgcacccaaatcttatctcgaatttccatgtgtcgtgggagggacccagtaggaggtaattgaatcaagggggcgggtcttttccatgctgttctcctgagagtgaataagtctcacgagatctgatggttttaaaaaagggagttttcctgcacaagctgtcttctcttgtctgccgccatgtgagacatgtctttcacctcctaccatgattgtgaggcctccccagccatgtagaactataagtgcaattaaacttctttcttttctaaattgcccagtcttgggtgtgtctttatcagcagcaagaaaatggactaatacagaccatatgtcacattgctcatttcatctcttctgtctttttccttcctctctttctggaacataaagaaattacttcccttgcctgtggaaggcaatttctcccacatttaaatgctcttgggaggggcagaatgcctcactttccctagtttatcaagggtttccttctaaacaaagtgtgtaaacaaatatagaggtgctttccctaaattaaggaattctagtgaagtagattttctgtaccttagtacctttgtatttgtggttgtttattattcattttccatttaacatttcacaagtagcctaacttctttaattttagagaggctttaaatgaagaattttaaatgaacctaagagattatctaggtaaatgtgttttccttttccctaagtttttgttgatgctgtcagttagtttcactatatgtagtcaaaaaactcttgaagaggaccatttgtgttacgtagataggggccatatttcaggcaattgtcaccttccccacctctctccccctctcttttttttctttcttcctccctccctcatctacctacctagcccccatccctccctccctccctccttcctttcttctttctctctttcttagcattatagttgatattgaaatactttatataaagtgcaagaatgtacttagatgtgacattgataaaaagttgcattttgattcttactgttgcttattcattttccattagttgaaggaactagaaattacttccagatgtgttgctttattccttgtcttcaagaagtagtatcttctcttattttcagtattttaaattcatttaacaaatactgtgagtgtgttatgggcacataatgtgtttggacattgtgaaaaattcaaaaatatattatggcttctgctcacagaatgacaagtgatggagaaatgccaggaataagagtatgatgcagggtaggaggagaaatcagaaagcaatagattctatatacatagatttgggccctcacagatgctgcttttttcaaacatatagttgaagatgcagtattggatttgaaattccctgtagataaggaaattgaacatcaagctgttgccgaattttgctccttagttcagctaaaaccgggctcttgtcacgcaaccagggaaatttaggcatgcagacacattgaaaggtgagtagaacaggatattattaggctaaaagggaaaaaaagaaacaaaaaacccagcacagtgagatggactcctgctaacaggcccccaacctcacaggttgaatcccaggccaccacacaggaactgaggaggccaggatcctccttgctactggtggctccaccccgttcccccagtgcgcatgtgggcatgctcagacaaggtcatgggcaggttccctcatctgcacgaaagcatctgatgtaaacacttgtggggctgttcagagattctccggagaccccttttttgtgtgtgtgcattttttttattatactttaagttttagggtacatgtgcacaacgtgcaggtttgttacgtgtgtatacatgtgtcatgttggtgtgctgcactcattaactcatcatttaacattaggtatatctcctaatgctatccctcccccctccccccaccccacaacaggcccccgtgtgtgatgttccccttcctgtgtccgtgtgttctcattgttcatttcccacctatgagaacatgcggtgtttggttttttgtccttgcgatagtttgctgagaatgatggtttccagcttcatccatgtccctacaaaggacatgaactcattatttcttatggctgcatagtattccatggtgtatatgtgccacattttcttaatccagtctatcattgttggacatttgacttggttccaagtctttgctattgtgaatagtgctgcaataaacatacatgtgcatgtgcctttatagcagcatgatttataatcctttgggtatatacccagtaatgggattgctgggtcaaatggtatttctagttctagatccctgaggagttgccacaccgacttccacagtggttgaactagtttacagtcccaccaacagtgtaaaagtgttcctatttctccacatcctctccagcacctgttgtttcctgactttttaatgatcaccattctaactggtgtgagatggtatctcattgtggttttgatttgcatttctctgatggccagtgatgctgagcattttttcatgtgttttttggctgcataaatgtcttcttttgagaagtgtgtgttcatatccttcacccacttgttgatggggttttttgtttttttcttgtaaatttgtttgagttcattgtagattctggatattagccctttgtcagaagagtaggttgcaaaaattttctcccattctgtaggttgcctgttcactctgatggtagtttcttttgctgtgcagaagctctttagtttaattagatcctgtttgtcaattttggcttttgttgccattgcttttggtgttttaaacatgaagtccttgcccatgcctatgtcctgaatggtattgcctagattttcttctatggtttttatggttttaggtctaacatttaagtctttaatccatcttgaattaattttagtataaggtgtaaggaagggatccagtttcagctttctacatatggccagccagttttctcagcaccatttgttattaaatagggaatcctttccccatttcttgtttttgtcaggtttgtcaaagatcagatggttgtagatatgtggcattatttctgagggctctgttctgttccattggtctatatgtctgttttggtaccagtaccatgctgttttggttactgtagccttgtaatatagtttgaagtcaggcagcatgatgcctccagctttgttcttttggcttaggattgacttggcgatgcgggctcttttttggttccatatgaactttaaagtagttttttccaattctgtgaagaaagtcattggtagcttgatggggatggcattgaatctataaattaccttgggcagtatggccattttcacaatattgattcttcctacccatgagcatggaatgttcttccatttgtttgtatcctcttttatttcattgagcagtggtttgtagttctccttgaagaggtccttcacatcccttgtaggttggattcctaggtattttattctccttgaagcaattgtgaataggagttcactcatgatttggctgtttgtctgttattggtgtagaagaatggttgtgatttttgcacattgattttgtatcctgagactttgctgaagttgcctatcagcttgaggagattttgggccaaggcgatgggattttctagatatacaatcatgtcatctgcaaacagggacaatttggcttcctcttttcctaattgaataccctttatttctttctcctgcctgattgccctggccagaacttccaacactatgttgaataggagtggtgagagagggcatccctgtcttgtgccagttttcaaagggaatgcttccagtttttgtccattcagtatgatattggctgtgggtttgtcatagatagctcttattattttgagatatgtcccatcaataactaatttattgagagtttttagcatgaagtgttgttgagttttgtcaaaggccttttctgcctctattgagataatcatgtgttttttgtcgttggttctgttaatatgctggattatgattattgatttgtgtatgttgaaccagccttgcatcccaggaatgaagcccacttgatcatggtggataagtgttttgatatgctgtgctgctggatttggtttgccagtatttttttgagaatttttgtatcaatgttcatcagggatattggtctaaaattctctttttttgttgtgtctctgcccggctttggtatcaggatgatgctggcctcatacaatgagttagggaggattccctctttttctactgattggaatagtttcagaaggaatggtaccagctcctccttgtacctctggtagaattcagctgtgaatccctctggtcctggacttctttttgttggtaagctattaattattgcctcaatttcagagcctgttattggtctattcagagattcaacttcttcctggtttagtgttgggagggtgtatgtgtcaaggaatttatccatttcttctagattttctgatttatttgcatagaggtgtttatagtattctctgatggtagtttgtatttctgtgggatcggtggtgatatcccctttatcattttttattgcatctatttgattcttctctcttttcttctttattagtcttgctagcggtctatcaattttgttgatcttttcaaaaaaccagctcctggattcattgatttgttgaagggttttttgtgtgtctatctccttcagttctgctctgacttagttatttcttgccttctgctagctttgaatgtgtttgtcccttgcttctctagttcttttaattgtgatgttaagatgtgaattttagatctttcctcctttctcttgtgggcatttagtcctataaagttccctctacacactgctttgagtgtgtcccagagattctggtatgttgtctctctgttctcgttggtttcaaagaacatcttaatttctgccttgatttcgttatgtacccagtagtcattcaggagcaggttgttcagtttccatgtagttgagtggttttcagtgagtttcttaatcctgaattctagtttgattgcactgtggtctgagagacagtttgttatcatttctgctcttttacatttactgaggagtgctttacttccaactatgtggtcaattttggaataggtgtggtgtggtgctgaaaagaatgtatattctgttgatttgggttggagagttctgtagatgtctattaggtctgcttggtgcagagctgagttcagttcctggagagccttgttaactttctgtctcgttgatctgtctaacgttgagagtggggtgttaaagtctcccatttttattgtgtgggagtctaagtctctttgtaggtctctaaggacgtgctttatgaatctgggtgctcctgtattgggtgcatatatatttaggatagttagctcttcttgttgaattgatccctttaccattatgtaatggccttctttgtctctcttgatctttgttggtttaaagtctgttttatgagagactaggatcgcaacccctgcctttttttgttttccatttgtttggtagatcttcctccatccctttattttgagcttatgtgtgtctctgcacgtgagatgggtttcctgaatacagcacactgatgggtcttgactctttatccaatttgccagtctgtgtcttttaattggagcatttagcccatttacatttaaggttaatattgttatgtgtgaatttgatcctgtcagtatgatgttagctggttattttgctcattagttgatgcagtttcttcctagcctcgatggtctttacaatttggcatgtttttgcagtggctctggagacccctttttatctgcctaggcatttggctgtctcaaagctttattttttgttgttgttgttttgagacggattttcgctctgttgcccaggctagagtgcagtggcacgatcttggctcactgcaagctctgcctcccaggttcatgccattcttctgcctcagcctcccgagtagctgggactacaggtgcctgtcaccacgcccagctaattttttgtatttttagtagagagggggtttcactgtgttagcctggatggtctcaatcttctgacctcatgatctgcccgccttggtcccccaaagtgctggaattacagccgtgagccactgcacctggccgtctgtctcaaagctttcttacttatttatctgaattcaatggcttaataaacttatgatgagatatctaaaaggatgggtttaaaattcagttcttccttattccttctcacaaatctcttcaacattacagaatcagaagggtcaaaattagaatagcctgagaagctcaatttaaaaaaaaagttagagtgagatttgaactttagtcatatatagtttctattgaaatatttgaaactctagataatgttaactgtatgacgttcccacctagtgttaatatttgaattattctttaaaagtttttgggaaatgcctgtgttaagtattggtaatttaataaaattccgtttattctcatagtatatagaagttttgttatttctagtttttatggtttttagtgattatgtggtatttaaataataaacaatggtgaatttaacagatcaaaaattcatttaattgtattactgttttgttcctcatctggaaatatttctctggctagtccatttttcccttgatctcttagtccctgtgattcaggaaattgtattaatgaatttatggtcaatactactgactaggatgctttcaataacatagtttaaaatgtagtcacacttatagctagaatggtgaaacaaaagtttgttctccttaaagatttaccttgttaagaaatagtttctgatggctcggcacactggctcacacctgtagtttcagccttttgggagaccaagacaggaggattgcttgaggacaggaattcaagaccagcttgggcaacattgcaagaacccatctctacaaaaatttaaagaacaaaacttagccaggtatggtggtatgcgcctatagtcctagctactcaggagggagaggagggaggatcacttgagcccaggagttcaaggctggtgctaagattgtgccactgtactccagtgtgagcaatagagttagaccctgtttcttaaaaaaaaaaaaagtcaatggccgggcgcggtggctcactcctgtaatcccagcactttgggaggctgaggcgggcggatcatgaggtcaggagatggagaccatcgcagctaacatggtgaaaccccgtctctactaaaaatacaaaaaattagccgggcgtaatggcgggcgcctgtaattgcagctactcgggaggctgaggcaggagaatggcatgaaacctggaggcggaacttgcagtgagccgagatcgcaccactgtactccagcctgggcgacagaatgaggctccatctcaaaaaaaaaaaaaaaaaaaaaaaaaaaaagtcaataaatgaaagctgcttctctattcaaagttagggattgttggttcatatcttcttttccacactccactaaaaaaattttaagctgatgaaaatacttttagggaaacatacttttaaatggaatagttttttctgatataaatgattaccgttaagttgtctgtcttaaagagttcagccaaaaagcacatctatctttatttaaccatttgttgctgctgctgcttattccagtagtgttagcacaggaaaacttgtcattctggacttcttccatcttgccctcaagcagtgcccagaagcaaaaccctaactgggggatagtaagctttacttacagtgccaaaaatcctatcaccatttgctgtcacaagaaaggggcccttattgttatttctctcttaatttttttttttttttgtaaatttggactcttttagtcttatttaaaatagtgatattcatatagtaatctcgcggtactgacatttgttttttccactatcagtgcctaagacaatcgttgacagttattaaaacagtaaggttttctttgactttgtttaagagcctctgatttagcgcccttcttttgcagtgatatttatattaaatcgaaaatttgtaaaaatcagcccatttttatgaataaaaaaatagtagatacaagtttgcaatataagaaatgaccactacaatgcattttagaaattaaaattaaagcttctttaacatatgttaaagtaagcaagaaataagcctctggtaaagctactgaaattttgggattattcattactactgcaaaatcaagtttaacctcactgtcgcagtgcttttgtcagtagagctaaatcataattcacttaatttacagatgtatttttaatgggctgataatctcttagttatcttgtcatttgactttccacaagtttgtattaattgaattagaaccacatgtagtgtgtgtgtgtgtgtgtgtgtgtgtgtgtgtgtgtgtgtgtgtgtgcgcttttttttttttttttttgagacggagtcttgctcttgtcacccaggctgtagtgcagtgccgcaattttggctcactgcaacctccgcctcccagagaaccatgtgtatttgtaaatcaacaattgtggttcctctgatgcatactgaataaattattcagctttcagatttaacttctatagatctgagtcactttctaaattgttactggaaacagtaattgtaaattagctgagtaaatgtgcctttgctaatatgaacactcataaaatttcagagcacttcacagtttcaaagcatcatttcattgattcttaactacaattctaggagataagcaaggcaagtataattattgctgcattcattttacaggtggggaaattgaagcaaagtcatttgccccaggccatatggcttataaacagcagaattagggtcatcttctggctaatctttcaactgtttgtttttgtttttcatatcatctcgttagagtcaattatctgttcaggcagtgggcagtgagggagtggggagaggtggaaggatttgtttctctttttttttttaattcctaaacatttccaccagagacataaaattatccaaaacaaataaatgcattattttgccctccatgttgctggttgctagggcacccatgcctaatttaaaatatatacatcttttgaatgtagcattttaagttttcagatttatgcaaggtatggagaggaagggagactgttagcatgttttaaaacaaggttaactccatatggagccctgccttctcaagcaatgaattttccaggattaattataaccgaagcaagatttagtcatggactaaaagtagctgcattatcatagaattcttaagtgttattcatataagttttgtatataggatgaacaaattataggtttctaactagaactgcaatgtcattccagaaactatgcaagggtattaaaatgcttattttacagttgttcctggcatttctataattaactaatgatttagtacatctggtgatttggaccaggaatgtgagcaaatcagaatatattaactagtagaggaggtagaatgtttcctattttgtagtgttaagaaagtagacagttaactgactcttaccctgaagaaaatgacaaagggtcagccaggtgcccttccttatcagagatcgtaagtttctatagtccttttgtatggaagtgatagtatttggaaatggggcctttgtgaggcattcaggcttatatgaattcatgagggtggagccttcctgactctattaatgcccttataagaacagctaccagagaacaaacttgctgtctctctgccacgtgaggacacagatagaaggccaggaagagagccctcgccagcaaccaaatcagccaggacttcctagactccagaattatgagaaatagacttctatcgtttaagccactgagtgtgtggtattttgttatagcagttgaagtagacaaatagactattaccatatagctttagaatcaaacatttaatgttaaatcctacccccatagtactggtctcaggaaaggtatgtggcctgttcagggttgttataaattatcaggaacaatatacaagaagtgcctaaattataaaattttataaacttataaaacttcaaattgtcaagattttggtaagcgaggcactttaatttcactttctagaactcataattttctaggagaaattatctctggttttaatttttattccattttattgtctgaattattcatagatgtacaaataatgagaggactcaaagagttttcatgcaaacatagctcttaaaaagtgttaactctttgctccaaggaaataaatatttagaaaactcttactgtaaatatgattatagcagtttcccaaagctaataaaatatttcatcagctaatgaaaaattcagtcagtgcaattaagcagctaatgtgaagacctgaatcagagtttcaaagctactaagaaccacttaccatcatcatgtaggctcaagtgcttttcactcaaagcttagtagtatactttcttgttcaaggtatacttcaggggttaagaatatttccaaacctatagcttcctattgtgtcccaaaatgtttttttgagacacaggcagcactttcagttttttttctaaatccatcttttgagtctataatgtgtcatgataatctttttattatgtaagaggggagtcaggtaattttatctctatccagagccctttgccagaaaaaaaaaatagagcatctttatataaaggaattctaactatctattttctttgtttttctttggaataaatttgaataccaaatagattccttataggaatcactttacaatatgggcccagtctcaaagttgaataaatctttggtcatttttctctgttacatgagagaagggcttaggccactgggggcactttctaaaattcctttataatcacatcttttcttccttatgaacacattagtatttttactgttttaattatattaaatacattagtattttagtgttttcgttatattgtgacaatatataacatttgaatacaaataataattagaaattttaaaacatgtatgaattattgttaaattagttctgccgagagaagctggagaagatcccataaacaacagattggtgccattcaggtatcattttgcacacagatacggtggcttcttctctcacatcccacagtggctttcccacatcatcagtttcctaaatctcccactccactttcccctctttatactcagcaactaacttttcaacatgctacacagagaaaacgtatgtatgaatacattctctccaaagccacactctaactataaactcgtccatacttgtacacattgctaactccttctgtccattcttattggcagaaaggcctgtcctgcttttgaggccagtcccaccacctgtgttccatggcctacttttgattcaactcagggatattagaccatcaaattggtctccctccctctttcagattgagatcatcttctctgtgttgaaatatttcctttacaacatgaacatactcaaatttccatcttaaaaccacatagtcgcttcatcaaccctgaatcttcctctgactactgctctttcttccatattcaatgaaaaacctttgaaaaaagtcttatacttgctctctctacttccttatttctgattcatccaccaaacctagtggaatttggcttttacttagaatctgattttgctgattcacaatcgacttgctaattacaaaatttggtgggtaacttgcggtccttttcttattttacccttctatcgaaccattctcttattcttcaaactgtatctttcatttgctttatgacactacttcctttttgtttttgtttttgttttttttttcttcctctgatttcttctgaatccttttggccagttcttcttcctctgctaaagttattgtgtgaagtcattccttgaccttttgttctcattcactatcactaattgagtacctgtgtgtatggtaggctcttttttaggcacttcttgtatatcgttcctgataatttataacaaccctgaacaggccacatacctttcctgagaccagtactatgggggtaggatttaacatcaaatgtttgattctaaagctatatggtaatagtctatttgtctacttcaactgctataaccaaataccacacactcagtggcttaaacaatagaagtctatttctcataattctggaggctgggaagtcctggctgatttgattgctggcgagggctctcttcctggccttctatctgtgtcctcatgtggcagagagacagcaagtttgttctctggtatctgttcttgtaagggcattaatatagtcatgaaggctccaccctcgtgaattcatgtaaacctgaatgcctcacaaagaccccatttccaaatactatcacattgagagtaggggcttcaacagaagaattttaagggtagaggtaacacaattcagtacatagcaaatcgttttcagactttttaaaggaacacagctgtttttttaaaaacaatatcttcctaggaccccaacatataaaatagtcaaaagcagaactactccattacagtgggaatgacaggtccagagccctgataatttggacctccctcccaattctaaccccatagtgctccaaaggtatttgctcagaacccaagggctctgagaaaacagtttaaaaggtacaataatttatgttaaattgtccaggctcacacctgtaatcccagcactttgggaggccgaggcgggtggatcttctgaggtcaggagttcgagacaagcctggccaacatggtgaaaccccttctctactaaaaacacaaaaattagccaggcatggtgatgcgtgcctataatcctggctactctggagactgaggcaggagaatcgcttgaacccgggaggcagaggttgcagtaagtccagattgtgccactgcactccagcctcggcaacaaagtgagactctatctgaaaaataaaaattatgtaaaattgcaagcctagatttattttttagttagtttgaaaatcagatttccaaatggatcctggacacttctgtcattctacctgtgtctgaccagtacttcactcagttctttatgctccaaatggaacttaccttcattgttaacttctaactattgttttagtgaaacttcctacctcagcaaatcttccaggctccagacctgcgatgacaggtggaaagatttcttcttgctgctatgtcatgtaattggacagttaaggcctgtagagctgtagccccatagaggccctcataatcttttctctttgcttccttttttaccctctctttctccaatctatcttttctacaaaggtaaatttctaaaattcaagcccaatcgcattattcacctgctgacatttttcttgagcccccattgtctgttttaaaagatactgaaggggctgagcatggtgactcacgcctgtaatctcagcgcttaccaaggccaaggcgggagaatttcttgaggccaggagttcgagaacaccccgggcaactaagtgagaccctgtctctacaaaaaatttaaaaattagctgggcatggtggtgcatgcctgtagtcccagctcctcaggagactgagatgggacaatcacttgagcccaaggagttcaaggctatgattgtggcactgcacaccagcctgagtgacagagcaagaccctgtctctaaacaaacaaaaaaagatattcgaggcatacagaaccctcaggatttgacactgagaatacatcatattctctcaggcctcaagtcattgtagagttttttcatttctagaaaaccctctttgcttctttacctacctggcaaattatcattttcctttcatgtatcaacttactcattatgttttctgtactcgcctgacttctccgggtgaccagttctcttatcattaaaaatggtttatttttatgtttttcttcctattagacttatatctcctagaaaacagggactgtttgtcttctcatctagcacttaacatagtagttggtacatagtaagtgttcaagatatgttaattgaatagttgaattcttttcaagaaaattaattttttagcatatctaggtatcagccattttatctgttaaagaaacagcaagataagatgatttcaaaatttccttccagttttaggattatctgttaaagaaacagcaagataagatgatttcaaaatttccttccagttttaggattctgtgttacttctcttactataatctccttacccatgattcttctcacttattttacaaagcatttaaaatttatttttaataatcacatgtagaattaattttaagtatatctttaaagaaggatggacttttatcctcttgatatttattttatatttttttgaaaattatttttgttccataaaaaattagtttttgcaaatgagtccaattaggaacaaaatatatcaagaataaactttggattttttcctcttctttacttcctgttgactaattgtagcgggttctctccaaagcatgttcttggcgtaggaaaactgtgtggcctgttttgaacctaaggatgacaggtggaaataatttttctctcaaaagtagaattcaagaaaacagtagggcttttttctttcttttaaccttttaaagtgatgaaataagaagtctacatttttaacgataaagcatttttgtaatgtactgaagcaggttctgtaaaatttaacttttaaaacttatgattttagaaaaaagtcatatgtaactcattagaatgtatttttatttaaaatattataccagcatgtgcacagttacaaggcattgccaaaaaatgtactctggaagcaaaacagaatactgaaaataatgctacaatttttaaaataagaggaaaatattttctttacacatgaaatttttggtccaaatgatatttaaccaactaactggctaatctattaaagcattctatttcagaaaagcttcatttttggtaccattgattgcattagcacattacttctgatagtgggcatagattatttttttttctaaagtgatgttttttccaaagtgatattgtggttttactcttggaagaaagtacaagttttctgtgggcctaagtattaaaaatgttttttaaaaacttgaaattgttatacattaaactagaactcttggaactttttcagattttgctgctatagtcactagtcctttgacttagatattttatgaaccaatttttactggctggaaaatagaattttccataattaagagaaaacatcagttattttatccagttgactttgtctttgcttgttattgtttgctttagagatttatctaagttgttgacatgattcagattctagtgtatgaaataaagcttttgaggggaagttgctttgaatggaaaaataaataccttaaaaaatatttagctttgagtgtgtctagtcctgtttgaattttttgtttttccttgcactcatagttgtattctattgtagtatatatatttgagtataaaattggttaacacactaagagttcagtttatgagatgggataaatttaaatctcaaagcaattttcaaatatactcattaagaaaatgcaagtatttatattttaaataaagtcattttccactatataccctatcacccttttattattatagacgttttctaatttccaggaaaacctcgtccaccccagtgactgatatatactctagcttgttcaacccatggcctgcaggccacatgcagcccaggacagctttgaatgcagcccaacacaaattcgtaaactttcttaaaacattatgactttttgttttgttttatttttagcttattagctatcgttagtgttagtgtattttatgtgtggcccgagacaatttttcttccactgtggcccagggaagccaaaagattggacacccctgatgtatagcttacccttcattcaaacccctttcatctttcgacgaagcttcataatttgtggtgataattgttttcatatcctatttttatttgccagctattatcatggctgcactttagagctatatcttaactaatcagaacctaatttagttttaaaaattctgtattttctgattagaagttaggatgattttttaaaatgatggcaaataaatatttatgttgctatcaagaaacttatctagtggggaatgtataacatttttaagtagccatggtacgtagaagagaggtagcgataaagtgctttgcgaattcagaggaggaaagaagtaattctatctggacaatccagaagaggtgtaatctaaaacagttgttaaatatttcaaacatagagaagcacagagagtaatataataacataataattgtgctacccagaattaagaaatattatttgcaaacatcaaaaaattctaaacttaatatctttcctccttctgaacaaaacaaagaccttagaatgcttaaactcaggcttcccctcccttttttttttttttttttttgctgtttttgttgctactttgtcttattgttattattgtttttggctcatctttgctccttacatcctgcttttcccattggagtttaatttgcttcttgctgaaacatttcctttagtggttctttttcacattttcctttttttgtcgggggagagctctactgtattttgtgttttcctcacatatgtctttcagtttactattttctgtccttctgtggataatctaatgcttaacctgtccattgaaacttttattccaagattcctgtttgattctttcaaaaaagaaaatgcctattcttttcatattgtcctttccttgccgtatggcagctattcctttcgtggtttcttttgacattaaatatacttcttttagaatttctttcagtttattatctatgattgtggatgtgtcagtcctgccattggtcatgtcttctgactcttttataagtgaggttcatttaaattttttttttccattttactgtgaatttttttttagtgggagttgttttcctgtgggtcttggatcgtgaaggcatactgttatagagattcatatttgcttctgacaaattcctgttggcttcactgagtctgaaccagttgttattcttaattttttgcgggtggagcaggcttgggtagtctcattccttatgtgtgattccttttccacccatgccccagatgggttgcaagctttcttgtgactatacccaagctagtaagcaaaattttcctaggagctgtttcatagacagaagagtattttgtagatctaggttacatgcagggctgcaagcccagtttcagcttcctacctctaacaggactgagacctgtctcctttaatagagggtaacagaaaacctcacagttgactttggcttaagttcagggtacatggagatggttaatggaaaatatgtttggaaaggtgggttggaatcaagtacagtaggccttgaatggtaggctaaggaatttggacttcatgctacatatagcaggaatccaatgaatgtctttttgcgtgagagtcatgcagagctttgctctaagaagattaatttggtaaccatgaataggttggaatggagagaacatactgtaaatagggagatcaattaagagactattcacattagtctgtgaaagaggtaataaagacctgaaatacggtaacaatagtggcaatgaagatgatgtgagaggtaaatagatgtttatagagagattatgatacaggtttcacactggtattcaggagaaagagcattccaagatgaccccagtgaggatgctgaaactattaaggaaagtcagacacagacagagcgttaggtttgtaaagaaaggtgagttcgattatgaaaatattatctttgtagtgccagtgggatacccaggtacaaagggccacccatgcagataaacatattggactataattaagatagaaggacagaccaaaagagatgtggggcttagtagaacagaagcattaaatgaagccatacatttcagagacagaatcaagaatcaggaaagagaggaggtaaaccaagaagaaaattagtaattaggaaatagaaaaagagaattgtggggaatgatatgtcagagtagtaggagtgtggcccggggcatagactgatattatggaaatcagaaactggaagcatttcacggccaggggctatcactattagagaggtggaggaaaatgttgaggaggatgaggtccaagaaatggccatttaatggtaaccagagtcaaaatacaaggatatgaggaacaagtggaaggagaggcagtgagagtggaaataatgtagtaaattcacttctgaaataaaacttataagggtatacatagtatttgtgaaatatagatctgtatgtatatgtttgaatctatacaaatgtattatacgtatgtatatatgtaaatttttccccatgtctgttagcgtgtaggtattggcacccttgggttactctattaccctgtgataaaagattagcaagcaagattcttcttatcctttgaaatctccactttgatcttcataatagaggtacagtaaaaggggaaagatagaaagcaacaatattattgttggaatagacgtaggaggtcacagggttgggaaaggagaggtacatactattagcagagggtaaaagtgctttggaaatttgggctatggaagatctatcttttgtgaaagcatgctttgtattgaaattatcaaatagaagatagagggtggacaagaacacttacacataattgaatgtaccagatgctttacataaattttcatgtttcatctttcaaaacactaataaggagtgcatatggtagttctgtttttaattttttgaggaacttccgtactgttttccatgatggctttacaatttacattctcattaacactgtactaggggttctctgttctccacacccttgcgaacccttgttatatattgcctttttcatagtagccatcctaacaggtgtgaggtgatacctcattgtgattttaatttgttttgcctggtgattagtgatgttaaagttttttcacataccttttggccatttgtatgtcttcctttgagaaatgtctattccagtcatttgcccattttttaatcaggttatttgttttcttgctatcgagttgtttgtgttctttatatattttgtatattagcccctttctaggttctctgttctgttccattggtgtatactgtttttatgccagtaccaggctgttttgattactttagctttgtagtatactttgagatcaggtgatatttacatgcctctttgttcatttccttaagctttatttgcctattcaaggtcttttgttattccacatgaattttaggattcttttctctatttctgtgaaaaatgtcataagaattttgatagaaaaatgtgattagaattcagtgatggaatcattgaatctgttgatcactttggattttatggacattttatcaatgttaattcttccattccatgaataaggaatattttttcatttacttttgtctccaatgtctttcatcagagttttatagttttcagtgtatagatcttcacctccttggttaaatttgtttttaaattgttggggttttttgttttgtttttgtttgttttggtagctattgtaaatgggattgttttcttgatttcttcttcagacagctccttgttagtgtatggaggtgctactaatttctgtatgctgattttgcatgctgaagctttactgaatcaattagtttcaacagttttttggtggagttgttagggttttctataaataagatcatgttatctgcaaacagagacaatgtaacttttcctatttcttcttttgcctaattgctctggctataacttccagtattatgttgaacagaaatggcaagagtgggcattcttggcttattcctaattttaaaggaaaagctttcaacttttaacagtttagtgtgatgttagctatcgtattttatatatatatggcctttattgtgttgaggtacattccttctatatgtaatttgttgatagtttttatcatgaaaggacgttgaattttgttaaatgctttttttatatttattgagatgatcatatggtttttgtacattatgttaatgtggtgtatcattttcatagatttccatatgttgcatccctgtgacaaatcctacttgatcatagtgtattgattcttttaatatgctgttgattttggtttgctaatattttgttgaagatttttacatctgtgttcattatagatattagactgtaatagttcttttctttaatatccttgtttggcttttgtattagggtaatgcaggcctcataaaataagcttggaagtattgtctccttttcagtttttagaaaaatttgaagaaggattggtattaattcttttttgaacatttaggagaattcagcaatgaagccatcaggttctaagcttttctttaatgacattaaaaaaaaaattatagattcaggccaggtgtggtggctcacacctgtaatcccagcactttgggaggccgagacaggtgagtcacctgaggtcaggagttgaagaccagcctggccaacatggtgaaaccccatctctactaaaaatacaaaaatcagctgggcgtggtggtgggtgcctgtaatcccagctactgggagactgaggcaagataattgcttgaacccaggaggcggaggttgcagtgagccaagatcgcaccattgcactcaaacctgggcaacaagaacaaaactctgtctctaaataaataaataaataaaagattcaatctccttactttctattggtttgtttacaatttttattgctttataattcagtcttggtaggttgtctgtgtctaggaatttatccattttttctgagttctccaatttattggtgtataattgtttagtgatttttttcatacctatgtggcctcaattgtaatatctcctccttcatttctaattttatgtatttgagtcttctttcttttttcttagttaatctagctaaaggtttgtgagttttatgtttttaaaaaaaccaacttttagtttcattgattttttttctttctattgtatgtctaatctctattttatttctactctgatctttatttccatcctgactgtaactttgggcttccttacactaactagttctttaaagtgtaatatcaggttatttgagattttttttctttttaagtattgtcttttattagtataaatttctcaggactgctttggctacataccataaattttggtgtgttatgtttactttttcattattcttaagatatttttcttgagaatcaaaacttcccttttgatttcttcttgaaccattgattgttcatgagtgtgttgtttaatttccacgtttgtgaattttctagtttttcttctgttactgatttctagtttcatatcattgtggttataaaaattactcaatatgatttcagtcttactaaatgtgttaagatttggtttctgggctaacgtatgatttattttgtaaaatgttctttgcactcaagaagaatgtgtattctgctgctgttggctggaattttctgtatacgtctgttaggtttattttgtctgaagtgtaattccagcttagtgttcctttactgatattctttctggattatctatccattgttcgaagtgaaatgttgaattcccaactattattgtattgctgtctatttctccctttagatctgttaatatttgctttatgtgtttaggtgctctgacttcggttcacatatatttacatttgttatatcctcttgattaattgatccttttatcattatctagtgaccttctttgtttcatgtgatggtttgacttaacatctgttttgtctgatgtaagtttacctgtccctgttctttttggtttccatttacatggagtatcttcactttcattctgtgtgtgtccttaaatgtgaagtgagtctctttcaggcagcatataattgggtcttatttttttttatccattcaaccactctatgtcttttgattggcaaatttagtctatttacatttaaagtaatgattgataggtaaagatttacttttgctattttgttaatggtgttgtagttatttggttgttttggagaccttttgtcccttttttcttgctgtctttctttgtgatttgatgattttctgtagtggcatgtttcttctattcctttctcttcatcttttgtgtatctactgtaggtttttgcatttttgttaccatgagggttacataaaacatcttatagttacgctagtcatacaaaaacatacaaaaacttacttttactctcggtattagtctgtcctcatcctgctaataaagatatacctgagactgggtaatttataaaggaaagaggtttaattgactctcagttccacatggttggggaggcctcacaatcatggctgaaggcgaatgaggagcaaacacatcttacatggcagaaggcaagaaagcatgtggcaggggaactcccctttataaaaccaacagatctcatgagacttactcactatcatgagaacagcatgggaaagatctgctcccgtgattcatttacctcctactaggtccctcccatgacaggtgggaattatgggagctacaattcaagatgaaaatttgggtagggaaacagccgaaccatatcattcttctcttatattttatgttttctgtgtcagtgtatgtatttttacattatatatccattaacaaatttttgtagctctagttcttttctggaaatgcttttgtctttcaacatttatattagagttataagtaatttacacactaccagtacagtgttagggtattctgaatttgactatatatttacctttgtcagtgagttttatactttgatgttttttttttggggatggcgtttcactcttgttgcccagggtagagtgcagtggcacgatctcagctcactgcagcctccgcctcccaggttcaagtgattctcctgccccaacctcccgagtagctgggattacaggcatgcaccaccacacccagctaattttgtatttttactacagacaaggtttctccatgttggtcaggctggtctcgaacttccgacctcaggtgatctgcccgcctcaccctcccaaagtgctgggattacaggcttgagccaccgtgcccactctatactttcatgtttctaagtagtggccttttgttaaagtctgaagaactcccttttgcatttcttgtaacacaagtctaatagtgatgaactccctcagttttgtttgtctggaaaagtctttgtccctcattggtgaaggatagctttgctgcataaagtatttttggttggcattttttttttctttcacaaactcttcccacttactcctggtctgcaagatttttgctgagaaattcatcagtggtcttatttagcttcccttgtatgtgatatgctgcttctctcttgctgctttaaaaattctctgtctttgatttttgaaaatttgattataatgtgtcttggtgaagtcttctctgggttgaatctgattttacatctttatgtttcatgtaccttgatgtttatatctttccccatatttagaaagttttctgacagtatttctttctctttctctttctttctttttccttctttcgagacaaggtcttttttttttttttttttttgagacagagtctcgctctgtcacccaggctggagtgcagtggcgcgatcttggctcactgcaagctccgcctcctgggttcacaccattctcctgcctcagcctcctgagtagctgggactacaggcgcccaccaccacgcctggctaatttctttttgtatttttggtagagacggagtttcactgtgttagccaggatggtctcaatctcctgacctcgtgatctgcctgcctcggcctcccaaagtgctgggattacaggcgtgagccactgcgcctgggagacaaggtcttactctgttactttggctgtactgcagtggcataattatgactcactgaagccttaacctcccaggctcaagtgaccctcctgcctcagtctcccaagtagttaggactacaggcacacgtcaccacttaggcacctggagattgggaaggcagaaaactgtgggatgcccagtggccaaacctgcagggggtctgttgtagctatgctgactgctagattcctcagcagccagcaaaagcctgttagggtcttctgcagagcaagctgccgtggtccacctcagtgaacaccgtggtatcctcaggggtgaaatctcttgtggtagccacaagggctgttgaggtcctcagcagagaaggctgctggaatcctgtgcagagcaggccactaaggataataatgatttctgcttatatggctgatactgatagcccccatccttctttgtttccacccatgccagtctcttcagcaatctgggtggggtataactaatgctggttgctgatttctcaggcagtaccctgaaagtctggggaagctgctctttcatcctgctctccattgccatgccagtgattacaaacttgggagttccttttctatgctgatcagtgctagccttgggaatgggatgataaaggcagaatgaactgtttctttcttttgtgtggttatggaatttttgtgtcattacttatgggagttttcttccagtgtattgctgtagtttcttaagtagattcctgagctcttccagttattcccattcatgggtagcgtccaattattgttctttgtgaagaaaacgaaggctgggttttcctacttagccatctttctgacatcattccttgcttttctttatagctttgtcatatttacatattccatgtttagctttgcatgttcagaatttaatatgaatggaaccatgctcttcatattcttatgtaacttggtttttatgtttttttttttttttttgctaagcattgtttctgagagtcagtcgtattgatgcatgtacatagctgtaacttatttattttcacttctgatagtattccattgtatcaataacaagtttatccattctcttgtcaatggacatttggttgtttctgttgttcttttgctataagaaacacgtctgctgtaaatactatgcatatgccctttggagtccttaggtgggggaatcaaataggttaccttgtctctgttattattgttttcctcctttccaggtggcttacacctcccttgtgtctacattttttgcaactctagaaaggaggggaagagagtttatgaggtattggggatagcaggggatagctgcatttactaccctttacttcaaaatagcttcttttgtcagaccattacacattgtagttctctaggcctctgccttaggccctcctcttttctcgttctatcccttcttcttaaatattaacatttatttttatggtttcaaataccatctaaattctggtaactccaaattggtatcttcatttcataactctcttcttttcacttggcccatatatccagctaccattcctcatcaccatgcatatgtctctactataatcacttcagactcaagtccaaaaccaaagttgggatctttcccttctttcctctcccacccttaattgcttctccagttttctatttctctgtgagggcatcttccctgatctatgtgattatgtgactaggtacctggaagttgaccttgacactgctttctccttcccaccctcatattcccacccccatatccacccactcactcactgaaatatttctaaaccagtagttttcattattttcactgccaccaccctaattcaaatcaccattgcatcaagcctggactagagaaacatcctcctaaggaatctctctgtatctactcttgcttttctctaatccattgggcagccaaagtggaccatttacattatcaggtttcctttttactttcttttttctttttttttctttttttgagacggagtgttgctcttgttgcccaggctggagtgcaatggtgcgatctcagctcaccgcaacctctacctcccgggttcaagtgattctcctgcctcagcctcccgagtagctgagattacaggcatgcgcctctgtgtccagctgattttgtatttttagtagagatggggtttctccatgttggtcgggcaggtctcgaactcctgacctcagatgatccgcccacctcggcctcccaaagtgctgggattacaggcatgagccaccgcgcccggccatcagctttctaataataacttttcagtggcttcccagtgcccttgaataaaatccacagtttttaaacattttctataaggccatcttttgtgtactttctgcctacatctctagcctcatcctgagctgaaaccacctgtcccctatattctcaatatgtactgtgtctccttactccttcatatatgttcttccctctctctggatcaccgttatactccccttgccttcctagctaattttatctctttggatctaagcttaactgtcatttttttagggaaacctgttctgatcttattcatgttggcttctctttttatccacattcatcaagccctactttctcatttgtaatattcattatttaatatgtttcttttctgctggattatacggtcaatgagatcacgaaggctttgttctctgtcttattatcagggctacttcaatacctggcaaatagtaggctctcagtaattttttttttgagaatgaatgagctgcatgtatctaaatttctgcatttttgtcccctcactcttggagataaattactcatcctgcctttataaagatatgatgaaaattctggcacatagctgttactaacatggaatttctagtaaaaaattacattagacaaaccagaatcaggcactaggttttttaaggaatattaccaaagaaattcagaagctagtacatttatttttataatatctactgaatttccaagaagtgacacttgttcctcattgggatacacaaaatctaggctcatattacttgctatttttagattttttaatgaaactttgccttactctgtctcttccagtcattattctgaataaattaatagaaatgagtatcataatgttttaagaatcaaaaaataaaaacaatatttatgccatttttctgtgtaatgtcatctaagcatataatggcaatactgaaattagacaaacattgtattaatctcttgtggaaataaacatctgacttggaagaatatacttaaaatttatcaaatatcttttggcctattagctactgtttattatctgtttttcatggctctatctatctcatagcccatgttcctgagatgttcctgtgtttaaatgtatgtagtatatagacagaatctatccttagaggtctatcctttgagataatcagcactaccaacaacattgttcatagaatatattatacttaagtagctatatcttctgtgtgttctatagttcacacttaaatcaaggaagtaatcctttcattatgtaattatattaactgtcagtaataactgttctatccaaaatacctggtgtgctctttgatagcaataaattacacagttatagtataactggacttatactccagttataaggcagaaagtcttctccgagcaatctatattcagttattaaatatgagtaataataaagcattgtgttcatttggaaaccatgtgtcttttaatttccaaatatgagttttggtgtttgattggtctaaatgtctggcataactattcactctctttccaagtgtattgatgtaaatctgaattcagttttattattagtttattcaaattgtattctcactagctggctagatggtaaagtgtaagagtaacatatgactgcctgtggaagtttgttacatttttgtttggacttcatgaagccatatgttttttgttttttgttttttttaagatggagtctcgctctgtcgcccaggctggagtgcagtggcgtgatcttggctcgctgcgacctccacctcccgggttcaagcgattctcctgcctcagcctcctgagtagctgggattacaggtgcgtgccaccacgcccggctaatttttgtatttttagtagattcgggttttcaccatgttggtcaggctggtctggaactcctgacctcgtgatctgcccacctcgccctcccaaagtgctgggattacaggcatgagccaccacacccagccggccatgtatttttataaccaagctgccctcagaattatgaatagtatttctgacatgtagtgtcttttctcatttatcttagaatatatggttaccactctataaacagtttgtctattattctggtactgtgcttagtttaagacacctaaccattaactagttttcagaatggttttgctttttagtgatagttgtgtgagcgcactgttgctctggttgtttttaaatctcactgaggtaggcttcaggttgttaatgtaaatctttatagctttggctgaacttcctacaagagctgtgggtcttgatagctgagatcagctggctgatctctcttaatggcagttagatttgaattttgtgggctaggacacagatctgtttggaaatggtctgtttaatgcatgatggctttaaatgaagactaaaaaaacgggccaccttgtaaaaagaaagtcttagtctctagagttcactacctttcttagtttgaaccaatccaagtttttaactctccatagggcccggtaatttgaggtggaggaaactaatatgaactttacatttcatttcaatattaattccaagccagtgtgctttaaggattgtcacaaacatattatgactggacaggaagagtgcttgcctcttggtcttgagtgacaagccctgccctctgcccctagctgagaactcaaagcattgttaagtagcactaaaacgagctgagtccaagacttcagccagatggtcaatatagtgcttttaaaggaagggaaataggaaaagagtaatctcagaagcactcctatgttaaagaactaagaaactgaagtctttctgaagctaagtgtaaattattccactttctttgggagcaaaagctgcaaaatataacacaagaaaatgacagtgtaggaaaccaaagttcaggaacaaaccttcaagtgtggttttctaatgcttaatcgtatcttacgcccttctcaggatccattgctccttttccctccctcttctccaaggtctgtttgaaagggattttgatgggataggaaggcagctttagacagagcataaattagggcataagatgtcctttgtacaagaattatcttagacatgctttcaaaaacatactttttttgaccttattaagaaaataatcaaaggtatgattttttaagtctttgagtttagtctgctttcagtaaaaataaggtataggtaccaaaataagcaaacctcgtttttactttcctggtttctgcttatacgatttacacatatttaaaataaacccatgaaaaacaggaatagtgtcatgggattggctaaatagtcagagcaattacctccaggctcccaaacccaactgagcttgacttttggaagtaaatttggctaagacttcttcctcattctgttttataaaggtatacatgaaatgatactgacttctgccagaaaccccaggaatcctgttcagtgatgtacttgtaatggtcatgaaagaataaaaacacagatgtggattaaggtagaaaagtacagaaaacactaaattttcattgtgctgtttcaatgtggcagattctttaaaatacttcgacatgctacaataattaaaggttttaagaacattaagatacttaaaaaataaaagcccacaattgaataacaaaaatgaactttgttttattttttattggcattaatgtaggttgccgtggtgaaaatagtttgaaatacttcacagtaacagttttgtgcagccctagagatcaaaaacagcaaagtaaataagcaggactctcaacgactcatactcacagacatgtttaatgtaaatgattgctagaagggaagggcattttcttcagtgctatgcaaagaaattttaattgacttggttttggcagtgagaattgtacaacttagcattaataagtcaaatttaaaaatttgctcattactctggattatgactatgttcaagaaatactattttcaagcactaatcatttagataaaactttttttacacatttatggcatcaaggagtatgactgtttataacattttacctataaagctgaactgttttatatactctttatggaaacatggccataaattaaaagatgcaactgttttgaatattttactggtggtcctctgttttcctgccagcagtgcagctgtttcaggtttctcaggataacatataaaaagctgtatgcacactgcaagtttatgctcaaattgccaagccagatatggtatgactcaactttcccagaagcaagctgtaccaaaatgtgatgaatcaaaacagttagttgcacagtggtttgtattacagctatgaaaaccaattctcatttatgatgtttggcttttcaaggttgacaaacattctactgtggtgcttgaattttaccataagtgaacatctattgaagctaagactatgcttttcttttgaggatctgaggaaaggaaagggtgatacattatcatctggtgtgcggataaaaattagctggaaacttgtatcaggaatggaacatttcatttccaagttacctataaaaatattactcacttattatttgtatgatagttattgaattccctgtgaagccaggttaatttttagacctttctgaggtaacttaacatttacttcatttctcatgcatcagaatcttaacagttgatactttattgtgtcttggaaagtaataagcagataactttatggccatggggtaggtgtggtgaatccctatttcaatcctatgcgacctaaggttctatcaagagtttaacaacgactatttttcttttttttttttaaacagggtctcactctgttgcccaggctggagtgcagtggtgcgatctccgctcactgcaacctctgcctcatggactgaagtgattctcttgcctcccaagtagctggattacaggcacctgccactgtgcctggctactttttctatttttagtagagacggggtttcaccatgttggccaggctggtctgaaactcctgtcctcaggtgatccacctgcctcggcttcccagagtgctgggctcacaggtgtgcgccaccacacccagacaacaatgactaattaataatagtagtctctaaagtgggatgtgtcccatgaggatatgtaagatacagtatatggagaaaatattaaaacattcattcattaatttatttagagatggagtctcgctgtgtcacccaggctggagtgcagtggcgaaatctcggctcactgcaacctccacctcctgggttcaagtgattctcctgcctcatcctcctgggtagctgggattacaggcatgtgccaccacgcccagccaagtttttgtatttttagtagagatggggttttgccatattggccaggctggtcttgaacttctgacttcagatgatccgcccaccttggccttccaaagtgctgggttacaggtgtgagccactgtacccagccagaacttttatttaaatatttttatttcatcctttttctatttatatttttatattacactgactatattagtatcttatgtatataattatatatagtaacatatagtacattagtattctacataaaacatatctgagatatgttttatggctataaaatactatcaaaaatgtttttgtttttgttcaataaatattctcttcttccttccgctttcccctttcgcccttggcagagaagcaaataattgagttaaaaccttgatttgtggcaatgtgaataaattatagctaattccaggaacttagctgcatcctaccttgacccattttttctactggactcttatattgctctatatgttttagctacacaggtttattaaacatggatacagatgaaaaacagacttgttatgttagaagttataagttgctcatgcattaagattttgacacacaggaagtttgaatgaatgagtgaaaaaggttccaagttattaaaatgttctggtacctgatttattcatttgccataccagtaattctaaggtgggtgaagctcctttacttcctgaagaaacaagttagtttcttaaactaagcattaaaagaaagctggaattatttgtttccagaagtgttagtagtcatgctaagttgcccttctttggctagattgtccaatgttttttaggcctgttttgtctatttttgtcaagatataaatgtttaattgctttaaaaaaactgtgtggttgcagaaaaaaattgtactgttatattgttgagatcaatgagacttttctgtatttactttttcagacattattttgaactcaggctcagtctcagagatttcttcaacatgtaattttctaatgtttcctttcctgcaaggaatgagacaatatattcttggaatattaaagtacttttgaagtaactcatacgttttctcccctcttccatttgtttagctattgagggtttgctttaaaacaaatttatgtagaaatatcagtactataatagtattgtgatactgtgtatttcttaagcatatgccaggaaggagagcattagttaggtgtccaaaaaacagccaacaaaacaaatcagctctgaaaatcgtgaagcagtgaatattttagaattatttttgaaacctctttcagaactgtttttagaccccgtggtaatttgctatgtaatttaatactagtttaggcactccatgtacagttggtatgtttccttttgaaagataataatctatttataataaaagtctgaatatttcaatctcggaattcctctttaaaacttgaatcagttttactattgctttttaaaatgttacctatttatatttgctttgtatatcaatgctacacttcttgttttgttttaggtatttaaaccatgtcagagctgcctcaccacaggaccttgctggaggctatacttcttctcttgcttgtcacagagcactacaggatgcattcagtgggcttttctggcagcccagttaaccatttataagatttggaccttggagctgaaccagggagctagcaaaagtaaagcagacttataaaattatagctatgtgcagctgcacaacacagtccttccactagcagctgtgttaaagtatttataaggagaaaatttcagaactaagttgagtaatataggggatatatatttgtgaaaaataatttttacttatatttttcagaggatttgacacgataagcctcatctgatggaagagaggaataaataattcacctatatgtgtttgaggttgtgacagacttataaaatctttttaaaaaataaagctataatttatattaagttctgtggtttttctcttattacagtgttttacttgaacacattttaaataccattttgattacaacatttactgttaatatccaagtctattatttcttctcataaaatgttcccctttttcctaatgtcttgttaatactagtccagacaagtggatatatttcctttgaccaagttatggcaagaaaaacctgacccatgataatgtcattccctcaatactaaggactcaatgcctgttttaagcagtggaaaatgaggcaaaccttgatcaaggtgttatagttcccagctgtgagccacactcaggataaaacaaaacccagcattaacctgctttagtgacacattcaaagaagttaataaaatttaatacttaaatgatacctttcacctccaatgtaagctcattttatgatgaatcctttggagactggagaaggtacattttaagtacagttccctatgtataaattgtatactgatacagtttttttgttgaaacttcaaaggcttttattaccagggttttgcttaaagagtttagatatgaataggatgatattgcagcatctcaaccttgtatgagtctgttacatagagcattggatatgggatatagtttcttaaggaaattaagggatttcctatcaaatctctattacaacagatgttagttttatgggtagaaacttaggtgaaacaagacttgtggttacattaggatggactatccatctgtaacaactccatcttattttactaagcagttattaattaattttagcaatacatcttcatctttattgtacttctatctttgttaaatgagaaaaccaaggcatcaaataattgagtagacaaagatcatattcacaagttagtaaaaagccagaattagaatgcaggttttttttttcaaagtccagttccatctacattctaccagactgcatatcctattcctgtatctattaggtattcccgaactgaggattagtgtttttaagtacagtctataaatctgttcaaagaatagttagaacattgaatgtagagttaaggctttgcagcagccaattgcaaaaataaggaatccagtcttttgaaaagaaacactactgcttgttctcataccttttataaatgtattttaaaaagaatgaactaattaataaaacatatcaaaggcttttaa

SEQ ID NO: 84 - DNA, 30161 bp, Homo Sapiens
atttttcatgggtttgcggacccaccagcgaaggcgggaggtgtcgcagggacatcttctggctgtttccgtcgcctgcgtggcccttgcaccccggtcttccattagcggcgcagacgtttgggcctaagcgctgggcgaggcgaggccctgcccctccccgccaacggccattctctggacctgtctttcttccgggaggcggtgacagctgctgagacgtgttgcagccagagtctctccgctttaatgcgctcccattagtgccgtcccccactggaaaaccgtggcttctgtattatttgccatctttgttgtgtaggagcagggagggcttcctcccggggtcctaggcggcggtgcagtccgtcgtagaagaattagagtagaagttgtcggggtccgctcttaggacgcagccgcctcatgggggtccaggggctctggaagctgctggagtgctccgggcggcaggtcagccccgaagcgctggaagggaagatcctggctgttggtatccttaacgccgcgttgggacttggggtgcagggattcggggctggattcctcgcggggctctgccttgggcacagtggcatctgcaggatgatggtcttgggtcggggtcggggtcgctatagaatctctgtcactaggttttctaagtacagtcgtccctcggtatccccggggctttggttccagcccctcctccgtataccacgatgttcaagttccttcaactcccttatataatggcgtggtatttgcatataaactacccacttccgtaatcttttaaatcgtttctagcttacttgtaatgccgaatgcaatgtaagtgatctgtaaatagttgttatactgtattttaaaattttttgtagtttttattggtatgttttatttatttatttttttccatcgcaaatatttttgatccgtggtaggttgattgcggaatcgggtgatgaggcgggccgccctgtctgctttccccagctttgcagtcttagcggcctgtgcatcctggtttgtcactttgtggcagtgctttatgttcctctctgccttagttctctcatctgcaaagtagaggtggtgatagtatctacacacaggattggaatgaggaataaagaaattgcctacatgagagaagtttagtgcgattaatacagtaaatcttaaagttattatcctgtccgggaggtcagtaaggagagcagagtagacttcgacgattagttttgcttgagtcttgccccatttatgtttcttagaggaaggatagtgtggacaggtgttttacccattttttaaattgactttttaaggactattgtttctgtacatgtttggctggttttgtttgtcattggaattaaattcttttttcattagcaaaacgtgatactgcttttgaaatttttatctttttctttgttatgtagtcattttttttttttttttgagtatctattctggctcagaatctggtgataccttacaccaatttcctaaatggggatctatgagtctaggggctcgtgggcttgtggaaagagtcctgtaaatgattgcggggggattggggacgggaaatggagtgcaagagtgtgtgggcgttcagcaaaggaatccctgactgtggagccctaattcttcagtaggtacaaaacttataaataaaacgacattgataagttttaaaacataatgagattatcattttttgcaagtgaataatctttaaataaatctgtaattgatttttggcttaaaagtttttatacagggtactttgaattggggaaagccaaaggatttttgttttgttttgttttgttttttgttttttagagcacatgcgctgttgctgccctcaagctgttgcttagtatcattgcagtctaaagattttctcagaaataaagggtaaaggttagttttcagtgacaagaacccttaaaacttcagcaaagatttagatcattttatgtagcagcccttgtgaagaattactaaagaggactgtggccaggctcagtggcttacgcctgtcatcccagcactttgggaggtcaaggcaggaggatcatttgagcccaggagttcaagaccagcctgggcaacatagtgaacccctgtctacacacagtcaaaaaattagctggacgtggtggcctgcacctttggtcccagctacacggaaggctgaggcaggaagattgcttgggcccaggcggtcaaggctgcaatgagccgtgttcatgtctgtctctgaataaataaataaaaaggactgtgaaagacattctagtcatgacaacctcatatatttataataaactcgtttatgtcaaaggagtatatctgattacttgttctacaatcggttttgctttatttcattttcacgggaattcagacacctgaaattatttagattttattgtattgtttgttaatgacaaacttacccgttattatactagtttcataatttactcttgtatctctatactaaattgtttggtctttaaaccatctatatagcttagtgtcttatttatacagtctaaatgtctgtgtcaaataatgcagaagtaagttaaacttttgtctcttatagattttaatgtttgtaatatgcgtttaagtgtattagcaagatattaccatctctttaggctatgtatactaatggagatttttaagtcacctaactaaagaactaaagaaacttattttttgtattgaaatgttattggtctttgggtcttataccgaaagtgatttttggctttgctgcagattttaacttttctgtccgcagaaatttaattttgcgtatataaacttactgaaattagacaagtcaaattatacaaatattttcagattgtctcatttttcatatttcttgtctaacaatttatgtgaatattttcaggtcgtctaattttacatatttcatctctaagaattcaagccaaaattctcaaccctagctgagaattggcattacctgtagttaattgaaaaataaaaaataaaagaagtcctacctcagtctctatgatttagaattttaggcccatggggtttaataatccgtatgtttcagaagcttcatatcctattctaatggatagcagggatgagagccactgatctgaaactagatttcctcactgaagttaaagtttaaagtagtgggccaagtagaaactaatttaatcctatgtaatagtgagcttcatggcttttccagactatacttgtagcaagcagaaacatcgatctaatacaagacagatgcacatcaacaccaagttctacctctgagatgtatcttttatccgatctcttctcgtggtctccaccactactgtctgcgttaacttgggctattgtaactcattttagaactggtttccttataatctgttcttcacatgttcatcaaagttatccttaaatcatgttctagaaacttcccagtggccgtatcacctcctgccattccttttgtcctgctgcactggcttcctggagatagggaccgtctctgttttgttcatggctgaattgtttggtgtatatccctagggtcttggatatgcctggcccatggtattgctaaatattatagaaataagcatagcagtagcttgctttccactaggtattttgttacatagtgttttgtaaattaattgttgatggacctacatttttttttatgttagtaaaagttaggcagtgtacattcatttaaatactaaactgttcaacttatttaatagcagatatttattgtgtataagagtccctgtgaaagggagtgcagtgcacaaattgcccgggcaagccatggagcacacaggctgggttttttccctgctagattataaactccatagggccaatactgtgttttgttcagtgcactggatatgccagtgcatagaaaaaatgctgccacataataaaaacagaaataacgtgataggtggccccttcaatgttcttttcctatgttagaaatttacctgcaaatattagcatcagtccaggtttctctctgttttttttttctttttgtttttttttgagacagagtctccctctgttacgcaggctcgagtgcagtggcgtgatcttggctcactgcaaccttcgcctcccaggttcaatcgattctcctgcctcagccttataggcacacgccaccatgcctggctaatttttgtatttttagtagagacaggatttcaccattttggccaggatggtctcgatctcctgacctcaggtggtctgcccgccttggcctcccaaagtgctgggattacaagtgtgagctaccgcactcggcctcaatatattttttaaataggaatgtatacaaggaggatgtcttcatctagactgaggaggggacccctggactgagaccttagagtaggagagaactaggcggagagagggagaaactgtttcaggcagaggaagcagcatgtgagaagaacctggaggcaggaaggagcttagtgatttctgggtttgaggaaagcccagtagcaggaagtgagcagaggccagatcattcaaggcttcctagaccaggagaagaagttttagatagtatcttgaaggcagtgggaagctttggagggttttcaccaaagatacgttggtgaaatctagtatataccttcaagatacattagaagatagaattgatagacctggtaatagctataggtggtgatgcccagcattctggctcaggtgaatggcagggacattcactgagatgggggcatgagcagctgagtggagaagacatggagttcagttttgatcatgttaagtttgaaatgtctatgaggtatggggtagagacgtcatctgggctctctgttctggggtcaggagcgtgctctgggccagacatatacatggagtcagggcgtggtgtatgtggaggggagtggaggttgatagttcagacaggaggaaagaagagggcctgagaaagatcactgatgaagtgaatactttaacagtgttacaggagctggcaaagagtctgagagcaggaaaaccagcagagcgcggtgtcactctttcttttggacaaatataacattttttgagaagcactttttagaaaagtttaaaaatataagaaaacttcaagatgaaaatataagttatctttagtctcagcagacataatatctactttaatattttggtatgtgaactagttttttatatttaacatatatactgtatcagaaaatggagttatactttatatggttttatagcctgttttactatctttaataatatttaatgactatcttccttatcacacatgctcctgcaacttccatttttaagggctttttggtattccagcaaataggtctgccataattagtttttcttttttgagacggagtcttgctctgtcaccaggctggagtgcagtggcgcgatctcggctcactgcaacctctgcctcctgggttcaagcgattctcctgcctcagcctcctgagtagctgggactacaggtgcgcaccaccatgcccagccaatttttgtatttttagtagagatggggtttcaccatgttggccaggatggtctcgatctcttgatctcgtgatccacctgcctcggcctcccaaagtgctgggattacaggtgtgagccaccgcgcccggcctatgattagttttttaaaaagacctgctggaaaacttttaagttgatttttatattttcattattataaacaagcattctgtaaataactctcattatatatccatgatgattttctgaggatcaatgtctggaagtggtaaaatagactgcaaagttttaaaaagtttttttcactatgaattgtcaaattgtcctccagaaaatttgtgctaattcatgaaaattctttagcaatcacttatttttttttaaagaagcaattctttgcaatgagacttcttaaaaggatatgtctgtctttgtatgattttaaaatgcagtatgtgaataggggtaacaagagttcaactaaaagttaactgactttaggtagatcccatgagagctaaatgtttttcaattttaaatgaatagtgataagtatttagtgttcaacgtttggataatatcagttattaggaaattgaagttgtgaggatgaagagaaaaatcccggagttttttccattaacaattctcccagatattagcatttggttaaaccaagcacttaaaggagtccgggatcgccatgggaactcaatagaaaatcctcatcttctcactttgtttcatcggctctgcaaactcttattttttcgaattcgtcctatttttgtgtttgatggggatgctccactattgaagaaacagactttggtaagtgtcgtatagtttttagtaagtgtcaaataatttttttctttctgcattcttagaaaaattcacataaaatttttgttttctctttagaattttagaaacagacttattttgacacatacttaattacatctacttttttatcttgaacaattaatttttcttttaaaaagttttatgagagttcatcatgggtacaatgataaaatttaacttttaaataaaactaactactaaaaaccttgctgttgagagttttcccttcagaggatcttgttaggtgttttatatttatttcaaggatgcggccatcactcagaacactgtggaaaccctcttttgggaagtgcctccctgaatctgagatcaagtatcctccgtgatagcaagccttcttttaaggggaattggattttaggagtaagcaatgttatgtggtgccaagtggtgactaaagtggattatctaggaaggaaattgaccatgatatagaagagtcagaatgagttgctgctttattgttctggaagtagttttaaaaaatgtttttggaaggccgggggcaggaggattgcttgagcccaagtccagcctgggcaacacagggagaccccatctctaaaaaaatgacataaaataatgtttaaacagtccaaatgacagcacccatttggatatatgacttttatttgttgaaaataccaaagtaatgaaatgatgactttgtaatcataccagatactctctaaatgaggatataggataaaagtaaggatataggataaaaataaaaagcatttataaatgctgggggacctttgttgcctcagtaagagtgtctagtcttgaatgttgcagttttcagttacccaaggcatactgtaaatcaggtactttgtggaaggattagaaaggaaaagagaatatcttggttatttttatccgatattcagccataagcacagggactatccatttgtcactacttgaacatttcttacaagatatttctatacattttagaatttctcatgatatataatcttgaatattgaagggcagaattacatgtaagtaatgcatgtttataaaaagcaatattagaaattgtttttggtgtcactgtgacattttatagaataaataaataatttcttttgggaagcatttaagctttccacttcttgggcatattaaaagacatttaaaagaaactgaaagtaaattaagtttcccaaatatattgtgtagtagcccattaagtaatagatggaaactctgggtgtcctttacgtagcagcaacctgaagatatacactgatatggcaattaggaggaaatgctaaagcagccatagtctgaaaactcagacaaaccaaattctctggaaaataaatcacagcaatgtttctagtggtctaatatcctgaagtgagatcttacatcctttcttctcataggtgaagagaaggcagagaaaggacttagcgtccagtgactccaggaaaacgacagagaagcttctgaaaacatttttgaaaagacaagccatcaaaactgccttcagaagcaaaaggcaagaggaaaattatagtcgtgttagagatgaagttttaaaaaagtgatttttgtcttgatttcctgcgattctctttccctatctaattttgactctcaacagaaaatagagagtgaaatgagacaagtaggctgccattttgacctggtaatttggagttgtggcaattctccgttctgtgagaatcaactttgctaatgagaaaaaaaagctgtcgtgttgcgtcatgtacactttttactttgattatggtcttcttgactctaggtgagcagccccgccaaggttccttcctttctctcggctgcatttattttccacagcagtggcctgagagcagccaggtcaggtccctgttcaccatcctgagcagggtctgcataatctgtttaaagatttgtgtactttccagagatgaagcactacccagtcttacccaagttcgaagagaaaacgacctctatgttttgcctcctttacaagaggaagaaaaacacaggtaaatgtttaactatttaagaatattattttagtcattgctacattcagacacatttaaaccttgatgtgttatctacatgataaggcatgtgaacatttcttaatgcatctgaaataggcatgctctatacctttcagaatatttttcaaagactaaattttttatttactattctttgtgttttggtgattcatgattcttattcctcttcattctaaagaacttctgccagggctgtggattctaaattctccaaggcatgaattttagttttgcttacactttgcttacacatgctgtctctagctgcttttcaatccagtatggtctctctcaccatgatgctaaaataccacaacccatgacattcttgttgctaaatctagcagacgctttgcacgtcttagtgtgctcgacttctctgcactaaacaccatgccacactgccccgctcccccggcatctctctggcgctttctgctcagcctctctgtggactcctcttcctctgtctctctcttaatggttggtggtttctgtgtttgaagtgaaggtggagaaccggaagcttggcagtttgcctttgtcccctgtccttccctccacctcttcctttcccaggagttcccaagagacaacttagcttttgtatcagctcagttctatttgtctccattgctaccactgtcattttttctccaggttacattattagcttttaaacttctttctgtctttgtctttgatcataccctttttgtaatagttcctcccaccaagcccaatctctgttttgtgttatagtctgtttaaaatccaaatctgatattgtcatttccttacttaaaacactttctagcttctccttctcatttttttctttcttttttttttgagatggagtctctgttgcccagactggagtgcagtggcacaatctcagctcactgcaacccctgcctcctgggtttaagcgattctcctgcctcagcctccggagtagctgggattacaggcacgtgccaccacacctggctaattttttgtatttttagtagagacgaggtttcaccatgttgtccaggctggtctcgaactcctgacctcaagtgatccacctgcctcggcctcccaaagtgctgggattgcaggcgtgagccaccacacgcagcttagcttctcatttctttaggataaaactttaactccttaattacactttccagtcttatccctgcctttcttcacatcatccacaggcaggctttcttttccttgtttctatatggtcatacaacttagttcttttgcctggaacactcttctccatgaaccttcccgctccctacaactacactcattaattcgtggctaactccaaccagtgtaattgcaggagatcctggaaagcttttgtgactcctaaattgggtgaggtgactccctattgcatctctagtgacctgcccttcccttgtggtggaagttattagatcccactctaattgcttacttacacgtgtcccccaccagaccatgagaccagtagtggcacagatcttgctgttttattcaccactgtagcccgtataacgagcagagccttgcatacaagtatttttgtaaggggtccttaaaaatcatagatatcgtaaaagtatgtttgactttcagttcagaagaggaagatgaaaaagaatggcaagaaagaatgaatcaaaaacaagcattacaggtatttagatcatttttgaattcagaatgtattctgttatttgaaatgaatgacatgaaaatgaatattaatgaggtatatcaaactgtgaaagttcctgataaaaagtaaagacagatggctttttggttgtgcatatatatgtgtacatgtatgtatttaaaacacactcacctacacacgtgtatatatatatatatggaatttgccattatgcacatctatatattcaaaacaagctatttttcttttacaaccaaccaaccaatagtaatatgtgcttacatagaaaatatagaaaacatatcattcataaataacttgtaataacagtttgatatattttcatccattctttgcctgccccatatagttgaatatctgtgtgtgtatttgtatatatgtatcaaatgtgcatgtgtacatatatatgtgtacacatatgtgtgtatgttctagttatctgtcgctgtgtaacttagtggttaaaacatcatttgttatcgtcatctgtctgggttccaggggtagatgagctcagacaggcagttctctctggggtctcttgtgtagatgcagccagtctgtagctggggctggagtgattaacgaggtttccttgctgccatgggcggtggttgatgctggctgtcagccagtcttccatgcggccagcaccagagcacctacttgtggcctctccacgtggcctgggcattttcccagcatgatgactgtattcccagtgtgggcatcccaagagaaagttctaagcagaagccctgttgcctttctgacctagctttggaagttgtgcagcatccttcccactacatcctgttcctcagaagctagttactgccctatggaaggggcagagagttagacaagaagaatgtcccacacatattttcatgaataacatttttacaaattgagattatgctgtatatatacatttttttcataaacatttttcaagtttcttagtgtcacagatagcattttttgattcccaaattcactgtttcttgtttgttcatatggttttgttctatcaggtagaaacttttgagctaaaacctcgagatccttcaggttgcggaggtgctgtgctattaatgcagctagtgagagcaatcttagttaagaccatgggcctcgtggtcaaaaagacctgcgtttcagtccaggctccactgttcactagctgtgtgatcttacacagattaaattctccaaggctttatttttttttgtaaaacgaaattgatatcaatgccttcctgatgggggtgatgggagcattagtgagggaaagcacaggaaatgctgagcgcagtgacaggtctgtcctacgtgtttgctggttggtacgtacacatgtaacatacagacatgcaggacatcaggttgtattagcttatcttttttactaatgaaggattttaaagtacttttggtaatgagttaaagttgagaaaagttttacacttttccatgtcttctgtgaatttcttttaatttcatttcttatgttataagcaaaataaaactaacttaattatgggaatgatatatattgcttgaattcctaaggcacattctgtcttgggttcttgcattttctgttctctcagcctgaaatgctctatcctcagtgaggctctttgatatcttccaagtccctgctcacacatcctctttttagtggggtcttctttatctatcaaatagatctttttttccacgttctgttcatgtaatcactctcatatcagataaatctgctttattttaccattatcttgttcatttatttatttatttattgtcttctctcctctgctcctaagagcagggaccttatctggcaccttatccgatctcacagtaccttagcacctagaacagtgcctggtgccttagaggtacctgctaagtatttttttcttttgaatgaattaaagagtgaatggctacattccctaatttgcctactcactttgttgcctgtcacagattatatgcaactgtgtttagccaattgttgattatgtagaactgtgtttattatataaacataatacatatccttaatgttgaatagaactaagtgtatgaaatgtaaatttcatggtgctgtgattttatctttacaggaagagttctttcataatcctcaagcgatagatattgagtctgaggacttcagcagcctgccccctgaagtaaagcatgaaatcttgactgatatgaaagagttcaccaagcgcagaagaacattatttgaagcaatgccagaggtgaaatatgcaacagtacattcatgcttagaattaagaacttcagcaaaactttttattagaaagaagagaaaattgataagcaatacttacacgatatctcagttaacagtaaacagcatttctacatctcagattctaagaagcatcgtatatttatacgtttgagcctatagacatttactctaagaagtttttcttgacttttgacccgagactaggtcttttttcctggtctttgttctcacagcaccctgtaatatcacttcatagttcttagttccaaaacacgcttatcttgctcacctctgtattttcagtgtctagctcagtatttttcacatggtatgtgtccagtagatgcttactgactcaattcttaggttaggtcataaaagttattgtaacctataatatacattgtctataaaaactaatagtcatatagaatctaatcacaatggaaaaataagttctaaattgaaattccaggtatatcttcctctgctgcagccctagagatgccattggctctccacattcccttgccctcttcctggacagtgcgaatggggcttcttcaccttggaacatcttgtagcttggcaggcccagaaagctagagtggaggtggtatgtgcagttgggtgctagcaaatgtgtctcctgatcatgctgccattgatacttaattcatgttactattgatgactccctgtcttagttgccagtgagtgagttctttttctctttctgttgctgctacctgttatttctaccgtagttctccattcacccactataggacagaatcgaaattttgcagcatcatcgaccttagtgcatagatggagtgtttttttattttctacaatttttgaatattgcttaaattgatagcagaaatatgaaaaaggaagggtaaatttcttttctcatcactccctgttttttccacaaagaatgtgcagtagcacacactaaggtgcacagaagtgacattcttgggtctttggatatacaaaggacagaagtaaattgatttttatttcaggagaaaaatccaggctcagtctgtctatcaggcattttatttcttgagtatgaaaggatctctggctggcagttgaggaagtagaattttggttgtgtaaacaataacaggaagaaatgggagaaagagagacagtccctaatgatttactgttctttattttctttctgcaaccatgaagtctctggaagtggtggactgtagggtggtgtggagtagcagcttactggatctgtaattttgatagagatgttctaagtcatccatgttgggcctttgtgtgatctgtatgtcgtgcaaatgtaatattgataatagtagtgatggtaggtaataatagcagtagtaataatcataataccatagttccactttactcacggtttgcagttttcagtgacctgtggtaaactgtggtctgaaaatattaaatggaaactttcagaaataaacaattcataagttttaagttgcacaccattctgagtagagtgatgaaatctcacaccctcctgctccatcttgcctggaacgtgaatcctccctttgtctagcatctccgtgctgtagatgcttcctgcctgttaatcactgagtagctgtcgcggtgatcagatcaactgtcgcgatattgcagtgcttctcctcaagtcactcttatttgacttaatgatggcacaacagtgcaagagtatgatgctggcaatttgaatatgccaaagagaagctgtaaagtgcctcctttaaatgaaaaggtgaaagttcttgaattaataaggaaagaaaaaaatcgtattctggctgaggttgcttagatctgcataaaaatgacttttctatctgtgatattgtgaagaagcgaaaagaaattggtgctagttttgctgccgtaccataaactgcaaaagtcatgacctcagcgtgtgataagtgctcagttaggatggaaaagccattacattttggggtggaagacatgaagagaaacatgttctgattgatgacaatcaggtttggtacttctgcagtttcaggcatcctctgggggtcttggaacataccccaaggatgagggggctgtctactatgttaatagaatcaattgtagtaaattgacatgcttttgatcccagatctaccacttattagccctgtgactctagggaggttacctaacctatttaagtcccaatttcttcatttataaaatggaggtgatatctgtttcataggatgattgtgagaataaaatgaggtattatatgtaaaagcacttagaaaaatgccctccatgggaaatgccttataatgttaagtattactgttaataactgtgattactgtgatttattgtgtcttttatgggataaggttgtgcaggacacttcacttgcatatttacctacattctagaagattgttaagccataatcagatgtcatagtgactgctatgcattacatgctcaatacatgtttattgaataatgattaaatcataaacagtattcatgatttttttttttttttttttgaggggaagtctcgctcttgtccctcaggctggagtgcaatggcacaatctcggctcactgcaacctctgcctccccggttcaagtgattctcctgcctcagtctcctgggtagctgggattacaggtgcctgccatcacacccggctaatttttgtatttttagtagagacagggtttcaccacgttggccaggctggtctcgaactcctgacctccggtggtccacccatctcggcctcccaaagtgctaggattacaggcatgagccaccgcacctggccatagtattcatgatttttttttgcccaactctttcgaagattatttttttaaaaggaagctgtagtttttcttgttattcaccttttataatatgaaactaccatcaatgaaaaaagccaattgttctttgttccctgttggggaaagggtggaaatatggtaatattatctgtatttaatataaaacagtaattttgtttgtttattttgcctttaggagtctgatgacttttcacagtaccaactcaaaggcttgcttaaaaagaactatctgaaccagcatatagaacatgtccaaaaggaaatgaatcagcaacattcaggacacatccgaaggcagtatgaagatgaagggggctttctgaaggaggtagagtcaaggagagtggtctctgaagacacttcacattacatcttgataaaaggtatcaggcaccatcatttatatatttacattaaaaaatcaaagatatatcatgactctgaattctataaactagcacccctggataatattaatgaaattctatttatgtaataactgtatactgctattaatggattaactactatagtgccaaaccactttaaaattagctaatgaattaactcctagttgccgattaaatgaaaatgtatatacttatttatgagaaccagtgttctcttatccatcttactagaagcgtattgtcacactgtaaaactgaatggtgagaagtgttttaattcttcttaaggtattcaagctaagacagttgcagaagtggattcagagtctcttccttcttccagcaaaatgcacggcatgtcttttgacgtgaagtcatctccatgtgaaaaactgaagacagagaaagagcctgatgctacccctccttctccaagaactttactagctatgcaagctgccctgctgggaagtagctcagaagaggagctggagagtgaaaatcgaaggcaggcccgtgggaggaacgcacctgctgctgtagacgaaggctccatatcaccccggactctttcagccattaagagagctcttgacgatgacgaagatgtaaaagtgtgtgctggggatgatgtgcagacgggagggccaggagcagaagaaatgcgtataaacagctccaccgagaacagtgatgaaggacttaaagtgagagatggaaaaggaataccgtttactgcaacacttgcgtcatctagtgtgaactctgcagaggagcacgtagccagcactaatgaggggagagagcccacagactcagttccaaaagaacaaatgtcacttgttcacgtggggactgaagcctttccgataagtgatgagtctatgattaaggacagaaaagatcggctgcctctggagagtgcagtggttagacatagtgacgcacctgggctcccgaatggaagggaactgacaccggcatctccaacttgtacaaattctgtgtcaaagaatgaaacacatgctgaagtgcttgagcagcagaacgaactttgcccatatgagagtaaattcgattcttctcttctttcaagtgatgatgaaacaaaatgtaaaccgaattctgcttctgaagtcattggccctgtcagtttgcaagaaacaagtagcatagtaagtgtcccttcagaggcagtagataatgtggaaaatgtggtgtcatttaatgctaaagagcatgagaattttctggaaaccatccaagaacagcagaccactgaatctgcaggccaggatttaatttccattccaaaggccgtggaaccaatggaaattgactcggaagaaagtgaatctgatggtacgtgtctgtgcttttgtagaaatctggaacggtaggatttcccctctgtaggaattcagagatcggttagtgtagtcccgttttaactttttacagataaggaacgagagacgtagaaagaaagatgaaatgactttcccagggagtcacagctggtcatggaatcttgaccttccctgtgttgctctgctttttgttatcatttttaaaggcatgaagtgccctatttggggaaggtaaagttgagtttccctctagtttttaaaaactttttattttgaaataattatgaactttaaaaagttggaagaatattataaaacactggttccttcatccagtacctcagtggctagcatgttaccacattagcttagaatttctcttggtctctctgtggccctctatatgtatatcatatatctccaaatctgtatacatatgtataccattgatcctcattatttgtagattccatatttgcaaaattgcctgatcactaaaatttatttataactccaaaatcagtactcaccgcaatgtctttgtggtcatttgtggacatttgcagagttggggaaaagcttgagttgccacactgtcccctgctgaggttaagcaaggtgacactctgcctggttcccgtgttctgagagagatgaccagagggtggggacagtaggggattatgcaatggagagagagcaagaagctccggccccaggccagttggaccagatttgaatccctattctggcacctgttagcgtggcagcttcacacaggtcactaatttgtttcttgaactttgtttcttgtttataaaataaatggaatctattaagatggtggttttttaggatttaagataatatatatgaaatgtgttcatatatatgttatatatgcatatgtgtgtatatgcacatagatatgtttaggagcaatgactcggtattggctaatttagtgttcacagagacttcatacgtgatggccactttgaataagagaatcaaccacacacacacacacacacacacacacacacacacacacaatttgttcctggtatctgctagttttcttcattcaaatgttactatttcccttttgtaattaataagtattttgtggaaaaggaatttttggagctatataaatatgctgttcctgaacaaacttccacccacttgttagcatccattgatgtttacctgaataatttgttactacgttggttgccaaatgatggtttttctaactccatcattccttatatattattacttgacatcctcctatgaggaagatcttttccttctccccatttatttttattatttttaatcagtgtagactcctgtattcctatttagtgagttataatccaatactgtcataatttactttgttactcaaattatcacagctttggccattggggctccttctaatggctttcagcagttttttcattatattttgagcttttccttgctttctggccaagctgtttcaggcatatgttgtactttctctgccctggtcctggaaccagccatttcaccagggagctctggttcctttcagtggagcatggggtttagacaccacaagctggatgtgagtgtgcttatggatcctgaggtataactgtctcaggccttttcagcaacagtgccaggaagtatatttatgtatacatatacatgcacacacacatctatatttatttctatgtctatctgtactaaaatccatgagtttatactgacatctgcaattccatggggttcagtctagcctcctgcttctttatagtttccctaacaatgagaaacattgctccccttatcctcaatacatttacatctgcttattctccctggatatgtaaccatctccccctcccactggcctcctccttggccctgctctcttctttgcttcagctgtgtccttggtgccagctcccagtccctgagagccccctcctctgttctgattgtctccttaaacccagctggacaggccttgccagccctctccacctacagggaaggaaggcaaccattaaatatattttaaggagaaggaaagacagtaagacagtaagagaggagagaagggaagtggaagaggaagaactatttcttagtcacagctttattctgtgctgtgtaaatagcataaaaacatactgagcaacttccatgattgtttatatactttgataatcctcctttttgaatttttaaaacaatgtcagttaacttagaacatatttatataaagcgaatatacaaatcttaagagagtttcctactttcaaagacagtgccagtttacctaattgaaaaggcttgttttgaagttacaggcatttgtgattacatttatttattaataacgctactattacatgtattctgttatagtcatatctttcctttttaggatgtagcatttttcaggttcctccagaaagctcttgatgattgcaggatcattttaatgttttgattgtagatgaagtgaccttttaattttggtacaggaagtttcattgaagtgcaaagtgtgattagtgatgaggaacttcaagcagaattccctgaaacttccaaacctccctcagaacaaggcgaagaggaactggtaggaactagggagggagaagcccctgctgagtccgagagcctcctgagggacaactctgagagggacgacgtggatggtgagccacaggaagctgagaaagatgcggaagattcgctccatgaatggcaagatattaatttggtaataccgtaacattgtgtttcgacttcttgctgaggaagccaggttaagtaggttttgagttttaaggagttggtggatgagtatttagtagctatttgcagtacatcttgtggttgctgatggcttcatttttgtgtaggttactggctgggatagactccgttttccatgtggtttagtgatgaatctctaaagatattacagagtcttggttagacatccagtggagtacttcctaaggagaaagagcttattggtaatttcagtcagactaaatgcaggctttttgtaaacaaaactcatttggattattaatataaatctataaatgaaaaaacattttataggaggagttggaaactctggagagcaacctcttagcacagcagaattcactgaaagctcaaaaacagcagcaagaacggatcgctgctactgtcaccggacagatgttcctggaaagccaggtgggtgcaggcagcttgggtttcctttaccaccttcttcagacccctgggggaatgcactgcatgaagggggtatgcactgtgccccctggtgctcagggcctggtgatgccgttccctgggggtcactgtgtgtccctaactctgcaggaatgaatgcattacatgaagtggtaggcactgctccccctgtgctcagggcctggcggtgcccttccctgggcgtcactgtgtacccctcactctgcaggaactcctgcgcctgttcggcattccctacatccaggctcccatggaagcagaggcgcagtgcgccatcctggacctgactgatcagacttccggaaccatcactgatgacagtgatatctggctgtttggagcgcggcatgtctatagaaacttttttaataaaaacaagtttgtagaatattatcaatatgtggactttcacaatcaattgggtaagacttcagagtctttttgattactttctgacatttaccttcagagtttgtcctaggaagttttctttccaaggaactagtttgatgcattgatggaaattgcaggtctatgcaaatttttatatgagtgatctttggcttatatagaggaataggattttaaacatttgaattaaggaattaaagtcctagtatgtttaggtagttaatcaactgacttagttaaactttgactagttacccgagatctccacagtgaacaaaaggtggtggagaggggaagcaggccgcgcctgggcctgtattcgggtttctggcactgatcttcttctgttcatccagcaaatatatgtttggtgactcctatatgccagttgttcttaacaagagggaaggaacagagagtaaaatagtaggagaaacagatgataagcagatacataaatcataatttgacagttggtggtaagtgccaaatagaaaaatataacagtaaaggagaggagagagtgaacttcaggcatcgagagtgcaggtgctgtttcagagagttgttgggaaaggctttactcgtgtaacttcaaggcagggacctgcaggaaataggaagcaagcactgtagatagatacctcgggactagtgagtgaaaggggctgaggcagaagcttgtgggctgtgttctagggaagcaaggaggccagtgtgagaggaggagggaggaaatggcaagggttaatcttagagaataggaagaagctgaaacccaccagggtctggtgtgctagggtatgcaggcagattgaatgtggggtgggagaagaatgaagtcgaggaggattccagatactgagcagctggtcgagtggacctgccttcagtaagacaaggagggagcacagtggaggaggagaaacgaagtgttcaggtttggatatgataaattggggatgctcattggatacccagtggaggtgttgagttgatagttgaatatatgtgactgtggttcagagagactcaggctagatagctaactttgggggtcagcgtatagagggtatttaaagctatgagaatggatgaaactttaaaaatattaacagaatgccattgaataaaataatttattttcaaataataagatatttttggtggttggatatagatatagatatacacacgtacatgatttatataataaaatgtttataaatgtcatataagaaatcttgataaaaattaaaaaatattgttactctttaggattggaccggaataagttaataaatttggcttatttgcttggaagtgattataccgaaggaataccaactgtgggttgtgtaaccgccatggaaattctcaatgaattccctgggcatggcctggaacctctcctaaaattctcgtaaggtcttttatttctttaatttggataattgtgtaaatacccaaataagcaaatagaactattatttacagcatgaactgtcatgctgtaacatgtgaacaatggttcactgagaaagcagcagaaagtattggttgttttccattttctagagatgatgaaatcagagtcagttcttagtggtgctgggcttatcctagttcaagggtacaaagccagtcctgtggatttcacaggaatgtagaagttgccttttcatccattgacatacttatagagcagctatgatgtgtcagacactgtgctggccctggggaaaggagagatgagtaaggcataggccataccctcaaggactccccccatatacttggaggtgatggagaagcaaagcaaattgtacttgtctgtgtgtttggtgtcctgagagaggtcagccaggaagcgacttggaaatataatgccaggaatgttacatccagcactcctgtcctgtttctcaccatgtgaatcccgtgacgtgttcagtggtgaagtcttgctccatccagaacccagagtcgtgctatactcggggtacatttatcattttgaagattctgagatggtaggagttatgagtatgtctgggaaagtagttttttctttgtccttgatggcatctttttaaaaaattgaaatatagtcacataccacagagttcaccgatttaaagtgtacagttcattggtttttagtgtattcacaagattgtggtggcatcttttaaccgtcactatgtcgtgagatgctgtttggtggtggctgatttaatgatccttgagtgttctctccagttacatatcctgtgtttgaaagatgctaggatgctctgacctgaagagtcagtgactggaatcactgaaatgaacggcgaaactgttgtagtgatcatggtcttccagtcatagcacactcaccaatgtgttgtattttatactttcttcatttatctttttctgattttcttattgttgaggaaatttatataccgggaatgagttatgaggtagacatacgtcatggtaggtaaataacttgaaaacctacaaataactttattatacaaataaagtaaatacatcatagaaaattataaatatgtattaaaaagatgattacagtttacaatttgtttatgtaattttagacttcacacatatatatgcatatacattgcatatatatgtatactcatttgagtgtgtgtatgattttttttataagaatgggatgatgctatatactttttattttacctgtaacccatttggtattagaacaagacctattatcaacgatgatatagatttatatcgtttttaatggctacaggtagtatctttttgcgtctatcagggctagtttaatcaagtgtcttttgttatttctatttttagaaaggtattaacagacattgatttgagtgtccttaatcttcgggttcttatctaatgattattttagaataagtgaaatagtatctgacttttccatttggtttcttgataactattgagagtgaattttttatgttcatagacggtttgtgtttctgatttagtgaatgacctgtttatgctgttccacttttctttgttcagcagtttttgctcgtttgttgcctgctgaatcattttcatatttgagcagtttctgcctttggtcctccagctcgttgatgccagataggagcagccttcgctctgcctggctcaggacatttaggatgaatacagagtaaagagcaggaaggatggtgggaaaccagtaaaatcagaatgtggcctcactttgttttctgttctcctcttctgagggcaccctggctggtgaatcattcttagagtggggctgcattgggcctgcaggttgaattgagctgtagtcacatttggtttggactacacggtgtattcttctcttgagctttaattttcaattggctaccaacatttacctttgggagattttacacaaaattatggattctgttgggggaaaaaggagagctgaaaatactgggcctgaatttctggatagccccaaaatagctggcatggagcaacagcagttcccctcccctaccccaaggccttggactgggcatgaatccttcagtttcatcacagttgcctccactcccccagctcagctgattgacagacaccttcctcctttcatctttatgtgaagtgccaggccctcctgcttgaaggagtaaccatagctttggcttgatgagctcacaagtgcactgattctaactgccagtcatgattacagtttcaaaaacgaaaatctgcaagtaaagtagaggagaattatcggtattctctcagtgcactcctggaaagaatgttgtaaaagtaatgaagaaaaattattttttcctttttgcattttgttgttataatactttgaagaccgcaattagtaatttccaacgctagatggcactcctgcatcggtgaggcggaccctggccctgacagccggtctgagtgggttcctaatgctgcactagcaagcttgtgaagcgggggagcctgagctgcgggcgttttttcaggttccattgagtacatagattggtgaggattatgttagtaactttgatggcatttattttttcctaattgtgtaaatgtttctggtcagtcgtcactgcattacaaactaccttcagccttagtggcttcacacagcagtagtcactgattttgctcatgcctctgaagctcgctcaggcctggtgggggtgtcttgtctctgttccatgtcggctaggacagctcagctgggctaggaccccttaagatggctcgcggggctgatgaggtggcttcggcctcggggcctgggtggacacttggtgagcttggcttcctcatagcatgttggagccaagagcaggaggtccaggggacaggaagtggcgagggcctcccctaggcctggcacggcttgagtcacactggtcagccatggccgccctgctcaagaggaggccacagggacccccttcgtgatgggaggagggtccaagagtgtgtcgctgtctttatccggccgatttaggcttagaatggaaaacattgaaaaatgaataaaatataaagaagaaaatgaatggctgtgtgctcacgtagaatattgcctagcacacagcgaaataatagttgttagtgttatttattttaagtatctgtttacttttctcatatatgtgttttttccaaaactggaatcatactttaagtagagttctattatctctgtttttgtatatatttatttgttttacatacatatgtatttatatatatataaaatgttaaattttaaaaacagatacatgtatctgtttttacagattttttaaacaaatttaacattttcttggcatatttacattttattaaatattcttcgatccattattgtatttgatttgaggtaaataatacagatacattacttccattttactgctgagaaagagacccagagaagttgtaacttctgtggtataattatgagtgtgggctctagaggaagactgtaccaattccagctgtgaaatcttgagccagttacttatttttgagttcagttccctcctctgtgaggtgagggtaacgatagggcatggcttgtgtgatgattgggcatgtgaaatatttaacacagtgccaagcacagaggaagacttccataaatgtttgccatcattatacattgtggctaatagtactaaaattaataaaatattctatatagcatacaatttgagttagaacttgagtttacatgttctaagtttagttcttcatccatagtgtatgaactataatgtctcattgctgtgtaagtaattgtttcctttattttacagagaatggtggcatgaagctcaaaaaaatccaaagataagacctaatcctcatgacaccaaagtgaaaaaaaaattacggacattgcaactcacccctggctttcctaacccagctgttgccgaggcctacctcaaacccgtggtggatgactcgaagggatcctttctgtgggggaaacctgatctcgacaaaattagagaatatcctttgcttcttaaaagagaaggaaacaccttgtcaaatatgtgtttggtttaaaacttatggaagagaaacttggatcatttttttcttatatcccgttaatcccattttcttaatatcccgctctccttttcactctttcttccctctcctcagttgttgttttttgtttgtttgtttgttttaaaggaacagtgtatcactctgtcacccagcctggagtgcagtggtgcaatcatagctcactgcagccaccacttcctgggctcaaggaatcctcctgcctcagcctcctaagtagcacaagccactgcatctggcccctctccttagttttaaagagggtctttgtttgaataagcagtgataagcattcatagatataaccacatacttaaatattattgattctgaaagaaggaaagatgactaatcttgtcctttttattactggttgtcctttccgtgtatatttaagtaatcatttggatagatgtttcaaaacttgcactagaattaatccaactacgtttgattttttctcttaatgaaataggcaagatatctgaaacttgtttttattccagttaaccttttttcatagtcacaagtctttgatgtcctaaagtgagagctaaatatgttttattttatagaattgaaaagaacatagtgccagatgattatgctggagtcatttattttgttagtactttcttttagcactctaatctttataaataggaaaatcttaggagatacagggaatggaatcaagaatgggttctttggacctttttatttgtcacttgtttaaatatctttcaaaatatttataagtcttaactgcatgcatattttgtcagcggtatttcggctggaacagaacgaagacagatgaatctctgtttcctgtattaaagcaactcgatgcccagcaggtaatcatggtggacccttctcctaagttcaggatgaagggtaggctgtggttgacagctgttaaagaccagttaactcttattttggggcatagagcagacattttgaaattaggataatttagatgagagaatagaagaaaatagaaaaagaaaagttagactttggcttcattttctatgatcactcttagggctgaactttggagtcctttcatattcatttttttctttgaaaaaaccagtctaataactgatttcacactaaggtgtttctgattaaatacattaccccttgggatttactttcattttttaacgaaaggaagtcttcaaagcaattctgatcatttaagtttttataagtactaatatttttaaattctataaacgaatcttgaaaggtagaagttcagtcattattgtgtatcagtaggagaggtttttgtgggaaggagcccttttgtatgacctttagttcctctaggtacctacttcttgctttatctgtgagtatgttctgactcacacaaaacaagctttcgcccacactagaaacaacccacaaaacatacatacaaataaaccacttagcagaaatgagaatgtagcttttgtgataatatatttaaattaaacccattttcattaggcttggataattttgaaaaacatgaacaaaactaagacagcatttctatgagtttctctttgttttttggatgactatctactggaaacattataaaccaaccaaaaaggaaagctatttgtcttagtgtctggtgatttcttaatttcagataaattttgttgtaatatttatctcctttttcattctaaaacttaatgtgtttatttttccaaaattagaaaatgaagaaaatgaattaaaactactcattagttacctcctctaatacagttgttaacatttaggttaaaaaattttcctgcatttatttgtggccatactaaatgtaacttaatagatctaatcctcccccccaacttattagcatattttcttctatgtattgtgtggttttcttaattccagatgactagattatatttcatgaaagatatttaaataattagttcagtttacttgttagacctttaattttcaagtttgttatagtaatgctgtgatgaacattaggcatatagctttacccatatattttttttttgagacggagtctcactctgtctcccaggctggagtgcagtggtgagaactcggctcactgcaagctccgcctcccgggttcacgccattctcctgcctcagcctcccgagtagctgggactacaggcgcccgccaccacgcctggctaatgttttgtatttttttagtagagacggggtttcaccgtgtaagccagaatggtctcgatctgacctcgtgatccacccacctcggcctcccagagtgctggggttacaggcgtgagccaccatgcccggccaaagaatatcttcttaaaagtgaatttactgaataaaaggcatgaatatttcttacagttgctaatatatactgtgaacttgcctctcaaaggtattgtatgatgataatgtttttaaaagaaagatatagtaggacttagaaacaggccccatgaagtcgtgttgctcctgaggaagatgaaatgtttagctacagaaaaatatttaacgctctttgaatatcttaggaagagatttctcatttgagatgtggactaaagacttagttgacagagatggtacaagtactgctttaggtatgatttagaaagtgaaaattactgtcagtaattcactgggagagaactgggttttgggagataatgaattaatattctctgacatagtaatccaatgtgagtgatcaaggttgagcttgttgatttggtttagaaacttgacttacttgtctgatttattattattattcttttgttatttttttagacacagctccgaattgattccttctttagattagcacaacaggagaaagaagatgctaaacgtattaagagccagagactaaacagagctgtgacatgtatgctaaggaaagagaaagaagcagcagccagcgaaatagaagcagtttctgttgccatggagaaagaatttgagctacttgataaggcaaaaggaaaaacccagaagagaggcataacaaataccttagaagagtcatcaagcctgaaaagaaagaggctttcagattctaaaggaaagaatacatgcggtggatttttgggggagacctgcctctcagaatcatctgatggatcttcaagtgaagatgctgaaagttcatctttaatgaatgtacaaaggagaacagctgcgaaagagccaaaaaccagtgcttcagattcgcagaactcagtgaaggaagctcccgtgaagaatggaggtgcgaccaccagcagctctagtgatagtgatgacgatggagggaaagagaagatggtcctcgtgaccgccagatctgtgtttgggaagaaaagaaggaaactaagacgtgcgaggggaagaaaaaggaaaacctaattaaaaaatatgtatcctctataattagttatgacagccatttgtaatgaatttgtcgcaaagacgtaataaaattaactggtggcacggtctttgta

SEQ ID NO: 85 - DNA, 71534 bp, Homo Sapiens
gcacagtgaaagaaacaagtttattggaaactactcctttacagagtagagtgtcctcagaaagcagggggagaaacccacagccctttgttagtatttctacttataagaaactataaggaactatagttaaacttggagtgtgcagataagctcactaaaggtaggggctattggtgttatccacgaccattaatcctgcaacctaagcttgctcatttatgttatatttaagtaatgggggctgcattcttaggacatttggacattctgcaggcttggtggaacatgttctgtatggccataaatattctgtaattataattggtggtcagcctgggatgtggttattttcaggccataagcatgaaccttgtaagtgcctagctactcactttaagatggagtcactctagtcatgttttattaaaaaccagaggccagccaggcgcagtggctggtgcctgtaatcccatcctttgggaggccgaggcgagcagatcacttgaggtcaggagttcaagaccagcctggccaacatagtgaaattgtctctactaaaaatacaaaaattggctgggcgtggtggcaggtgcctgtaatcccagctacttgagaggctgaggcaggagaatcgcttgaacccaggaggtggacattgcagtgagccgagatcatgccactgcactccagcctaggcaacagagcaagactctctcaaaaaaaaacaaaaaaaaaatcaaaaaaccttccctctcctgttccacttaagcctctgccctccctgtttctctctgtagcttcaatgggcggcatgtgcctctctctggctcccagatcgtcaagggcaaattggcaggcaagcggcaccgctatcgagtcctcagcagctgtccccaagctggagaagcgaccctgctggccccctcaacggaggcaggaggtggactcacctgtgcctcagccccccagggcaccctaaggatccttgagggtccccagcaatccctgtcagggagccctctgcagcccatcccagcaagtcccccaccacagatccctcctggcctgaggcctcggttctgtgcctttgggggcaacccaccagtcacagggcctaggtcagccttggcccccaacctgctcacctcagggaagaagaaaaaggagatgcaggtgacagaggccccagtcactcaggaggcagtgaatgggcacggggccctggaggtggacatggctttggggtcgccagaaatggatgtgcggaagaagaagaagaaaaaaaatcagcagctgaaagaaccagaggcagcagggcctgtggggacagagcccacagtggagacactggagcctctgggagtgctgttcccgtccaccaccaagaagaggaagaagcccaaagggaaagaaaccttcgagccagaagacaagacagtgaagcaggaacagattaacactgagcctctagaagacacagtcctgtccccgaccaaaaagagaaagaggcaaaaggggacggaagggatggagccagaggagggggtgacagttgagtctcagccacaggtgaaggtggagccactggaggaagccatccctctgccccctacgaagaagaggaaaaaagaaaagggacagatggcaatgatggagccagggacggaggcgatggagccagtggagccggagatgaagcctctggagtccccaggggggaccatggcgcctcaacagccagaaggagcgaagcctcaggcccaggcagctctggcagctcccaaaaagaagacgaagaaagaaaaacagcaagatgccacagtggagccagagacagaggtggtggggcctgagctgccggatgaccttgagcctcaggcagctcccacatccaccaagaagaagaagaagaagaaagagagaggtcacacagtgactgagccaattcagccactagagcctgaactgccaggggagggacagcctgaagccagggcaactccgggatccaccaagaagaggaagaagcagagtcaggaaagccggatgccagagacagtgccccaagaggagatgccagggccgccactgaattcagagtctggggaggaggctcccacaggccgggacaagaagcggaagcagcagcagcagcagcctgtgtagtctgcccccgggaaactgaggaactaaagaaagctgaaggtgcccacctgggccaccagaaggtgacacccccagaatccctccccagagactgcaccagcgcagccagcaggagcctggcctgggaggacgatttattattacactgggggtttccttggcagctggggtcatcagggtactttcaagaagggctcgtgcaggacatcaaacagcctccgggcctggatgggagggagaaaaaaatgaggaaccagtcattaaaggagctgtttcctgggtaaatctagagtggggttttggttctttattttcccctataccctcaagcatttatccattgagttacaaacaatccagttacaatctttttaagttattattattattattattttttttttttttgagatggagtctcgctctgtcgcccaggttggagtgcagtggcgcaatctcggctcactgcaagctccgcctcccgggttcacgccattctcctgcctcagcctcctgagtagctgggactacaggcccctgcccagctaattttttgtatttttttttagtagagatggggtttcaccacgttagccaggatggtctcgatctcctgacctcctgatgcgcctgcctcagcctcccagtgctgggattataggtgtgagccactgcgcctggctaagttattattatttttttgagacagtctcctggtgtcacccaggctggagtgcagtggtgtgatcttggctcactgcaacctccgcctcctgggttccaacgattctcctgcctcagcctcccgagtagctgggcctaaaggtgcccaccactatacccggctaatttttgtatttttagtagagacaggggtttcaccatattggccaggctggtctcgaactcctgacctcgtgatccacctgccttgacctcccaaagtgctaggataacaggtgtgagccaccgcaccctgccaagttattttaaaatgtaccattattattgactatagtcacctggttgtgttatcaaatagtatgtcttattcattctttctttgtgtgtgtgtgtgtgtgtgtgtgtgtgtgtggtacccattaaccttccccatctccctgccagcccctaactaccctccccagcctccaggaactatccatccactcttatctccatgagttcaattgttttgatttttagatacacaaataaataagaacatgcaatgtttgtctttctgtgcctggcttatttcacttaacataataatccccagttcattatgttgtaattgacaggatctcatgttttttttgttttgttttgttttgttttgaaaagggtctcgctctgtcgcccaggctggagtgcagtggcacaatcttggctcactgcaacctccgcctcccggattcaagcgattctcctgcctcagcctcccaagtagttgtgattacaggcacgcgccaccacacccagctcattttttcatttttagtagagacaaggtttcaccacgttggccaggctggtcttgaacttctggcctcaagtgatctgcccgcctcggcctcccaaagtgctgggattagaggtgtgagccaccgcgcccagccaggatctcattcttttttatggctgaagagtatccattgtgtgtaagtaccacattttctttgcctggtcatctgctgatggacacaggttggttctaagttttggcaatgtgaactgtgctgcaacaaacaggagtgcagatacctgttccatacactgatttcctttttttggggatatacccagcagtgggattgctggatcatgtggaacctcaacttttcagtttttagaggagcctccaaactgttttccatagtggttgtactgatttacattcccatcaaaagtatatgagggttcccttttcttcacatcctcgccaccatttgttattgcctgtccaccatttgttattgcctgtcctttggataaaagccattttaaggccgggcaccatggctcacacctgtaatcccggcactttgggagaccgaggtgggtggatcaccagaggtcaggagttcaagaccagcctgaccaacctagggaaaccccatctctactaaaaatacaaaaactagctgggcatggtagcgagtgcctgtaatcccatctactcaggaggctgaggcaggagaatcgcttggatccaggagacggaggttgcagtgagctgagatcatgccattgcactccagcctgggcaacagagtgagactccatctcaaaaaataataataagccattttaatagagctgagatggtatctcattatagtttatttttggtttttggttttcttttttgagatggagtctcactctgtcacccaggctggagtgcagtggtatgatctcggctcactgcaagctctgcctcccaggttcatgccattctcctgcctcagcctcccgagtagctgggactacaggtgcccaccaccacacccagctaatttttttttgtatttttagtagagacggggtttcaccatgttagccatgatggtctcaatctcctgacctcacgatccacccgcctcggcctcccaaagtgttgggattacaggcgtgagccaccatgcccggcctatttttggttttttttgagatggagttttgcttctgttgtccaggctggagggcagtggtgtgatttcagctcactgcaacctccgtctcccgggttcaagagattctcctgcctcagccactcaagtagctgggattacaagcatgcgccaccacacccaactaatttttatatttttagtagagatggggtttcgccatgttggccaggctgatcttgaactcctggcctcaagtgatctgcccgcctcggcctcccaaagtgctgggattacaggcatgagccactgcacccagcctcactgtagttttgatttgcatttttctgatgatcaatgatgctgagcaccttttcatatgcctgcttgccatttgtatgtcttttgagaaatgttaattcaaatattttgcccactttttgattggattattatattttatcctatagagttgttagaactcttatcttctgattattgattccttgtcagatggttagtttgcagatattttctcccatcctgtgtgttgtctcttcactttgtggaatgtttgctgtgcagaagccttttattcttttttttttttttaatttttgagatagagtttcactcttattgtccaggctggagtgcaatggcgctatcttggctcactgcaacctccacctcccgggttcaaacgattgtcctgcctcagccttccaagtagctgggattacaggcatgtgccaccatacctggctacttttttgtatttttagtaaagatggggtgtctccatgttggccaggctggtcccaaactcctgacctcaggtgatccagccgcctcagcctctcaaagtgctgggattacaggcccaagccaccgcacctggcttagaagctttttaatttgatgtgatcccatttgtccattttgctttagtttcctatgcttatagggcattactcaagaaatctctgcccagttcaatgtcctggagagcttctcaatgttttcttgtagacgtttcatgcattgaggtcttagatttaagtctgtaatccattttaatttgatttttgtatatggcgagagatagctatctagtttcattcttcctcattggattgcttctgctttgagacaggatcgctctgtcacccaggctggagcgtagtaacatgcttatagctcactgcagcctcaacctcctgggctcaagcgatcctcccacctcagtctccccagtagctgagactacaggcacgtagcaagctcacaccaccatgcccagctagttttttttatttttagtaaaaatgaggtgtccacttgcccaggctggtctccaacttctggcctcaagcagtcctcccgccttggcctcccaaaatgttgggattacaggcggaagccactgtgtctggtctttggttcttttttcaccttaaaactttggggtctcaggttgtgtttatttggggctctctccttcccccaactccttgggttctttcccagagctcttactttctgagggcccaggcctgggcataaggccagatcttctcttgatgcggcgatgagctgttccagagactgaaaggtgaaagcgaggggtcagggcagttgagcacaaaagcctcccctgtcccagctgaggaggggcctcagatattccccaggggagatgagggcctgtgggaaggcaggacgggcaaggggtgggcagggagatggaaggaaatgggtgacaggctttctaaaaaaggcaaggggacagaaatgcctatggggcaggggagccattccttactccaaatgtggtcaggagggtctgactgtccgttttgttgactgacttcacggtggtcagacattcagtcacctggaaagggtggaggcaggagtgtgtcggaagaagaaaggccagcaagactgagcctaggagggcagggctgggtcacagctgtgtccccagactgcctggcgtgcaggaagcactcaataaacgctttttttcccaactgattaaaaagtcatctcaggctgggcgtggtggctcatgcctaataatcccagcactttcgaggccgaggcgggaggatcacctgaggccaggagttcaagaccagcctggccaacacactgaaaccccatctttactaaaaaatacaaaaattagacaggcatggttgtgggcacctgtagtcccagctactcaggaggctcaggcaggagaatcacttgaacctgggaggcagaggttgcagtgagccgagatcatgtcattgcactccagcctgggcaagagagtgagactccatctcaaaaaaaaaaaaaaggaattaggcaggtaattgggcagagggaacagaaggggcaagtgcttggagaagcgagctaggcctgggagaagtgaagtgtgaagtggaggccacggggcttctgagcctgacgggcccttgttgagcctggtgagaagtctgggctttctctcggggtactggggagccatgggaggattttgagctagggagggtagcagcagatttgtgctcaggaaaacccctctagctgcagtttcggtgggatgggccaggaaagacgaggcccagggatgaatggacagtgccttaaaattggaactgaagctcaaccacccaggagctgcggggaggcccaggcagggatgggaggtgaggtggcctcacccgggagacgaagtcctgctctagcttctccatcaggaggtccgctggtttctgctcataggccttgtaggtctccaggtaccgcccagcttcctcggggctgggataacaggatacagggcagccgggaggtgaggtatcagattatagatttgcttcattatggtcagtcataagaattgccaatactaggccgggcgcggtggctcacgcctgtaatcccagcactttgggatgatgaggcaggcagatcatctgaggtcaggagttcgagaccagcctggccaacatggtgaaacctcgtttctactaaaaatacaaaaaagtagctgggcttggtggcgcgtgcctgtagtcccagctactcaggaggctgaggcaggagaatcgcctgaacccgggaggcggaggttgcagtgagccaagatcacgccattgcactcccgcttgggcaacaagagtgaaactccatttcagaaaaaaaaaaaaaaaaaggccgggtgtggtggctcacgcctataatcccagcactttgggaggctgaggtgagcagatcaccaggtcaggagatcgagaccatcccgactaacatggtgaaaccccatctctactaaaaatacaaaaaattagccgggcgtggtagcgggcgcctgtagtcccagcttttcaggaggctgaggcatgagaatggcgtgaacccgggaggtggagtttgcaatgagccgagatcacgccactgcactccagcctgggcgacagagccagactccgtctcaaaaaaaaaaaaaaaaaaaaaaacaattgtggttgctaaaaatcaaaattccagcccatcccccgccaaatacaacctggtagtaaccactgctgggcgcatcttgatatcttttctggctacaggccagctcttgggagcccaaccccacttctccctgggtaaccctgggccagtggtttgctctctgggcctgtttcctcactgtaaagtggggtggtcaggcatagtggctcatgcttgtaatcccagcactttgggaggctgaggcaggaggatcacttgagctcaggagttcaagaccagccgggacaacatagcaaggtgttgtctccacaaaaaattaaaaattagccaggtgtggtggcgcgtgcctttagtctcagctgctcgggaggctgaggcaggaggactgcctgagcctgtcaagttgaggcttcagtaacctgtgatagcaccactgcactccagcctcagcaaaagagcaagaccctgtctcaaaaaaataataataaagtggggaggatggtatgactttgaagatcagagaatactctggaatgctctgtaagtgccaaaagccacgcctggcactgctgaagaaatgttagctattttggaagggaagtcagcacacaaagtgtttgtactgggtttgacaggaggaaaaccagaaacactgcttattttcccgctgcagcaagaagccaacctcatgaaatgttcagcttccaaccgggcacagtggctcacgcctgtaatcccagcactttgggagggtaaggcgggaggatcacctgaggtcaggatttcaagaccagcctggccaacatggcaaaacccgtccctactaaaaatacaaaaaaattagctgggcgtggtggtgcacacctgtaatcccagctacttgggaggctgaggcagaattgcttgaacccccaaggcagagccgagatcgtgccactgcacttcagcctaggggacagagtgaggctctgtatcaaaaaaaaaaaaaaaaaaattaagaccttgttttacagatgaggaaactgaaggccagagagaggcagtgcctgcaccaggcccacacaggaaggagaagggaagggctgggcagggtgggatgggggagcagggaccaatcccaggtggagcctgaatgaggcagggaagccctcatctcacctccaggcgaggatcaatgtgcagtcggccaggatacacatcttagccagctccttgagggcctgctggggatctttctggaggagaaaatcagaattagaaacctagaagccaggaattacaaaaattagccaggcgtggtggcaggtgcctgtaatcccagctactagggaagctgaggtgggggaactgcttgaacccgggaggcagacgttgcagtgagccaagatcgcgccactgcactccaacctgggcgacagggtgagactctgtctcaaaaaaaaaaagaagaacaaaaaaagaattaaagcctgaaaacacagtagctcaggatgccaagagcctctcacccaattgtcactctctaagctcctactgggtgcctggcccgtgctaagcagtgctaggacccagcagtggctgagacagccctgactctgccctcccagggctcacagtctgatgagcaggacagacctgtccccagacactgatgatctggagtggccagggctgcgatgtgggagccagaggagggactgagcctgcctgggggatcagggagggcttcttggaggaggggacattagagctgagacccaaaggaggatgaggaggaggaaaggatgaaaaggagaccagaaaagggaattccagacataaagaacagcatgggcaaaggatgggaggggaaagagggcttgaggaattataattcgctccctacgggagagaggatgtgaaattccatgaggagcatggaatcttagagacgggcctggagaactgggtagaggttggaggtcacacagggccccataggtcatggaagggagcagaactttctcctagggtgcttaggagccatgtgagttttatgatctttttaatttttttcagacggagtctcgctctgttgcccaggctggagtgcagtgacatgatcttggctcattgcaacctccacctcccgggttcaagcaattctcctgcctcagcctcctgagtagctgggactataggtgcccaccaccatattttttgtattttgtagagatgggggtcttcactatgttgcccagactagtctcgaactcttggcctcaagtgatcctcctgcctcagcctctcaaagagctaggattacaggcatgagccactgcacccaacccaatggaagaggaatgcttgaggccaggagttcaagaccagactgggtaacatagcaagaccctgtctctaaaaattaaaaaaaaaaatcacctggtgggggtggctcacacctgtaatcccaacactttaggatcacctgagatcagaagttcaagaccagcctgaccaacatggtgaaaccgcatctctactaaaaatacaaaaaattagccggtcatggtggtacgcacctgtaatcccagctattcaggaggctgagtcaggagaatcacctgaatccaggaggtggaggttgcagtgagccaagattgcaccactacactccagtctgggcgaaagagcgagactctgtctcaaaacaatcaatcaatcaatcaatcaataaaaattagcaaggcatggtgtcatcccagttgctcgagaggctgaggcaggagaatcgtttgaacccaggaggcagaggttgcagtgggctaagatctggccattgcactccagcctgggcgacagaggagactccgtcttaaaaaaataaaagagagagatatggccaggcacggtggctcatgcctgtaatcccagcctttgggaggctgaggtgggtggatcacctgaggtcaggagttcaagaccagcctggccaacatggtgaaaaccagtctctactaaaaatacaaaaatcagccgggcgtggtggtgcatgcctataatcccagctactcagaaggctgaggcaggagaatcgcttgaaccccagaggtgaaggctgcagtgagccaagatcaagtcattgcactccagcctgggcaacaagagcgaaactccgtctcaaacaaacaaacaaacaaacacaaaacaaaaagaagagatatttaggtggcagagatctgggactaattgaaggggatgtggggaaagaggaaatagacaattttgccctcccctctccttgccaacataatgtcttggtgacccatgtcatctcagatgtgaaaaacgttcctcgctgaggttttagctgcatttcctcttggaagggattcaacagcccactgcacaacctcaaagcccggtgaggctggctagggagcagcccctgcttaccacatccacctggacaagcaggacccgcaaggcgaagttcttccccaggctctgcagccgcccatggatgtagtctgggtgcaggttgtggtagcggaggctggtgggggcagggagcgggagttgagaggtctcagtctcttcaagacccccaaagcccttttccctctcactggaatactaagggctcagagtacggcatgggggacagagggtcctgaggcccacagagggtaagtcacttgccccaggtcactcttccaagaagatgctccgcagggattggcagccagggccacatggctgtgcttacctagaagaccagacccctggcttcttcatgaagaggggaagagacttgggcttcaaggggagaacaggtgccaggggccctagagagtgtgggcacggggacactgcatggctcgcggtgggaagcagggcccactgccaaaccatctgctctggccttggagggctacggtgagggcttcatgacccagggaactaggactggctctgcccagcagtctgcagctgtcacagcctgcagggagcacaggaactcagaggtttcacttcctctgtctggccctgtctgcagaggggcccctaggttggaggggaaagttgtttaactagggtagagatgggagaaatcctgcttctcatcaactccagtcaaggatgtctgggacatgagtgacccagtccctcctccgtcagatccaggagtctgggcccagcccctcctcccttagacccaggaatctggccccagcccctcctcccttagacccaggagtccaggcccccagcccctcctccctgagaccccaggagtccaggcccccagcccctcctccctgagaccccaggagtccaggcccccagcccctcctgcctcagacccaggagtctaggccccagcccctcctccctcagatccccaggagtccagccctcagcccctcctcccccggacccaggagtccggcccccagcccctccttcctgagacccaggagttcgggctccagctcttgttgcactgggcacctccaggccaagaccccctgcctccaacacagggtcccaccaaggcccagaacctgcaggaccatgcccagaggcttctcatagaacagtccagaacactgggacatgaccctcccaggccagtggggtgcccttcctgaagtctggggtggcgccgcagagctcacctgaggaacagggcacaggtgctctggcccagcacatagtcgggaattacgtcgccaaattcccagggcacattgcgcacgaacttcagtacgggattgcccctctggggagggacgaagggcagaagccatcaatagggatgacccttgataaccacagggccctcctccacctcttcttgcacctcctccctcctcccacctcttcccacacctcctgcctcctcgcacctcttcccacacctcctccctcctcccacctgtggcagggtcttttccagcttctctctcctcctaaccctggacagtccctgatcctctgatccaggctcctcccctccatgcccactggcaccaggcctttcctaaagggtccccgggtctgtctccagctcagccctctccctccagccccagtctgcgtgtcctgtggtcctgaacacttcctgccctcacgcccagcaactttttgtgtttttagtagagatggggtgtcaccatattcgccagactggtctcgaactcctgacctcaggtgatccacctgcctcagcctctccaaagtgctgggattacaggtgtgagccaccacacccagcctcattcagtacattttgaataaattaacaaacctggggtgaggaaacagagctacaccaatacagccacagccccagcaagtagagctggggcactctcaacccacacactgctgtcgaatgaatgaatgaatgaatgaatgaatggggagaacaaagtggctggaactcagacctccttgcactggagtcatccctagaacagcgtttcccactgaaaacctcaaggcctcacttctccgtctccctcctcacctgccgagggctcacaatgatgctgttggattttgccccgggtttcagggcctggttgggcgtctctcctgccaggggctctgaccctgtggggcacgtggccccagccccttccagaggctgtgagatggcatattcggcgtaggtctgaggggccgcctgggccgaggtgtccacagtgggaaggctctgtgtagatcggaataagggcttggcctgtggggagaaagggagtttgcaggggactggttggggtgagcagaggacatctgaggccctgtgagttcctctcccctttctttttctttttttgagacagtcttgctctgtcacccagactggagtgtagtggcactatcttggctcattgcaacctccacctcccgggttcaagcaattctgcctcagcttcccaagtagctgggattacaggtgcccaccaccacgcccagctaattttttttttttttttttgagatggagtcttgctctgtcacccaggctggagtgcagtggcgtgatctcggctcactgcaacctccgccccccaggttcaagcgattctcctgtctcagcctcccaaatagctgggactacaggcgtgtaccaccacgctggctaatttttgtatttttagtagagacagggtttcaacatgttgtccaggctgatctcgaactcctgacctcaggtgatccgcccgcctcggcctcccaaagtcctgggattacaggtgtgagccacagcacttgacccctctcccctcttcagggctgcccatcctccttcctcctaatgtcccttccagaaggctgagagctcaaaatctgaattcagccacttctcccccactcctcagcctccactctggtcccagccaccagcgtttcacccttggaccactgaagtcacttcctcaccagctccttgcccacaccctcgccccctggaagtctgtcccctaactaagtcctcatgtccctcctctgctcagagctggtgggtggctcctgcctcagagtgaaagccaaagctgtcaccatcacccacaaggctctagatctgtccctgctccttgcctcagaaactacaccttctaccacttctccttgctttctctactccagccccaccagacttcgttctgcccttgaacacggcaggctctctctgacctcagggctttggcactggctgttccctctaccccagatgtcgccatggctcactccctcacctctttcacgtctctaccaagatgtcacctcctcagagaggccctcccttgaccttcctatctaaagtaggaaggggccaggcatggtggctcatgcctgtacatcccagcactttgggaggccgaggtgggcggatcacttgaggttcgagaccagcctgaccaacatggtgaaacccgtctctactaaaaatacaaaaattagccaggcgcgctcctgtaatcccagttactcgggaggctgaggcaggagaatcgcttgaacccaggaggcagaggttgcagtgagccgagatggtgccagtgcactccagcctgggcaaaagagcgagactctgtctcaaaaaaataaataaataaataaataaatagagtaggaaggtcctctcccccatcatgccctacatccttagcccactttccttttcttcatagccaatgctcatcacccgtcgattgttttcccttgggaaggagatttcaatattgccaggtccttccatttaccaaaatatgtctaaagtgtagatttttttaagattgcaaaacctggcgattcttaaacacgagcaataaattcatgtcttgaaaaatcagggtgctggcctcgtaaaacacatcaggggctacctgctgaatgccagtgtctggcctctgccttagccctctcttagaaccacccatccatttcacagatggggaaactgggacctggggaggaccaaggactgtttccccaagtcgtccgtggcccccaaatccactaacccacaccctggtcccacaggccccatcctatcctcttcgtcctaacagcccccagcctcccaggggccccgcatctccttgtcctaccactccaggagggacctcatcctcgtcgaggggtatcacaaatttcttccttgctggcggccctgagggctggggcaccccctctttgtccttcccagggtccatctggagcctgaaagggaaggtgccaggagcgagtgagccactggcgtctacgttctcatcccgcagcaggaaccccccactcacagccgtcccccacaaaactccgagagctccatagcgtcaggtccccaacacccagcgctagaggctctgtaacgccacgcccctttgacctccaccttcggctcgccccgccccttacaggtccacaagtcccatcgctccgcccctcgcccccaccggattctattggctccgtccccaccatcccccgccttccgttcgtccggcccccgaggctagcatctggacgccctccccacgcctggccttgtccatctctcagactcggcaatgattggcttccgcggcgccaatctccacccgcagtctccgcctcccgcacctgtggtccgggcctcacggtttcagcgccgcgaggcctcacctgctggtcttggagcctcaagggaaagactgcagagggatcgaggcggcccactgccagcacggccagcgtggcccagggctcgcagcacttccggcctctctggccccgctccccaggagagtagagcatagagcagggcgatctctgtacaactctctatggttctggaggaccgcggaggtcgtgggaggagagagatgtggcctgaggatctggctcccaaactgttaagtttcaaagcccttactgagcgcttctgtgtgcccagaatcctggcagggctcagtggagaacagatcgcaggagatccaacttggtccctcctctcagtaaggagagacttaagtttgaatccaactcagacattgacttggcttcagtttcctcattcattcatttattccacacctattccccccacgcgcttcctctcttcccggtcctgtgcgagtccgtgctggtgacacagcagtgaccaacgacagccccgtgttgtcctcccggagcttacggttcagtaagggacacagacacgttcccagtgctgacccagaatgggcaggtctgggatgggagatcccgggagagccgtgggatgggggtcagggggagcgcctgactcagccccggagtccggaagggcttcctggaggaagggacatctgagcaggggcctggctgatgagttagtattagtcacttcctgaaaggatagtatcacactgttctaacttgcagctctctgattactaaggaaatggaatgttttttgtgaaagtattggtcttgtaaattttgtcttctgtgaattgcttgctcatattccttgtccatttttaaaatgggttgtatggcttttttattactattaatttctaggggtactttatggattctgattctaatccttagttacccatattgcaaacatttcctcctagtttctactttgggctttaactttagttatttttggcacagaagttatttgtgtttatgcgcaactatttatcaatctgttccgttctgacttttgcttttggtgtgttaagagccctgccataacccagggtcataatgataaattcttttttttcttttttttttttttttcgagacggagtttcgctcttattacccaggctggagtgcaatggcgcgatctcagttcactgcacctccccctcccgggttcaagcgattctcctgcctccttagtagctgggattacaggcatgtgccaccatgcccggctaattttttttttttttttttttttttgtatttttagtagagacggggtttcaccatgttggccaggctggtctcaaactcctgacctcagctgatcctgaggtcactttgtgacctcccaaagtgctgggattacagtgcacggctataatgatatattctatcatttcttttatctacgtaaaagataaaagccccgtgttgtcctcccagagcttacagttcagtgagggacacagacacggtcccaaacagtaatgacctagaatgagcaggtcatctggctttaatctatgtaagatttatttatttatttattattttttgagatggagttttgctcttgttgcctaggctggagtgcaatggagcaatctaggctcactgcaacctccgccacccacattcaagcagttctcctgcctcagcctcccaagtagctgggattacaggctaacttttgtatttttagtagagacggagtttcaccatgttggccctgctggtctcgaactcttgacctcaagtgatctgcccacctcagcctcccaaagtgctgggattacaagcatgagccacggtgcctggccaagatttatttttgaaagtgcaccgaggtcgttgtttatgagtgatgtaaccaattgtctcaagttgaccaaaggtagatcttttctccactgttctgaaattctacctttatcacataccaaattcccatacacacacgtctatttctgacatttctgttatgttcattgatctttttatttattcttgcctgcatgtacatgacatccctctgtttctttgttcacatcagtctttcatctatgggtgtctatctgtgtctacattttcccattttacttaattttttttttctgggcatggtggctaatgtctgtaatcctagcactttgggaggcctaggcgggtggatcacctgaggtcaggagttcgagaccagcctgaccaacatggagaaatcctatctctattaaaaatacaaaattagagtcccggtgcagtggctcacacctgtaatcccagcactttgggaggccgagacaggcggatcacgaggtcaggagttcaagaccagcctggccaatatggtgaaaccccgtctttactaaaaatactaaaattagttgggcgtggtagcgcacacctgtagtcccagctactcaggaggctgaggcagaagaatcgcttgaacctgggaggcggaggctgcagtgagccgagattgtgccactggactccagcctgggtgacagagccagactctgtctcaaaaaaaaaaaaaaaaaaaaaaattagccgggcatggtggcacatgcctgtaatcccagctactcaggaggctgaggcaggagaattgcttgaaccctggaggcaaaggttgcggtgagctgagatcgcaccattgcactccagcctgggcaacaagagtgaaactccatctcaaaaaaaaaaaaaaaattttttttgagacaaggtcttgatctattgcccagatttattgtcctgaaccttgcttacctcaaatgcctttttcttttcaccctaacaattgaaatccagaattctaggctgggtgcggtggctcatgcctataatcccaacaatttaggaggccaaggtgggcagattgcttgggctccagagttcaagaccagccagggcaacatgacaaaaccccatctctacaaaaaaacacaaaaattggctgggcaaggtagctcatgcctgtaatcccagcactttggaaagctgaggcaggagaatcacttgaacccgggaggtggaagttgtagtgagccaagatcacgcaattgtactccagcctgggcgacaaaagcgaaactccatctaaaaaaaaaaaaaaaaaaaaaaagctatgtgtgttggtgtgcacctgtagtcccagatactcaggaggctgaggagggagaattgcttgagcccaggaggcagaggctgcagtgagctgcgattgtgccactgcactccagcctgggtgacagagtgagaccaaaaacaaacaaaacaaaacaaacaaacaaacaaaaaaacgaaagaaaagaaaggaaagaaaaaggaaatccagaatcctaggttcttagtattgtttcttgcaatgttagaagatataggggccaggagaggtggctcacgcctagtaggaaggaaggagaatcagtctaatagtctcatcactaggtataattttcccccaggaggccgggcacagtggctcacgcctgtaatctcggcactttgggaggccgatggaaggtggatcacgaggtcaggagttcaaaaccagcctggccaagatgatgaaaccttgtctctactaaaaaatacaaaaaaaaaattagccgggcgtggtggcggacgcctgtaatcccagctactcgggaggctgagacggagaattgcttgaacccaggaggcggaggttgcagtgagccgagattacaccactgcactctagcctgggcgacagagcgagactccgtctcaaaaaacgaaaaaaagaaaaaatgaaatatgcctctgtatccaagaccatacagcgattctagaagtaggtcatcccaagtagaagggcttgtgactcagttatccccttggggaatggaattgccagacttaaccctgcaactcctgcgttttctgcaagggggcgatggtgcaccacaagaggattggaagtgttggggagccggggcctctctgctccgccagaacccagcgggggcaggaccccctagaaggcggcccattccccgctcccgattcatttccttgaagcagaagtgcggtaaagggcccgccgcctgcgatcagtggaattctgaatcggttaacgttagttaagagcgaggggaaaaaattgccctgggttctacgttatttccaagttggcaagttggatgttggatttctaccctcagtttcttttctttttttctttttctttctttctttcttttttttttttttttttgagacggagtctctctctgtcacccagactagagtgcggtggtgcgatcacacctcactgcagcctcaacctcccgggctcagatgatcctcccacatcagcttaccgagtagctggaccacaggcgcgcgccaccacgcctggccaacttttgtattttttttgtagaggcgtgggggtgggggggtggggtctcactatagcccaggctggtctcgaactcctgggctcaagcgatcctcccttctcgccctcccaaagtgtcgggattactgtagtgagccactgctcccagcctaagctgtttcaaaactaaactttggaatcccggattcgaatctccccggctcccagagttgcgcgttcgaatcccccagccgtatccaagctccgattccgcctctttcttccaaacgccccaagttccagaattcagccgcaactccagtttgggccactccccagctacggcccctgctcccatcccaaaccttcccctcctctcaacttcgagccctttgttcgccccggaacgggtggggtggggacggagactgtaaggacgggaccctcaccgacaattccgccaaaggggacctgaacggggggcggagagcagcccggccgaaggctctggaagcgggcaccgccggggggcgcagtgaccaggctggcgtccccgcccgcctctaaacttagccgcggtgacgcgcggcccggcgatcgcggcggggccggggacgcaggggggcccgagtggaggggggcggctcggctcggcgagcctctatttatagcgcccggagcccgaaatagcgcggagcggagcggccgggatgacgcgggagccgccgggggctgactcacccggccccaagcggaggcccccggatggggggcagtggaggcgcctagcccctactccgcgtcctcccgggcaccttttttggtgggacatcccaagtctccgctggagaggctgtggatggatgtacagcaaaggaaagatctgcagcatgagagactgaggttggatcagaagtgggacttccacacacacaaaaaaccccagaactgggccgggcgcggtggctcccgcctgtaatctcagcactttgagaagccgaggagggcagatcacctgaggtcaggagattgagaccagcctggccagcatgatgaaacctcatctctactaaaaacacaaaattagccaggcgtggtggctcatgcctataatcccagctactcgggaggctgaggcaggagaatcgcttgaacctgggagacagaggttgtagtgagccaagatcgcgccactgcactccagtctgggcaaaaacagcgaaactccatctcaaaaaaagaaagaaagaaggaaagaaaaataaagacagaatggaggacctatttatacaaaatgagaaaggcggaaagaggggaggtgaaccagatatacacacttgtttctcaccagcaagagaactgggatgttctggaggcaaaggaatggactcagggaccctgggtagttgccattccagagcacatgccattctccacttgtcacgatttcttgcatactgttcccattccctagaatgttcttccttgccttctcagccttgagaactcatgtacctccaggacctggtgcccagggcaattcctttatttttattattatcattattattatttgagacagagtctcgctctgtcacccaggctgtagtgcagtggcatgatcacgattcactgcaacttccgcctcccaggttcaagtgattctcctgcctcagcctcctgagtagctgggactacaggcgcatgccaccacacccagctaattttttatttttagtagagatggggtttcaccatgttggccaggctggtttcgaactcctgacctcaggtgatccacccgcctcggcctcccaaagtgatgggattacaggcatgagccaccgcgtccagccggagcaattcctcaaataaaaactccgtgacccactgaactgggagccccataagggcagggtcaaggccatctcagtcatcgccttgtccccagcgctgcccagcacaggacaggccttgggataaattaactgcatgaataaaaggtgctggtgataaaataaaatgacatttcccgttataatagcaaatgttgattgcatgctctgtgaccggcacgcatgattctgagccttatctcctgtgggcctcgctgcagccctgcagggatgtacttttattattattatcaccgccatccctatgttagagatgaagacaccaggcccaaaggggctaaaagtactggatctcactgcttgcactcagagctttctcttaaacctaggtcaccttggctccaaaggtgttcggtttccagcatacatacatctgggtcctgtggaaccaaaagctagggagtgagtctcagcctgcagcccaaagaaccttagggggttccccagcacccctttgggggtctacaaatacaaaattattatcataagcggggcgcggtggctcatgcctgtaatcccagcactttgggaggctgaggcatcaggcggatcacgtgaggtcaggagtttgagaccagcctggcaaacatggcaaaaccccaactctactaaaaatacaaaaaattagcagggcatggtggtgggtgcctgtgattccagctacttgggaggccgaggtgggagaattgggagatgaagtttgcagtgagctgagattgggccactgcactccagcctgggcaacagagcaagacctcgtctcaaaaaaaaattaccataataatattgacataatatatgatacaccataataataatacttagttggggggtggggtctcagccttccccaggctggagtgcagtggcacgatcttggcttactgcaacctccacctcccgtgttcaagcgattctcccgcctcagcctcccaagtagctgagactatagtcatgcaccaccatgcccggctaatttttttgtatttttagtagaaacggggtttcaccatatcagccagtgcagtttccatgatattgcaacagaccaaatgcagacacacacgtgaggacccagctgtcttctgttaagcctgacgtgaaagtgatttgcaaaaattaaaacaatgcccttcctctcactaagtttttgtttcaggctgtgcatggtggtacatccctgtaattccaggactttgggaggtcaaggtgggagaatggcttaagcccaggagttcaagaccagcctggagggccgggagcagtggctcatgcctgtaatcccagcactttgggagactgaggcggtggatcacctgaggtcaggaattcaagaccagcctgaccaacacggagaaacccatctctactaaaaatacaaaaattagctgggcgtggtggcacacgcctgtaatcccagctacttgggaggctaaggcaggagaatcacttgaacccaggaggtggaggctgcaatgagccaagatcatgccattgcactccagcctgagcaacaagagtgaaactccatctcaaaaaaaaaaaaaaccagcctgggcaacttaggaagacccctatctctacaaaaaatgttaaaatgagctgtgcttggtggcgcgtgcctacgttctcagctgcttgggaggttgaggtgggaggatcacttgagcctagcaggtggaggctgcagtgagtcttaattatacccctggcaccccagcctggacaacagactgagaccctgcctcaaaaaaatttttttttattttggaaaacatggttattttcatgtaaaagatataacttacattaacattcaattaattttttatttttttatttttttgagatggaatctcgctctgtcgcccagcctggagtgcaatggcgcaatcttggctcgctgcaacctccgcctcccgggttcaagcaattctcctgcctcagcctcccgagtagctgggactacaggcatgtgccgccacaccgggctaatttttcatattttagtagtgacggtgtttcaccatgttagccaggctgctctcgatctcctgacctcatgatccacccgccttggcctcccaaagtgctgggattacaggcatgagccaccacgcctggccaacacaaaattaatttattattattattattattattattattattagttatttttagagatgggggtcttgttgcgctgcccaggctggtctcaaactcaagcgatacttccaccccagcctcccaagtagctaggattacaggtttacaccactgcacccagctacttttaaatgaatcaacaaatatttctaaaatttctcagttttgatttccattacagtaaatattgatagaaatcatacacatcaacaaaaactctttggggtcctcaatacattttttaaattttagacagggtttcactctgttgcccaggctggagttcaatggtgcagtcataactcactgcacgctttgaactgggctaaagcagtcctcccacctcagcctcccaaatagctaggactacaggtgcatgccaccactcctggctgcttttatttatttttgtagagacggggtcttgctatgttgcccaggcagaggccttcaataattaggagtgtaagggggccaggtggagtggctcacgcctgtattcccagcactttgggaggccgaggtgggcggatcacgtgaggttgggagttcgagaccagcctgaccaacatgacctgaccaacatggataaaccctgtctctactaaaaatacaaaattagccgggcatggtggcacatgcctctaatcccacctactcgggaggctgaggcaggagaatcgcttgaacctgggaggcggagtttgcggtgagccgagatcgcgccactgcactccagcctgggcaacaagaatgaaactctgtctcaaaataaataaataaataaatggattaggccgggtgcggtggctcacacctgtaatcccagcactttgggagaacaaggcaggcagatcacttgaggtcaggagtttgagaccggcctgggcaacgtggtgaaaccctgtctctactaaaattacaaaaattaagccgggcacaatgcctcatgcctgtaatcccagcactttgggagaccaaggcaggtggatcaccagaggtcaggagttcaagaccagcctgggcaacatggtgaaaccccgtctctactaaaaatacaaaaattagccaggcgtggtggcatgtgcctggaatcccagctacttgggaggccaaggcacgagaatcgcttgaacctgggaggtggaggttgcagtgagccgagattgcgccattgtactccagcctgggtaacagagtgagagtccatctcaaaaacaaacaaattagccaggcatggtggtgcacggatgtaatcccagctacttaggacgctgaggccagagaattgcttgaacccgggagacagaggttgcagtgagccgaaattgtaccactgcacaccagcctgggtgacagagcaagactctgtctttaaaaaaaaaaaaaaaagaatcaatgaactaacaatcatacaaacctgattagtgtcatgaaggacaagaatgtggaacatcattttaactttgaaggagaggacgagtggatgggagggtagcggaggtttctctgtcaaaggagcatttaaggagagacctggctgggcacagtggctcacacctgtaatcccagcactttgggaggccaaggtgggtggatcacgtgaggtcaggagttcgagaccatcctggctaacatggtgaaaccccgtctctactaaaaatacacgcacacaaaaattagtcaggcatggtggcatgcgcctgtagtcccagctactcgggaggaggctgaggcaggagaatcacttgaacccgagaggcagaggttgcagtgagccgagattgtgccactgcactccagcctggccaacagcaagaatgtctcacacacacacacacacaaaaaaaaaaaaaaaaaaaaagaggaagaagaagaagagacctgtccatgtgccctggctcacacctgtaatcccagcactttgggaagctaaggctggcagatcgcttgagcccaggagtttgagaccagcctgggcaacatggtgaaacaccgtgtctctccaaaaaatacaaaaaaaaaaaaaatcgcatggcttggtggcatgtgcctgtagtcccacgtactcgggaggctaaggtgggaggatcacttgagcccaaaaatgtcaaggctgcagagggccatgatcatgacaatgcactccagcctgggcaactgagtaaagccctatctcaaaaaaaagaaaagagaatctatctggcagttttctctcttgccttccaatcgttgcatctcatttatttttcttgtcttacagcatttttttgtttttgcttttgttttccgagactgagtcttgctctgtcacccaggctggagtgcagtggtacgacctcagctcactgcaaccttcgcctcccgggttcaagcaattctcctgcctcagcctcccgagcagctgggactacaggcgaacattgccacacccggccttttttaaaaatttttttatttttatttttattgttttttttgagacagagtttcgctcttgttgcccaggctggagtgcaatagtgcgatcttggctcactgcaacctctgcctcctgggttcaagcgattctgctgtctcagcctcctgagtagctgggattacaggcatgcaccaccacgcccggctaattttttgtatttttttttttagtagagatggggtttttccacgttggtcgggctggtctcaaactcctgacctcaggtgatccacctgcttcagcctcccaaagtgctgcaattacaggcatgagccatggtgcctggccaaatttttgtatttttagtagagacggggtttccccatgttggccaggctggtctcagactcctgacttcatgatccatccaccttggcctcccaaagtgctgggattacaggcatgagccactgtgccaggcccattttacagcatttcaaacacttccaggactatgccgcacagtaacattgattctcacagcagccctccacactacaaccctctgagatgacttatctcaccatgcccattttacagagggagaaactgaggcacagggaaggtagactcttatccaaggccacatagcaggtaaacaaacaaactaggactccaaccaaaccttgtgctctgtctcagccttaaaagaaaactcaataaacattctggcctttttgtttttgttttgagacctttattctgttacgcaggttggagtgcagtgtggtgatcacagctcactgcagcctcaaactcctaggctcaagcaaacctcctacctcagcctcacaagtagctgggactataggtgtgcaccgccagagctggctatttttgtgtagagatggggtctcgctatgttgcccaggctgctgatctcaaactgctggcctcaagggatcctcctgccttggactcccaaagtgttgggattacaggtgtgagcctccatgttcagtccacattctgtacttttttttttagatggagtctcactctgtcacccagggtggagagcagtggcgcaatcttggctcactgcaacctctgcctcccggattcaagcgattctctcaagtctcagcctcccaagtagccgggagtacagacatgtaccaccatgcccggctaatattttttgtatttttagtagagacggggtttcaccatggtggccaggttggtcttgaactcctgacctcagttgatctgcccacctcatcctcccaaagtgctgagattacagacatgagccaccgtgcccagcctattttttttaaaacgggaaaaatatctgtaaattgccacagtgacccacggagcctggatgaagagcgggaagcctgaggtctccttcagtctccatcctctctctgagcctcagtttccttccctatgtggaagggttggaaaagatgttctctaaaagcctcagaaactctgccgttagcgtggaggggacagaagctcaaacagattgcattagtttcttaacggctactataacaaattatccccaattcagtgacttaaaacaagagaaattcggccgggcgccgtggctcacgcctgtaatcccagcactttgggaggccgaggcgggcggatcacgaggtcaagagatcgagactatcctggtcaacatggtgaaaccctgtctctactaaaaatacaaaaaattagccgggcatggtggcgggcgcctgtagacccagctactcgtgaggctgaggcaggagaatggcgtgaacccaggaggcggagcttgcagtgagccgagatcacgccactgcactccagcctgggtgacagtgagactccgtctcagacaaacaaacaaacaaaaatagttttgtagagatgaagcgggggggcggggtcttgctctattgcctacgctgatctcaaactcctggccttgacattgcaatctgcccgccttggcctcccaaagggctgagattacgagtgtgagccaccctggcctaaacatttaaaacgacatgtgtgacagccaggcatggtagcctgcacttgtaatcccagctccttggaaagctgaggtgggaggaccccgtgagaccaagagttggagatcaacctgggccatacagtgagactccatatatagtggattccaatatagtgagactttaaaatataaaataagggccgggcatagtggctcacgcgtgtaatcccagcactttgggaggccaaggtgggtgaatcacctgaggtcaggagttcgagaccagcctgaccaacatggtgaaaccccatctccactaaaaatacaaaattagccaggcgttgtgacacacgcccgtaatcccagctactcaggaggctgagggaggagaatcgcttgaacccaggaggcagaggttgcagtgagccttgatcacgccactgcacttcggcctgggcgacaggagcaagacttcatctcaaaaaagaaaaagaaaatatatatgtgtgtgtgtatatatatatataataagtaaaaataaaatcgtacatatggatctagcagactcatatacctctggttatatttccaaaggaattgaaatcaggatgtcgaagggttatctacactctcaagttcattgcagcactggtcacaatagccaagatatggagtcaacctaagtgtccatcaagggacataatggataaagcaaatgttgcatatacacacgatggaatactatacagccttgaaaagggaggaaattctgccattcaagacaacatggatggaactggaggacattattctaagtgaaataaaccagacacagaaagacaaacaccacatgatcccacttttatatggaatcttaaaaagtcgagctcatagaaacagtataaaggtggctactagagtccagggaagtgggagagggttgggaaaagagaagatgttgatcaaagggtgcaaagtttcagcgagactggagaaatatatttcagtgatctattgcacagcatggtaaccacagttaatactaatgtattgtgtatttcaaagttgctaaaatagagtttaaattttttaaatttgtaaatattattttttattttttgtcactacgtgttctcatctgattttttttttttttgagacggagtctcgctctgctgcccaggctggagtgcagtggcacaatctcggctcactgcaacctctgcctcctgggttcaagtgattctcctgcctccgcctcccgagtagctgggactacaggcgtgtgagaccacgcccagctaaattttttttgtatttttagtagagatgggatttcaccgtgtcagccaggatggtgtcgatctcctgacctcgtgatccacccgcctccgtctcccaaagtgctgggattacaggcgtgagccactgtgcccggcctctcatctgattttttttatttttattattgtgctttttgtagagatggcatctcactacattgcccagattagtctccaactcctgggctcaagccatcctcctgcttcggcctcccaaactgctggatttataggcgtgagtcaccgcacctggccctgacatcttgatgtcaatttatttgcaatatacacccagaagtgggattgctggatccatatgtgtaattttattttttatgtgtttgtttgtttgtttatttatttattttaagacagtctcactctgtcgcccaggctggagtgcagtggcacaatctcggctcactgcaacctttgcctcccatgctcctgtgatcctcctacctcagccttctgagtagctgggactacaggtgtgcactatcacgcccggctaattatttttatttattattattattattttttaagacagagttttgttctttttgcccaggctggagtgcaatggctggatctcggctcagcgtgacctccgcctccctgggtccagcaattctcctgcctcagcctcccaagtaactgggattataggcatgcgccaccacgcccggctaattttgtatttttagtagagacggggtttctccgtgttggtcaggctggtctcgaaatcccgacctcaagtgatccgccccactcggcctcccgaagtgctgggattacaggtgtgaaccaccgcgcccggcccgaagttattcctcttatctgactgtagtttggtattttttaaccgcatctctctgttcttcctctcccaaccccatctctactaaaaatacaaaattagccagccgttgtggcgcatgcctgtaatcccagctactcgggaggctaaggcaggagaatttcttgcacccaggaggtgtaggttgcagtgagctgagatcgcaccactgcactccagcctgggcgacagagcgagactctgtctcaaaaaacaaaaacaaacaaacaaaaaaacaaatagcgcctcgttttctgggaggcagtgaattccccatttaggaagtgtccaagctcaagttgaaatgatggtacattgcggttcatgctgcaatgcctcaacccagttcctctccggacctcagtttcctcatttataaaatgggtgtggacgacgaggtcagatttaaaaaaataataatagtagttaataataataggccgggtgcagtggctcaggcctttaatcccagcactttgggaggccgaggtagcaggatcgcttgagcccaggagttctagacaatcctggggcaatatagcgagattctatctcaaagaaataatcataatcataataaaaataaatgaatagataagctgagacggactcaggcccagctcctgcctgcgatccctgcgggggccaccagggggcgcggcgcccctgcccaaaactccgccgtcggctctgaaccccggcggacgcgtcccgacgcccctggaagattctgcgccctgccggctcgccggcgcccgggagcccgggaggcgggtgtgcacgcggggtgtccagggcgcccccgatcgaggccccctcgccgtgcctcggggtagggggacggctgtgactcaggcgcgcgctcctccccggggccctcagtggtcgcgagggggcgcgcacggcctcgggaacccgcgcggcgccgcgtccatttttaccccagctccgctaaaaatagttgccgcgctccgagccgagcccgaaatagcggcccccagataaggcaggacgactcagcgcttccggggagcggaagggggagcgcgcggggggagcggtgctgggcgcagcccggccgagcaggcgccgctgtccccagcgcacccccactctgccctggcggtcacactcgcccccgactgcgaccccgccccgccgctagcctggctgccttcctacgtcccccacattgtatcctcatcccctgtcccccatcctcagcttcacctccattcctcatcataactcccccctcccctacacccccagcgatgtcccccactggtactcatccgcatcccccagcctgtcctactcctgtccctatttcccctctccaccctcatcgccaatctcctgtcgtcctgaatctgccccttaccatctctgtcctcaaggccaacctttatgggggcagagcagggcgagaggatcacagggagtcaggagacctgcgggctgagggctgagggctgggggtgaggatctgatttcttggtttgtttctactgtgggcaggggtaggcttagatctgggggttggagcatgggacacttcagtctggcctagtcttcagagctgaggcgaggcatggccagcatcacggctcattctgtgaccagggtcggggctcaggctggggaaggatgaccgtctttgtcaccaaatttgatcactgtgtcaccagagttagggctcagccttgagccgtttctttatttacccacctccactaatattttttatttcagacaaggccttgctctgtcgcccaggctggagtgcagtgttgcccatgctggaatgcagtgctgggatcttagttgactgcagccttgaactcctgggttcaagagatcctcccacctcagccttcctagtagctgggactacaggtgtgcaccagcacacctggctaatttttcatttttttgtagagacagagtctccatgccttgcccgccttgtccaggctggtcttgagctcctggcctcaagctatcctctggcctcctcctaggaaggcactgaaatgacaggcatgagctacagagcccgcctccactaagattctttcctcccttgcaagtcagtgattggacacaacagctccaggccttgggaacagtcagaactctgttccctgggcctaggtcttccctttgcactgagatcatctaagggcctccccatttccatatcctgagattctcagtgcccactccaagcatcagtgtcaggcctcaaggacctacactgcatgttctgggggtttaaagggagcacactgacttccctgagggtgacagaggtcagaatgagtgactaaggtcttgggcctggccctgaccctgcagtgggtgggagagatacccagttgaggcccaggtctccacccaggtagcagggtggatggcgggggggtcatccctgaggtgaaatgtgggtggaagatacctagataagtttcagagtcagtgcagagatggtaatttttaagtaacttctaaaattttcgagtagctgggattacaggcgcctgctaccaagcctggctaatttttgtatttttttgtagagacggggttttactatgttgtccaggctggtctcaaactcctgacctcaagtgatccgcccacctcggcctcccaaagtgccgggattacaggcgtaagccactgcgtccagcctaattttttttttttttttctgagacggagtcttgctctgtcacccaggctggagtgcagtggcgggatctcggctcactgcaacctctgcctcctgggttcaagtggttctcctgcctcagcctcccaagtagctgggactacaggccaggcgcatgccaccacgcccaactaattttttgtatttttagtagagacggggtttcacagtgttagccaggatggtctcgatctcctgacctcatgatccgcctgcctcggcctcccaaagtgctgggattacaggtgtgagccactgtgcacagcactttttttttattttattttttttaattttgaaaactgtttagaggccaggtgcggtggctcatgcctgtaatcccacccagcactttgggaggccgaggtgggaggattgcttgagcccaggagttcaagaccagcctcgacattatagtgagatctcatctctgggaaaaaaattttttttaattagccaagtgtggtggcatgcacctgtggtcccacctactcaggaggctgaggtgggtgggaggatcggttgagcccaggaggtggaggttgcagtgaaccgagatggcaccactacactccagcgtgggcaacagagaccctgtctcaaaaaaaaaaaaaagaaaaagaaaaaaagttttggtaactacaaaagggtataccttggaaaagtaaatttccctcccactctgatccccacttctcaatattaactattttttatgtatcttggccagtaggattcactgagctctcacgatgtccctggcctatgcaaagcccatcacagaaatgaagtggctggaatcattcagcactcagtgagtaggccagaccccattgctatgcccattttagagatgggaaaactgaggcttggagaggtgcaaggatgtgtccttttgagggcccggttctgaaggcttttcaaagttgaggcaaggaagtggatgagatcaaagaggcaaggttcaggccaggatacaaatcccagggagggtgacaggggtggggagtcaaggaaggctgcctggaagaagactaagggtagccaggaaggcatcttccagaaccttctgatggagggcttggatggaagtagataactctgtttggcaggctgaggaaccaccagcagcagggcgtggcccctcctcagacccacagcaccccagaggtatgtatagaagaagcaggctgcttaatgacatctcagggacacatctcggtgatagcacagccggcttagttatgacgtctgagtgatttgccaactgccttaagaccagcatccctagtcatgccccgcgggggggatgaagataagaggaagtgacaggccatcgggggaggaaggggagatgcagtcacacacagaccagggactcaggagctgagggatgtgtggtgccctctgcactagggaggggtctcccagctgcctggatgtgagggtccatcttattgatttgtctagtgaaggaggccaggctccaaggaggtatggctgtagtcagtcacactcagtttgggatggggtccgcccaggggctgcaaggatcagtcactgctgtgtccccatcacctaaggcagtaactgggacacagccggcgctccatacatcttactgaatgaatgaatcgaatgaaaagggtcagcaccgtctgggactcagtttaccctcgcggtcattgggctgcttcaaccaaggggatcgctaagaacacccctccccaccttgggtcccagatcccagatcgccagtgagtaagaaaacgggttcgcgccgttggtggactccgcccacttgtgacgtcacgagccgctcccccaggatcccgacccaggcgtctcccttgggatgggggcggagaggaacccgggagtccagactcaggccccgcccccgggagcaggcgggccgggcagggttacacaacccgtcgtcgcgtcccgagggaagtcgccggatgtcctggccgggccggggacaatgggcaaggagggcccctcccgcaggaacctggaagtggcaggggctccccctcttctgattcacccttgtttccggcccggtttagcctccttctccctggggatcctatctcctcccaactctaccctcctgtggccctgcagttcggttctttctccgaaccggcaaacctctctcctctacaccccgtaccccgtcctttcacaccttcccaacgccccccgaaactctctgccctcacactcatcgcttgtaattcccgaatcccctaaacttccagtgtccccggtccttccttcactcatccataccgggcccctcttcccaccccctcaactacccccactatcctgcccaggccctcccaatcccctccccgggctcccccaagctttcctcaatatctcccagccctccctagcccccgactcacccgcttccctccaactgaccccaatacactctcttgtcctcctaatcccagcctcccgcagttccctcctgtctcctcgaactgccccatgtccctacctcatctccccaaatcctgttccccatttccccccctcccccagccagccgcttcgccccccaccccggagcccctccccgcccctaggcccaaggccggcccgcgcccctcccgggcgcgctcccacgcccggcgcgggttcccaggccgcccccccgcggtggcccagagacccagtttgctgcggcaaaacactggtctccaggcaacaggccccgccccgccccagggccgccagatgaggctgggcggtcaggaggccaccgggccgggacggagcacccaggcctgcgcgccaaaccctcggccttggcccccagaggcctcagggcgcagaaacccggagactgaggcgcagcaaagaggagatacagagatcagggccccggagcaagaaattcggagacatgcgtggaggccgaagcaacagggaactgtcggggcgcagagatataaggaaagaccacgcgacagatcgaacaaggacggggcccagaaataagcacagaaataatgcagttacacacgggcaacaccgaggccggcagggacgcccctgatggcagaataatccatctttagtcctcaggacctttgcactcagttcgagggacttcccctctctgactctgtttctgtatttgtaaaatggggacattaatacgcagcgcttagcaaatcaggctgttctgacgattcagtgaattcgcagacccagagcttgtagcacaattcctggcatgtacactcatcattcattcattcaaccgattttttgttgttgttgttattgttgtctgagaggagtttcgctctgtggcccaggctggagtgcaatggtaccatctgggctcactgcaacctccgcctcctgagttcaagcaattctcctgcctcagcctcccaggtagctaggattacaagcctgtgcctccacgcccagctatttcttgtatttttagtagagacacggtttcaccatgttggccaggctggtctgaactcctgacctcaagtgatccacccaccttggccacccaaagtgctgggattagaggtgtgagccacggcacctgccccaatcaacaggtatttattgagcatctactatacgccaggcactggtaaagactgtgagaatgcagtattgaacaagacaaagctctctgttctggaagcttactctttggaaattggaagggggatgaccaacaataaatgaacaaatgagcaaattaagcaaattatatagtactttggaaagtagtaagtgctgggaaaagcagagacagggggttgggggttgctattttaaatgggatggtcagggaaggcctaaatgagaaggtgatgtttgagcaaagactagaagttggtttgggagaagccatgcagatatgtggcctaagcaagtgcaaagggtgtaaggtgaagacatgtctggtgtgttggaggaacacggaggcagctagtgtgggtggacagagagaacgtggggagggcactggagcagaagaggtcagagagactaagggctgatcccgcagggcccgatgggctgaggtgaagtcttttacagagtgggtcaggagctatgggagggttttgagcaaaagagggatgtgaactgtttcttatttgttaattaatttatttatttatttattttgagacagagtttctttcttgctgcccaagctggagtgcaatggcgtggtctcggctcactgcaacctccgcctcctgggttcaagcgattctcctgcctcagcctcccaagtagctaggattacaggctcgtgccaccacgcctggctaattttttttttgcatttttatagagatgaggtttcactcaacccaatgttggccaggctggtctcgaactcctgacctcaggtgatttgcccacctcagcctcccaaagtgttgggattacaggcgtgagccaccgcgcctggcttgttttttattttaacagggtcctttgggttgtaggtggggaatagactttggaggacaagtgtggagtcagggagaccagtcactgtcatggtccagttgagtccaatggtgacttggactaggaggtagtagggatcgattctggaggcctttgagttaagagaggcaaaatttgctgacaagcacattcatagcaagccatcagtagatggcagcactttccattatgttaggtggtactcaccacatccccataaaagttaacatccctattttacagatgtgcaaactgaggcccaaagaggtcgcttaacttgcctaaggtctcacggctcagtctagctccaaagatggtacccctctattgggacggctattcccaagcccacacacccgaacataacactctcagtgcctagatttacatctaaacctgtactcatccatgtgggccccaggactcccggagccatgtcctcatcagtcacatggagccggtgtagaaagtaggagctgggccgggagaggtggctcacaactgtaatcccggaactttgggaggccaaggcgggcagatcacgaggtcaggaattcgagaccagcctgaccaacatggtgaaacctcatctctactaaaaatacaaaaattagctgagcgcagtggcaggcgcctgtaatctcagctactcaggaggctgaggcaggagaatcatttgaacccgggaggtggaggttgcagtgagccaagaacgcgccattgcactccagcctgggtgacagggtgagactctgtctaaaaaaaaagaaaagaaaagaaagtaggagccagatggggagaatgctggcccaggacacttgcttagaggcaggttggcacaggcacagagggtccacccagaacctcccagcccagcatctggctcccacatccaatcacggcctaggcctggcacaccccagcactacgtgcagcaacatgtgaaacacagtcacgcatacacacggaaatgtggccttctgctctgggaatgcattttcaggcagtgtgcagaaaacacagatttgcttcttttttttttttttttttttttgagacagagatttgctcttgtcatccaggctggagtacagtggcgggatctaggctcactgcaacgtctccctttcaggttcaagcgattctcctgcctcagcctcctgagtagctggaactacaggcacgtgccaccacacccagctaattttgtatttttagtagagacagggtttcaccatgtcggtcaggctggtcttgaactcctgacctcaggtggtccacctgcctccgcctcccaaagtgatgggattacaggcgtgaaccactgtgccgggcgtctatctctttatgtctctgtatctctctgttttcttttcttgtctctatctctgacctttgtctcactctgacccagctctgtctctctcacgcctccacactcaggatcctctaactgccgcagaatgactcttgtccctggctgtgtgtttccataggacctcacctattatgtaccatgagaacctggcctctggacaggtgtgtccagccccaggtcggcaattctggctggttgctcagaatcacctggggagtaactcacatagcataattctctgggcttctttctctgagatttttttttttttttgagatagtatcttgctctgtcacccaggctggagtgcagtggcacaatctcagttcactgcaacctctgcctcccaggttcaagtgattctcctgcctcagtctcccaagtagctgggactacaggtgtatgccaccaagcctggctaatttttgtatttttagtagagacggggtttcgccatgctggccatgctggtctcaaactcctaacctcaggtgatccacccacctcggcctcccaaagtgttgggattacaggcataagccatcgcgcccggtcgtctttctctgagattctgacccacagcttgtgggtgtggaactggaggaacccacctttaaaatactccccagtgactgggacccctgcctgcttgtactagttactgcatctgattttacagacagagaagagtcaaggcccagagagcagacagctcaccccaacatcacacagcagtcagctgcgaggggcttggtgctactcagatttctcctaagaatgtttggaaacaacctgagggagagttaagtaataaaggaaaatcacaaacagagacagagacccagaaagggactcacgggaataaaagcagaaagtgacagagatacatagagatgatgagacagagacagagagatcagagatagggttcagaaaaaaagaagagagaggctgggcacagttgctcacgccagtaatcccagcactttgagaggcggagatgggaggatctcttgagcccaggagtttgagaccagcctggacagcatagtaagaccccatctttatttaaaaaaaagtttttattaatttaaaaaaaatgcagagagagataaacacacatcagaggctgagaaagacaaaaagctatttgggggcctagaaagaccccccaccccgccccaggagagatgtattttcttttgaaggagacaataccgtctccttggcccatgctttaataggccctacttcccagaaacagccagtgccatggtttagcaatctcagccttaccaagccaggtctcctccccaggcttgatatgtaggatgcacattaaatacgtttatataacctgccctctgtgcagaatcaaggagctttacataacgtagccctgtgagtcatgcggcagacacggggcactgacctgacatgcccagtgagaggggacccctcgcccaggacctttacctggaagtgattgtgaaggataagggatcatgcatttcactgaagaggaagcagagggttagagaaggcaaggcacttacttggggtcacacagccaggattcagcacagcaaggattccaaccacatctgctagtgccttatcacgtgatcctttacagagtggaggaaacaataataaaaacacctctagtaatacaacgactgctgtgtattgagtgcaccgggctgcagtaagtactttacaaacaccgtcttatgtattccaaaacccagtgaggagctggacgctgtggctcacgcctgcaaccccagcactttgggaggccaaggcaggaagattgggtgagcccaggaggagttcgagaccagcctgggcaacataatgagacccccgtctctaaaaacaaaaaataataaaaattaaaaattaaaaaattagccagtgcctatagtcccagctagttggtaggctgaggcgggaggattgcttgagctcaggaagtgaggctgcagtgagctgtgatcataccactgcactctagcctgggcaacagaatgagaccttgtctcaaaaaaaaccaacaaaatggccgggcgcggtgggtcacgcctgtaatcccagcactttaggaggccgaggtgagtggattactggaggtcaggagttcaagaccagcctggccaacatggtgaaacctcgtccctactaaaaatacaaaattagcccagcatggtggcgggtgcctgtaatcccagctactcgggaggctgaggcaggagaatcacttgaacatgggaggcaaaggttgccgtgagccgagatcatgccattgcactccagcctgggcaaaaagagcaaaactccatctcaaacaaaacaaaaaaagcccagcgagttagggacagaatccagttattaaataacataattaaacctattttatacggagcacttattatgtactaagtgctttaccggatttgatggtcacaattctaggggtgggtgatgttatcacctccatttcaggaaggaaggaggctcagaggaagtcacaggtcaaggttccggagtgggtaactaaacccagtccttgctagccctgtatctctatcacctactcccatgcatacaggtccacaagcatgcctatgcacacgtgcaatcaatattgcactaacatctccaaacactctagttgaaatacccagagctcccgccttatatcttttctcttcctcaagaaggctaacccagcctccaatcccctaaaccttcatgagccagggaaggaaccctcttctttccctctaacgcctcagttccgccacgcggccggccgaggtcggcgctgtaaaatgctcctgctcctttaagagaatgaacagtccaggccgggcgcggtggctcacgcctgtaatcccaacactttgggaggcctaggcgggtggatcaactgagttcaggagttcgagaccagactgactaacatggcgaaaccccgtctctactaaaaatacaaaaattggtcgtgatggtgcgcacctgtaatcccaactactgtggaggctgaggcaggagaatcgcttgaacccgggaggcagaggttgcagtgagccgagatcgcgccattgcactccagcctgggccacagagcgaaagcgagactccgtctcaaaaaaaaaaaaaaaaagagagagagaatgaacagtcggccggcgttgcccggcagcgccgcgccggttgccgggcaacgtcaacaaacgacgcggccgccgtctccgtgcgcccgccccccccccccccccccacgcccgcgcagacgcggtgacgcgacggactgtggaacgccgtcgcctagcaacgcgagggctgtttgtcccgggctgggtggcgcggccgcacagggcgcagccaggaccggcccgggcggacagaccggcccgccgggagcccggggcggggggtggaggggattgcggtgatggaagcgggggagaaccgggttcccaaattaccggtttccctttagacagccgccgtctgttgtcgcccgctcctcctgtctgccccgggaccgcctccgctcgggtatctgtccgtctgcgccccctcctccccggcatgtccgtctgtccagcgcctcccgcgctgtggctgtctcatatcccccccaaaccatcacaaccaaaatagggacaagcacacacttcgctggcctgccgtttctgccttggactgccggatttccgggtgcattgttgcggttggggtccccaccaggggagacagacagacaaggggagacaatctgttcacactcaagccacagccccaaagccctcccgttcctttccccgctcccttggggttctcttgcctgtctttctcgagcctctttcaagagacaggcagcccgtggtccttccatcctgtgtccgggaagctgtccacagctgggaggttctaacaactcatccccaacacacactcccaacacccccccatccagtagcttcatgtgaccagggctggggcgaatctccgagcagagagaagaaattgagtgtgtgacagtgtgaatggatgtgactataggtgagcaacagtcggtgacaatgtgcacatctggtatttcctgtgtgagagcaaaactgcaggactcagtgagtggtttctgtggtttgcacttgtgtatctgggtgtatgggagtgtgtagccctgctgactgtgtagatatgaatgtgtgtgcagttgtgagtcttgcatgtggtcatctatgtgaaacaatgcctgtataagtacccatggatgtgcacggttttgcctctagccgtgcatttctggttctgtgtgtgtgtgtttctggttttttcgtttgttttttagagatggggtctggctgtgttgcccaggctagtcttaaactcctgggctcaagcgatccccgccgtctcagcctcccgactagtggggactacaggcaagcgccactacactcggctaattttctggttttttttgtagagacaggatcttgctgtgttgctcaggctggtctccaattcctggccccaagtgatcctcccacctcggccttccaccacagtgctaggattataggcatgagccaccgtgcctagccatgtgtgtttctggatttctgtgtgtaaccatgcaggtacctgcgtttgtgtacagattatttttcagagctccctccacagcattcattgcaatgtctaattatatatttgttcctttgtttactgtccatctcccccactggactgtgcaccctgtgagggcaggacccaaggctgttgtggtcactgccaggtccccagcaccaccctgcacagagaaggtgctcagtaattccttgttgggtaaatgaatcgatgactcttatgtccatgtcgagcacacacatccatgtaaccctgcaagtgattttgtggtactgggtcttctgtgtgtgtctagaagctgcgtgggccatagcacaggagggtctctgtagccatgtagctctaatttttggcaccccccacagtgcagggcacatatcagagcctcatggcacatatcagggccacgtggagtaggaggccaggtgcactggctcacacctgcaatcccagcattttgggaggctaaggcaggaggatcacttgagacctggagttcaagaccagcctgggcaacaaggtgagaccctgtctctacacataatacaaaaattaggccaggcgcagtggctcatgcctgtaatcccagcaatttgggaggccaaggagggtggatcacctgaggtcaggagttcgagaccagcctagccaacatggtgaaaccccatctctactaaaaataaagaaaaaaaagccaggcatggtggtgggtgcctgtaatcccagccacttggaaggctgaagctaaagaattgcttaaacccgggaggtagaggttgcagtgatccaagatcacgtcattgcactccagcctgggcaacaagagtgaaactccgtctcaaacaacaacaacaacaataaaaacaaaacgaaaattagccgggcatggtggtgcacacctggaatcccagctacttggcaggctgtggtgggaggatcatcagagaccaggagatcaaggctgcagtgagctgtgattacaccactgtactccagcctgtacaacagagtgagactttgtctcaaaagaaaaacaaaaaacaaaaacaaaaatttaaaaaacccctaaaaactatggatttgaactctgttgtctttttttttttttttttttttgagacagagtctcactctgtcacccaggctggagtgcagacgtgtgattccgtctcactgcaacctctgcctcccgaattctcctgcctcagcctcccaagtagctgggattacaagtgcctgcaccacgcccagctaatttttgtgtatttttagcagagacgaggtttcaccatgttggccaggctgatctcaaactcctgacctcaagtgatccacctgcctcagcctctcaaagtgctgggattacaggcgtgagccaccgcgtccggccgaactgtgtggccttcctcctgctagcattaggacctctatgcactcggtttcctcatctgtcaaatagggagaataatagacccagtttatgggactgttgtgggagagtaaatgagttcatatggaaagcatttagaaaatgcctggcagaaaacaaacatttacaaaatacctgttttgattgttgtcagtattattacttcctctgtgtgtgtccttggatgtgcgtgtgcgtgtctagaatctgggttgcagatgcaggctttagctctgtagtcctgtgttactgggtacccaaatgccctgagtctcactttccttcctataccatgggcatgttccagaccttctccagggccagttgggactcaatgaagctgcatctggaacaccccaatggctacaaggcccagccgtggtctggtttcaggaaaggtaaatgaagggtgaagttgggacgggatggaattgaggttcaaatcactccatgggactgggaaagtgggaagtgaaagagggatgaaagagcgcatttgaagcaggcagactgagggtcagactccagaaaggacttcctcctaggactattttggggctgggaactataagaaatgaactgttttgctgggcctggtggcctacacctgtaatcccagcactttgggaggccgaggcaggcagatcgcaaggtcaagagatcaagatcatcctggtcaacctggtgaaaccccatctctactaaaaatacaaaaattaggtgggcgtggtggcgcgtgcctgtagtcccagatactcaggaggcagaggcaggagaatcacttgaactcgggaggcgggggttgcagtgagccgaaattgcgccactgcactccagcctggtgacagagcaagactccctctcaaaaaaaaaaaaagaaagaaaaacatgagctgtttggagagctgcctggaggaagagaaaccagcctgagtttcacaggctagtggaatttggaggggggcaataatagcaataacaataggccaggcacggtggctcacacctgtaatcccagcactttgggaggccgagaagggtggatcacctgaggtctggagttcgagaccagcctggccagcatggcaaaaccctgtctttactaaaaatacaaaaaaaattaaccaggcttggtggtgtgtgcctgtaattccagctactcgggaggttgaggcaggagaataacttgaacccgggaggtgtgggttgcagtgaaccgagatcatgccactgcactccagcctgggcgacagagtgagactttgtgtcaaaaacaataataataataataataatgcactaggtgcagatactgataaaggctttgtgaggaattttctttctttcttttttcttttttttttgagacagagtctcactctctttcctggctggagtgcagtggcacgatctcggctcactgcaacctccgcctcccgggttcaagcgattctcctgcctcaggctcccaagtggctgggataacaggtgcccaccactacgcccagctaattttttttttttttttagatagggtctggctctggctctgtcatacaggctggagcacagtggcatgatgacaacccactgcagccttgacctcctgggcttaagtgatcctcttgcctcagcctcctgagtagctggggctacaggcttatttttttgtagagatggggtctcactctgttgcccaggctggtctcaaacttctgggctcaagcaatcctcctgccttggcttcccaaagtgctgggtttacaggagtgagccaccatgtctggccatttgaggaaatttttatttttgtctgtcttgtttcctgctctgtccccagcacctagagtgtgtgactgcagtgtgtgtgtgtgtgtgtgtgtgtgtgtgtgtgtgtgtgtaggtgtgctgattaaatatttgaatggctgattgaatgaacgaatgaatgtcatcctacaaccacttgtgagtcctggtcttaggggaaggctgggctggggccctggcctctgggatccctcttgtgccagtcccccagccctgctgttcccacagctctgtgctgaagagggcgtggagggggccagggaagggagtgtcaggcagccagccggctgcctgccctggacagcagcccagagtgtctgcaggagggagagggtagttcaggagcctgagtcaccctgggagaaaccccagccacatacctggccgctgacatcacccggccagggcacccccggcagcctagacaagctgactgaatcacaggcggaattcagccaccccgggcacgtggcctgctgtgaccccccgcaacacccccgagtggccgtctggctgcgggggttgggccgggcacacaggggtcagtgagggggcatggggcctgagtcagggacagggtggctacagccagagaccacccagccacaggcgtccatgtggggcaggaaggagaaagtttgggaaggagagcctgtggggaggccctggcgggtgaggaggaagcacgtgtgggtgtgacggggaggctgcggcttgtgggcagcggctgggcgacccacaggggtgggatggggtctgagtgtttgcgcagagaatcaccaaatcgtaagagacttggtcgtaagagtcagtcaggaggacaatggaatcaccaatgtgcttacacacgcaaaggcacacacgcacactcaacacccggcctggggaggccctgactccacccaccccaggccagcggggcctcactacccataagcctgcaagttccctaagggactgaggcctaagggacagtttcctcatctgttgagtgggggtattaacaagcattattaggccaggcacagtgactcgtgaggcagaggtaggcggatcccttggaggccagaagttcaagaccagcctggacatcatagcaagaccccttctctacaaagaaaaaatttaaaaattagctggatgtggtggtgtgcacctgtagtcccaggtactcaggaggctgtggagggtggattgctggagtgttggagtttgagactgcagtgagctattgattgcaccactgtactccagcctagacaacagaacaagatcctatagcaaaaaaaaaaaaaaaaaaaaatcactattattgtaatagctatgcttacggggaacatactttctgccaggtgctgttctaggcattctacattttttttttttaaataatggagatgacgtctcactatgtttcccaggctggtcttgaactcctgagctcaggctatcctctcgcttttttggtggctggcacgcctgtaatcccgacattttgggaggccaaggtgggtggatcgccggagcccaagagttcgagaccagcctgggaaacatagtgagatgccatctctaccaaaaaatcaaaaaattagctaagcatggtggctcatgcctgtagtcccagctactcaggatgctgaggtgggaggatcacttgaacctgggagatggaagttgcagtaagctgagattgtgccactgcactccagcctgggtgacagaataagaccttgtctcaaaaaaaaaaaaaaaaaaaaaaaaagaagaagaaaaaagagagtcaactgcatctgtatttgtggcacttggtacatacacggtaagctttctcaagtgactctgttatgattcttagtactaaacatattattttccctttttttgtttctttctttcttttttttttttttttcggtgatggagtctcactctgttgcccaggctggagtgcagtggtgcaatctcggcccactgcaacctccgcctcccaggttcaagcgattctcctgtctcagcctcccaagtagtagggattacaggaccctaccaccatgcccagctaatttttgtatttttagaagagacggggtttcaccatgttggtcaggctggtctcgaactccagaccttaggtgatccacccaccttggcctcccacagtgttgggattacaggcgtgagccaccgtgcctggccaaatacacattatttttatccctaagtccaactaggaaggcctccaaaacagtcaccctcactgccttggtccagttctacttcttacctccctgcagtccttcctgctgcctcttctttggttatatatgtctgtagtagggagagagtgcttcagggactccctcctcattcataactcttcagaactcaatcatgattatctagatccacctccaccaggaagtcctcctggcttactccagcctcactaagcactctcaccacccaatgcctggagtggttgtagtcagtgagtgacacattgcacagtgtgtgccccctggattgggggtgggtgagagacagcccccacagtgagtggcacccctggccagggcctgggacaagtctgtatccaagggtggctctctgcttaggtctgtgtttgtacctgggtgtgtctgtgtctgccctactctgtgcatactcatatatgtgaacccgtgtgtgtgtgtgtagttgtgagtgtgtgtggaagaggctgcatggcagtggaagctaggtgtgtgattcgtgtatctgtgtgcctagagtgccttgttctatagatttggatgccactccaagcaagtcagtgggtctttttgttttttgttttttgagatggaatctcactctgttgcccaggctggagtgcagtggcacgatcttggctcactgcaacctctacctcctgggttcaagtgattctcctgcctcggccccccgagtagctgggattacaggtgcccaccaatacactcagctaatttgttgtatttttagtaaagatggggtttcaccatgttggccaggctggtctcaaactcctgacctcatgattctcctgcctcggcctcccaaagtgctgggattacaggcatgagccaccgcgcccggccaagtcagtgggtctttaggagctgtttcgtacggtgtgactgtgagtgaaccttcgcacacgtgtctgtacggatatctaagaaattcttcaagtaggccgggcacagtggttcaggcctgtagccttagcactttgggaggcccaggtgagtggatcgcttgagctcaggagttcgagaacagcctgggcaacatagtgagacttcgtatctacaaaaaatatgaaaattagccaggcatgacagtgggcacctgtagtcccagctactacttggggggctgaggcaggaggatcccttgagcctgggaggtggaggctgcagtgagctgagatcgagccactgcactccagcctgggcgacagagggagaccctgtctcaaaaaaaaagaaaagaaaagaaaaaaagaagacattcttcaagtccacaactctgagggtatcactgtgagagcaggggtcctagctctacccatttgtgtgtgtgtggagatgtgtaagtctatgtagacaaaagtgtgtgtcatttactgtgtttggggtgtgaacacctatgtgatgtgtttgcacaactgcacgtgttttgttctgtgtgtgtgatcgtgtgttcaaataagtcatcttgtcgccgggcgtggtcgctcatgcctataatcccagcactttgggaggcctaggcaggaggaccattgagcccaggaggtccagactgcagtgagccgagattgcgccactgcactccagcctgggcgacagcaagaccttgtctcaaaacaaaagcaaaaacaaaaataaacaaatagtcatcaggtgcctgcacagacaaaggtgaaaggtgtctgcctgttgagatctgtggatagggtgtatatatggacatctcagcctgtctacgtgtgtatctgtctctgtcctcacggcaaaagagaggttggccgggtgtgtggtggctcacgcctgtaatcccagcactttgggaggctgaggcgggcggatcacctgaggtgaggagttcaaaaccagcctggccaacatggcgaaactccatctcttctaaaaatacaaaaaaattaaccgggcgtggtggcacacgcttgtaatcccagctactcagggaggctgaggcattagaattgcttgaacccaggaggtggaggttgcagtgagccaagattgcgccactggactccagcctgggcaacagaacaagactccgtctcaaaaaaaaaaaaaaaaaaaaaaagaggctcagatatgtttctgtctgagagtctgtcagagtttaggaattagtaaatgaatgaatggtgaagatccatttactcaacaaacatttatttatttatttatttattgagacagagtctcgctctgtcacccaggatggagtgcagtggcgcaatctcggctcactgaagcctctgcctcctgggtttaagagagtcttgtgcctcagccaccaagtagctgggattacaggtgtgtgccactgcgcccagctaatttttgtatatttagtagagatggggtttcaccatgttgcccaggctggtctcgaactcctggcctgaagtgatctgctcacctcagtctcccaatatgctgggattacaggcatgagccaccagtcctgcctcatttattcttatattatattatattgtttttattttaaatttttttgtagtgacagggtcttactatgttgactgggctggcctcaaactggcctcaagtgattctcctgcctcagcctcccaaagtgctgggattacaggcatgagccactgtgcctggcttgaacaaatatttaataaccacctattgggtaccacgtgctatgctggggacaaggcagtgaccgggatggttttggccgagctttcacccagctcacaacccaatgagggagacaaacctatccccagacaatgatgagcccagattggcagagttggagggagggaccccaggagagggggccttgactcagcctggagatcagggagggcttcctggaggagaggttatgggagttaagacttggaggaaaagactatgagccacaggaagcgaagggaagagtgacccaggcagagggaaaagcacctgcaaaggcctgaagtccagggagagaggccaggcatctggaacacaacggggagaggagagacgagactagggcaccctcggagcaggtcgttcagggcctcaggagccatggggaggagtataatgcaggatgcaggggtactgggagggtcaagctaacagtgtccaatctgggttactctgcttccctgaaactccagggacatctcctccaggaagccctagggattgctcagtgtggagcggctcagccacccagtcacactcactattcaatgctgagcactgaggaggcagccgttactaaatcagcctggatttgccctcccagaggtcacagtcacaacagtcaaacacacacctgcacgtgcacactcatgaacgtgcccctcccctcctctggagcctcagaaacccacagaccttgttcctcccagggggtgtccctggggccaaagcttctgcactaccagggggcttgttggaaatgcaaaagatggctgggcacagtggctcacacctgtaatcccagcagtttgggaagctgaggcaggcagatcatttgaggtcaggagttcatttgaggttgggagttcaagaccagcttggccaacatagcgaaactctgtctctactaaaaatacaaaaaaattagccgggcgtggtagcacacgcctgtaatcccagctacttgggaggctgaggcaggagaatcttttgaacccgagaggtgaaggctgcagtgagccaagatggcaccactgcactccagcctgggtgacagagtgagtcttaaaaaaataataataaaataggctgggcgcggtggctcacgcctgtaatcccagcactttgggaggctgaggcaggcggatcacctgaggtcaggagttcgagaccagcctgaccaaaatagtgaaaccccgtctctactaaaaatacaaaaaaatttagctgggcgtagtggctaacgcctgtaatcccagctacaggctgaggcaggaaaattgcttgaacccaggggtgcagaggttgcagtgagccaagatggcaccattgcactccagcctgggcaacaacagtgaaactccgtctcaaaaaacaaaatacaaaaattagccaggcatggtggcacacacctgtaatcccagctactcgggaggctgaggcaggagaatcacttgaacccgggaggcagaggttgcagtgagctgagatcgtgccactgcactcaagcctgtgtaacaagagtgaaattccgtctcaaaataaaataaaataataaaaataaaaagatgaccacagcagatctgctggctctccaggcaattcgtgatcaccacgaattgagaagcgctgctctcaggcttaacccccctgtacctcagtttccttttctgtacaaggagatcaaaacagaatccatgtagaggactgacgtggagtgaggcttaactgagataatgagtgtgaaagtgctaagcacagcttcctaagtgcttgttttcagcagctcctcttcctcttttctatttttttatttttattttttttggggggggaacagggtctcgctctgttgcccaggctggagtatagtggcagagtcatagctcactgcaacctcaatctctcagggctcaagtgatgcccgtgcctcagcctcctgagtggctgggactacaggtgtgtgccaccatgcccagctaatttttaaatttcttgtagaggttgggggtgggtctcactatgttgcccaggctggtcttgtactcctggcctctggcgatcctcttacctaggcctcccaaagtgctgggattacaggcgtgagccaccacacccagccctcctcctcctctgtattattaaatttcagagctggaaagaaatttcgaagaccgccatcactcaaccttcttgctctacagatgggggaactgaggaacagaggagcagaggtttggccagaggaaggtgggaaggacgtggtgtggctggccttcacagactctgccgggggctgtttacaggatactctgaggaaagccaggatgggcactgatacccacctccaccctgcgggaggcagaaggctaaggctcccccagccgtctcccccaagcagagctgagcccttgggagccagggcagagatgcaaccctctcccccatgctcaggtcctcctcctcctggaagctctccttccaagaggagcctcttattttattttttattattattatttttgagacaaggtctcactttgtcacccaggctggaagtgccgtggcatgatcatggctcactgaagccttgccctccccaagctcaagtgatcctctcacctcagcctcccaaatagctgagactacaggcacacgccaccacccctggctagtttttgtatttttagtagagatggggtcttgccattgtccaggctggtcttgaactcccgggctcaagtgatctgcccaccttggcctcccaaagtgctgggattacaggcatgagacactgagcctggcaaggaatgagccttatggagaagaacttgatttacccactccatgctctgcaggcaggtgtgtcatgtctgtgagtgcaggtgtgtgtgtgtgtgtgtatgtgtgtgtgtgtgtgtctccagggccaatttctcccttaggcccaggggcacagtgcctagggcccatgataaatttaaccgacccacggatatgggtcaggagggtatacatgtataaagttcaggaagactttgttttagtaacaaaacgagcatgtacaatctgtcaggagccttatgatatcttcccaccagtctcatgagtgggcactacatcttgttctcctttgtcgggtagggaaactgaggccccggatgtcctagctcaagttcaccaagctacttggtgatagaagcggaacataagcctaggccacctagcttctgggtctgcgatcgtgtgaggataaatgcccagtgtgttcgtgaacatgagcatccctgtgtgaataaattgacatacataaacccatttaataaatttcaaagccaggcgccgtggcttactcctgcaatctcagcgctctgggaggctgaggtgggaggatcgcttgaagccaggagtttgagatcagcctgcaacaaagtgagaccctgactctaaaaacatttttttgaataaaaaaattaggctggacacagtggctcacgcctgtaatcccagcactttgggaggccaaggtgggtggatcacttgaggtcaggagtttgagaccagcctggtcaacagggtgaaaccctttctctactaaaaatagaaaaattagccaggcgtggtggcacatgcctgtaatcccacctactggggaggctgaggccggaaaattgcttgaatctgggaggtagaggttgcagtgagccaagatcatgccattgcactccagcctgggcgaagaaacgagactctgtctcaaaaaaaaaaaaaaaaaattagtcaagcatggtggtacgcacctgtagttgttagttacttgggaggctgaagcaggaggattacttgaggccaggagttcgaggttacagtgaactatgattgcatcactgcactctagcctggatgacagagcaagatcctatctcaaaataatactaatagttcaaggaacagactttgaagcctgacaccctgcatggtgttattccagctttgctacttacttgctgtgtgactctgggtgaataacttaacctctctgggcttctgtttcccttcctgtaaaatgatcatttgtacctcacaggagtgttgtgagaattaaataagttaatataagctcttgggaagaattagctcttgttatggttgtgtgaagagctttacacgagtccctctgcaggatgcatggttgttggtctgtgtgtgtgtatatatatatatgtgtgtgtgtatgtgtgtatctatgtgtatatgtgtatatgtgtgtgttgctctcttgatctctgagtgttgtgtgtgtgtcaatgtgtgagatcatatatgcacctttagtaaagatctaggggtctctgtgtgttttgggggtctgtacctgtccttggctgtacacctgaaccctacgtcttcttgtgtgtgtagggatgtgtgtcatgtgtgttgataaccatatgacagtgtgtgtttccacatgccagtgtgtgtctgtgaagctgtttctatgtggctgtgggtgattgcccacgcgtgacctggtgagcggctgtgtggaagtctgtgttgcctgtgtcgggtgtggagtctctggccagccagggtaggtctttgcatgtttcctttattccatggaggaggagatgaggggcttggatgagacagaagaatgaggggtcactccctgtctgatgctggggccgagtcactgcctactagtggctgctgtgtcatctcccagtctctgtccctccctcctggctggtggcagacagagggggcgtggaggaacagggcagggggtgggcttgaggctggacttttgtctggaaacttgaacctccacctatgccccccacgtccctctagtcttccacatctccctacaccctccctactattggggcagggaatcaggactccctgaaaattaagaaccatcgccttggctctgccacaggcttgctgtgtagcccggagacaggccctgcccctctctcaacctgtgaaattcaatgttttaaaagtgcttcttcctttgtgcccagggctgggccaggctgtgcactgggagggaagtgctgggttctctgaggtttgtgaaatagctggtagcacccttcccagtgggtgcttaagagttgggggctgtagcatctgaaatacccaagtcagtgcaggcatagtggctcatgcctgtaatcccagcactttgggagaccgaggcaggcggatcacctgaggttgggagttcgaaaccagcctggccaacatggtgaaacccccatctctattaaaaatacaaaagttaggccgggcacagtggcttacgcctgtaatcccagcatttaagaaggccaaggcgggaggatcacctgagtttgggagtttgagagcagcctgaccaatatggagaaactctgtctctactaaaaatacaaaaaaactagccaggcatggtggcacatgcctgtaatcccagctactcgggaggctgaggcaggagaagcacttcaacccgggaggcggaggttgcggtgagccgagatcgtgccattgcactccagcctgggcaacaagagcaaaactctgtctcaaaaaacaaaacagaacaaaacaaaaattagccaggtgtggtggcgcacacctgtaatcccagctactcgggaggctgaggcaggagaatcacttgaacccaggagatgtaggctgcagtgagccgagattgtggcactgcactccagcctgggcaacagagtgagactctgtcaaaaaaaaaaaaaaaaaacgtcagattcatgaaccccatttgctaagaagatttgctcaggtagtcacctgtacccctgtgagccaagattgcaacagtacatgctaagagcagtaagaaggagattgtaaagcttagaaagacctgacaggccaggcgctgtggctcacgcctgtaatctcgacacttcgggaggccgaggcaggcggatcaccaggtcaggagttcaagaccatcctgaccaatatggtgaaaccccgtctgtactaaacatataaaaattagcttgacgtggtggcccgcgcctgtagtccagcaactcgagaggctaaggtgaggcggaggttgcagtgagccgagatcgccactgcactccagcctggcggcagagcaagactccgtctcaaaaaaaaaaaaaaaaaaaaaaaaaaaaagacctgacaagtgaaagctactaatattgccattatcatttaaaaaaaccccagacacaggtttttcagggagtttcatccaaccaggcaggtctcagaaatcagaaaagaaatggaaagggtaggaaatctggagtttgacaattctgagtttgaatttcttgtgatgggatcttgggcaagtcatttaacctccctgagtatcatttttttcttttataaaatgaagatttttctctcttaaccttccagagctgttttaaggattacaaatcttctactgaaaggcgtagcacaggagctgtgcttggcaagtgccaaatacaaggcattaattattattattagaattaataataatatcccctccctcttacacattctttgtctccgggtggattaaaaggtggaaggagaggctaccaacaccatcagaagagaggcttctctctaagtttcatttcccatctcctccaaatccgcatccctcccaaacgccggacctgtaaggccagcagggtccaagacacacatcctttgcccagcggggaagattaaagctaaagctcagagagggaaaacatttcctaagctcgcacagcgaatcaggacagaaaccaggacgagcctcggaatccctccattacctccactttcacctgagcatcacagcccgctcgggactcagtttccccacctacgtgaccacaccacactaatcagggtctccttttggagatctgctcttcttctcgaatgggggcgctgcaccatcggtagaacagggtaggtgggggcgccagaggtgaaggggacctgcaggctggggtcttccccgcccgggtcagcggggtccctgcggggctagtctaagcgcctattattaccagcccccggggcggcgttgcactgcgcaggcgcgggcggggcgcgggcgcgcgcgcgagcgagcgagggattccctctgacgtcattgctaggataccaaacaaacactccgccgcgccggccgagctccttatatggctaattgcgtcacaggaactccgggaaggcggggccgggatcccctcccgccgagtggcccggaacgcaacccccgagacccccagggccccgagggtcatgcaagtgaccagatcgagtctagaacagacctcttgctggacagtgcgggactcgatttggcggggccggagatttggggaagtttgtccagcaaggggcgggtgacgtaagcaggggggcgggtcccgggcatataaatacaggctggcgggtctgtgcttcattcataagactcagagctacggccacggcagggacacgcggaaccaagacttggaaacttgattgttgtggttcttcttgggggttatgaaatttcattaatctttttttttccggggagaaagtttttggaaagattcttccagatatttcttcattttcttttggaggaccgacttactttttttggtcttctttattactcccctccccccgtgggacccgccggacgcgtggaggagaccgtagctgaagctgattctgtacagcgggacagcgctttctgcccctgggggagcaacccctccctcgcccctgggtcctacggagcctgcactttcaagaggtacagcggcatcctgtgggggcctgggcaccgcaggaagactgcacagaaactttgccattgttggaacgggacgttgctccttccccgagcttccccggacagcgtactttgaggactcgctcagctcaccggggactcccacggctcaccccggacttgcaccttacttccccaacccggccatagccttggcttcccggcgacctcagcgtggtcacaggggcccccctgtgcccagggaaatgtttcaggctttccccggagactacgactccggctcccggtgcagctcctcaccctctgccgagtctcaatatctgtcttcggtggactccttcggcagtccacccaccgccgccgcctcccaggtaagtttttgatagtaggggtgctgctttgtaggttttattttttaagtcaagggtgaaaagaataaaccccaacccccacaaaaaggcgcatcagaaccctagatctgagatggaaaaggctcacagcgcactttgcaaactgcaaagagtcgggagatgtttgcaattggttgcgtgcgtggagcgcaaggagggaacgcggcagggagggtaggctttggggcgaggtgggggtggggtgggtaatgcgctgctcaatgcaacgtgtatgcggtagcggggctgagaactttgagccggccccgggactgccccctgctcgggtcccagacctgaagctagcgcagttaggcaggtgggggaaatcccggggaagcttccagcagtctcttttcctttcctcctccttcggagcgcccacttcggtgccgggtcgccctccacccatcgggaagaggggcctcgaaccctcagccgcgctgcctccgcctcctgcgcggagacgtaacgggggacccgtgcgtaacggctgacgcgctggaatcctccgtctgacgcggggcacgcacggcgcgcggcgcccccttcgtccgccccgcccctgacgtcccgggagcgttctattttggaacgccggggccacgttgctaagggagggggcagcccggcgtttcgattggccgccggggcgcacgccttggccaatcagctttcccttcctatttgtagggtgcattttccttcccccctctctgtccccggaacccgtggttccttggcggctgggtctcttttcggcgcctctagaggcagagggaggggatccctgtcgtgacaagagcgcctgtctgcgacccaatggatctgcgaggcccttgcggggatctagtccctgggctctcaggagaagggggtgtctgcttgtgtgctggcgtttcttggagagatacggtggctgtcaccctcttctccaggcacacacagacacattcccactccctctgctcctcatgcccggttcctccggtgtgtcccaagacaggactagaaccgcgaaccgaagggcaaccagccaggtggtctccaggagctccgccccctctgggttcccaggactctgattggtcggcgagccagcccttccctcaccacgccccccgagagagtagttaagccttcagagcagttccaggagtccatttacgggaggggggagatgagcgctgctgaggcttgggggctcaggtcccgcaccattccccctccgcgacaatctgagagagctccagtggttacttttatctacctgtccgttcaccctaaactgtcactcgtcagtctcactctgagaagagacagtaacttgaaacgttgttctaaactcctaggcccgtcccccaaacacccttttgactgggacccccgcccctgcatgggacctcgcgcagaggggggtgtgtatgtgtgtgagtgtagaggaaggcttggcctaaggcctctccttctccctccccttgcctctggggtgggggtggggtgttgtggctgtgtgtgtggctgtggctccgtcccgggggttctgtcacccggctgtgtccagcctcctctccaccccccatacctaagagtcaccaacccggggtgtgattcaccacccgctggaaccgtgcaacctttccccgaggaagaaggaggaggtagaagccagttgagcagaaatcctctcattaaccactgcgtcacggtgtagtggaagggtgggtgttgtggctttttccctgtgacacacacatccacactcgctcaccctgtgctcactcacggggtcggtgtgtgttatgtgtgttgggtgtgtgtgtgtcggtgtctttgtttgtgtgtctacgcctgtgtgtgtatgtgtcaccccgtaggagtgcgccggtctcggggaaatgcccggttccttcgtgcccacggtcaccgcgatcacaaccagccaggacctccagtggcttgtgcaacccaccctcatctcttccatggcccagtcccaggggcagccactggcctcccagcccccggtcgtcgacccctacgacatgccgggaaccagctactccacaccaggcatgagtggctacagcagtggcggagcgagtggcagtggtgggccttccaccagcggaactaccagtgggcctgggcctgcccgcccagcccgagcccggcctaggagaccccgagaggagacggtgagtaagggacatcagaacttggcctgggtagggggaagcaagagaggcaggaagtttcttatgaatggaggggggctccactaaggcctcagtgttacagaaaccccaagatccttgctacacgagcgaggaccggaggcttgttttttggctcttgggggttctgaaagaagtagaggttcgggatgggtggaggagtgctgtatccccaaatctcatggcctctatctccctgactcagctcaccccagaggaagaggagaagcgaagggtgcgccgggaacgaaataaactagcagcagctaaatgcaggaaccggcggagggagctgaccgaccgactccaggcggtgaggacaggccctggggtgggagaggggatgttgaggggagctctctccccattctctgccccctctccacctgtacccttatcctgggttgagaactagacgttccacacatggaactaggtactgctgtggccagactgggtagcccagggcacaaacacagacccccatggacttaagtcaactcctggtcccccccccatttcctgaccccacggactactctcctagccttcatttcatcccaaggggccacatggggcccttgaggagaggggcgcccccatcatttctcccatctggtcttcagcaagtaacaacccattttgcctcagtttctccatctctgcaaaccctcatcaaatctcccgggctctttctacccttaacactctggaaagcctgtgaaatgaaattattccacctcctgccctagccacccacagctctcctggtgctggtggcatcccccaaaacccactcccttcctacgtcctcccttggtctgagagttccctgctgtatgcctgcagggtgagctgttactccttgagggaacaagggaattgtcaactttccttctctactttttctcttccccgggaggtagagagggaggggtaatagaagggaacacattaaaaacacataacagtggctcatgcctgtgatcccagcactttgagaggccaaggcaggaggattgcttgagcccaggagtttgagaccagcctgggaaacatagggaggacttgtctctaccaagaaaaaaaaaaattagttgggcatggtggtgcacaccactgtggtcccagctactatggaggctttagtgggaggatcgcttgagccgaggaggtccaggctgcagtgagccatgattgcactattgcactccagcctgggggacagagcgagactctggctcaaaagcaaaacaaaaccaaccacataacgattgttcattcattcaacaaacctcctgcacaccagaaacttccccataaacctggccccttctgtaccatcctttggacagatgggggaaactgaggttcctggaaggcaagacccttgccccaactcccatggccaccaggactccatctcaggaggtgttttttctcagcccggggctgccttccagcagcaagtccaagggagccatgacccgagtttcccggtcactgacatgcttttttctccttcctctctctcttctgtgacctggcctccctggcctcaggagacagatcagttggaggaagaaaaagcagagctggagtcggagatcgccgagctccaaaaggagaaggaacgtctggagtttgtgctggtggcccacaaaccgggctgcaagatcccctacgaagaggggcccgggccgggcccgctggcggaggtgagagatttgccgggctcagcaccggctaaggaagatggcttcagctggctgctgccgcccccgccaccaccgcccctgcccttccagaccagccaagacgcaccccccaacctgacggcttctctctttacacacagtgaagttcaagtcctcggcgaccccttccccgttgttaacccttcgtacacttcttcgtttgtcctcacctgcccggaggtctccgcgttcgccggcgcccaacgcaccagcggcagtgaccagccttccgatcccctgaactcgccctccctcctcgctctgtgaactctttagacacacaaaacaaacaaacacatgggggagagagacttggaagaggaggaggaggaggagaaggaggagagagaggggaagagacaaagtgggtgtgtggcctccctggctcctccgtctgaccctctgcggccactgcgccactgccatcggacaggaggattccttgtgttttgtcctgcctcttgtttctgtgccccggcgaggccggagagctggtgactttggggacagggggtgggaaggggatggacacccccagctgactgttggctctctgacgtcaacccaagctctggggatgggtggggaggggggcgggtgacgcccaccttcgggcagtcctgtgtgaggattaagggacgggggtgggaggtaggctgtggggtgggctggagtcctctccagagaggctcaacaaggaaaaatgccactccctacccaatgtctcccacacccaccctttttttggggtgcctaggttggtttcccctgcactcccgaccttagcttattgatcccacatttccatggtgtgagatcctctttactctgggcagaagtgagccccccccttaaagggaattcgatgcccccctagaataatctcatccccccacccgacttcttttgaaatgtgaacgtccttccttgactgtctagccactccctcccagaaaaactggctctgattggaatttctggcctcctaaggctccccaccccgaaatcagcccccagccttgtttctgatgacagtgttatcccaagaccctgccccctgccagccgaccctcctggccttcctcgttgggccgctctgatttcaggcagcaggggctgctgtgatgccgtcctgctggagtgatttatactgtgaaatgagttggccagattgtggggtgcagctgggtggggcagcacacctctggggggataatgtccccactcccgaaagcctttcctcggtctcccttccgtccatcccccttcttcctcccctcaacagtgagttagactcaagggggtgacagaaccgagaagggggtgacagtcctccatccacgtggcctctctctctctcctcaggaccctcagccctggcctttttctttaaggtcccccgaccaatccccagcctaggacgccaacttctcccaccccttggcccctcacatcctctccaggaagggagtgaggggctgtgacatttttccggagaagatttcagagctgaggctttggtacccccaaacccccaatatttttggactggcagactcaaggggctggaatctcatgattccatgcccgagtccgcccatccctgaccatggttttggctctcccaccccgccgttccctgcgcttcatctcatgaggatttctttatgaggcaaatttatattttttaatatcggggggtggaccacgccgccctccatccgtgctgcatgaaaaacattccacgtgccccttgtcgcgcgtctcccatcctgatcccagacccattccttagctatttatccctttcctggtttccgaaaggcaattatatctattatgtataagtaaatatattatatatggatgtgtgtgtgtgcgtgcgcgtgagtgtgtgagcgcttctgcagcctcggcctaggtcacgttggccctcaaagcgagccgttgaattggaaactgcttctagaaactctggctcagcctgtctcgggctgacccttttctgatcgtctcggcccctctgattgttcccgatggtctctctccctctgtcttttctcctccgcctgtgtccatctgaccgttttcacttgtctcctttctgactgtccctgccaatgctccagctgtcgtctgactctgggttcgttggggacatgagattttattttttgtgagtgagactgagggatcgtagatttttacaatctgtatctttgacaattctgggtgcgagtgtgagagtgtgagcagggcttgctcctgccaaccacaattcaatgaatccccgacccccctaccccatgctgtacttgtggttctctttttgtattttgcatctgaccccggggggctgggacagattggcaatgggccgtcccctctccccttggttctgcactgttgccaataaaaagctcttaaaaacgcattcgccaggctacagtgtttatttcctcctaacacccattgcctggcttccttttagtaagagaggatgaggttagattgtcgaaggactacacacacacagagatcatacacccatgcacacacacacacagacacacacctatgcaggaactccttctagtcaatgggtctacagcaggataaaaggaaggcagacagtcaggaggacttcctgtactcgcaggcagtgcctcctactagaaaaagtaagtggctacagctgggcgcagtggcttgcgcctgtaatcccagcattttgggaggccaagatgggcggatcacttgaggtcaggagtttgagaccagccttgccaagatggtgaaaccctgtctctacaaaaaatacaaaaattagcctggtgtggtggtgcacacctgtaatcccaggctacttgagaggttgaggcaggagaatcactttaacttaggaggcagaggttgcagtgacacaagattgcaccactgcactccagcctgggtgacaaagtgaaactgtcaaaaaaaaaaaaaaaagtaaggggtcagaaggttagcctgcaggtgtgggatcacagaggtgtcctagtgatggagcttgtatgctctatgggttaaaaacagacgctaaggagataaactatacacagaagaagcttaatgggctgtgcacagtggcttgcacttgcaatcccagctctttcggaggccgaggtaggaggctaggagttcgagaacagcctggggcaacatagtgagacaccccccaccccaacccatctcattatgttgagaaaaaaaaaaaaaagaggatcttgagaaacttgcacagcaaactactaaagaccactcaggctaggaatgaggcgtcatcttggattttttacaaactacaactacaaaaaacaattattttacactgaagatgtgtttccttttgttttccatatgaccactattggggccaacccaagactgactgaagcaaatatatgaccattttttttttttacacatagagtggagccatccccattgcaaaatcctagccgtctcttatttgcataacagcaagtcctctgggaattgaggtgagggtccaggggtcgctcagacgctttggtaaatcaataagcaagggaatttgtcatggtggaatccatttattaattcactcaaaaaaatgtgctaagcacctacccaactgtgctgggagttggggacactatagggactgagcctcaggtcttgccctcctggggctcacagtccattgggggacacacaccgttgccagtcagggacaacctaaagtggattgggtttgggaagcccatggggctagggaagcacagcagggacacctagcttggactgggagtcgggaaaaacttcctggcggaggggacagctgagctgagtcctagaggaggatagagagtatagaaagaaatagaaaaaggccaaggccaagaaaatagcacagccatagatctgttggtggggagaaggcttgatacattgagaacgcttagagggtcgggtgcgatggctcatgcctgtaatcccagcactttgggaggccgaggtgggtggatcacctgaggtcaggcattcaagaccagtctggccaacgtggcgaaaccccgtctctactaaaaaatatatatatatatatacaaaaaattagctaggcatggtggtgggcacctgtgatcccagctactcgggaggctgaggcaggagaatcgcttgaacctggaaagtggacattgcagtgagctgagattgtgccactgcactccagcctgggcaacacagcgagactctgtctcaaaaaaaaaaaaaaaagaaagaaaaaaaagagaaaactcagagattcgtggagactggaaccacgggtgtggagagaggggttagtagagaccagattctgcaggtactataatgacattcccaggctaaggagtttagatcttttcttcagggcactggggagctattgcaggttttgaacacgagaggggcaggggcaggtttgtgatttaggaaagacccctctggccccagactgagcgtgactggaagggagaggagtgagactgagcaggagaccagggaggaagtggggtggggaccctgcagggtggggtgaggaggagtccagaacagggccagggacatgggacagagaggaggggaaggattcaggagacactcgggaggcaggacagttgggcttggtgagcagccggcttgggaaggaaaatacagggcagtaataaatagcatgggtcaagtggtctgagtgaggctgggagtggtggcacgcacctatggtcccagctactcaggaggctgaggtgggaggattgcttgagcctggaagtttgaggctgcagtgagctatgatcgtaccgctgcactccactttcggtgacagagtaagaccctgtctcaaaaaaaaaaaaaaaaaggaaaaaaaaaaaaagacactgcctatgagttaaccctgctctacaaggagcagtttttaaagtaaaattaaaaaaaaaaaaaaaaaaaaaagaaagaaagaaagaaagaaagagagagaaaaaagaaaaaaggctgggttgccttggacaacagacttcatctccctgagcctccatttcctcatctgtagaatgggggctgttaagaggagttgcaaggcttgtgcatgccagcagtaagtgcagagtgacggtgcaattatcattacccccatcatctttattggggtcagcctgaaccctcgatatcccataatattcacccccatccttcaagggtctgccctaatgttcccatgacacccgaccagctcagctctccttatgagagggcctcacttttctattccctttgcagccgttatcccctttgtagttgttaattaagtgtgtaattacatgatggcttaatgtttgtctcccccactgggctgactgcaccaggagaccaaggccagggctgtcacccaccgctgcgtcctcagcaaatgcttgtttgatgagtgaatgacagatgaacaaatgggcaagtatttgactgattaatcacggcatgcgtgattaaataaatgagtgagcaaacgactgaatgagtaagcaattgaaggggagagatctaggataatttccaaactgccaatatcccagaactgggtagatgactttttctccgtcttttggagtgggtttttatactccggagggggaaataagtaacgacaatcagagatcggagtgacagagaatgagtttgcgatgcggaaggccgcagcgacctctccaggtgcaggctggaggagcgcctcccgggcaacaagcaaaagaagtccggttcgataagtaagatttaaggcgcttagttactaccgcccgaaaggtggaattgaaccactctgtcgctagacagctacaggtttgaagcctgcaccccagaccactgaggatcatccgggcaggacaaccttattcccgcgcagctatataaggatcgcaaaagcttaccttttagagttatggtcgcgtcctttggaaaggtgtgagatggttgacttcaagggctataagttctccccactcatttatcgtgagagatgtccttgtaaaacgttgccttcacttcatatagtatgaat

SEQ ID NO: 86 - DNA, 32211 bp, Homo Sapiens
cgttcggctgcgacccggaagagcttccatggagtcagggcagccggctcgacggattgccatggcgccgctgctggagtacgagcgacagctggtgctggaactgctcgacactgacgggctagtagtgtgcgcccgcgggctcggcgcggaccggctcctctaccactttctccagctgcactgccacccagcctgcctggtgctggtgctcaacacgcagccggccgaggaggtgcggccgcgctggcgcgggagtgaggggactccgagagtgttgagggcctcctgagcggatgcgaggcctctgacagggatggaggggctctgagggggattcaggcccctgacactacgcgatgacacagagaaggatggcaggggtccccagggggatgcaggtccctcacactgcgggaacacagacgtatgtaaggggtcgctaggaggataccggtcgctcacaccgtgcggggacactgataagaattggaggggccccgagaaggctgcaggtccctggcaggagttgaagaacactaagaggaatgccagtccctgacactgtgcggggactctgagagggaagggaggggtcccaagaaggatgcaagtctttgaccagagttcaagaacactaagagaaatgggaggggtccccaggggatgcgggtccctgacactgtgcaggcacagtgagaatgatggaaggggtcccgagaaggatgcaattccctgacaacactaagagggatgggaggggtccccagaaggatgcaggtccctgacatgggtgcaagggcactgaaaggtgaaggggctctgagtggtaggagaggatcggaggtcgctgcaggggagggggagatgtcggaaggaggatctggataggaataacgggagagtcctgaagttggccattaagggagtttctgggggcagaaggaaggtccctgaaagggaacagtgatgaggatggaagatctctgagggtgatggggagacatgaaaggagatgctgaggcgctggaaaaaccccaatagggaaaaggagggaccaggaaataggacattcaccaaggctgtgttaagagggccatagggtcagaaagggattggagcttgacgctgaggatgttggcaaaggttaactacagttaaggacaatggagaacactgagaaagatggaatggggctacacatgggtctgaggggtgttgagaggggacacagcttggtcggacaagtctgatgatcccctagatatatcaggtggccgggagaaaaatgtcagctgagaagagtgaccacagtctctttgagggcagggatcctgtttgattcatctaggtatccccagtgcttggcatagggcctaaggcaacacacagggcctagtaaagatggttttaaactggggatataaataaaccaagccaagggacccagtgacatgaagtccctctaggatagattagcacagaactgatagtctaaaacattgtctggggaaaggattcccttgttatcatctcatagaatgtgcttggctacaaacctggctttggtgggaagtattttctaggtagcagaaatcttttaatccaggcttttaaaagtttgaggttttgtatgtgtgtgcatatgttattgtagttgagtgctgataatgactgaagtgcaattattccttagtgtaaaccccaaaacaagaaaacctcattaaatgtagactggttggctgaagttactataaagaagtaacttagtgtgtatattcattattaagttcattatctcagagaaagacagcacattattttaaatatctgtgacctattaaaaactgccctgtattaaatagcctactaatcaagtttgatttgatttaggagtattttatcaatcagctgaagatagaaggagttgaacacctccctcgccgtgtaacaaatgaaatcacaagcaacagtcgctatgaagtttacacacaaggtggtgttatatttgcgacaagtaggatacttgtggttgacttcttgactgatagaataccttcagatttaattactggtaagaatttgaaatcttattattagtatgtaaatttgtacttttttttttttaagtacaatttccattttatttttctccagagaatagtctgtcttcagtcttgaaggactcagctccctacatcacctttggtaggggtcgtggggcagcacccacaggtctaaatctgggtgggggtgttcggtccttgcaggcttcacaagatcgattcctgactactttgttgtgaattgcacaactcacacagtaatttagcttcacatacatcttgggaagcacataggcgtcgaagatgctcgcttcagaaatgtccctgactgctgtggcctccactgtgttttgaatgacgaatttcttaatggctttatccttgggcacacatcaggcacagttcgtgcagcaaataggctgcacatggccgcagccctttttggcatgaccgttgtcctttcttttctttgtcatcttggaggcacggaccggagagggtattttctacatttttatttttgtctgtctcctctgctgaacgctctactagaaccttctagtgggcactactggatccttttgttcaacattatgcttccaactttcagcatgatacctgacacattgtagatgctcagtaaatatctgtgacctgaataagtaactaaatgttagattaacttttcattgttttctaagctcttattcagtaaatacttgcaattcgttagcatttgcttttagaacttaatcagatttgaaatgtttataaataatctttgtatatttcctaaaatatttagttttcctccttaagatttttttggcattatttgaaattaaatcaagtagttgcttgcttattttgaggaaaaattattttagctagaattaaatagaaaagaaattcattttcattatcctttcaaaaccttttctgatgtccccaaagctaatgtaggggctgtgcctctgtgccctcatattaccctgtatttctccccagtcatagtgctcacaacactacattatatttatgtgtttgtctatctcactcacaagataagctgaagcacaaggaacaagttgttcatcccaggctaaataactggtacatggtaggcactaaagacgtatttgttgggtgaatgatggatggatatagtactgtgatcgttagtgaacttctggaggcagagagactctgaaattcataatcttattcccactgtatctgtcatgttgccctgaacctagatgaccctcaagaaaaatttgataaataaatgtgtcaatgaatgcttcaatggtaaaccgactgaagaagtttggttactcttttataacttttataattgttataaacagtatcataggctcacctggttttgaatgctaacaccctgcttacaaagcaaactccttaattttcattaaccccagttttctcattaagaaaacagtgcttcctgaagttattataaggattaagttaataaaataatttcttagtatagtgcctggtacacaacaaactcttagtaattcataccaaataaaattggccttttgtaaccagaaatcttgatacaccagtcttttactgtttgctgctttcttataagcttggttttactttattttttaaattgatttaaaaaaatttttttgttgtgtttaaaactaccactaggtgtcagtaatatcctgtgactttcagttacagtgcaacctaattaggcagagagcaatgtgaatttatgcaacgttgaagtctggcttatctgtagctcctaatgaaaaatgccaaattccctcctcctttctgatcaaagcccaccgaataatgaagctggagctgttactgatgcttggctgagtggaatgtaaatgaatgccaaaaatgaattcttttgaattctttcatcccctgggatcatcccccaggactgaccaaagagcagtgcgtgaagtgcaggtaaccctctggaaaggctgaatcccccagccccaacttcttcacctgtcaccacccattattaccaccacaccccaccctgggaatccctgctaaccagaactcctaacacgtgggagaactatataaatatctggtgaggttgtaccttgaaaagaacaggacaggaggatgctttcattgccaaaactgaccctgacatctccagacagaactaagaacacactttctgggaaatatatatgtatttttcagttacacttttgatttgtgtacccagtgctgtgcctccactttatattcattcaacaaatatttaactcactaagggtcccttgtttggcaggaagggtgctgaagatagacagatgaatgggacagtatggtgaactcgtgagttagactgcttctgggtttgagttatcttcatcttgcaccagctgtgtatttttaggcaagtttcttaatttctctatgcctcagcttactcacccgtacattggtgataaagatagtaccttcctcctaggattgtcagggtgaaatgaaatgcttatatgtaaaatacttggtagcatggcacatagtcagcattctatgatctctgtgatctctgcctgttggtgttacgatgttcctgttctcgggcagtttaatggaggagacaagtaaagaagtagttatagtacagtatgggtacaaaatgtcataggaacaaaaaaaactaaagtaggcttttgtggagctaaaactcctcccaaaaacctaacctgcttctattatttttattttttgaaaaaggagtgtcttgagttggtgtgactaaataggaataacatgattttacacatgatttggaaccttcggcctcccacttgcttgctggatgaccttggttaagttgcttcccttccttggtctcatcatgatacctactgcatggaattatcataacaattaaatgaaatgaaaatctatagaaacacctaacccagttacctgggatgtagtatcagttctcttcttcctcctgggttccaaccaaaataaagacaactttttggagcgcaacattttcttaaattgagtttctccttttctttggaagttcatttttattattcttgactctacgtaatatttcaatccaggctaacaaaatgtggcctcttagagtccttgggaaaacccaccaattaggtacagaatattttctgagtagtaaattagttatgtacgtgtattgggggggttattgaaaatcctttgtctatgaattcctaaataacattattaatttttactatatttggaagataatttgctgagctagagtaaatttagctccatccacctctatccaaaacttaaacattaaaatagtaaaatctgagtttagtttattgaactattagaagggtcataaatcactgttagtattattgtccatacccttccagatatgagaactggatcaaaagcatgcaagtaccattatgccaaatatatataaggtaaccagcttgatttaggtctaaaagacagactcgtcttggagtaattgtggttttgatctagaaagcatgtctgtatgcctttatgtcatctcatgtttctccctaacttagcactaatcacactgcatcagatgacacaatatatatgaaagatctgggtcagtagtctcatttcataaataacaaagcatgtataattgttcttatttttgagatgctgaggtgttataatcatgtacacccccaaagacatgtataagtatgtcgattgaaggtttttgttttaaatggactaatttacctctgaattgactatcttctgattctgaaaattgaattcatctcataggtaatgtagatgttgcccagacttctaaaatgtggctattttgtatagtccacatctgattcatacattaaaaaaaaaaaattcatgacctactttgctttcagaaattcttcctctgacatgccagaaacaccccaccccagggcctgtgccctcactgtcccctcagcctggcagcctggaactctcttggcccagatggtcacaaggctccatccagcctttattcagataccaccttggtgagaccacccctcatacatactccctctcctccttctctgattcattttttcttctcagcacttgtagcatcctaaatattttacgtatttatattgtttatagtcaattccttgaggacagggatttatctctgttctgtgcgtggctatatgcccagtctagaatggtgcttattcattctcttgtaagtacttaagaaaaatgtgatgaatgaatggcaattacctacctgttctgtagtttaaattatgtttctccccctcaggcatcttggtgtatagagcccacagaataatcgagtcttgtcaagaagcattcatcttgcgcctctttcgccagaaaaacaaacgtggttttattaaagctttcacagacaatgctgttgcctttgatactggtttttgtcatgtggaaagagtgatgagaaatctttttgtgaggaaactgtatctgtggccaaggtaaagaacattatgtgacaaataatgatgacattatttgtcatctttgtttgtgagatctactgtaacttagttgcactttgatgtaatataatgtaaaattcattgtaattttgtttgatagaacctagtcagttttataacaaacacatccagctataaatatgtattcaccaagtttgtggttttatttaagtcgagagcaatttgatggttgcttttctgctggtccatcacatccatccaagacagccactttattctttcttacacatttagggaaactcccagggatctagagacccacatatacaacagctttaggtgtacagcagatttattggctaacattaccacttctgctttgaaaattactcaacagggaaataaagcacaaaggttttgaagaagttttattaatttctaggaataacattaaggtttcagttttcaaacatttttgcaacctatgctaccatgtattttggttataatatatgttattttgagagtagttgtacaccgggtgcagtggcttacgcctgtaatcccagcgctttgggaggccaaggcaggcggatcacctgaggtcaggagttcgagaccagcctggtcaacatggtgaaaccctgtctctactataaatacaaaaattagccaggcgtgttggcacatgcctgtagtcccagctacttgggaggctgaggcaggagaatcacttgaacccaggaggcagaggttgcagtgagctgagatcgcaccattgcactccagcctgggcaacgagcgaaactccatctcaaaaaaaaaaaaaaaaaaaaagagtagttatagtatttttaactttcttgattataccttgttttaggagtcaacaaactcttcatgtaaatggccaggtagtaaatattttgggctttgcaggccatatagactgtcacaattactcaactctgttattgcccaaaaacaagtatagactgcttacataagtaatggtgtgactgcattccagtgagactatagaaacaggtacaggatttggcccagaccgtagtttgctgaccctttccttatctgaataatacactgcttctattcattgaggttcaaagtgtttttgaaaatgttgttgctttgcttttcatttgtttgttgttttgcttttcgtgttgtttgtagcatttataaaaatggggtgttaaaccaagaccagaaatacatagctgctgaaactctagaaaattgttgaaaaatatttgtctctttaggttccatgtagcagtaaactcatttttagaacagcacaaacctgaagttgtagaaatccatgtttctatgacacctaccatgcttgctatacagactgctatactggacattttaaatgcatgtctaaaggaactaaaatgccataacccatcgcttgaagtggaagatttatctttagaaaatgctattggaaaaccttttgacaaggtactctttttccttttaagcacagtttattatgttgtaattttaaagaatgcaagttattttaatatttgcaatgttgttaataggaatttgctgttatttaagaataaaattggaggtcacttaaaaacatagcttctttggtttactggaaagtaataatttatagtaaagtatgtggattggcatataagcatcactctgacttttgcagttatagtaagtgattatctcttattttaactataatcaagaagaaaataaataactttttttactttgaaatgacaacacttggatgtctacaggtagaagagttttacataagaatgctccataattgtacatgaatttatgatctcttttatggaataaaaaataatttggatgagttttcattactgaggagtgtgaaacttgctctgtcttaaaattacattctgaattgaggaaatggtaagacatcagttccaggaatttttattctaactaattttttattatagattaatattgcagatatataaatgtctactttttcattatagattaatattattacagatacataaacgtctagtattgaattggagatccagaaaatgctgaccttttagaaattcttggcagcctttttgtcatattctggtagaaaaagtttctgtcttttaaactctgagtcaatctctatgtcactggcaataatgcgtggcgattataaaaaaggaaaaaattgacttatttctctgattcttcaaaaaagtcagttgactatgaatattgatacataaaactaattttatatattctgttcctctgtgcttaaagttttttatgatttagtccatggtgattttttttaaatcccacacaatcttttaatagaatgtgtatatccctagaaaaataaaattgtagcctaacatgtttcacactgaatttctgttgattatcccccggttagtaacagtcacttcattgttttagatattcttttagtaaccatatctaaatatagatatcccatgtgtcttgttaaaatgtttaatattttgtagatgattttacaaaaaaggcatgtagttatatatcccagtttgttcaggatagtcccagtatctacctgttgtcctgcagtgattataaatagtgtatcatttctttttccacaagtgttctggtttagacaataaactatacagtcatccagatacttctcctgctcattattaaatttgttagataagattccgtgcaatggtactgcttttatatcaggctacaaatttctgattaaaaatcagataattctgtacctaaaaagtaacagaatcagtctgtgaaggaaacatacatatacatagctgtggatatgtaggtacctacatagtgtatacataaagctgttctttgttttagacagcattttggaatcttaaaaaataattggccgggtgcggtggctcacgcctgtaatcccagcactttgggaggccgaggcgggcagatcatgaggtcaggagatcgagaccatcctggctaacacggtgaaacctcgtctctactaaaaatacaaaaaatgagctgggcgtggtggcaacgcctgtagtcccagctacttgggaggctgaggcaggataatggcacgaacctgggaggcggaggttgcagtgagccgagattgtgccactgcactcgagcctggctacagagtgagactccatctcaaaataataataataataatcaaacttagtccattgttaatttaacaaatattttcctatcatgaatccactttagaaaaaacactaaagaaatttttacaccaacaaattatggtacgttgttatttaatttgataattcttatttaatttgtacatgggcatcaaactaaatttttcatttcttggttataccttattttaaaggtcaaaaaacatgatactcatgtacaaattaaatagcaatgtaccttaatttgttagtaagccatcgtgcttgtgtatgccctctgcttggtccatttggatcccatgtctttatccatccaggatagtcagagtcaaacttggcaggaattgaacatatctgagctacatgcttagattctgttcataaaaacaaataattgattatctgatgtttataaggtcttttctcccctgacagtaatatatatttggatgatagattgactctatctgatcataaagattctagcagtaagacattcttctatatttgaaaatttaaacattattattagaattttattaactgaaatgttctagccacttccttgaataatgcttgcagtttttttattgtagtaaaatatatatgacataaaatttaccattttaaccatttttagatacacaggaaataatccttttgaaagtatgatttgtattaagaataactatacttaacatattttagcaataccaaattttattcttgttttagacaatccgccattatctggatcctttgtggcaccagcttggagccaagactaaatccttagttcaggatttgaagatattacgaactttgctgcagtatctctctcagtatgattgtgtcacatttcttaatcttctggaatctctgagagcaacggaaaaagcttttggtcagaattcaggtgggagattaaaatactaataatattctaagagctgatttgaataaagtgttaggttttagggggaatcaggtgtgaaaagtgctatattcaactatatgttatactgagatttcaaattatgttttatgttcatagcacaaagatgtaggttttattgatagctaatgtttccgcctacttaacgtctgttctgtataataataaatattcatatccgttccgggcaattttatttctagaaaagactgtgtgtagtacaggcagtcctcaacttagaaataggttgtgttctggaagtttagttgttaagaacttaaaattcattttcctcaaagcaaaagcaagggagtatggggcttccatcagctagagtgccaaagactgaagagcagaagagattttagggaaatatacatatacagctggccaccatctcgtttggctaccactgttttggcctctgtcactgtttgaccagaccagcggttttcaaagtgtggtccgtgaacccctggggtcaagatttaatacagttaataattctgatggttctttagggacattcttaagtgatgaactgcagaagcatgacagtaaagaatgcactgaatgccagtacactttcatggcactgccttggttcatgctacggcaccagcatgtacaattatggagcattcttatgtaaaactcttctacctgtagatatccaaatgttgtcatttcaaagtaaaaaatgttatttattttcctcttgattatagttaaaataagagataaccacttactatataactgcaaaagtcagagtgatgcttatatgccaatccacatattttcctataaattattactttccagtaaaccaaagaagctgtgttttaaatgacctccaattttattcttaaataacagcaaattcctattaacaacattgcaaatattaaaataacttgcttttacgccatcactggaaatgtcaacgcagtgaaaaaagtcaaataatgtcatggtattgttacgagaaaagttctgacatcacatagccctgaaaatatcttgggggcccctgggagttcacggaccacacccagaaaaccactggtccagctgaacagcgacagatcacagtagtgggaggcggtgtggttggtaggaagacaggatgacagccagttacgtatgtaggtcatgtgaccatcagagactgttttaaattaaccataaattgatggcactttttcttttaacttttcgtattaggttggctgtttcttgactccagcacctcgatgtttataaatgctcgagcaagggtttatcatcttccagatgccaaaatgagtaaaaaagaaaaaatatctgaaaaaatggaaattaaagaaggggaaggtatcttgtggggttaagtctttaaatgtgttttttatttcggtatttggtatggaaatttaaagtgcaatttaaagtcttctttggccatgtgaaaagtgtgttccttgaagataaatgtatgtatgtttgttatatgtaacatgtaatgtatgttgaaagtatatatgtaaagtatatgtgtaatgtatgtcgaagtatacagcatggcaagtcttgcagtctattgcccagggcttccaaataacagatgtcaaatattgatcaaaagtatgctacatgaggagctatatattgatttttttagaacttcaaagtaattattatttttgagtcagaatgaggttggggcatggtggcacacacctataatcccagccctttgggaggccgaggcaggaggattgcttgagcccgggagttcaagaccatcctgggcaacaaagcaagactccatctctacaaaaaaaattttaaggctgggctcagtggctcacgtctgtaatcccagcactttgggaggctgaggcaggccgatcacctgaggtcaggagtttgagaccagcctggccaatatggtgaaaccccgtctctattaaaaataccaaaaattagccaggcgtggtggcgggcacctgtaatcccagctactcaggaggctgaggcaggagaatcacttgaacccaggaggcggaggttgcagtgagctgagatcacactactgcactccagcctgggcaacagagtgagactcggtctcaaaaaaaaaaaaaaaaaaaaaacacaaaaacttttaaagtagcctggcgaggtgatgtgcacttatcgtctcagctacttgagaggctaaggtgagcccaggagttgaaggtgacaccaagatatgatcacaccactatactccagcctgggtgacagagtacgactgtgtctcaaaactaataaataaagtcaggatggaatatttgaatatcctttttaatttttaagcaacataaatatactagaatgaggcaaatatgggttttattccagcatcttatctagtgataccgtaaatatcactagttttttaaggcatgggatagggttaatgcctgctttctgcctagtttaaaggtctgtttcaaaacttaactgaggccgggcgcggtggctcatgcctgtaatcccagtactttgggaagccagtgcaggtggatcacctgaggtcaggagttcgagactagcctgaccaacatggtgaaatcctctctctactaaaaatacaaaattagccaggagtggtggcacatgcctgtaatcccagctacttgggaggctgaggcaggagacttgcttgaacccaggaggcagaggttgcaacgagccgagatcatgccattgcctccagcctgggcagtaagagtgaaacttcgtcttaaaaaaaaaaaatctttttaaagaaaacttaattgaatatattattgatgtgtttgtgtttgaatgcgtataggaacaaaaaatttaattgttgtctacttttatccatgttcaggattatgaaagtcatggggattttagaaatagtaaatactgtcattgtgtaccgatgcctttgttttgtatagctgcttatatatagtgtcacagaaacaactaacacagaatggtctctcattagtgaccatgcatataactttctaccaaggcattttgaaagccatattaatggtttgaagtatctttcatttacaccttaagtagatctttttcaggaaagcagattccatctaacattataaagaaagcttaaataaatgggcatatgtactgatgctcgtgttatctgttgttttaaaagcctttggaagactttatgggtaaatattatcacatagaatgagatatttttatttctctacagaaacaaaaaaggaactggtcctagaaagcaacccaaagtgggaggcactgactgaagtattaaaagaaattgaggcagaaaataaggagagtgaagctcttggtggtccaggtaggaaaaaaggagatgaaaacatttgcttccaaaatctatcaaatgagtcctgatttaattagctctttaaaagtagttcaagactagcctgaccaacatggtgaaaccctgtctctattttaaaacactgctattttatctataaaatgtagacaaataaatggcaaatgaacactgagatcctagtggcaacctcatttctgttcgtttgatgttgttttctccaggttgaatcattgtatattcatgaaagcaggtttttaaactagttgggttcttagaacttctatttaaagattgagctaatctctacacatattcaccaagctttaaatctggaatccccaaggaataaactaatgggtctcctgttttatatcctcagccaagtatctttccaaaaaagcctcaactcttctattacttcaatatgtaatgagccggtacaaactgaagacattgtctaaattggcagaggagactaacacaattcacaaaagaggaaaaatccatttggaattaatttaggcatatatgagatcctctggaaaaaaatattaattaaaaagaacttctttaaagccccaattacaccacagttgtactttcataagattaaatagtctggcttcaactttactgaaaagatttaagtaatcttgccagagaggagaaagcatttgatcaatacctaagaccctttttaaatagtttgtaaattgtggatctttaataccaaagggtaagatgtcttcccttcgggtgaaggaataagggggcacagggaaactaggaggacaagtgaggtaatagtaacataatgttgttttctattttcaggtcaagtactgatttgtgcaagtgatgaccgaacatgttcccagctgagagactatatcactcttggagcggaggccttcttattgaggctctacaggaaaacctttgagaaggatagcaaagctgaagaagtctggatgaaatttaggaaggaagacagttcaaagagaattaggaaatctcacaaaagacctaaagacccccaaaacaaagaacgggcttctaccaaagaaagaaccctcaaaaagaaaaaacggaagttgaccttaactcaaatggtaggaaaacctgaagaactggaagaggaaggagatgtcgaggaaggatatcgtcgagaaataagcagtagcccagaaagctgcccggaagaaattaagcatgaagaatttgatgtaaatttgtcatcggatgctgctttcggaatcctgaaagaacccctcactatcatccatccgcttctgggttgcagcgacccctatgctctgacaagggtactacatgaagtggagccaagatacgtggttctttatgacgcagagctaacctttgttcggcagcttgaaatttacagggcgagtaggcctgggaaacctctgaggcaagttataaagaatcacagctttcagttgcacagttctttaggatttaacccagaaactataccagttgcatgttagttttctttaatatccgttacgatgctgcttatgtttatgaaaccttattttgcttcctgatgaatctgggaagttggataggaaggatgtcaagtatcacagcagaacaacaaaccaaggggactgctcttgttctcgttacgtgctgctgtgcgttctctcctttattctttgggtattggtttgcatcgtatggggtactgtatctgaaaaagtctgggaaatgcataatattctaatttctaacaaaagttaatataactgtgactcggctaagtaattttaatcttctaaaatatctttcctataaattttaagaaatgactctaaattacatccatataaaactaaagtgttgggggaattactgtaccaggttttcttgagtttcaagatatatcagatgaaacatctacagaaatatcagatgagaaaatgatgcctcccaaagaagatagtgttctggctttccaattatctgaggggaaataaacagcaaaattaatatcctgaactcagtctgaaccaaaaacggagccaaaagaaaccttcccctagcattttaactaacacagcctttcagagtagagatgaatggaggagctggatcagaaataatgcaggatgaagagattagatgaggctggtaaaataattataggctggtaaattttttgtaccgtgctgttgatcaactttgtagatagcttatgtacaccaagcttctttcttgcctgagaacagaatagtgtggtatttgggagcaaaatgttagaatcagaagggacctgggagttcaaccacttactctatcaacgggaaactgaggcccagaaatggtgactgagttggccttggccacatgacacatccgtgggagagctgagtctcttgactcatcacccaatgatcttttctctgtttacacttcaaagaattatcatctaggaagataacagctaaaagaaaaaccaaggctcaaaaaggaaaatagctttgactgaaggtgaagcaaagggacagaggaggtgcttaattcagctctcttagcaacaaacaagatggaaaagcaggccttttttttttttcctttttttttttttctttgaggcagtgtcttgcccagatgcccagactggagtgcagtgttgcaatcatggctcactgcagcctcaacacctccccctttccctgactcacgtgattctcccacatcagccccaagtggctgggactacaggcatgtgccaccatgctcaactaattttttttttttttttgtagagatggggtctcagtatattacccaggctgatcttctgagctcaaatgatcctcccacctcagccccccaaagtgctgggattacaggtgtgagccaccgtgcccagcctaaaaaccaggacttttctaagagaaagtagatcaaattattctttgagatgcctgatgtaatccatacgtcttccatgcccatgtatttatataaaatgtgtgaccgctgtattctgttaagacatgaattaaaaaaaacgttcataggctggttttcataactactgtccaactttttaaatgattgtttggctgaggtacaaagaaagaattggagaagcctctaaaatttgtgtgtttttctgtttgtttatagttatgaggagagaattattctatccctctagttatatttcagtgtttacctaaactcgtttcttccttttggcaaaagaaaataaaaaatgccctgtgtggtaacgagacctttaacaggtggggtttaggcagcttaatttgagctagtgtgtgataaatgaaacctttgattcttagtcaaatatttgttatttgagcgctctaggttgctgatttcacatgttctgctgttcctttcagggattaaaaatgctgtttttccaacctaaaagttctgtcttaacatgcagggtttactttcttatatacggaggttcaactgaggaacaacgctatctcactgctttgcggaaagaaaaggaagcttttgaaaaactcataaggtaatacatagaaaatcagtatgaaagccccaactacattggaaacctctggatgggggaatatcagatagtcctgctcaggaaggatagggcaaggaagacgttggagaggatcacattgagataaacctgtggtctgaattgtcctccagtgtagatctcagcacatacttcctttttctcttccccgtctcttccttcatctccagttgcttttcagtggtttgtttaatagaatattagaaatgtgacaaagacaactgcttttttgtttgtgaagcagtatgataaaacacgagaaatatagctaaaatactgcttttctaagaaatacattagtaaatctccctcctccctgccttatgcacaatatgtccttgggtgggtggctgctttaccgtttattgggaaatgcttttacaacacagccaattatgatcaccatcaatagaatcactctgggaaaatatttcttaggaagtgtgttgtttgtctggacatacacgtgtatgtttttaagaatgagtatctggtactattccaaatccaagtagaaaatgcccttccattttacgaaaggaaaatggtgagatgttcacaaactggttggctacctcttgccctgaaggcattcgataaatctgataaccacctaccagggatattgtcaagaagattgcagcctggtgtgggaagatgggccagataatctctaagggcctcagaagccagggcaagtgctggatggggcatcacagagctgagccagagaaagttagatcagcagagaccatggcctggacggagtgggctgggccagagcaaacttccaagcctcagacattggcaatggagggcagaaattatttttagcagtagtcaacctgcgaggactgccaagaccctaggccaaatttcaaaatggataaccattctgcagtggtggctgcgggttctcagtgtatgtgcaaaatatacatataacctggatagcccaggagaagaattcttggaaatgggggtatttgctgaatcagtggcatggagtcccacgatgggggtcagcatggtgcatgggcggtcccctcttttcccttcacatcctctcgaatggtgatatgccttggccatggattcatccagctgctagtcatacaagtattgctcagtcctctcagcctatgaaaatatgtttcctaccagtgtgctctatgggattgtttatgtcgtatatgtgggtatatatatttttcaaaaacctagttcagaaatcgtgttataacagaccaggcattataccagccgcctcttgttccaggctctttgctcctctctgtcttactctttgtctgctagaccttcacgccacaaggctcaaagagtaaacaggtatttattaagcatctggtatgtgccaggccctgtgctaatattaaagtgctgaggttacaagtggtgcagaaaaagcctctgccctcctggaacttaccctttagtggaaaagacagacattaaattattataaatattgtaataagtagaggtatacagagcaccgctggctgcaaaggtaaaagaagagggtgtaataggagagtacatcaaagacctcacccagaccacaagctgatcgggagccgcttccctgaggaaatgatattcaagctgatactaggcagatggggtggaaagggggttatgttgaacaaaggcgtgcacgaaggctcccaggtacaagaggccctgtaaaggatttagggcttcacgggcagtaagaccgcactgaagcattctaagtaggaaagggacttaggtatgtttgtaaaggctttctctggcatcaagctgaggagtgagtgagggtggaaaccagtcagaatgctagtgcagtctgatgggagaaggtggtagccaagattaggttaatggaggaaagaagacagatttgagagagatttgggagatagaatcaaagaattggtgatactggatgtgggccagtacctcctgaccattccttcactctttttagaacagcctttgcccaagttttcgctcattaaaataattgtcacctagatagaaatgagtgcacagagctaaaatactcagattgggttttcagtgttcatgtcagggttccccaagatcatcctcaggctcgatgattcactagaactcacatgagtcagaaaaggtgttatactcacaatacagtttcttccagcaaaaggatacagattaagactggatgcagtggctcacgcctgtaatcccagcacttttgggaggccaaggcgggcagatcacttgaagtcaggagttcacgaccagcctggccaacatggtgaaaccctgcctctactaaaaatgcaaaaattagccaggagtggtggcgcatgcctgtaatcccagctacccgggaggctaaggtgggagaatcactcaaaccccaggaggtggaggttgcagtgagcttagatcgtgccactgcactccagcctgggcaaccgagtgacccccgtctcaaaaaaaaaaaagaaaaaaaagattaaaatcagcaaagggaaaaggcacatggggcaaagtccaggtaaaaccaggcctaagcttccaggtgtcctctcccagtggagtcacatggatgtgctgagtcctcccagcaacagtgtgtgaccacacatgcaaagtgttgtcaacagggaaactcacctgagccttgagtccccacatttttactgagctgagtcacatagacacagagtacctccatggctggctacagctcctcagactccagcccccaaagcagcaacagacatttacgataaatcacatcgtcagcataaactatctgatccagctggcacattgtgacccaaggcctcaggcatataaaaaccttatcagggagaatactccaggggctcagagctcatctcccaggagctgaccaagagccagtgttgaggagagaagcctttcttggaaacatgcagagtttgagcagcccaggcctgctgagttaatcctttcctgcacagcgttagagccagaggagcctgatagaatgggaggaagacagcacctgagtaggtgagtttcttgcttcgcctgtcttcatgcagctgcctcttctccagtgcatcagggaatctaatctagaaaagagcacttttagtagatagtagtaaggtaccagatcccatgccattcctgatttatgcacctgcttctacacatcaaaggactcagtgacaagatgtggattagccttatacatactggaaaacctcactcagcagaacctggatcatggactctctcccacatttcaatccatagaaaaatttctgcaccaggttttaacataattttatctgttatctggcataatttttaatgctttcaatgatgattgtctacttgtcataaataagatcttcccattttacccagcagtcaatcagatagttgcactgttaagaatcttaagatacttactttcccaggaaacttgggaaatttgagaggtgcttcttttgcaaagcaaaaacatatttgaggtgcattgttcaaaaaacatttgcactgtgtacttaagagaaaaatttaatatgaagatgagacaatgtgcttttaccaagacctccatgggtgatgttgtaagaacaaaagcagttgtggctctttaaccagaaaggaacaaatcaggtgaactgacagtgaaaggattgtttagctggattaaagatctgtagattatagataacagataaagtggaaaagattacactgctaaatatcataataattttatttctacccagggacgtaaaatgctccctgggtagaaaacttagtaataacatcctcagtatacatagctttgaggaggtcactgcttttcaaaggaaagggtaagattatttgaaattttactttttgaaaatacgatcacaaaatgggctagcatgagggcttaagtaaatgcccattggaagagacttctagttcagtgctactttcctatgttgccataggattatgttgtacacggtattcaaataacattgaagactgggtgcagtggctcacgcctgtaatcccagcaccttggaaggccaaggcgagaggatcacttgagcccaggagctcaagaccaccatgggcaacatgtgagaatccatctcaatttgtttaaaaattaaaataaaataaattttaataaaaataccattgaagatactaaagcaaacataggaaagcttggtgctttaagcagaaataggaatctgaattttttaattgttttgtgtctgtcacataggggaacttggataattatgccacatgttgaaagcaagagactggctgtttataattacgatacatttctgttaaactgaattactgcttaggaaggcttattttcttcatagtccaggtttcatctcgaatatattttttctcacattcgacttgtagttaagttataacatttagtggtaaactagctgttttctgtagctattaatggaaacaattgtggaattatttgaaagcaaatcttcagttttttagtataatcatggataattagacgaagagattaccacgttataagaaaagtacagtaataataacacctaacatttatatagtgcttactaggtgccaggcactgttctgagcgccttgcatatgttatgtaatcctcataacagtcttttgaggtaagtttttaaattattatcctcattttaccaataaagaagttgaagtacagagccatgaaatgacttgcctaaggtcacgtggccagtaaatggtttcagatccacacactttggaaccggaatctgtactctaaccccctaagattatacagactacaaattaatcaggaaattgggatgatcccatgtgtgatatacagcttagccagtgtaacaagtagaaacaaagtgggggacacaacataataataccaaatgaatgttaaggaaaaatagaagagcagtaatttttttgaatggtctgccctttgtcctaaccagagtgcaatagagagaatggagtggtaatgagtggcagccagagccattgccattgcagagggcttttcagcaggtagcgcttgagtctggtattgagaataatgagaaaaacatggaactgaaaccattgtctgcccccttgtgatctacttataaaatttgtactaataatatatttgcatttataggttgtttcaaatagtataaaattttaaattacaatttctgttctttagtagtatcttctagtgataccctgctctaaaatatttatccagagtggttgaagaattgaaccctctgatttcatttcctctaatgggtgtattagtccattttcatattgctatgaagaaataccccagacttggtaatttataaagaaaagaggtttagttgattcacaagtttcacatggctggggaggccttgggaaacttacaatcatggcagaaggggaagcaaacttgtccttcttcacatggcagcaggagagagaatgagtgccagcaggacaaatgccagacacttctaaaaccatcagatctcgtgagaactcactcactatcatgagaataacatgggggaaaccacccccatgactcaatcacttcccaccaggtcccttccaggacacatggggattatcggaactattaattcaagatgagatttgcgtggggacccagccagaccatatcaatgggaaaatcttggttgttttaacccttgttgaaattaattaacattgatggttcctcttctgttcccctcaccttagtctgttttatcgcagttcctcagttccagttgtttttttttttcttctcatgtttgctttgttccctcgacatcagttgtgaacccaagcagggaagagactcagcttatatatcttttctgtcatacctggcagaattaattataacatactttatcaattttgaaaaataaagctaccgcaaacctggcttactctttctgtgattattgaggatcttgtcatgatgtagttccaaattgcgaatcttagttatgattgtactgtcctctagatctaccgtataagatatgagccaccttgaagacaggaattcttgcgtgatcacgattatatccaaagtacctagagcaccacgcaggaacactccataaatgtttttcaataaatgcatgagtgagtaatgaatgctgctcccaaggcataacctgagctgttgattttttgttttaatctctgatagaaatttgatttcttatatctatttcaaaatcttgatcttgattttcctttaaaactcagggtgtttaatgggacctcccacctggagtttttaacatcaaaattctatcatatatgttttttagtttcttaatgatttttaaccacccctatttgtgattaccctgaaaatgtttgaatataaatgatttacatttacactttaaccttacaaacagtctcaagaatctcttggtggcattttttacatgtggcattttttgacatgcttgtgttgtttcttaaatatttgaatataaagtcaaaataaacaactgctttttttactctggaaaatcaagaagtagtatccgaccaaggcactttttactgactttttctacttcctttacccatcatttgtcttggcatatttacttctaatatattccttgtttttgtttttgtttttctcttactgctatcatcatgtagatcattttcaatactacaatttacacacaataaaatctagaattttgaaatttgtttcagaagtgttgacaatgttttctcccacagggaaaaagcaagcatggttgtccctgaagaaagagaaggcagagatgaaacaaacttagacctagtaagaggcacagcatctgcagatgtttccactgacactcggaaagccggtgagtcctgcactttgtcaggcacctccattgcctgcaaagggggctgtgaagttccagagttactctgccaaggcttggtctgtattaacaaactcttaaaaatgggggttgggccaaggagaggatgtgtacttccctactctaatctcagctctgccattcactaaccatgtgtcctccccagagtgaaggcactgtgtcatctgcgaatcatgtgaggttgagttttaggcaccccagcttagaatgggttatgttccagcatttcctttatatttggttggttgagactcagaatgtacttttgcaaataaactttgttaaacggtgattaggttcttatctcaacctaaaaagccagtttaactcagagtagttaaaggaagtttctccttccctcctctgcctctccccttagttgtatacataggtggggtgcatacactcctcctctccttctgtattcatttcttcttggtagctccccagatacctggtgtctggtacgcattgctgtgcagtgtccaaactgtggcatgccaccaagacctgctgaattccaagtgcactgtgatccagaagtcaccattttcccattccccaaattcctattttcctatgccagcagctgatttcagccaggtggcatgagaaaagcaatacgattgagttggtttaaccttcggtgaggccaagtacagttgaagcagtgggtgtcagaatttagtagactttagaataacctcagatgctcattaaaactgtagattcataaccctcaattcatagaaattccaactcagtggatgtgaaatggagccagcagctcgggggcttctgatggaagtggtttttggaccatactttgggaaacattgcctcagagcctctgtgtcttgttcaaagaagattctttgaaatatcaaccaggttgttgacatttcatgaagaacgacagaatgtaaggcagtatgggtaccacacagagagctgttcgtagaagtctttccttagagatcagttctccacgccttcatattagttgcctatggctgctataacgaattaccccagacttagtggctcaaaacagcacacattttattatgttacagttctgcaggttcaaagtccaaatgggtttcacaaggctaaaatcaagatatcggcatggctgcattcctcctggaggctctaggggagaatccctttcctggccttttccagcctctagaggccacctgatttccttagcttatagccccttcctccatcttcatagccagtagcatagcatcctcccttctctgatcatcctgcctccatctttcacttctgagaatccttcagcctacctagataagccagataatctcccaatctcaaaatgcttaacggagatacattctgagaaatgtgtcattaggcgatttcatcattacatgaacatcacagaacgtgcttacacaaagctagacggtctagcctgctgcacagctaggctatgtggtatggcctatggctcctgggccacaaacctgcacagcatgttactgtactgaatactctaggcaactgtaacacaatggtaagtatttgtgtatgtaaacacatctaaacatagaaaggtacaaaaatacagtattgtgatcttacgggatcactgtcttatatgcactttgtcattgaccaaaacgttgttgtacagcacatgaccgtattaataggttgcagggatttggatgtggacatctttgcggggtaccattattctgcctacagcagcccttgatacttaaaaatgtgatccttaaacaagcagcattagcatcacctggcattttgttatgaatgcagattcttagaccccttagatctcagacctactaaatacaacatctgtttttttgtttgtttgtttgtttgtttgtttgtttttgagacggagtttcacccttgttgtccaggctggagtgcactggtgcagtctcggctaactgcaacctccacctcctgggctcaagcaattctcctgccacagcctcccgagtagctgggattacaggtgcacgccaccacacccggctaattttttgtattttttgtagagacggggtttcaccatgttagccaggatggtctcaaactcctttcctcaggtgatccgtccacctcggcctcccaaagtgctgggatcacaggcgtgagccaccgcgcccggcccgaatctgctttttaatgtgaccccaggtggctcatgtgcatgttataatgtgagaagctgtggtctaagatgttcatgtttttcccagctccttccctttccccatctctggactcactgatataaatacaatagtccctaaatcactagatttgctcagtgagcatttttaacatctactggggccgctattttaagcctctaccctcaggctttgtcctaggaattgggaatacattgaccaacaaaatgtggtcagtgaggaaactacagaggggagaccttagcaggtatgtgtggatttatgaatcatcgcaagtaaggaactactgacagtctaactttcctattagctcggtttccttcaagggaaattgcctctactttataaacaaatctttttgaaaatatagaaattatatggaatattaccatatagaattatgtaaccatccatcagagttaacaacagaaacatcgatttttagattttgttatattccttctttgagagttcttccccagtgacattacttactttttctctgtaggtggccaggaacagaatggtacacagcaaagcatagttgtggatatgcgtgaatttcgaagtgagcttccatctctgatccatcgtcggggcattgacattgaacccgtgactttagaggttggagattacatcctcactccagaaatgtgcgtggagcgcaagagtatcagtgatttaatcggctctttaaataacggccgcctctacagccagtgcatctccatgtcccgctactacaagcgtcccgtgcttctgattgagtttgaccctagcaagcctttctctctcacttcccgaggtgccttgtttcaggagatctccagcaatgacattagttccaaactcactcttcttacacttcacttccccagactacggattctctggtgcccctctcctcatgcaacggcggagttgtttgaggagctgaaacaaagcaagccacagcctgatgcggcgacagcactggccattacagcagattctgaaacccttcccgagtcagagaagtataatcctggtccccaagacttcttgttaaaaatgccaggggtgaatgccaaaaactgccgctccttgatgcaccacgttaagaacatcgcagaattagcagccctgtcacaagacgagctcacgagtattctggggaatgctgcaaatgccaaacagctttatgatttcattcacacctcttttgcagaagtcgtatcaaaaggaaaagggaaaaagtgaacagtgatggctgttttcttatcccatgcctgtacttttcagcggctccttgccagacatcataggtcattattaattattggtttgctatttcattcttttccaatgctcttaatgattgtacggtggaccagaagccaggattcctctctgaactctgcagttaggcatcacttgaacttgcctgtgcctgctctttttcctccctgcaccgtctatgccgggcttagcatgtttctttttaaatgaggtttgtcaggatcaggtaaagttcctacaagtgattacagaaggtagaaactttacctgatcctaacagatctcatttagaaaggaatatgctaagcctggcatggacggtgcagggagggaaaagagcaggcacaagaaagctaccatttttaacagtccttgttatctagtgcaacataaataacagtcttaattgcacttatacccatgtcctgtggctctccaaatctggtctttgctgttgtgtctgctggacgcttgaactgatgtttgtgtaggaaatcatgttctgaccctttgtctacaaaggagccttctggaacactgagaagaaacatctctttgccattcctgaccagttctctctaccacattttcttcagctccatacttctgcctgtctgctctaaggaaatttcatggagccttcctactactaattcaagacagtctcctcaaaaactggttgactagtcttctaatgaccctaacatatgtagcatatactataatttcattgttccaaattagtatttttaaagcaaaatgaattacctgtttgcaaaagttaatgatgaaggagctcttagaattctcaatttttgcacatattcagtctcctaatatcagagatccctaagtccagctggctagttacagagttttttcagacttcctcgtttctcagctcttatatcctaagacaccagcatcatatcctctagaaatacaacctaattggcagtgagccgagatcgcaccactgcacccctgcctgggcgacagagtgagactttgtctctattacaaaaagaaaagaaaagaaatacaacctaagctcacctgcctgtgattcctcatttctcaccatcctgtgccagggtggctacttctctctgtgaggactcaaatacaagccaatgagtggcccactaagcttttaagatttgattttcctgccttgagataaaaaggagtgtaggtaaatgaaagatcaatgtatggaatatataaaaatacgaaagaaatatatacgtttaaaaatccataaagaaaaaaatctcattctaaacctgattaagttggctttttacgtaagtgtacaaataggatattcacagcatctttgtgcagtttttaaacttttatatttaaacattattaagttggcttttgttcacatgttgagtaatgggtagtaaattttctacctcaggagctgatatagacatcagttctgctagccatatcacatattttaatgtttcatcaacatcagctgtttttttgtttgctacactatttgaactaatagacagtggatcatgtaacacaaaattgtcttcaactttaacaaaattgtcattgttatttttttttgagacagagtctccctctgttgcccaggctggagtgcagtggcgcaatctcggctcactgcaacctcgcctgctgggttcaagcagttctcccacctcagcctcccaagtagctgggattataggtgtgcaccaccagacccggctaatttttgtatttttagtagagacggggtttcaccatgttggccaggctggtctcaaactactgacctcaggtgatccacccaccttggcctcccaaagtgctgagataacaggcgtgagccaccgcacccacccaacaaaattatttttaactgtcgtttctgaactgaacctctcacattggcatcttgatttattggtacttaacagtatatatggattttgaactctacacaagggtataaccagaatgaattgaggggtatcaagaaccagattggttacagtagaactctgtaagatgatgtggagagtaaggaaaaggagaagaaataaaaattagtttaagatggaataaagatttgggctgctaattttttcccaggattcaaaatatacccgctagaatggaaaacaaaaatttgaatgattacaacattatcgttaacattcaattttgtatttattgttttattgaatatagttcagagtatattaaaatagacctaccacttcaaatgataatgattattataatgtctcttcaccctattctagcacttctgcttgcagtatgtggtttctatttttttcctcttgtataattccacttgcttttaattgttgtttcattatataaaaggaacatcttcccatagcatattctatgaaaggggtttcattccaagttgagttttcaaaaaaaaggtcttcctaaagctaccattttcaaccgtccttgttatctagtacaacataaataacagtcttaaaaattgcactaataccagtgcccccctggctctccaaatctgttctttgctcttgtatctgctggacgcttgaagacaggtgcactgtctcgtatgtatttgaattatgaacagtaatttctaatgaattctaaaatggtcattgtaagtgaaagcctctcgctaccacttcctcttccaactacataaatatatttcaatgtatttccagttttggaaagttttcaatacatacatcaagtgtttacttagatttttataaaaattttttttacaatctaataatctttggtaaaggaactagagatgcatgcagttgcaaaattaatgtatttattttccagcataattttattaacttcactttttttctctctagtaaatatccagtgtacttatgaactcatgtttggctcttttaaaaccttttctaaaagctagatcagcatttttctattttacaagttttttgtataaaaaggtgaacatatgagatattgtgagaaatcattttaagtttcatttaaatcatggtgcctcttttgatactttcttaaaattgtgcaagaagaaatcatttttagtagtggtcataaatattatccttttggcagtaagctattactaattcagcctgaagctcggtagacaatatgtctacatgtgtttgagtacatcctggatacagtttcccagctcatgagggactgaaaatagtcttattcatcaacccactaggatgtgaagggttaagtctagatttggtcgcattgaaaccccacaatatagaattaataaatggccttcagtaggaaaacctacactaaagcaaatccgaagaagtggggcagggggaaagaggcattactggtctttccttttgttttgcaagcataatttgattttcctttggctcagaaaactcatttggggaaattctcttttgtgttcagtttaacctagaaaggtcctcttgaaaaaccaacattttaggaaagttcttttttcaggatggagtatattaaaattaagccaggctttgacgtgaattatcacttttctttattattttgttttctattttggtttatagctatttctggttcagttctgaacttcagcacttaatcatccttatcaaccaggcttttggtagcctaaaccgctatgctgttgtttttttaatttaaagatgtataagccaaaatttggatgggagtgagacataactgatttatatgaattttaacagagttgtatttgtgtgtgtttaataaaatatatatttattcagtactttcctcagtattttatgggcaaagtaaaaataacaatgcatagtgaaagggcatatattaccagcagtaataattcaaaatcctgaaaatgtttcattttttttgtttttgttatgcagaataaacaaggcagaaatgctctttgaaccact

SEQ ID NO: 87 - DNA, 55159 bp, Homo Sapiens
tagctatccaataattatttattgaaagaaatgacgggatgaatcccagactccggagtaagccaccccctcacacacacacccctcccctgactctcaaaatccacagcctgccacagcagatttgctaaaaagcaaaggcaataataaccctggggtccgtccaactcatgccctgtacccaggccctaggagggcgagggcttagtaggtatcttcagggtcagagcctgagtcctcgccttgttggttctgaatctgactttgcttccggtacaaacaggccacctgcggagagagggtgggacggggtggtcagaagctccctggctgctcccacctccacaaggttccagagaggccaccacgctaaaaagctggtagggccaagcagctgggcggcccacccctgcttcccaggacctcacctgagcactggtggtggcctgctccggctgcttgtcttcacggactcgaataaaccgagggaagcgaagggagatgcccttgtcactatccacctgcggaagcgggatggagactcctgcggtccagccccagcgaccccctgctcagtctcctccctcctccactctggactgtttcctgatccacatgacggggccgaacgatgggttgtcataaggattaaacaagttgacaaagtgcttggaacagtacccgggcacagtaagtgctcaagaaatgctgcctgttggccgggtgcggtggctcacccctgtaatcccagcactttgggaggccgaggcgggtggatcacgaggtcaggagatggagactatcctggctaacacggtgaaaccccgcctctactaaaaatacaaaaagaaattagccaggtgtggtggcgggcgcctgtagtcccagctactcaggaagctgaggcaggagaatggcgtgaatccgggaggtggggagcttgcagtgagctgagattgcgccactgtactccagcctgggtgacagagcgagactccaactcaaaaaaaaaaaaaaaaaaatgccacctgctacagccgttacgataatgacggtaattcgggctgagaggctgaactacggcgccagggtatgggttctagaatctgactgtgggattccaatcccagctcccaactctcaggagccgcgtgatgcaggggcagttactcaggctctctagggctctacatcctcaccgtaaaatggagatgtttgtgtcactacgtcttacggattttgagaggattaaatgagtgtctatgagtgacacgctgatgaccacacagtgcccactgcacagcaagggctggatacacaccggctcctgtgccttgttactaagggtccctggctgtctaacgtgcagcatggtaaaacatttttaaaaattagatcaaaaatgtaagttcttggctgggcatggtggcccacacctgtaatcccagcactttgggaggccgaggtgggcggattgaggccaggtgtttgtgaccagcctagtcaacatggtgaaaccccgtctctacaggcacgggtcaccatacccagctaatttttctattttttggtagaggtggggtttcaccgtgttggtcaggctggtcttgaactcctgacctcaagtgatctgcctgcctcggcctcccaaagtgctgggattacaggcatgagccactgtgcttgccctgggaattcttttatttaagaaaagaattttcttttctttttttgagacagagtcttgctttgtcacccaggatggagtacagtggtgtgatctcggctcactgcaacctccgcctcccaggttcaagcgattctcctgcctcagcctcctgggtagctgggactacaggcacccgccatcacacatggctaatttttgtatttttggtagagatggggtttcaccatgttggccaggctggccttgaactcctgacctcaagtgatctgcctgcctcggtctcccaaagtgctgggattacaggcacgagcccccatgcccggcccatttttaaagaaaaaatgttttgatctttttatctgacactcaaataaaatgcaagctcatcttcctgatccttacctggaagagcagatgtgagccaaggtcccctccctactctgctctctgtgtgcccgcccagaatcccacacagggccacggccaggtcctctgccactcaccaggccccgcgcagcagggtagatgggagagagggagaggtcagcgcacttcacctcccacacagcgctggggtccagccagtggtcgggaatcacagcgccatctatccgcacgtaagggcgtgggctgggcagcaccagcgcctgcagtgagcagaggaagagaggaacagagggtctggaatctcaaagtcaaggccaagtgttggagggctggggagagggaggaagggaaaaaaacaggcacccccttgaagtaaacagaaataggaagtgaaataagggaaaagaaacaagacacccccttgaagtaaacagaaatagaaagagaaacagaaagtgaaagaagggaaaagaaacaagacccccttgaagtaaaaagttgagaaaggtgggagttgggaggaatgggagatggaaagaaatgaaaggccctgggggctgaggcaggacattaaagacaaaaagaggcagagaaagggccagagacctggaggaaggagacagagacacagtgggacagggacagagatgtagagagagagggcaatggagagagagaaccaaagagtgggacagagatggtgtcagggtccgtgtgtccccacccacatcttgtcttgaatcatagctcccaaaatccccatgtgtcgtggagggacctggtgggaggtaactgaacgatgggggcaggtttttcccgtgctgttctcgtgatagtgaggaagtctcacgagatctgacggctttataaagggcagttcccctgcacacgctctcttgcctggcgccatgtaagatgtgcctttgctcctctttcgccttctgccatgactgtgaggcctccccagccgtgtggaactgtgagtccaggaaacctctctttataaatgatccttttttttttttttttttttttgagacagagtctcactctgtttcccaggctggagtgcaatggcatgatttcagctcactgcaacctctgcatcctgggttcaagcaattcttctgcctcagcctcccaagtagctgggaccacaggcatgcgccaccacgcccggcaagtcttgggttatttcttcatagcagtatgagtatgaaaataaactaatacagatccaatatgtaggacagacactcatgcctgaaatgcctgtgaccatgacaacattcattcacattgatcagggctcacaggcacttcacaaggagcagctatggcacctgctgtgtcctttggctaacccctggtgtgaatgaggcacagggcttggggaggtgaggctgcttgagcagggtcaccagctagtagccggcagtgctgagacatgaacctggagatgctggactccaaagccagctccactgcctgctgccctcctgcccacacctggagccccaagatggtggaagccaagagccctgcatggaaggactgtgctgtcaggggcaggggggagaggggtggaggctgaggcgcagccgccatggctcaccttgaggctctggtgatgctcctccagctcctcatcactgaagccagttccaagctgcagggaggaagcgggaggtcagaggctcagccagccacaggcccagcacttgctcctgccatctaaagctgtgtacactcatggcccccaccccactctggtctacgcagtatccacagaaaaccagggaagtagggagctgggggtgcggagcatccatccagagactcccgggtgggaatgttctcccagcaggcctgccgtgaaccactccctgtcttctgctttatggagaaactcttgctgcttccactgtctccctggccccaggaagtcactcccttatgctcacccacatcctcactgcccagtaactggctgtcctcacttccagtctttttttttttttttttttttttttttgagacagggtgtagctctgttatccaggctggagtgcagtggtgcaatcttggctcactgcaacctccacctcctgggctcaagcaatcctcctgcctcagcctcccaagtagctgggaccacaggcatgcaccaccacgcctggctaattttttaaaaaagtttttgtagaggtggggtctcactatgttgcccaggctggtcccgaactcctgggctcaagtgatcctcccacctcagcctcccaaagtgctgggattacaggcgtgagtggccatgcccagcccatctccaatgttaacactgccaagagcttctttcacctaccaaaataggaaaggctaaaaattagcagtaatgctggatgctggcagatacgcagcaagtgggcaataatcaccaatataaacgtcacctggaaagccccttttgcattgagagtcttaaggattctttttgccttttgtcctgacaatagctcatttaaaaatctattctaaataatgcaaaatggtgacaatgtagattggtggccaaaacatttgtgatttataaaagtcacttctgtcactgatcgtttaggttaacggacactaagtaatcacattacccatcagaacaaagccggcaacaacttccccacacagccacggggagctggttcaggacacagcactatgtgctatggggcacagcacttgaaaactcttgtgcgggcattcaggtcctgttgccatattgcttaagggcatatacaacactgaaaacaaagtacttccagggtaaaaaggcagaaaagaaaattactcatagagaaggatcacaactttgcaaaaatgtaaataaaacattccctcaaatgtcactactgcgtgtctctgggtggtacgattctaggtgatattttgttctgtttctgtggcaaaagacccaaatttgttggagaggggaatataggaaatacgtaagaaaatctagtccaaaatgtgcacagctttaagaaaaactttaacttgaaaaaaagtaaatcactttacatttcccagaattccttgcagctaggggtgagccatggagcaaagtgatgagcaacagaacttgagcagaaggtgttcactggctgaggctgactcagggtccaaccccctttgctcttccctggtgcgtggagcaggcatggccatgagggctggaactcctgcagccacattgtgatgatgaggccagaggcacatggcagaaaaaaaaaatgtggggacaaaaaaaaatgtggggagaggaggaacctgaatccctaatggcatcagactgccccctccacacttctcatttcataacaaaaaaattcttttcttatgtgagccaccactatttgtagctaatctcaatctctcactgacacacattcctgacatctttctatcccagcctgtttttctatatgaagcaagagttgctcatagaaccagaaaaagtaaataaaaactggggagaacggatccttcacagggggatgtgagcacccctcggtctgggttgtgcaataggaaatacccccgggagtctaatctccttccctcctgcttctgccatcagccccagttccccaggaccttgcatatggcctgcagctcctcactgtcctcgtcgtaggaggccagcaggaagcccccgtaccggccggcccgcttcccccggcccaggtaggcgccgatcaccaccaggtccagggtgtcacccacgccatcaaggtagtccttcttcagctgggagaaggggaggcaagagatgagaagggggagcgcccaaggcggggccctcactgctggggaggggctcctcagtggactgaggagggactagaagtaagtctgaagggaacttccagaaggaaccccaaggatggcccctgggaagagactggacatgggaagggtttctaggtttaaataagaacaaatggggccgggcacggtggctcatgcctgtaatcccagcattttgggaggccgaggcgggtggatcacctgaggtcgggagttcgagaccagtctgaccaacatggagaaaccccgtctctattaaaaatacaaaattagccgggcgtggtggcgtgtgcctgtaatcccagctacttgggaggctgaggcaggggaatcgcttgaacccgggaggcggaggttgcagtgagccaagatcgtgccattgcactccagcctgggcaatgagagtgaaactccgtcttaaaataaataaataaataaataagaacaaatgggaaacgcaggcgggatcgatgggacctcaggagtcagccttgccgccgtctttccctcaggacagagacgtggccaactcactctggccactcctccaaagggagagcattttcccattcgttcagaaacgttcactaagtgctaaccatgtgccaggcagaagctcagccctgggggcacaacagtgctatttcctgagacaggaaaggtctgtgctggagggaaaccagccacagacagacataagtacacaggaagagctagtcagcaggcctggccggctcagtgccacaatgcctcccgctccagtccccttgtccacccctcactgcccctctccactcaaacatccatcaactcttactgatgacaggctcctgctcgctggccctcaacacacccgtcctccactcgaggggaaaccccaggagcttcgcacaatgacaacctgtgactcccggcacggaacccccactgacttcctgaaaccttcaagaggaagatccagttttatctcacagtggccccaggtgctgcctcatctggggcctgctccccactctgagctcacctcccgcctcgcctgcccttgctccctgcacacgcagaggctgctcctccctcagggtctctgcaccgggggttttcctccctagtgctctgtccctcactttgggaaagactcttcctgatcatccggggcactcccagccccgccttgctggcccggagctgacttgcttttcttcatggcgcccactcctgcctgactttctcttattcatgtcctggcttaattcctgcccaagagcctggcccgacacgggcggcaggctcaggagagagacacctcatcacgctgcacctcgtgggatgtgcggtgcttgggctggggctgttctccatcagaactcgtgagcaagggctcgcagcagggagaaggtctgaactcagttgcagcagggggctggggtgggattgtgaaaaggggccctgagctcagacagggtacacagtggaggctcgaaatccactgcctagctgggacagacctccagacccggggtggagaaggcccagttgggggtcgagaatcaccttgagccagttgtgcgatctcttggcgatctcgtaggtggcatcaacatccagggtcttcaccatcagcccctcgcaggagtctgagggagacacagaagcgtggtccttgggaagccctggctcacaagcgccggagcaggcaggattctggtcaaacggtccaggactggggacaggctgggaggccggggtcagcgcaagctgcagacctcaggagagaaaagtgagcaccctcacctttcactgactgctccaggaactcggcgatctgctcgatgtccttggtgtccagggaggtggcgaagacaaactcgccctctgtctccacaaagttctcccggagcagctgccggcgccgggaaaggggctcacgtaccagggactgcagggccggcagggagaagagagatgagacatctttgtgagaataaagacaataagccctaaatgtgaggcgaacaggacatgtgcgggtcacaactagtgacagggttcgtggaaagccttgagagggaagaaccctgatgtcagaaggattctgagagcttaaagcatggggctagtcactggcaagagggcccgacaccatttagagtcggtgacttcaggagcatcagacggggggctgcggccttgctggagcttgaattaacactttacgggcatctcatcagttttgttttttgtttttgtttttttgagacggaatctcgctctgtcgcccaggctggagtgcggtggtgcgatcttggctgactgcagcctccgcctcctgaattcaagcgactgtcttgcgtcggcctcccgagtagctgggactacaggtgcacatcacaagagatccacccacctcagcctcccaaagtgttgggattacaggcgtgagccactgcatccagcctcatccccaagataattaaaaaaaaaaaaaaaagtcctcctttccttagaattccaaaagttttcactgagtttttccagcacatttacagttttgtgttttgctttgaaatcagttccagctggaccttgcaagagtgtgtgtcagagaggaaggaggtgatctgagtgtttttaaacaaaggacaaagcagttgtctccacatgtcaacactgactaatccgtcttgtggctttgaattgcttttctcttttgttcgatcggtccccacccacgcgcagtgtttctggtctgccctttgctcagggcttctctgtgatgatgttaaactaccttcaccacttgccctccagggggacattcacgtgttttccatggacagcttttttctgttgtaaaattgtgctcatgaacattttgtatgaaaagatgagagagaggagccacaagggttaagcaggtacaatttatctggggtcagaccatttcaggtttacatcccagccacacgcttcctagctggtgacttcaggcaagcgtttccctctgtgtacctcagagctcccatctgtaaaatgcagcaatacctactcagggcacgtctgggaagatcagctgagcccgtgctacccagtgtagccgccaccagccatgtgtagcaattgagcccttgaaatgtagcaagttcaatcggagatgtgccaagggcaaaacagtcactggctttagaagacttaatccaagaaaagagtgtaaaattccatgttaataatttcttatattcatcacacattgaaaggataatatcttagacattggattaaagaaaatatgattttatctgtttcttcttaccttttaatatggctactagaagctctaaaattagaaatgtaggctactgcagtggctcatgcctgtaatctcagcgctttggaaagcggaggtgggtggatcacctgaggtcaggagttcaacatcagcctggccaacatggtgaaaccccgactctactaaaaatgcacaaattagctgggtgtggtggtgggtgcctgtaatcccagctacttgggaggctgacgcaggagaatcacttgaacgccagaggcggaggctgcagtgagccaagatcacaccactgcactccagcctgggcgacagagactgtgtctcaaaaaaaaaaaaaaaatcatggggatgaggacacattaaacagaaaaaaaatgatatacttgactacataaaaatagttcatccatgttcaactactactaataaaaaaatttgtaaaagtaatagctcaaacaagtcctatacaacaaaataggccatcaataaattttaaagaaggaatatttgaaggaatgagaagaaatatttgaaatgctcatgggagacaaaggaaccagctgagcagggatgatcaaatcctgcagaaaaacccacaaagtatccagtgtttggaaagcacctgatacttgactttcctctccccagacatcacgggaaacaaaaatcagactctgactgtcttcctacagtaatttcatgtagtgaaacatcagtctgcatcatgaaattgggggtttgagcatcaaaggcatctctgcattagaaccactaccagctccacctgtcccggcgaaggacagatgggcctaacggagaaaaaacgtttacagaccaggaagacatgagtgagaacccaccagacaggcaggcaaaagacacgcggaggcaagtcacggaacaaatgcacgcggccaacaaacctgaaaagatgattgatcatcaatatccattaataagacagaagtgaccaagttaccacaagatcgtggttcatctaccagatgatcatctgggatgggccgggcgtggtggctcacgcctgtaaatcccagcactttgggaggctgaggtgggcagatcacgatgtcaggagatcaagaccatcctggccaacatggtgaaacaccgtctctactaaaatacaaaaaattcgccaggcgtggtggtgcacgcctgtaatcccagctactcgggaggctgaggcaggggaatcgcttgaccccaggaggcggaggttgcagtgagctgagatcatgccactgcactccagcctgggcaacagagtgagactccatctcaaaaaaaaaaaaaaaaaaagattatctgggatattgatgattgcagctaattttttttgagagcttccatgtactaactactgagttccacacccctatcccactgtttagccctcaccctaacagataaagcacctgccactgttagctccttactgtagatcaagaaactgacacacagagaggctgagtcattcatctgtagccatgccgctaggaaggttagggctgggatatgacggcatgtggcctggctccagattcctgacatcctaaagcaagctgttctcaaactgttgtcttgaggcctctttaacactcttaaaaattattcaaggccaggcgtggtggttcacgcctgtaatcccagcacttcaggaggccaaggtgggcagatcacctgaggtcaagagttcgagaccagcctggccaacatggtgaaaccccgtctctactaaaaatacaaaaattagctggacctggtggtgcacatctgtaatcccagctacttgggaggctgaggcaggagaatcacttgaacctgggaggaggcagttgtagtgagctgagatctcaccactgcactccagcctgggtgactgagcaagactcttatctcaaaaaaaaaaaaaaaaattcaagactcactccatagagcttgttcatgtgggttacataatattatagttacacctattagaaatttaaaatgagaaattaaaaaaataaatccaatatgctcacccaaataatattaattttttttttttttttgaatagacacaaggtcttttctatattgcccaggctggtcttgaactactgggctcaagcgatcctcccacctcccaaagtgctctgattacaggcgtgaaccacagtgcctggctctaaataacatattttgatgaaacataacccaagttttgagaaagtggtgagactagaggcattattttacacttttgcaaatcctctaatatctggcttaacagaggctggattctcctgcgtgcttctacgacacactcttctcgttgcaggacctgaggaagatccacctcacgccaatgtggagttggaaagagagggaccttgaagatgtccttgaaagaatcttaaggaacctcaggggtcctcagaccacactttgagaactgctgcccaagtgtggcttcctggccatgtgaagtggcagagtcggaaatggaagtcagaggggcagctgccaggctcacaccccaccccgtcacccctcagctgcccctggacaggaagctggaactcacctctccattgaggtagatgaggtcgaaggcgtacaaacacacctgcacctggatctcagacgcatccacctcctgggttggggcacaacggagttcgtgagtgcaggaaggtgagacggggcactgtgcctgaggccgacagcattcatctaccggtctccctctcgccccacctaactggctgcccatctgtgagggcggccatgctgctggctccaggtgctggatcgttaacggctctcagctaattccgacaacctcattccccttcaccagatatttgctctcctagacttttctgcagctaatggcagtgacatggcacagttctggccaatgagatggaaaaggggaaacctgtggggtgcaggttgtggggttttccagaacagatcttctttcatagtaaaacaacagagatgcccgaaaagggcccttcccctcttcctacttgggatgctgggatgagaatgcgatggctggagctgtggcagccattctgcagaaggctgagagaagtgcatccagactgacactctgcccttctgggcactgggcaggacccacagccaggactgggtggaagatgaggaagtacggggccttggcaggcagtggagcgggtgatgctaccttgcgtttgcgggtggtgagcacttggaatggctggatctgcttcttttcccggtcccaagccacggcttcggtgtccaggatgaaggatgtgaccgatgggagtttaatctgaaaagtgaagggagagacccagggcctgagagaggtggaagatgaggtggaaagacaaacacggggagataaattcccttttccttctgcagctctcaagatgcactaacaaagaggcaggtgcacacagatgcttttcttttattccccaccaagaggagacagaaactaatgtctctgagaatgtaatatttggtctcacaagctggaaacctaggagctcttgtcatctccctcctcctgtcacccacattcagttcctcagtgaacctgatgatttcctaagccgtccacttcccaccaactccctgctcagcctcgcctactgggcttccctgtcctgcaccgatcccctccaatccagcttccccatagcagccagggtgacactggcaagccccaaatccgatcacagcacctccctgctaaaaaccatccccatgattccccaaagctggggggactctcccgggtcagcctgggtcgtccctcgcctcacctggccccctgagcctctcttcaccccagcacgtgagcctctctgtttctcaaataagtgggcaatgcctcttccactactgggcctttgcatgtgccgttccctctagaacccctgcccctgtctgtctcctccactggcaagccttcttttccctcaagggaacactgttgcccaagccgggggcagcattcatgttgtatcctggagccaggtagcttccctgacaccaagtctaagccacacctatttctttttgagtcagagtctagctctgtcgcccaggctgcagtgcagtggtgcgatcttggctcactgcaacctctgcctcccaggctcaagcaattctcctgcctcagcctcccgagtagctgggattacaggcacatgccaccatgcctggataaattttgtattttagtagaaacggtttcaccatgttggccaggctggtctcgaactcctgaccgcaagtgatctgcctgctttggcctcccaaagtgctgggattataggcgtgagccaccacgcctggcctcttttcttttttgagacagtctcccactgttgtccagcctggcgtgcagtggtgcaatctccgctcagtgcagcctctgcctcccacgttcaagtgattctcctgcctcagcctcccaagtagctgggactacaagagcacgccaccacatccagctaatttctgtatttttagtagtcagggtttcaccatgttggccaggctggtctcgaactcctaacctcaagtgattcacccgccttgccctcccaaagtgctgggattacaggagccactgtcaccggccaggcctgtttgttacataggctcacagaatgctggtcctttcctgtggagcccggatctccacatataatttacagagccagctgcaggactctctggtgaaggtctgcctgctctgctgggctgtgagctcagtgagggcagagaccatggcaggcctgttacactcccagcctccagcatggggcctagctcggagcagatgcccagtaaatacttgctgaacgaatgagcaaaagcagccagatgcaagagactagtgccatattataccaccaacaggaagctctagaacaggtaaaaccaacctgtggcgaccaaaaagcagacctggggttgcctctggtggatgcatggtgttggacagaggagggggccttgcttggccagggacacaaggaaatatttgattttttatttttatttttttgagatggagtcttactgtcacccaggctagagtacagtggcccgatctcagctcactgcaacctccgcctcctgggtacaaacgattctcgtgcctcagcctcccaagtagctgggactacaggtgcgtgccaccacacccagctaatttttgtatttttagtagagatgggatttcaccatgtcagccaggctggtcttgaactcctgacctcaggtgatccacccgcctcagcctcccaaagtgctgggattacaggcgtgggccactgcgcccagcggaaatatgttagaatgatgagaatgtggaaatattttatacattcattggggtgtcggttacttgggtgtatgaacttttcaaaactcatcaaacagcatagtgcacactgaaaatcactaacttttagggaaattacatcttaagaaaattgatttaaagaacagtgcttggcacggaacaggagctcccctaacacgtgcactgaactgtgcctctctctgtcactgtctctaacaggcagaatgatgggcaccgtgccccctgctttcttaaataacttatttcctatttaattaggggcaggcaaagagaaaggctctttgataggggactcctcgaacaggcacgagacccctactgggtgcagagaagtccccaactctggggcctgtgaggcccagccctgtatgactctgagctgctatttctgaggcttggggcctatccacaggctggccccctccaaactcgtcctgactcctcctccccgcgttcctggctggagaggctgcagagttagactctggctttccgaggctttgttgcactagggtggccatggaacccagtgctggacagtgactcccagctgcagtccacggcgggggaggggttgtgggtgggaggtgtccaggaaagtgttaactcaagctagaatcccttttccctctttctgtctggaagaatgacatctgtttgggaaactctaaggggacaagcattggcactaaaagccaaccagccaaggacagcaggggatagaggtagcgataagcttggttcagggggacatcagtgctcagccaagtcggtgctggggtgcccacctctagatgtgagaaaaaatcatatgggcttacaccacgcaggactgagtgctctgtcatttgcagccaaacgcaacctgatctcctcccaataaaccccgcactgtgccacactggcctagatgggcctcaggcctttgcacccctgaccacagaccctggcagagtgcaagtgtgtggcagacgcccaccttggggatgcggctgatgatgtccgggtacttcccagtgttgtcttcctgattcctgctgaagatcttcacctccccgccttccagggcgtggatctgtcacgatgggagaagggaggggaaatcagctgagtcccctcatgtggcctcagctttctcttctgaccccacctgcactggtagaaggttctggaagctctggaggaggaactggtgcagagacttgagcgaatcatctcctcagttccaacagcacctcccagccctgctctggaaggccctaccatcattttcttcttcatttccaatccctacacctctccccatgtaggcacatgcaccttgctgcatgtgggtgctgatttgtttaaatgtcattatgctctagatctcattctgatttttttttgaggcggagtctcgcccaggctggagagcagtggtgcaatctctgctcaatgcaacctccacctcccgggttcaagagagccttccgcctcagcctcccaaggagctgggattacaggcgcccaccaccacacctggctaatttttgtatttttagtagagccaggctggtcttgaactttcgacctcaggtgatccgcccaccttagcctcccaaagtgctgggattacaggcgtgagccactgcgcccagcctctatgtctatttattttaagacagtccggtcacagcccttgagcagggcggcatatatagcatcttatatgtttgttattatttccaggaacagttgtcaagaaatcattgtcactatcgtaaatcatcttgtgtcttttttctcaacactattttggagatccatctctgatcctgtgtctgttggatccaccctttttttttttttttttttaaaagatggagtctcactcttatcgtggaggctgtagtgtagtggcacgatcttggctcactgcaccctctgcctcctgggttcaagcaattctcctgcctcagcctcccgagtagctgggactacaggcacacgccaccacactggctcatttttgtggttttagtagagatggggtttcaccatgttggccaggctggtctcctcaggggtccacttcctgtaactgccccgagccctgtggctcccacccactttgcctgcttacctatccccaggtgagaaggccccacacttgccaggacagaagagacacaacacattcttacagaccccaggaccaaggacgcctgaggccctggatcacaggacacacatgcacgtcacggcatgaaggggtcatgtaggcacctcccagaacggctgttaaaatgaacacacccaccagcagcatcagcggagcccacgtttcatgagctcccactatcatcggtcaggactctggaggattgtagcttcggataagctggtgaggtagttaagaccacaccctagaggccaggcacgatggttcatgcctgtaatcccagcactttgggaggctgaggtgggtggatcatgaggtcaagagatcgagaccatcttggccaacatggtgaaacctcgtctctactaaaaatacaaaaaattagccgggcacggtagcgggcgcctgtagtcccagctacttgggaggctgaggcaggagaatcacttgaagccaggaggtggaggttacagtgagccaagatcatgccaatgcactccagcctggatgacagagtgagactctgtctcaaaaaaaaaaaaaaaaaaaaaaaaaaagaacacactcactgcatggaggtggatgctgaagcccagagagatgagcgagggctcggcagtctgtggcgcaggccggcttgaagctcaggcctcagtgaccccacacccctgctctttgacgttttcctgtctgtggaagggacatgtcccactccccatacctgtgccctctgcccgtcatatttgtattcgcaggtgaaagctgcctcctcaaagcgtttcaggacctcgctgatgccccgggtgggatgggccaacattggtttcaggggaatccctgggaaaggaggagagtgagttagaggagagggaaggcaatggattagagggggaacatggagaggagaactgctaatgggccccaggaccattctgctttcttgctattcagtcacgaagcctcccacgttttagaaggggacctagcctcccactggggactacagcccccggccttccttccaggtgggaaaggccatgtgattggaacccacgcagcatgtgcaatgtctggctcacatccttgcaaggaatctggttgcctcccctccctcctctgcgtccctcctcccacaattagaacagggaagtgagccacatttgatcacagacattggggtgacaacctttggagggcagagggacacaggaacctgggtccccgggtcatccctgggacacagctgcacacctgtaccttccctggccacctcccttgctctggacacttctgtgtgacagaaagaaattctatctggcctgacccactgccttctggcccatttttatttacttatttattgtctcactctgtcgcccagctggagtgcagtagcgcgatgacggctcactgcagccttgaactcctgggctcaagcgatcctcccacctcagcctcccgagtagctgggatcacaggcacacgccaccacgcccggctcctgtttatcacagcagtgtcacctacaccctatctactccacaaggggaaattccaaggagaaaagcagtgggtttcagcaccagggaggagcatttggttttggtgggggagaggactctgcaagttctgagaggggcgcctacgatggccaccctcacgccgactcaggagggagcagggctgctgccaggctggtgagcgcccctggggcctgtacctgggctcagcttgcagtgctccgggagacgttccaggccgtgctccagcagcacggggataattcggtccaggtcgggaacctcgctggggtggcgggtgagaacaagataggggaagcctttctagaactcacacagtttggaaagagagctcggcctgctcccagaagcctgggctcctggatgcctctgcccactgagtcaccacctgccaagctcctcttgccaccctgtctctgtgctctcccttcgtgtcactatctgttgctttgtctcccttagtctggccttgcccctgttccctatctgtcaccacgagaccagcgattctctactcggctacacaggagaccactcaagaatacagtttttaaaaaaaggtttttggccgggcatggtggctcatgcctacaggcatgtaatcccagcactttgggaggccgaggtgggtgcatcacttgagcccaggagttcaagaccagcctagccaacatggtgaaatcccatctttactaaaaatataaaagttagctgggggtggtggcacgcgcctgtagtcccagctactcaggagactgaggcaggagaatcacttgaaccctggaggcggaagttgcagtgagctgagattgtgctgctgcactccagcctggatgacagggcgagactccgtctcaaacaaaataaaaatagacaaaggttttcaaggctaggttccacctacaaagattttgatgtagctggtgtggggtaggcctgaggtcagcagctgatagagccccacgtgcaggcagagttgagcttgctgcccgggcctgttcaccactctctgctcagcacccagtggggggccctggcccagagcaggtgctctgaggccatctgtggaactgccatcggccctcctgcctctgacatcctctctggggcagtcatgatcttggagtcaccagccctgggtcagctgctggcctaggtccctccacatggctctctctggagccctcgtggccgctccacggatgtcctctccatgactgtcaagacccttcaccatgtgtcagtcacctgctcctctctgggtcccttaaggcctttctgcatgcacagccctgtctggcactcagaaacctcatgttgccggctgccctcccttgctgtcagcgtctttcttttttttaagacagtctcactctgttgcccaggctggaacgcagtggcgtgatctcagctcactgcagcctccaactcctgggttcaaatgattcttgtgcctcagtttcccaagtagctgggattacaggctaatttttgtatttttagtagagacagggtttcaccatgttggccaggctggtctcaaactcctgacctcaagtgatctgcctgcttcaggctcccaagtgctgggattacaggcgtgagccactgtgcctggccgctgccagcgtctttctatacctctcctggggtcactgacccttcactgtttgccaccttcctgatctttgtcaccatccttgtgtcaagcaccagccttgtctagatcaccacctctgctctcagtcaccccgtgaccggcactcgtgatgcctgtccgtcacttcactggccccacccactgctcctctggctccacccccaccctggcactctgcccacagcccctggcaactccacccactgcccagctctcaccagaacgtctgcttcaggatcatgccttgctcctccagccacgtctttctggcctctgctgtcttgcccttcccagcatccaccatggctggtgggaattctaagaaaagacccaccagaggctttggaaggcacccacatccttggctacaccagggtgcagtgggtggtttgctgtatggcaaggaatgcagatgccgcggcccaagacgccccctcccccccacccaggagagaggagcctggtatggcaggggcccgctggggaaggggcgggcatgggcctctgaagaggaggggggaagcctgaggtaactccagcgagggatgcagagacgggccacaggagctcaccttggcccgggggcgtgaggctcactgcctgggagagggcagccagcaccgactgctctgccagcccaaggcgcagccgtccgctcagggacctggggagagagcaggccagggaagggggcttgtctgcacctccccaatcttgcctcctcccttctctgatctcctcgaccttgatgtatgtagaccctctcctcaaaaaccagaagaatcttcagagcctggaagggaccccagatatcacacagccccatgtgacagatgaggaaactgagccaggcagtaatgatcctgcccactagcatagactggggaggggcacaagtaggtgcaccagcacctcccatctcagctgccctgaggggttggcgaggcttgaggaggatgagtcagggagagaactgagcctggcgcccgccctggtgactgtaatggtcaggaccccagcatggtccttgctttgagccagtggcaggagacaagtggcttagtttgcctccccatgtctccatttccccttctataaactggaggtgagggtaacaagaccagtctcacagagttgctggtaggaactgatgaggtaaggcacggggcacagggcagggctcccaagaaatgctccatgatgtgagccctcaatggatttgctctcactgtcatggcaaacaaaccctggcttcctgctgcagggcccgcgcccaagccgaggcagacctcaccaatcaatcacagcatgcttcacccacaggggcccaggggccttctctagacagcactaccaagggacagaagctggcctgtgaaaggaaatggtgtcccttcccactctttaggggctgggcctcctgctcatgcttttctcatccaaggatggtcagggcatttgtgatgattccagctgccagtccctccctcctttcacctccgagcctgcagtccccctctgtagcctcacaggcccacacgcttacctagcgatgaaccgggcttctgagtggcggcaggccacaaagaggcctttgatgatgtctatcttcttggctgtggactggagagtcaggggaagagccgtcagtgcctggtgaaggcagggaccacacctccaccccaccagccgtgctgctgccctgcattttggaatacctgccctccttccctcaccccatccccatgtcccagctcccatggccgcccactcttagggcagtaagaacgagctagctctcctccttgcctccctctccctttatccaggaagtatttactgagtcctgtcatgtggcagccatggcattaggtctgctagactctgaagaggagactcccctaggattgggtgcaggaaggaggagaggaagctgtgcaccccatgagaaggactgatgcgacccagctgatggtctacccagaagccttcctgacacacgcgtggcctcaggtccccaagatgtctggggtccgggatgagcggcccgccccactcacagcactgccagtgagcctggcgatgtcgcggaacttgctgaagaccccggaggcagtgagcggaggtggtggcagcatgagcctctgggtgctgcggctgttctcggccaccagccccacgtcgcctttctcggctgcctcagcccggacggactccagctgccgaccttcaggggagagcgcgggtgggggtgtcgagggtgacagttgtggctgcgtgtctcccttctctcgcggcctggatgaattttctccagctgtgtgtgcttgtggcgagtccctgcacctccctgtgtctaacgctcacccacttggtagaaatggcttggggaacgtgcccccagccacgctggctgtaggaagtcagcaaacatgcacgtggagccaggaaagcggtggatgaacgagcatgaccacactcaggggagacatctgggccggtgtcatcagggcgcggatgggatttaaagccacaggcgggacaaggtcactagggaagtgagtgtggacagagcagagaaggccaagggaccctttcctctggcgggtcatgaacatctctggcagtgaccaaagacccttcggcttgttttggagccaccagcttacacacgtgggatgtgctctggccccacttactgtccagagctgggtcccatgggcgcctgggtgtaagagctggggagatggagcctcaagtcacggtgacagctgtgacaagcagctctcaacctatcagaaccaacacacccttgtcaccagatactgtgtgtcacctcttttctggtctgaaataaaatgtggagataacataacctgcctacacctatcgagataacgccctaaccctaacacagaaaagaatgaaagggaaagcaatccgtaatgaacgaacaagtgcgcgtttcagtccacagatgctcagccgcggcacagagcacatgaaggtgggcctcgcgcctgaagcgaaactgccacaaatgggagagccgacagtgtgagcctcaccaatgggatgttatcgaatcacacatcaaaggggacgggattctccaaagtggccaacaactcacaacaaacccgggacttggacagccacgggggccacaaggcggcacggagagcagtgtgagtgtgaacacgacccatcaagggtggaggcatgagacagtggaagaggccccagctgccatggattgttgggcaggaaagccagcatctgcaacttcttttgtgagaaaaacagatccttctttgtccaagccaatgtagttgggttttctgttacctgcagctcagagtattcttaaccgaccccgtgtgtgctgggtctggtatgacgtcagtgctcccgaaacacatcttgagtgaatgagtgagaaaatcttgagtctcatctcctctggctcccataagcccgtaactctttcctgatccaagtcaacctttctcagtccctctgtcctctcatgaaagcctgaaacccctgccttccctaaatgttggtgcccatggccctaagccagctccagtgctcccagcacatcctctccccaggcggatgagaacccaccagtgggtggtcatccctcctacactgaccagcccgaaccctgggctctgagccagacctggtgagcctcagacccgtttccaaacttcctggatggccctgggggcccacagatagaggttgctcatgcctgccccacgctggggtgattaatgccccctgcaggtgcctgcccctcaccagggtcccaagctgccgacggctttgtcatccatccagtcacccagggagatcctggaggcattcctcctgcctcctcaccctgacatccactgtctgccagatctctcctgccctcttctctcttctctacagctggggtccagctcctcttccccctggatgctgccccttgcctgctcacaatccttccatggctccccagtgtcctcatgataagcaccgagcactccaggcccttggcaggcgggccatccgcatcaccagcctttccacccagcactggcggctgggccccttcaggctgctggccccccacacaccatgttctttcctcccactccttccaatccctccagtcaaagtcctttcagacctctctaagccccaaccttccatctcagcccccaaatcctgctgtctctgcctccagcatctttccccagccctccccttccctgcaccccacaccccctgtcccagcacatgcctggtcctccctcacctgaactgctgcccctgtgttctctcccacacccctgcaaatctgtccccatcaggctctcctccctctcagccttctcctcaaccctgtttcacagcctctctccaccatctctccgatccacctgacctctgcattttctctggctgagctcctgtccttctggtccctccaaccacagtcccccttacctgtggcctgggccactgccttgagaaggacaccatcacccacgccaagctccaggccctgctggggtggcccaaggtggttgaggctgaggtagaggacagggaggaggtctggaggcgacagggccaccacggagcgcagcaagttgctcagcgtctccaccatccggagcctggaggaggggacgggggtatgaacacgtggttcctcaaggtcaaagtgtggtgtcggggtggggtgggtttaagggggtggacactagaaagaaatggagaaagaagaggaaagggctcagaacagtcccaggctctggggcctggagccatgaggacaatcacagattgctggaggtgaaaccgcctttgcaaaaccgtaactgaggaaattatgacagtggaaagaaatcacacctaaccgattccatcttgcttctaacctttaagctgtccttgttcagtcctgggcataggcagaactaactttgggaaggaatttggttcgtggcttgactctgaaacgaaattggtaatagccctttctggaaaagacccctttttgcctaaggacctgccttcgcaagactcacaaattagctacaagattagaaatttaggtttaggggtcacgcagcctctggcttccccgattgctcctggggataacatcactactgtaaaacctaagatgagtgcttaagatagtttgcagaccctgcactcagtctgacgccacccagactgtaatctggctcaacaagttctgccatcccacccaggaacagaagacagcaagaaaacctcccttcgaccccctgtgagtccatcttcaacctgaccaatcagcactccccacttaccaagcccctacacgccaaattatctttaaaaactctgctccccacatgctcagggagactgatttgagtaaaaatgaaactccggtctcccgcacagccagctctgcgggaatgactctttctccactgcagttcccccgtctagataaatcggctctgtctaggcagcgggcaaggtgaacccaccggacggttacagtgggggagtaacttggtgtgacggtaacaatgatgaagatggtgatgatcagcccagagaaacgacagctgatgctacggagcattttctaaattcaggagctggctttgagcactttgcaccttttttttgagacggagtctcgctccatcgcccaaggtagagtgcagtggcacgatctcggctcgctgcaacctccaccttgtgggttcaggtgattctcctccggagtagccgggactaccggtgcgcaccaccatgcccggctaattttttttaatttttagtagagacggggtttcaacgtgttggtcaggctggtctcgaactcctgacctcaaatgatccgcccgcctcggcctcccaaagtgctgggattacaggcgtgagccaacacggccagccctttgcaccttttaactcatagaatcttcacagctcccctctgaggtaggtaccattattatttccattttacggataaagaaacagaggcaccgaaagagtccgtggcttgcccaaggtcacagagcgagtaagtatgaagctgagatgtacaccaaggccgtgtgcctgaggactgtgctcccagccaccaagctgcaccacctctaaaacgaaaaccgtgtttctgtctaaaacttcaaagctggaaagaatggctttgttactgaaaaacttagggggcctcattagaaacagaagctgggtttttcctacagaagtctcattaccgaggtttttaaggtgcagagaagaaatacaaaaaccaacatcagggaaatccctcagtaatcattgtaggcaaaagccaccattggatggtgcagtggatggaacagcccccccaaaattcaggtccactcagagcctcacaacatgacctcatttggaaagaaggtctttgcggatgtacctgtagattaagatgagagcatagtgaatgaaggtaggctctgaatccaaaaagcatccttacaaaatacagaagagggccgggtgtggtggctcaggcctgtaatcccagcattttgggaggccgaggcgggccgatcacttgaggtcaggagttcaagaccagcctggccaacatagtgaaaccccatctctattacaaatacaaaattagggccgggcgcggtggctcacacctgtaatcccagcactttgggaggcggaggtgggcggatcacgaggtcaggagatcaagatcttcctggctaacacagtgaaaccccatctctactaaaaacacacacacaaaaaattagttgggcatggtggcaggtgcctgtagtcccagctactcgggaggctgaggcaggagaatggtgtgaacctgggaggcggagctgcaagtgagccgagattgcgccactgcactccagcctgggcaacagagcaagactccatctcaaaaaaaaaaaaaaacagagtgctgggaacagcctgaaatgctccactcatgttggggaactgagaaatggcatgtgccatgtgagaacgaagggacactacagagcagtcacaacaggctcgaaccactcaaccaacatggacacatgtggaaacgggtttgatagtgaaggcaagcagaatgagccgtacccatgataattttgtttgtttgtttttgagacagagtctcactctgtcacccaggctggagtgtaatagcgtgatctcggctcactgcaatctctgcctcctgggttcaagtgattctcgtacctcagcctcctgagtagccgggattacaggcacccgccaccatgctgggctaattttgtgtttttagtagagatggggtttcaccatgttggccaggctggtcttgaactcctgacctcaggtgatccacccaccttggcctcccgatgtgctggaattaaggcatgagccactgcacccagcctccatgataatatttatataaactaaatacacaggggcgagtgctgggggtgaggaggacaaggagagaagaggaaatggggacagagaagggggctggcagggaccagcgatgctaacatgctgctgagaaggaccagggtggggcagtgctatgcactgggcatcactggggtgggacgctctgcagggaacctctgtgaatgagtagggggtcctcgctataactgagacctcaccttcttttgtgaatatggagacatgtaagcaagactgaagtcacttttgatgactcagggtggactagaagtaatcacggactgtgtgcaatggtgccagtcatcccgagatggagcctgtctccttaccctgcacatctgggctcgccccttgtgtcttgctctgaccatgagaatgaggcagaaagtcaagaggacctgcagccgcttttgtgaccatgtctgacatccatgatcatacgcccgagcggggtcagaggccaagttgacagggtttggcggaacaaggcagcacagaccgccatgcagaggacagacccagaagcgaccccgccccccacccaggcagtcctcattagttaccgagcagacacctcctcgatcttctcaaacgtccgggccacagccaggtaaggaaccctagggaaggaaaagagacgcaagagtgacagtggtgcaggctataccatgctgcccgtctgcacccttgcttcctcacgcctcctcgggacacccttgccaatacccaaatgcatgagctcacttcccagggctgtctctctgtccctttcaatgctgctgattgtcgccaaaacacaggagggagagacttgaccatttctcccaaccaagactctgcttagagagcctccggtggcaacagggaccggagggggacagtctgaaaagggagaaacctcacttctggcccggtttccagcaggcatcttccacgggatgatagttgttcttggcaggattgtaaccagatggatccaggggtctacggaggcaaaacggagattgaattgcatagagccctgggtcaaagcaaagtcattccttccaactgtgatgtgccaggctctgttcaaggcacacggtgcagagctggatgaaaacaaagtttgctaacctggagctcacattccagcaggagagtcagaggaaagtgggcaaaaagcccccacataaacacatcattaattttaggtgttaaaaaaatctttcagaaaacaaaagaaagccgagtagaggaagaggatgagatgagggtgctgcttcacagggtggtcagggaaggccggagacatctgggcagaatgagggaggggttagcacagtgggcagcaggggacgagcattccaggcagagagaatagcgtgtgcaaaggcgctgaggtgcagacaaacttgagaaacagaaaagggattgcgtagctgagctgggacagagggaggtgcgtatagtcccgggtgtcgcaaagtgccaggtgccatgctaacaccacatcgattaacaatcagacatgggaggaagggacctttccttttttcttgagacagagtctcactctgttgcccaggctggagtgcagtggcatgatctcggctcgctgcaacctctgcctcctggcttcaagtgattcttctgcctcagcctcccaagtaactgggattacaggcgtacacgaccacacctggctgatttttttgtattttcagaagagacgaggtttcaccatgttcgctaggctgattttgaactcctgacctcaaatgatctgcctgccttggcctcccaaagtgctaggattataggcgtgagccaccgtgcctggccagaagggacctttctaacttccttttccggataaggaaactggggcacagagtgattaactcacccatggccacacagctggtaagcagcgcagctctagagacagttcccaacctctatttttttttgagacagggtctcactgtcgcccaggctagagtgcagtggagcaatgcgcactgcagcctcaacctccagggctcaagggattctcctacctcagcttcttgagtagctaggactacaggtgcaagcaaccatgcccgactgatctttgtagagatggggttttgccgtgttgcacacgctggtgtctcactcctggacttaagcgatcctcccacctcgacctcccaaagtcctgggattataggcatgagccactgcgcccggcctcaacctttatatcgtaagtagctcacactgaccccagccaaactctgcattcagactcatctgggttccaatctgctctgccccggccagctgtacctgctgaggaagcagcttcccctctctgaaccacagcatctccatctgtctggggagctaaggggtccctactatgacaggttgtcctgaaggttacataaaaaatgacagtgagggttcccactcctgggtgcacttcatggaacaatgaggactccccagccccaggcctacatctgtaccaaaatggggacaagggttgggggggagaaagagacctcaggatatttttcagctcttcagctgattctgatgctcacacagggcatggatggccaagacagatagtgccactgcagggctgtgcatggcctttggtatgaacttggggtttaacaagcggtggccggcattacaatgaggcagcagagtgtggtgggcaggggagtctagagccagtcagcctggctagaaccacaatgctgccactccccacctgtgtggcctgagcatggcattaaaaacaaataagaatagtagcagcagttaccgtgacaacatgctggtcataatcaaggccagaccctgggctaagtgtttcacatcctcagaagagagacacagaaaggctaagtcacttcctcaaggtcacacagctgagagaggtggagctgggattcctagccagtcctcaatactgtcccacctccccgctttacttttctcacccaggaaaccaggataacaacagaatctactcccagcagtgttgtgaggatttggagcattgcgtcagggaaagcccgttgctgagtgcctggcacgtggggaagagtgggtggaagaacatgcttcctctcatcactgtgcccccatctgagaggtgaggaaattggagagtgggaaagtttgcctgtctcttggaggcagccattggagacagaggggaagtgaccaggctaggaatggtgcaagaaaagcagtcatgcctggcgtggtggctcacgcctgtaatcccagcactttgggaggccgaggcaggcagatcactgaggtcgggagtttgagaccaacctggccaacatggagaaattaaaggggtttggaataatccctgctgttcagcagaaaggacaggtgggttaaaaagtatgacgcagtgagtccaaaatctctttgatgtcatgcctctacaaatgaaacagataacgacaagaaattctttcagctttaacatttcatgattaaagtttaagtctaacaaaaaagtgtctgtctctattaaaaatacaaaagtagccgggcatggtggcgcatgcctgtaatcccagctacctgggaggctgaggcaggagaatcacttgaacccgggaggtggaggtcgcggtgagctgaaatcgtgccactgcactccagcctgggcagcaagagcaaaactccgtctcaaaagaaagaaaagcagtcgtagtatcacttgaaatagaaaacagaactttatatacagtaggacactgattttatttggaaaacatatttataaatacacaaacacggacacacactcaggaggcacgatatggcaatggggaagaaataactgctaggaatcaaaaacattccttagggtcccaggcctggccctacccccacctccctgtgtgacctggcgaggcccgacctaacctctctgggctaatcatgtcaatgtgtgtaaaatggctaaagtgctcccttcctccacaggaatactgcagagaggacgttaacgtgctatttaacctccttgataaggtctcaattgggggtacaaaattgatgtcaagaatcctccgaacacttttttgttagacttaaactgtaatcatgaaatgttaaagctgaaagaatttcttgtcgttatctgtttcatttgtagaggcgtgacatcaaagagattttggactcactgcgtcatactttttaacccacctgtcctttctgctgaacagcagggattattccaaaccccttttccgttaatttttttttagctttcaggacatcaagaattcaagaggggatgaagtccacgctgctaacaccatcacattgtatttgaaaacacaatctttagaggaaaaaaataacttcagatggatatatgattatgtaagaaatcaggctggccgtggtggctcatgcatgtaattccagcattctgggaggctgaggtgggaggatcacttgagtccaggagctcgacctgggcaatgtagtaggaccccatctctacaaaaagtaaacaaaaattagcccggcatggtggtacatgcctgtagttccagctacttgagaggctgaggtgggaggatcccgagcccaggagcaccactgcactccagcctgggtaacagagcaagaccctgtctttaaaaaaaaaaacaagaaacaaaaaacaaaaaacccaaaaaacctaagttctataaagaggaatttttgtctgatttgtttcctaccagatctcaggcacctaaaatccagtagctaacacgtaatcagtcctttgtaaatacttactgagtaaataaatgagtccatgattgactagtgaaaaaaaaaaatctgaaagtgctcatttaaatttctttcatggcagatttcctgggcttcctaggggccagccccagtgctgggagctaggcaagaagactaagaaggctgggacctcccacagccctggctctgtgggaaggagcttatgtctggttagggaggctctttaccatgtgacaagacataaaagacagtctgactcaagtgctggggacacgcacctcctctcacacatgaagggagaggcacccggcttccctaagcaggtgcaataggagttggggcctgagggaagcctgctgggcagggtgggttagggacagtgttgtaggccggggtcaagcatgttcagaagcagggaggaggctgggtgtggtggctcacgcctgtaatcccagcactttgagaggctgaggcggccagaacacctgagattaggagttcgagaccagcctggccaacatggtgaaacccggtctctactaaaaatacaaaaattagccaggcttggtggcgaggcacctgtaattctggctacttgggatgtggaggcagaagaatcgcttgaacctgggaagttgaaggtgcaatgagctgagatcgtgccactgcactccagcctgggcaacagagtgagattccatctcaaaaaaaaaaaaaaaaagcagggaggaatgacagcacgtggggacatggtgtgcagagggagcaggaaaaggctgcagatgccaggaggctgcaatgtaaggtggacagggctggctcatgagggcactgggaagcccagcatatcctctatgctggggagaatcgcagatgggttttgagcatggcagagatgggggggtgacctcattactttataggatatttatccacccacgcatccaatcatccattcagccagtcttcagtgcggcctcctgtgtgcatgttagatgtcgtgggaatcagcccagacatctcttcaaataattaacaaaattacagtgaagcaattaattgcttaacaacctattcagtgtcccacagccccagcacactaagcacatcacgagggctggggcagggcggccggctctctatggttcatcctcgtgggccgcccagggctggcaaagaaggggtgttcagtgaattttaaggcagagtagacgcgcctgcaggcttccagcacatacactaaatctggtgagttcaggccaggtgtactggctcacgcctgtaatcccagcactttgggaggccgaggtgggtgggtcacctgaggctaggagttcaagaccagcctgaccaatacggtgaaactgtgtctctactgaaaatacaaaaattatctgggtgtggtggcatgcacctgtaatcccagctacctgggagaatcgcttgaacctgggaggtggaggctgtggtgagctgagacagcaccactgcactgcaggctaggcgacagagcaagactctgtctcaaaaataaaaaatctggtgagttcagagccagaggaacagagaggtaggaagtgaggccagagagggaggtggcagccagtggccaaatgggcttagattttctcctgacggctctggggaaccctagaggggcagagtcaactctgggtgttagaaagatcccccaggctctacggggatcagactgaggatgaaagactggaggcagggtcagagggtggctggggccacggtcagcaaactccgaccctggaccgtttctacaggttctgggatctaagaatggttttgcaacaggggccaaatgtgtcccataaagcctaaaatatttactctctggctctttatagaaaaggtttgccaagtcctgcaagaggaggaagcctgagctgggggtggggctgtcggaatgcagagaagggaacacatcccgaagaacctttccagacctggacactgactcacccctcagcagctccctcctttcctggagcccctggctcctcttccttcacttcttttttgactgctggcttccggggggctaggaatgaagacagaaaacagtgggtcttttctccttccggtagcccccacctcccatccattctgcacccagcaccaccccagtgctcagggagatgggagacaggctggtagagacaaggccgactttccaaccagcaggaaaggaagaagggtcttcgcagcatctcaggcctctggagagaggctcaccagcctcctgcctgtacaaccccgggaggtggggtgagcaagggaaactcactgaagaagctgctgagcgtcttgggagctctgcggggaggcttggtctgctcttcctcctcctgcagttcctgcttcgtggccacctcaggctctgaaacgctttccgtcggggtctctgcttctgcggtgagagagctcagacggtgatgcaaactctttgaccctgagactttttttttctttttttttacccccaagatcattctgaccctgcagatggaagatataactacacctacccttttcctttctgttagctttgagctgagatctcaggcctgctgtctactcctcagtgctaactagcggaattctagcacttggcctgaaataggagacttaggaatagtggtaaaaagaaatctcatcgtcatgagaagaaaatattcccactcctcccagcagctgcagaaaatcagatacaactctgtatccctaaaattctcccggcaagtgttgtttctaacacaggggcctcatggacacttggaccaccctgagagggtaacttcagcctctaaaatcctgtaactcagtttggttgtctaacttaattaataacatttaatttacacctatgacttctgaaagctatgaatactttttatcttttactttgtctgaggcgggggagttcttgctctgtggccaaggctggagtgcagtggtgcgaccataggtcactgcaacctccacctcctgggctcaagcgatcctcccacctcagcctcccaagtagctggaactacaggtacgtgccaccacacccaggtcatttttgtattttttttggtagaaatggggtttcgccatgttgcccaggctggtcttgaactcctgggctcaagtagtccacccacctcagcctcccaaagagctaggattacaggtgtgaggcaccgtacccggcctaggaagattttttaaagaatggctggctctttcctcctttcccacatgcatggggaaaaataataattaaaaaaaaaaacccgagtaataaaaactattattcttctagattcggcatttaagcaataagtttgagaatctatgccttgtttaaattaatcatcctccaaagacttctgaccccaaaatcaggaggtggggcagggcggaggagaggaccagaaactcactggaggtctttaggggcttgggaggcgtggtgggctggtccccgtcttctccttccttctctgtggccacttcagcctctgtgaggctttctttcggggtctcctcttctgacgatagacagaacggtcagatggcaaaaaaatcccattgaacctacaagggcattttgactctggagacagtctgccctcatctgtcatctgttcttttttttgagacagagtttcgttcttaccgcccaggctggagtgcaatggtgtgatcttggctcactgcaacctctgcctcctgggttcatgcgattctcctgcctcagcctcccgagtagctgggatgacaggcgcccaccaccacatccagctatttttttgtatttttagtagagatgggatttcaccatgttggccaggctggtcttgaactactgacctcaggtgagccacccgccttggcctcccaaagtgcaggtcttacagttctatcttgtgccaatccaatgtgcctgtaaagcagtgggccacgtaagaccctgctccttgtcaaccccaagcaaggcagcgaccttgagggggtccagcccgtttgcctatgtagccgagacataaatggtgtgtctttccttaccaatgattcctttagtgttattcaccccaaaatagaatctgaaagggttaaaaatgcaaatgacagcctgttatagacaaaaataaaaatcttcaaagttaaaaaaaaaatcttacctctagggtcacaatacaaactacaaaaaccaacttgggaaaaatctgccttagtagaaagaggccacccccgccacccctcactggacactgacagtggctaaaagtgtagtttacaataaaatttgtactaaaaattgtcaataagaaatcaaatcttttttttttgagacacagtctccctctgtcgcccaggctagagtgcagtggcacaatctcggctcactgcaacctccacctcccagtttcaagggattctcatgcctcagcctcctgagtagctgggactacaggcgcatgccaccatacccagctaatttttataattttggtagggatggggtttcaccatgttggccaggctggtctccaactcccgacctcaagtgatccacccgcttcggcctcccaaactgctgggagtacaggcgtgagccactgcacctggccaagaaatcagatcttaaccaaatttaaatctgccctggaaaatggaccttttatttgtttgcagaaacaaaaaaccaaatgacgttaaaggctgcaattggtgtaatctcatgcaggccccagatgatcaatcgatcagatctttatggctgttttcggtgggttcaccaacatgcagggaactcactgggcgctgcaagatattttagatttttcaaaggaaacccagcgacacctgctggccagtgtgtgaactactagttcgaggtatttcagttttcagtattaaatcacattccttgcaatgacattgcatctctgcaaagctgggttttcataggttgctgctataaaaatcaagtactgtacaaaaatcaacatagaacaggaaatgacgttggcagttttcaattgaattccactgtttaagatgttacagagtatccaaggcatttcccacaagtaattatggttatttaagaacaaaatacaggctgggcgcagtggctcacgcctgtaatcccagggctttgtgaggccgaggtgggcagatcatgtgagctcaggagttcgagaccagcttggtcaacatagtgaaaccctgtctctactaaaaatacaaaaattagctgggcgtggtggtgtgtctgtaatcccagctactcgggaagctgaggtgggagaatcgcttgagcctgggaggtggagactgcagtgagcccaaactgtgccactgcactgtagcctgagcgacacagtgagactgtctcaaaaaaaaaaaaaaaaaaaaagcacaaatattactttttttccaatgtatgtatagtatctaatagttgtttggacataactacttaatagaactgataaggtattggcctaggagcatcataaaaaaattactaagacatcaagggtgctgtgaactaagaatgtttgggaactgcaactttatggtaaaatttacaaggaaaaggaaatcatttagaggaaaaatagtttccattaaataaatataaaaatagcaaataaaaatgggaaactgtgcctgaattattactaaattaagatgtccaaacaaatatatcccacaatgttttcagaacaaaagttcccatattggtaggtggaattcctggatgcctggacacaggcatcaaatcggcagggtccaaacatcctgagctctcaggcccctgcccttgcagatccaaaacacacacacacacacacacacacacacacacacacacacacacacacacacacctctccttctgggggctcaccttcctcctcctccttcctcttggcttcacacacacacacacacacacacacacacacacacctctccttctgggggctcaccttcctcctcctccttcctcttggcttcacacacacacacacacacacacacacacttctctccttctgggggctcaccttcctcctccttcttcctcttggcttctctgtcctcgtcctcactctgctcttccaggacttcctgaatggtccgtttcgggagctgcttccgagctggggaggcaaagggcttggtgtatctgacctcgctggctcgtgtgctcccatcccggagagctcacacccactgatgtagcctctggaaggctctgggccctctccccttctctgcctgcacacagtcactgccccagtgcaggccgcacccttcaatccctcctgcttcctggctgtgtgaccttgggcaggttacttaatttctctgtgctttgctctctcacgactgcagaatagaaataatccccacgagtaaacaatgatgtaatgtacttggcacagtaccgattccagcaggtcccctgagctccccactgctcccctcagatcttaactgcctccaagtgttccagacagcttccccggaacctcagaagtctggaagtggcagggaataaactagccccaggagaggccctcaccccacgatcggcaggagttggtgtataaataccccagctgcctcgcatctcgggggtcactctggagcatttacaccgttccccagagaatcccacaaaactaagctccagctgcccaacacatagcagacccaacagcacatcctgtgttggctgctcccctgtcctgaatcaccctctgttccctgcacctcctaaacaaaccacttgcacttgaatccctgtttcagagcttcagaacctgcttctaaaagcctctaaactcagatactaacccatgatgaagagctcacacaaaggcagttgtacccatcttcactgttatatctcatgttggccattgcgccacctggtccccggtctcccggcccccagtggctccttcacgtggccccagagggaccttctatcagcatggctggcactgtctctccctgctcaaaacccttccatgactccacattctctgctttatccaggataaagtcttttgatgtctaccccgatcctacctaatctctctccatctgaccttctaacccttcccacaccacatactccaccttcttttatatcactgctaaactggggtgtttccagacacaccaagctgtgtcacccctccaggcctcagcatgtgaggtttgggacatagctcaatgttgctccctctgaacaagatcccctgacacacccccagggccaacctcagcgtccacctggagctcccagcatgccctcagccacactgtgacttccttatggccacctttcattcagggatgaacctgcctccccacctcacagcccttccatggctcccaggacccacagcacgaagcccaggctccttagctgggagtgcaagaccttttgagatccagcccccactctcctctctagctcacctctcaccacgtgctatcctcaaactctccctgcttcccaggtcgcatccgattctccagaaacaaggaagtagatgagaggccccaaacatcccatgctgttcccatctcgaggcctctgcacgtgcccttcttgtctgaaatgcatgcatctgtcctttctcaacatggccaaccccaacccatcttctaagactcggctcagccatcacctcccctgggctgcttgacttctgagctcccagagtaccctgcgtcacccagcatcgtccgatggaaagatctggcaagccacgtatgtaaccttaaactttcttgcagccacgttaataaaaagggggaaaaaaccaggttgaacttggtttgaagagtctattttgctcaatacatctaaaacagtatgattccaacattctgttttcatgctaggtcttcaaaatccaatgaactcactgcacatctcaagttggacaccagattttcatcggcaacatgatctgtgtaggtttcataaaatgtacagctattcacataccaaagctgttccaaaatgatgtggaaaaagtgcaaagtctttacgcactgaatcacatattagctttcaaatgtaaattcaactgaaaggatctaacatgaaagattcagctcccctgtcacactcaccacgctaaagcgctcaataggctagaccggacggcaagggctcacactgccccgcattacgaatgggtctctcgccctgttcttaccccacagcaaacattccaagtcccccttaggacaaagacgctgttccccaagctggttttccaggaccttctcacctcattgctcaccatccccaatcctgcgctctacacgccagcacaccaggccctcagcagcccccaggccttctcaatttctatgttccccttgcctagcatgctcccctcctcctttgcttgttgcctcttctttgtcctaaagggctcagcttggttagcctctcttctggaagtctcccttgagccatggccccgcgcttgtgttcccacatgagctgtgaggcctccatctcagcgcataactacagtcacaatgacccacaatgactgagccccgactgagggctgggcccagttctgagcagcgtacacgtgttatcttctaactcagatatttctgtgcggtaggtgctatcattatcatcatctctacagataaagcaacctaagctcagagaaggtcagtcatttgtcccaggtcatacagccagtggatggtggacccgtgctcttaaccacaacactaagaccagagctgttgtaaggatgactaccttggatgggaatccaagtggggagaaaggcaggcgactggctgggtgcggtggctcacgcctgtaatcccagcactttgggaggctgaggcaggcggatcacgaggtcaggagtttgagaccagcctggccaacatagtgaaaccccgtctctactaaaaatacaaaaattagccaggcatggtggcgggctcctgtagtcccagctactcaggaggctaaggcaggagaatcgtttgaacccgggaggcggaggtcagtgagccgagatcatgccactgcactccagcctaggcaacagagcgagactatgtctcaaaaaaaaaaaaaaaaaaaaaaaagagaaaaagaaaggcaggcgactgaaggggcaggggcccgtgtgttctcacctgtgcgacgcttcggaatccctgatggggaactgtccatgggagaggtgtcagagagggaagcattgttctcaggagatgtggcaggacggggcggggagacctgtgagcagtccagggcaggcttctggaagaggaaagaacagttctagagtgagcgggggaaggagggactccattttccaaaagttgagagtagaggggactgaaacctctctgtctaccctcctttctgaccctatggtctcagccctaactcaggggtggcctcttctcacctgggccatcatcccgccctccagtgcaggatcatggtcccatcaaggacccccatagctcttctgttttctacagtaacagaatcttcgattctcctgcttcagcctcccaagtagctgggactacaggcctgcactaccatgcctggctaatttttgtatttttagtagagacggggtttcactatgttggccagctctacacaatgggatgtcaggggaaatgatgtacacctcttcgtatagttttatttttatttatttatttattgagacagggtgtcattctgtcgcccaggctggagtgcagtggcgcgatctcggctcactgcaacctctgcctcccaggttcaagcaattctcctgcctcagcctcccgagcaactgggataacaggcgcccgccaccacgcccagctaatttttgtattttttttatagagatggggcttcaccacgttggccaggctggtctcgaactcctgagctcaagcgatcctcccgccttggcctccagagcactgagaatacaggcgtgagcccccgtgcccagccttctctccatacagtttagatgtttgttccctccagatcgcatgttgcaatttggtctccaatgttggaggtatgacctggcgggaggcattcaggtcacgtgggcagatccctcatgaatggcttgtaccctccttgtggtaggaaccgagttcttcctctcctggttcacatgagagctggttgtttaaaattcctctcttgccatgtgacacacctgctcctccttcaccttccaccatgactggaagcatcctgaggctctcaccagaagcagatgctggcactatacttcttgtatagcctgcaggaccgtgggccaaaataaacctcttttctttataaattaactggtctgaagtattcctttatagcaatgcaaaatggactaacatgcatttcctggttcaaataacatccacttaatgttgagtggggtgccctcctcttcctgttggcagaatatggatgttcacagggacaagggcatctacagagagcaaacgacagcacagaggaagcctgggcctctgaccctgtgagacggtcacatgaatcccggactctgcactcaggagagagaaaaataagtttgcgtcttgcctaagccactgctaccgtgtctcggtttcaaccactcacttatcttcttacagggccctgtgccagttattaagtgattttctctcagctccaaacctgtcactgtccagtctccttcatgctgccaggaccgggactccacaaatcttcttcttgctctggcgccacctgggcatcaggcagtgccaatggagggaagcagagggcactgcatgactggaggcacagccggcttgccgggggcagctgctggatcccactgacagttttttctaacattcacggggcttgccacgtggtacctgatcagagaccctggcatctcccacccagtgctcccttcctgaaagatcagagttgcaggctctcggggcaccttctctaagctcagagacctgccagcagtcccaccacagaggtgtgaatttcagctcaaaagccacagggatggtcactgcaccccacagttgctacctccatgatgccttagagttagttctctttttagcccttcagttacctatttaacaactgcatacctagtgaccatcctttaaactccctctgttcaaatcactggtatggtttctgtctcccattgagaccctgatggagatacaggtctcagataatttttttttttttttgagatggagtcttgccctgttgttcaggctggagtgcaatggcacgatctcggctcaccacaacctccatctcccaggttcaagcaattctcctgcctcagcctcccaagtagctgggactacaggcccgtgccaccatgcccggctaacttttgtagcagagatgaggtttcactatgttggcctggctgctctcgaacttctgacctcgtgatccacccgccttggcctcccaaagtgttgggattacaggcgtgagccatcatgcctggccagatgaatattttaaacactgcccaggactaaatgatctctgcctctcttctgcccaaaactcttcctagctccccagaagcctcagggtaaagtctaagctccaaaagagatctctattctaatacctggaacctgggaatatgttaggttacatggcaaagggtaattgaggttgctaatcagctgaccttccgatagtgggattaccctggactatccaggtgggcctgatatagtcacaggggccttcaaagtggaagagggtggcaggagaggaaagtcagggtgagatgtggccacagaagaaaggcacagaaggaggcaatgccacttgcttatttatttatttatttatttattttttgagacagagtcttgctctgtcacccaggctggagtgcagtggcacgatcttggctcactgcaagctccgcctcccgggttcacgccattctcctgcctcatcctcccgagtagctgggactacaggcgcccgccaccacgcccagctaattttttgtatttttgatagagacatggtttcaccatgttagccaggatggtctcaatctccggaccttgtgatctgcctgcctcggcctcccaaagtgctgggattacaggcgtgagccaccacacccagccacttgctttgaaaacggagaaaaggggatctctagcagctggaaaaggcaattcctggattctcccccagagcccccagaaatgaacgcagacctgctgacaccttgagtttagcccagtgcaacccatttgagactcacgactcccaaactgtaagacaataaactgacactgttttaagccactgcgtttgtggtcaattgttatggcagcaaatgggaagctaacataggtggtgaggaaagtttcgctgaggaagtgatatctgagcaaagcatggaagaaagcaggggactgagccaggcgtgtatctgggaaagagagttttaggctgggaaagaaggtagtggcccagaggtggaagtgcacctggtgggtgtgggaagccaggatggagcgagctgaggaggagctgtggatgcggctgcagatgtgatgggcgggggaagagaggagcagcaggaggggcctgggaggtttccacaaggcctggctttggcctgtggtggtaataccagggggtttgggcagggagtcacaggacctgacctcaccactgacagaataagcagcaccacgctttggacatcatccacaaagcaatgaacaagcattaaatgacttaaacaggggaagagagtggtccaatgtatttggagaagttaaaaagccctctgaccacaggagaggctagatatacttttgaacccttatttttttgcttttttttttttgaagcaaggtcttgctctgtcaccccggctggagtacagtggtacaatcacagttcactgcagccttgaacacccgggctcaagcgatcctcctgcctcagcctctcaaggagatagcaccacaggcatgcaccaccacacctggctaatttttaaaacatttttttgtagagatggggtctcgctatgttgcccagcctggtctcgaactcctggcctcaagtgatcctcccacgttggcctcccaacgtgctgggattacagacgtaagccattgtgctgggccttgagcccttgttttaccatcaggcattattctcagatctgtatgtaaatcgactcatttcatcttcccagtcaccctatgaggaaggtgttaccaggagctgcatgttacagttgaggcatccaagacctaacgtggtgaaggagcccacccgaggtcctagggcaggggcaattaggaccaggttgtgtctgcccccgacacaaccaggaaacacatctacctctcccgggcaatttctccagaattctcctgaacagctgctgcactctgttccaaaggttaatgggaattagtttcttctggtaaaaatgggcagggtgatggggacctacctggcctttagcagggctaagggcttcatcctcctcttccccttcgctgcccaggacccgggccgccttcctccctggcctcttcaccggagagtcactctcggacaccactccattccactccttcagtgccgccctggaaggtggggaaatgggggtgtaaaggggcgactacagcaggcagagtgggggcactgcccgcaaacactttggtttctttgctgtttccttcccttcctttcaagcatccaatgaacattttctggttgtctcctcagcaaatctcatcatttcatccatcagtgcattaatccacccgcccactcatccactcacccacccatcacacatctctggaagtctccagagtgcctgccctgtgatgggtgatgctgaggagcaaatggagtccctgcctaaggttgccattggtctccagcatctattgggatgcctttttttttttttttttgagatggaatcttgctctgtcgcccaggctggagtgcagtgggccgagatcacaccattgcactccagcctgggtgagagtgagactccatttcaaaaaaaaaagagtactgttgtcttctacttagatgagacagcatcaagacgtggccagtggccagcggccagcttctctgcattatggagaatgtctggttctagaacgaggccaagacctgcagaaacagagacgtacagacaactccgaggccctggatccagctgtgcctgcagctgctcttgctcttggacttctggccacctggctgaaaaagttttttgggccccaagacattttgcattaggtttgaacacttgcaaccaagacaatcctgactgctaaaggaaaaaattcaccatatcccagccctgtgacatactttggagggggctccgtctctctgctgctattggatgcctccttctcaggcttctttgctttaccctctttcttggggtggaaaaatgacctagaggagcataaaagggggtaaaaaaaggagaataacagcaccaataccctgcctatctatgctgtatcctataacttccttttttttttttttttttgagacagagtctcgctctgtagcccaggctggagtgcaatggcgcaatctcagctcactgcaagctccgcctcctgggtgcatgccattctcctgcctcagcctcccaagtagctggaactacaggcacccgccaccatgcccagctaattttttgtatttttagtagagatggggtatcaccgtgttagccaggatggtctcgatctcctgaccttgtgatctgcttggcctcccaatgtgctgggattacaggcataagccaccgcgcccggccgcatcctataacttctaacaccatttccatctcagcacataacagagaatttcaaataagccctttaacttaactgataaggaaactcagactcagacaaaggaggcaacactaatttttctgccctaacgcacctgcaagatatgatacatcccaagttttattcaacaaatattaactatgcactttttaaatcttttttttttagacagactctcgctctgttgcccaggctagagtgcaatggtgtgatctcggctcactgcaacttctgcctcccaggttcaagcgattctcctgcctcagcctcccgagtagctgggattacaggtgcccaccacaacgcccagctaattttttttgtatttttggtagacacgggttttctccatgttggccaggccagtctcaaactcctgaccttaggtgatccacccaccctggcctcccaaagtgttgggattacaggcatgtgcccccgcgcccagcctaaaaaaatttttttttttgagatggagttttcactcttgttgcccaagggtggagtgcaatggtgcaatctcggctcactgcaacctcggcctcccagtttcaagtgtttctcctgcctcagcctcctgagtagctgagattacaggtggccgccaccacgcccggctaatttttttcatttagtagagaaggggtttcaccatgttggtcaggctggtctcgaactcctgatctcaggtgatcctcctgcctcccaaagtgctgggattacaggtgtgagccactgcgcccggcctacctaagcacttattatgtgccagggcctgttctgggcctgaggggtttggcagtgacccagacacacgaagttcctgccttcaagaagctaacactctggtgaagggcagaaatattaagcaaacaactaaatataaaatgttggggcctggcatggtggctcacacctgtaatcccaacactttgggaggccgaggtgggcggatcacgaggtcaggagatcaagaccatcctggctaacacggtgaaaccctgcttctactaaaaatacaaaaaaaattagctgggtgtggtggcaggcgcctgtagtcccagctactcaggaggctgaggcaggggaatggcctgaacctgggaggcagagcttacagtgagccaagatcgcgccactgcactccagcctgggcgacagagcaagactctgtctcaaaaaaaaaaaaaaaaaaaatgttggaaggcgtgaacattaaaaaaaaaatctggtgaaatctgaataataaagtatggagttcagttaagagtaatgtactgacattagtatctcagtggtgagaaacggatcatagtaatgtatgatattgacaatggaaactggccaagggtatacaggacctctctgtactgtctttgcaactttcctgtacctctaaaattattccagaataagaggtttatttaatcttcaaaaagaaaaggaaaaatcatgcaaaagccagtggacagaaagcaatcgaaggcaccatcagccctggagagacaatccccagattcctcatcacgggagaaaaacggaacccagcatttgtgtaagccactaccgcccaggtttctgggatggatgcccttgtctgggtctctctaccatccattttttcctcctggtaacagcccctccgttttcctcttgggatgcttcttaccccacattctctcagtacacacgatttgagtgggctggcccttttgcctgtgaccaggggtggacacgtgatccaggctgcatccctgtggctggttcagggataggtatgtggcccaggctgggccagtgaaactgggctctaacaccctctttccaaggggaccgctaagaggggagagcccgcctgagggtgaggacaacctcaaggacagtagagctgaacaatggagagagacagattcccagggaggaagttttggcaactggatcgaaccaagcctgaggctgtttactccagcaggtttcaatgatataagtcaagtcatgccctttcttgtcttcctgaagccggactgcattaacacgaggtttctcaacctagacactattgacatgttgggcctgatggttctgtgttgttgggggggctgtcctatgaattgaaggatgtttagcagcatgcctggcttttagccactagatgccaatggcaaaccctctgtccctaggttgtaacaaccaaaaatatctccagacactggccgggcgccgtggctcacgcctgaaatcccagcactctgggaggccgaggtgggcggatcacgaggtcaggagtttgagaccagcctgaccaacgtggtgaaaccccgtctctactaaaaatacaaaaattagccaggcgtggtggcacgtgcctataatcccagctactcaggaggctgaggcaggagaatcacttgaactcatgaggcggaggttgcagtgagccgagattgcgccactgtactccagcctgggtgacagagcaagactccaactcaaaaaaaaaaaatctccagacgctgccagatgttccctggggagcaaaattgctgctgactgagaaccactgcgttagggtttctgctccttgcaactaaaaactgttgttcaatacactgtcttccatatcccacggctcattttccatactacttgactcctggaaattccaactcaaaatctaacgtaagagtttttgtttgtttgtttgtttttttaagtacagatttagagaaagaaacagaggacttggagaaggaaagactcaggggcaagggagggtgctcacatgatacttcgctgcatgttggcgtcagaattctcccttcctgtccagcacttttcttcgtctgtcagctgctcctggaacagaaatccaaacacttgttgaggtgattggttgtgcagagatctaaacacacataaaaccctttctttaagaaagaaagaaaaaaaaaaacagaaacatgaatttccccttcaaaaagaaactcctgtttttatgaaccaaaataatttgctggtgagatttactggtgcagaataaaagctccaaatcagagaaaaagataagaggcctcctttaccataagaagactgtttttcatctaatatgaggaatagactgaggacctgaaatgggtttttttggagttaagtttaaaggttagtgaaaaattgttttaaggtgatgacataattccgtgaaacaactgtggaagcttataaaattgtacccgctggtctacataaattagctcttgggcagtttctaaggtatgctgttatttcaaacaaagggcagaatatcacagagtgtgtgctactgaactgtgtaaaagagaaaggctataggtcaggcacagtagctcacgcctgtcatcccagcactttgggaggccgaggtgggtggatcacttgaggtcaggagttcaagaccagcctggctaacatggcaaaaccctgtctctactaaaaatacaaaaattagccaggtgcggtggcacgcgcctgtattcccagctactctggaggctgaggcaggagaatcgcttgaacccgggaggtagaggctgcagtgacccgagattgtgctactgcactccagcctggacaagagtgaaactccatctcaaaaaacaaaaacaaaagaaagactataaatgtatccacatatcttgtatatgtacagaacatctcagttggaagacaaaaaactggtaatgctgtcgcctcaggagggacagacgctggagggagattttttaatatgcatgcttttgcaggcagaacaattggaatacgttaccccttcacaatatatttttaaaaattaaatacttttttaaaaagtctgttatttaatgaaatcaataacagtcactggggcttccacagtttagagtaactctaatgaaagggttcctaggccgggcgtggtggctgctgcccataatcccagcattttgggaggccgaagcgggtggatcgcctgaggtcaggagttcgagaccagcctggccagcatggtgaaacctcatctctactaaaaatacaaaaattagccaggtatggtggtgcacacctgtaatcccagctagtggggaggctgaggcaggagaatcacttgaacccaggaagtggaggttgcagtgagatcatgcactctagcctgggcaacagagtaacactctgtctcaaaaaaaaaaaaaaagaaagaaaaagaaagaaaaagaaaaagaaaagaaagggttcttaatctggggtccacaaaacccaggagtccaagagcagaactcaagtggtctatgaaatttgacaggaaagaaattacgactttattcttgtaaacttctaattggaactgagcctttccttccattataaatattaaagatataaaaaattataaattttctatatctttaatatttataatggaagaaaataaattacacattataattatgtaattataattatttacattatatttccttccactatgaatatattttttaaaaaaggactagcaggacctctgcgtggattgcttgagttgagaccagctcagaccagcctgggcaacagaaatggttttctttgactttcccttcctttgcacagaaatcttcttcaacccatggggtcccctttcgttttctggaatcagtactctctgtcccgcaccacacgcctctaagtctccactactctctacagccttggccgccacatgttggcaccacaactcaaactcaattttggaatcaaaaaactcagtaggccggcactgtggctcacgcctgtactcccagcactttggaaggctgagacaggcggatcacgaggtcaggagttcaagaccagcctggcccgcatggtgaaaccccatctctactaaaaatgcaaaaaattagccaggcatggtggtgccagcctgtaatcccaactactcaggaggctgaggcaggagaatcacttgatcccaggaggcagaggttgcagtgagctgagactgcaccactggactccagcctgggcgacagagcgagaccccgtcttaaaaaaaaaaaaaaaaaaaaaaaaacaaacaaaaaagaaactcagcaatttccaaacagagtttctcagggccagttggggagcaggaagtaagcaatgcttcaaccaaacagttcacacagaaagcaggttagggacttagccaccaaaatcctgagggcaaaggagaaaactattacgatccctcctgagtgctcaactgcctaggtacttgacattctcaattatactgactctccacaacaactctgttacagaaactaaggcacagaggggttttcaaaggaacttaacctgcatctatagtacgttccaccccaggtcggcctgctccacagctcacctcttaaccaccagactgagttgcaagggaaggagaaatacataagcgtttactgggaagcctactctatgcctgacaggctgatcacattctcaaataccctcaatcctcaagtcagccctccaagacaggtgagatcatccccactttatagatgaaggtaatgaggacagaggaacatagctggggttcaggcaaggcttcaaaacccggtgtggctggctccaaagcccacgttcctttctccttaccacggtactcaaggctggcttctcaactctgtgtactgctgagttggggggaacaaactggttgatgcctctggaggaccacctggcgtctctatcggaacggcaaccccacttctgtgtatttggcccacagagaccctcacaggtggaccaagtgaggcacaaagttacctgctgcagcactaactgtaatgagagaagactggaaactggtggaatgtctacccttagggaactggttccctcattactggaataccatatggtagaatattgttcagggttaaaattaaatgaatgatggataaaaggtataggagttttttggggggatgataaaaatatcctaaaatcgattatggtaataactgcacaactcagcgcatacactgaaaaccactgacttgtacactttaaatgggcactttaaatacactgaaatacactttaaatacactgaaaaccgctgacttgtacattttaaatgggcaaaattgtacactttaaatgggcaaactgtataattgtgaattatatctcaataaagcggttaccaaaatgaagagataatgacaggaaaaatatcaagtaaggatgaaacagtactcagtaataaaaagaaacgaagcactgatacaagcaacaacttgggtggacctccagggcattgtgcagagtagaaaaaaggtaacatcctaataatatatgattccatttacataacaatctccgaatgacaaaactagagatggtgaacacattagcggttgccaggggcctggggaggagttcttatgtggagagggaactgttctatatcacaattacgatgggggttacacaaatctatacaaggaatcaagctgcacgggcacacagatgcacaatcacactcacaccacacaaactggtgaaaactgaacaaggtctgtaatctagttaacagaactgtattgatgtcaatttcctggtttcgatattgggactacataagatgtcaccattaggggaagatggatatactcttttcacaacttccttgaatctataattatttcaaaataaaaagtaaaaacaagaggtaagctccatccctttatcaagcatacattaggccagacgtctccccattcagatgattctccatcttttacgagccctttacctagacctggaccttaccactgacctctccctgacaccacccatctccctccagtagggcccactccttccaggtgatgctgctgcccgcgatttaccttcttctagccccgccccctcagcacttccaggtggcccccgccccctcagcacttccggttcccagccagccccacccttggcacctcccccttccaggtggccccgcccacacgcaatcttttccccggccccgccccttagctcccttcagcccctccccctcccagatagccccgccccctcggggggccttccgatttccagctggccccgcccacacagttttcccccccccggccccgcccctcagttccatttggcctctcccctttccaggtgaactcgcacctcaaggcctcttctcagaggacctgtccaactgtctctgtctctcgtctaccctctacctggcccccctccctctgggagacacctctctgcactctccggcggcccgcagcccgcgctcttccgtctccaccgcgctctcggcagcctcagcgtccccacgcccactcctctgcagacaccccgacatggcgaagcataggccccaagcattcggcgcacccgccgccctccgcctcccatctgcttgcggacggccccacttgccttgcgttggtcccgcgcgccgctgcccgggcaacacactcagatccgccaggcgcgcctctgcagtcccaagttcgcgccacggcattcgcgcgcagacgtctgcgggcgggggcggggcagagcctaggggcgggacctgggcaccgtccgcaccgccgccgtcgcgcggaggacactgggagtcgtagtctcccgaatgggaggagggcgggaaaaggggtgaagtggggcgagccctcccgcagagcacactgggaaaatgcccgcgctttccctcgccctggatgagcgggtgtggctgagggtctgaggagtgactggcagggaaagaggaggaatcggtggaagcgcccccgcgag

SEQ ID NO: 88 - DNA, 71247 bp, Homo Sapiens
gagacaataacatagaaattttattacagcatttcatgtttaagccagattccctgccaggatattttctgcttgaattaatgaggcaggatttggtcataccttaatgagtttcacagaaaaagagttcaagcattagcgcaaactgccttctgacattaaaataaaataaagcaaacatgggattttcacaaagttaaaagcctcctgtgatgcacattttggatagtaggagacattgagccccaaaatgtttaacataaagcatggttaattaaatgaaaccactgaaaaatgtgaatacatgaagaagaaagaataaaataattttgatgttaccatttcaactactatttttgatataatcattcttggcaaaatcattcttaaaggtggaaacgagcaggctgatagtacagcaagtaagagaaagtcaatactgatggcctccacttgctgatcctctgagactgcatcttatagttcataaaatctgctgaaggtcacaactgaggtacaacgacttgtgttacttgtactgtagcaatgagggctttcccaggccacaacatctgggatcaaggaacacattttgactaaataaactatacagaagtctgttttaggattttatgcaaatattaacctcattttaaaacatgaggaaaaatattacccacatttagggctaatttagctgtcaggaatagaccatacagttgaaaaaaacacagtctcatttaaaaagtttcagcagagacaaaaaggtactaaagatgatattcatccttcttcatcactgctgctccaggcatcttcaaaggccggatttaattgtgattttgttgtagtctaaaaaaaaaaaagataaagaaaaaggaagattctgttttttctacttcataattttaggctcacaataaagttatgaaatatatcagataaatagcaattacattattttggaagaaaatgtataactgttaatttcagaacaaaaataagaaacaacccatatacaatataagataatgtaacttcatttgaaacagacaacaccagactttatccaaacaccctgtttcctttaatcacttcacaaatacatacatacacacatacatacatatactatgatgctgccattgctcaaggtatttctcaacaactctttggaattacctggagaaagtggcactctgatatccataggctaagactggactccaggtgtacagtctgacctgacagcccaaaatatcaatggtggcaactctttattgtttggatgaaaataacttttataaataaacaaataccaaatatggagaataaggtattcaagctgaataataccatttttagtccaaaaataatgtgggttattaagtagtgatatttatgtacttatttgtaagcagtgatatttaattacttatttttataggttggtagggcagttcagtaaaacatgcaaaatacgtcagaaatggtaacacgtttatagtcagcacataggtttccctcagggatttgtctgaaggataacatgcatctagatgatgtttatttaaaacaacaaggtgattagcaactacagaaattttaatcatctgtggtatttcaaatcagttcattttggggaaaacttctgaatagctacttctgatactcatgcaaataactaaaagggctttaagatggtctcattgttaaagtaattgggtattatgagccaggtttgcttctttttgtgcaacttttacaactactacaattttattcagattccaattccaatgctgtattagcatcaagactactcttaaattattttagatttattgccttttataacttagagaaattttttttttccttttgagacagaatctcacactgtcgcccgggctggagtgcagtggcgcgatctccgctcactgcaagctccgcctcccgggttcacgccattgtcctgcctcagcctcccaagaagctgggactacagacgcctgccaccacgcctggataattttttatattttaatttatttattttttcttttttttattatactgtaagttttagggtacatgtgcacaacgtgcaggtttgtcacatatgtatacatgtgccatgttggtgtgctgcacccatttaacattaggtatatctcctaatgctatccctcccccctacccccaccccacaacaggtcccggtgtgtgatgttccccttcctgtgtcgaagtgttcttactgttcaattcccacctatgagtgagaacttggcggtgtttgggtttttgtccttgcaatagtttgttgagaatgatggtttccagcttcatccatgtccctgcagaggacatgaactcatcattttttatggctgcatagtattccatggtatatatgtgccacattttcttaatccagtctatcactgatggacatttgggttggttccaagtctttcctgttgtgaatagtgccgcaataaacatacgtgtgcatgtgtctttatagcagcatgttttataatcctttgggtatatacccagtaatgggatggctgggtcaaatggtatttctagttctagatacctggggaattcctacatggacttccacaatggttgaactagttgacagtcccaccaacagtgtaaaactgttcctatttctccacatcctctccagcacctgttgttccctgactttttaatgatcaccattctaactggtgtgagatggtatctcattgtggttttgatttgcatttctctgatggccagtgatgatgagcattttttcatgtgtcttttggctgcataaatgtcttcttttgagaagtgtttgttcatatccttcgtccactttttgatggggttgtttgtttttttcttgtaaatttgtttgagtccattgtaggttctggatattagccctttgttagatgagtagattgcaaaaattttctcccattctgtaggttgcttgttcactctgatggtagtttcttttgctgtgcagaagctctttagtttaattagatcccatttgtcaattttggcttttgttgccattgcttttggtgttttagacatgaagtccttgcccatgcctatgtcctgaatggtaatgcctaggttttcttctggggtttttatggttttaggtctaacatttaagtcttaatccatcttgaattgatttttgtataaggtgtaaggaagggatccagtttcagctttctaagtatggctagccagttatcccagcaccatttactaaatagggaatcctttctccatttcttgtttttgtcaagtttgtcaaagatcagatggttgtagatatgcagcattacttctgagggctctgctctgttccattggtctatatctctgttttggtaccagtaccgtgctgttttggttactgtagccttgtagtatagtttgaagtcaggtagtgtgatgcctccagctttgttcttttggcttaggattgacttggcaatgcgggctcttttttggttccacatgaactttagttttttccaattctgtgaagaaagtcattggtagcttgatggggatggcattgaatctataaattaccttgggcagcatggccattttcacaatattgattcttcctacccatgagcatggaatgttcttccatttgtttgtatcctcttttatttccttgagcagtggtttgtagatctccttgaagaggtccttcacatcccttgtaagttggattcctaggtattttaatctctttgaagcaattgtgaatggaagttcactcgtgatttggctgtttgtctgttattggtgtataagaatgcttgtgatttttgcacattgattttgtatcctgagactttgctgaagttgcttatcagcttaaggagattttgggctgagacaatggggttttctagatatacagtcatgtcatctgcaaacagggacaatttgacttcctcttttcctaactgaataccctttatttccttttcctgcctgattgccctggacagaacttccaacactatgttgaataggagtggtgagagagggcatccctgtcttgtgcctgttttcaaagggaatgcttccagtttttgcccattcagtatgatattggctgtgggtttgtcatagatagctcttgttattttgagatacgtcccatcaatacctaatttattgagagtttttagcatgaaggttgttgaattttgtcaaacgccttttctgcatctattgagataatcatttggtttttgtcattggttctgtttatatgctcgattacgtttattgatttgtgtatgttgaactagccttgcatcccagggatgaagcccacttgttcatggtggataagctttttgatgtgctgctggattcagtttgccagtattttattaaggatttttgcattgatgctcatcagagatattggtgtaaaattctctttttttgttgtgtctctgccaggctttggtatcaggatgatgctgacctcatcaaatgagttagggaggattccctctttttctattgattggaatagtttcagaaggaatggtaccagctcctccttgtacctctggtagaattcggctgtcaatccatctggtcctggactttttttggttggtaagctatcaatgattgcctcaatttcagagcctgttattggtctattcagagattcaacttcttcctcgtttagtcttgggagggtgtatgtgtccaggaatttatccatttcttctagattttctagtttatttgcatagaggtgtttatagtattctgatggtagtttgtatttctgtgggattggtggtgatatcccctttatcattttttttgcgtctatttgattctgctctcttttcttctttattactcttgctagtggtctatcaattttgttgatcttttacaaaaaccagctcctggattcactgattttttgaagggttttttgtgtctctatttccttcagttctgctctgaccttagttatttcttaccttctgctagcttttgaatgtgtttgctcttgcttctctagttcttttaattgtgatgttagggtgtccattttagatctttcctgctttctcttgtgggcatttagtgctataaattgccctctacacactgctttgaatgtgtctcagagattctggtatgttgtgtctttggtctcgttggtttcaaagaacatctttatttctgccttcatttcgttatgtacccagtagtcattcaggaggaggttgttcagtttccatgtagttgagcggttttgagtgagtttcttaatcctgagttctagtttgattgcactggggtctgaaagaccgtttgctataatttctgttcttttacatttgctgaggagagctttacttccaactatgtggtcaattttggaataggtgtggtgtggtgctgaaaagaatgtatactctgttgatttggggtggagagttctgtagatgtctattaggtctgcttggtgcagagctgagttcaattcctggatatccttgttaactttctgtcttgttgatctgtctaatgttgacagtggggtgttaaagtctcccattattattgtgtgggagtctaagtctctttttaggtctctaaggacttgttttatgaatctgggtgctcctgtattgggtgcatatatatttaggatagttagctcttcttgttgaattgatccctttaccattatgtaatggccttgtctcttttgatctttgttggtttaaagtctgttttatcagagactaggattacaacctctgcctttttttgttttccatttgcttggtagatcttcctccatccctttattttcagcctatgtgtgtctctccacgtgagatgggtttcctgaatacagcacactgatgggtcttgactctttatccaatttgccagtctgtgtcttttaattggagcagttagcccatttacatttaaggttaatattgttatgtgtgaatttgatcctgtcatgatgacattagctggttattttgctcgttagttgatgcagtttcttcctagccttgatggtctttacaatttggcatgtttttgcagtggctggtaccggttgttcctttccatgtttagtgcttccttcaggagctcttttagggcaggcctggtggtgacaaaatctctcagcatttgcttgtctgtgaaggattttatttctccttcacttacgaagcttagtttggctggatatgaaattctgggttgaaaattcttctctttaagaatgttgaatattggcccccactctcttctggcttgtagagtttctgccaagagatctgctgttagtctgatggggttccgtttgtgggtaacccgacctttctctctggctgcccttaacattttttccttcatttcagctttagtgaatctgacaattatgtgtcttggagttgctcttctcgaggagtatctttgtggcattctctgtttttctgaatttgaatgttggcctgacttgctagattggggaagttctcctggataatatcctgcagagtgttttccaacttggttccattctccccgtcactttcaggtacaccaatcagatgtagatttggtcttttcacatagtcccatatttcttggaggctttgttcatttctttttattcttttttctctaaacttctcttctcacttcatttcattcatttgatcttccatcactgataccctttcttccagttgatcaaatcagctactgaggcttgaacattcatcacgtagttctcgtgccatggttttcagctccatcaggtcgttaaaggacttgtctgcattggttattctagttagccatttgtctaattttttttcaaggtttttaacttctttgccatgggttcaaacttcctcctttagcccggagtagtttgatcgtctgaagcccttttttctcaactcgtcaatgtcattctccatccagtttgttctgttgctggtgaggagctgcgttcctttggaggaggagaggtgctctgacttttagagtttccagtttttctgctctgttttttccccatctttgtggttttatctacctttggtctttgatgatggtgacgtacagatggggttttggtgtggatgtcctttctgcttgttagttttccttctaacagtcaggaccctcagcaacaggtctgttgaagtttgctggaggtcccctccagaccgtttgcctggctatcagctcagagactgcagaacagtggatattggtgaatagcaaatgttgctagctgatcgttcctctgggagttttgtctcagaggtgcacctggctctgtgaggtgtcagtctgcccctactggggggtgcctcacagttaggctactcggcatcagggacccacttgaggaggcagtctgtctgttctcagatctccagctgcgtgctgggagaaccactattctcttcaaagctgtcagacagggacatttaagtctgcagaggtttctgctgccttttgtttggctatgccgtgcccccagaggtgaagtctacagaggccggcaggcctccttgagctgtggtgggctccacccagtttgatcttcccagccgctttgtttacctactcaagcctcagcaatggcgggcgcccctcccccagcctggctgccgccttgcagtttgatctcagactgctgtgctagcaatgggcgaggctctgtgggcgtcggaccctccgagccaggcgcaggatataatctcctggtgtgctgtttgctaagaccattggaaaagtgcagtattagggtgggagtgacccgattttccaggtgccgtctgtcacccctttctgtgactaagaaagggaattccctgaccccttgtgcttcccaggtgaggcgatgcctcaccctgctttggctcatgctcagtgcgctgcacccactgtcctgcacccactgtccgacactccccagtgagatgaacctggtacctcagttggaaatgcataaatcacctgtcttctgcattgctcacgctgggagctgcagactggagctgttcctattcggccatcttggctccacctagttttttgtatttttagtagagacggggtttcaccgtgttagccaggatgatctcgatctcctgatctcgtgatctgcctacctcagcctcccagagtgctgggattacaggcgtgagccactgcgcccggcttagaaacattttttaatggtaacccctactgcatgtctgagaatgttcattttccttttgatgaatatgataactttgaatcttagaattcaatcaatgaaaacagtagaaaaagttacgtgttcctagtacattttccaagtatcagctagaagagctggaaaacaatatattaatttaggcattctttattgttaaacagattacattattaaacttaatgtcagctatactccaaatgtccagaagcgaaactattattattattatttgagatggagtcttgctctgtcacccaggctggagtgcagtggcatgatcttggctctctgcaacctctgccccccaggttcaagtgagtcttctgcctcagcttcctaagtagctgtgactacaggcgcatgccaccggcgaatttttgtatttttagtagagatggggtttcaccatattggctaggctggtcttgaactccagatcttgtgatctgccagccttggcctcccaaagtgctgggattacaggcgtgagccaccactcctgggcacgaaactattattaaacctcaggtaactactcactgatttctagccacggtacacttatttgcaacagttgtatactgaagtctgttcattttgtctttcatccaaatgtttactgaatttcctgtctttttgggttgtcaatttgactattaaattaggttatttagtgagagtttattaaaagacatcttgtcattgggggttagctgactcctcttccctactctgtctctagaagcctttaacttgcctttgataactaccaaaaatagccctgggaaaacacacacacacacacacacacacacacacacacatgtctgtaggtggataagccacatgagggccatgcttcctaatcctactatggaagcccagtgtgtaacctattaaaaattttaatttcagttgaaaactcaacagaaaagcaaaattatacttcatcataaattatttttgtatggtaagcaaagaaacaaaaataaatgaaaatcataatcagttgcatacaaattatttcacttttcagtgaaataatgatatatgaatgcattacagtattttagaaatacattttattgccaaaacaatcacaaataaatattatactggtagtatgataaagcagcagtaaaaatgttgtagatggatgtggtacacattaccatttgagacccactgatcaagtgtcactactattatttcagttttctctgcaacatctcctcctagtggacatgcagtctgtgcttgaacatattcatctatatctcaccaggttgtcaattctactgacagatagtgtcaatgttatagaaataatgaagcatgagtttagaggggacctagttatgagtttagagaaggaatagaaccaaacttaacatctacaaggatatttcttgataactttcaaatttctgactggtaattagtggcaactctcaggttgtcagcaagtgattatacattgacacaagtgatatgtaaaacagttatgtattgtgtgaatgtcaaaacaaagtaagattcttagtgagaggtcaggtttaaactggaataaacctgccctatagatctcaggcaggaaaaagtaattaggagttatagataggcttgtcttgaccagaccagcttttagaaaggagggtcaaaaggaagccagattcctcaaaatataataaaacagtctgccaactaaataaaaggatttatagttaaagaccataaatcctgtccctatcatccagtgttcttcctttctttagatagaattaaattcatcttctactttggatatcaggagaaacacccctaagggattacatcttgattgatggggaggtaactctcatctgaagaatgcatttgaaaggaaacctaagaataactttgattagacaattctgatatttggaaatattataagcttgtcccagatcataagtagaataaatggcagaactgggattcaaacccagtttcctgaagctaaagactaagtatgtgggctgagggtggtggctcaagcctgtaatcccaggactttgggaggccgaggcgggtggatcatgaggtcaggagatcgagaccatcctgtgaattgtgaaaccccatctctactaaaaatacaaaaaattagctgggcgtggtggtgggcgcctgtagtcccagctactcgggaggctgaggcaggagaatggcgtgaacccaggaggcggagcttgcagtgaaccgagattgtgccactgcactccagcctgggtgacagagccagactccttctcaaaaaaaaaaaaaaaaaaagactatgtgtatgtatatgtgtgtatgtgttttttttttttttgttttctagtgtggtatactgcctccttgggaaataaatatcaaataaatatacttattttgtagttgggataaaagcacttttaaacatggcttaaattataaacatacatgtaaggaataggatcttctggacagactattctactgggatctgcatcatgatcacattcatgttctgcctatattcacaggaatgcttcaaactaaaattttatggaaattactttagcacataccattttatattaatatgagaatgactgctatcttaaaatatatgaacatgacattttaaaaggtaaggttttatagctctaaaacaaatacaaaactcaacttgatatttgtatatctctatgtgattttctaacttgttttgcttaatttctcatatacaaaagtttgtttacacgaagagttcaaactatcactataacgacataacaaggaaataaaccatcagtcacatattatctttttttttttcctttgagtcaagatctcactctgtcacccaggctggagtatagtggtgcaattgtggctcactgtagccttgaactcttgggctcagtgatcctcccacctcaccctcttaagtagctggaactataagtgtaaagccaccaaacctggctaattttgtctattttttgtagagatggggtctttctatgttgcgtaggctggtcttgaactcctggactcaagagattctcccacctcagcctctcaaagtgctgggattacagatgtgagccaccacacctggccacatattatctttaagaattaaacaatttagtattcttctaacatccttttctatacataagtcactatagatttacttttcatttatttttactgttttcatttggtaaataaaatgttatatttcctaacatggcttacagtgttaacttgggtttaatgtatacagcaattcccaaagagcaggacacaataattacataaagaaatgtaaaataaatggctaaacctaattatttgaccatattaagctttatacagaagaatattctgacaccaaaagcagctgtatgctaaagttaatcaagccacaataaaccaaattagacgtgataaaatctggaagtatgcatatggcattgggtagctacttaaagatttatcaaaaggtatttttttctctttatttggattaaggacaaaagaaaataattcacaggtttacacagcagtaaaccttagcagttgaaaatttaggtatgaaatatatattgtcaatagctgtgagatgctatcaaccacctctatacaaattatattttcatgtggtttttgacatagtccttttttcataaaggaactaaacacagtatatgaaaaatgttttttgaatgtcaaacgtgctctatcaataacttttcctccacctccatttaagatgcttttactatgacttggttaagattaccttaaggtgtttccaactacattatttatatttccaacttaaagaactatatgtatatatatatgtatatatatacaaacattgtttttagacattgcttttagactttttatattgtagaaattaagataaatgaggatgattattaggagaataaaccttggtgggagagaaaccacctttaaacagcctctatcttcctactgcttgatgtgaaagttaaaaaaaaatacagaggctattactttaggtcagggacaatggtcttgttcatctttgtttacctactgtgtttttaaggtctttatttacactgtcatgcttatactgatttatgttctacgaaaggcactgtcagactgctggtaggagtgtaaactggtaaaatttgacgtgagaacaaagtcttaaaaatgtcggctaggggtagtggctcatgcgtgtaatcccagcactttgggaggccaaggcaggtggatcacttgaggtcaggagttgaagaccagcctgacaaacatggtgagaccacgtctctactaaaaatacaaaaattagccaggcgtggtggcgggtacctgtaatcccaactacttgggaggctgaggcaggataattgcttgaacccaggaggcaaaagttgcagtgagccaagatcacgccactgcactccagcctgggcgacagattgagactccatctcaaaaaaataaaaataaaaataaaaataaaaataaaaataaaaatagaaaaagaaaagaaaagaaaaaaagtgatatataataatttaagagataattccacttttaggaatctatctaaagacatagtcagaaatattaacaatttttgaacagatatttaccttgatgtttacaataatcaacagaaatgcctccaagtaggtaaatatttgaattgcttttatcaatgacagaatatcattagaaatgtttacacatagttattaatgacatgaaaaaaggcttattgtacaatgttaatgagaaaagtgagataccaagttgaatgtccaaccatgatatgaactatgttaaaaaacatatgcataggaaaaaacagttatgaaacaaatcaaaatgttaatattgattaatttgacttgaggaattttatgttcttcttttgatatttttctgaattttccaaatgtattaaaatagtcaaattatttttacggaaattaccaagaaatgcttttttgttgttgttgttctgagatggggtctcactacattgcccaggctggtcttgatttctgggctcaagtgatcatcttgcctcagtctcccaggtacctgggactataggtgcatgccactggcaagaaatgctttaaaagtctctctcacataaagtaacaaaacattatttcttaagctttagaagtcactgtaccatttgtgaaaataatatttacctcatcatcatcaggaactggttcatataaggatggaacccaagccagaatgttgcagtctctgctaccactataaagttcctataacatagaaggcaaagatgatactgtggatcaagagctgatatcaaactgaaatgaattatatcatttttgaaataattaggtcataataattagattaatgctatttctactccctaaagaaactaggccaatgctgtttttcctttgtttctttgttagtaaagctttgttttgtatttaaaaatagtattaggatttgtcagagcttactaatggtgtgaaaattttacaaacacaccccaaatcctagcagttttatcaattatagtatccatatatttctaatgtcagagaaagaaaaaaatagtttgtctttctgtgtccaaataactgagcttcaataaagacttcagtgaagaaaccatatgagcgtctactaaaataggccaagttctcaaaaagttttatttaacttacagctgcctaactggctgcaattcaacagaagagcttgaagatgtatatcccatgcctgttgagaagtttacttcataaggggaagcttggggtgatgcacagcctatgtcaatgtctacagatatgctgtttgcttatggctgaacaatgctcatgcccctccccaacaaaaccgaagaaatatgttatattggcttttttcctctgctgtttaatacaatttatttttattattgtacatctcaaaaacaatgtgaggcatggtataattgtgttttttatctaagtaaggatgtgggaaaagggaaaataagattatatagtaatttatagaaaatgtagatttaaataattattagatatacattatcaaatttcctaaataaaacaaaattttgttgactgtattacaaaatctagactataaagttacactaactgtggctgatgcaaagatatatatgttcagtgcccttgagtaattttactcccctgagaaggccaggtaatgcgcaagataacttggtcagataagcttatagagcaattcacaataagtactaacacacccagtgaagacataaaggaaattctgtagatgttcaagaaagagatattgaaagcagcaacatttaaattagaatgactaacaaagaacacttagatagaatgatttacattaagccttgaagtatctgtgatagatggaggagttcatttgggcaattagattttcttaaaaaataatctcaaaatgtaagttacaagtgcagtccaaaagacttcttttcccccttgaatcatatgagagtaagttgccaacattaggccttactactcttgaataattcagtgtatttttcctgtgaacaagggtacttccccttatagttacaaagtaaccaacaaaatcatattattaccaccatctaaagaccacattcatgtttcattatttgttccaatactgtcctttatagcaaaagggaccagttaaaaatcacatgctgcacttagtcgtcaagtctctttagttttcaagctggaacagttcttcagtctctttggcttttctgactttgataattttggatatacagcagttactttgtagactgcccttcacatttggcttgtcttatgtttcctcatgattaaatttgagtgatacaatttggtcaggaatatcacagaagtgatgtcccataactgggatgctaacttagattattcgatgaaggtgatatgtgccaggctccttcagggtaaaattaatctttttagtttgtacttcatattttgtagggtgatatgttgagattatataaatatctcattcctcatcaaattttcaatttattaatttacttacttatcccagcctagattcatgaatttatattctgttgcccatgttggagtgcagtggtgtgaacacggctcactcaatctcctggactcaagcaattctcttgcttcagcctcctgcacagctgggactacaggcatataccaccacacctggctgattttttgattttttgtaaatacagggcctcattctgtcacctaggctggcctggaactcctgggctcaagtgatgctttcggcctcctaaagtgctgggattacaggcatgagccactgtgcgcagccattgtcacgattttaatccattctaggcacacctattagagaagctccaatttggtagaaagaaataatttgtggttagagtacctgggatgaaatttcggctgtgtctctaagtaactttgcaaagaaaggagggacaatgttttaagaatttctttgaatacaaacacatgctttatcagtaactacttgcaggttaggggcaagtcacgtcacctctctggtgctttcgttttcttctctcagaacactaaaaatgtttaacaaatgggatataccttcttattgactaataaaaagagatactggctatagggttggagtagggtcttgtaggtccccttttagttgctgcgttaaggtgacgtctaagaggtcccagggaaggggctgaggctggaggtcgcttgggggcttggtgcagcagctgtttaccagccagtaggatatataaatatttatatattttaataatgaatactgccataatggtatgtactggctgaaaaatcaggtctatatatcttacagcacagtgtcaggcacaaattaggcaatcagtattaatgaatgaatgaataggagattcaaagtgatagtctccttgagctctaataatctgtaatgttcattctatcagtatttaacttacgtgagtttcattttccttacctacaaaacagggaaaataccaactatcttgcaatgttatactcatttaaagaagtgcatgaggtaatttgtgcaaatgttctctgaaaaaatgaaaaaccatctgctccattggtgatatgaaaagatctggatgtaaaacaaacaaacaaaagccagagtatttaagaaattatataggttgtattaacttcaaaacctccctttactagccattggtagaaaataaggaagaatagatcatccacacatacataaaccaacatatacaaattatattttatgattaaatgcctatattttatttcttacccaaaagattgtttcaagaaattattttaattcaccacagattttcagttgttaaataaatgaaggtcatatgcaaaagaaacagaatttataccaatcaagttgcacagtattatattgattcattcatacattgtatgctgtctaacaatctaggctgtgctattctctattaaataaatcctactacaaatgtggattaaaagcataactcctcagaataaaatcataatttattcttttacatataactggtctggcaagctagctagctgaacattttaaattcctgtatcactcttacctggaaatttgactgaaatacacagcagtcaacagttttataatgtcccttaagcatagttatctgttctcctgagtaaactgtataaacagcaatggtgctaccatatggtacaaaaacaaattctgaactgcagccacaggagacagtgaatttcaatccttttttactgttattacaaacttttccatagttcacctgtaggattaaaataataaggttactcatctctgaaatctgaatttaaaacacaacaaagcctaggagaaatacttaaaatattatgctataaaaagggctcttttaaatttaaggaaaatattcaacgttgacagaacaagggccaatgacatgaatgtacatttaacaaaagaggaaatacaaatagtaaaaaaccacaggggtaaatgtttacttttcaatcttaatagaagtaaaatacagacttcaaccttgaagaatcattttagaccatttagcaaaaaattaaaaaaacgtaagacattagtgatacaagtgaggtaaacatgttggtggcagtgtaatttggctattctttctaaaagggcaaatggtttattaatgcaaccattcttttcaaaagaataatattttttggggggtgtatattatatactcccaaaaaacattattttcaaaagactaccccaccaagaattttttttggggctaataccccccaaaaaccattcctttcaaaagaatggtattttttggggagggggtaatgatattttttgggggggcatattcttttttttttttcctgctgatacttcttttatttctgttgtaaaacagagtaggggttaaataaagggtattgggtttgtcagctccagcctcttgggactctttttcctggagagagtggagagaacagtgggaggcaaagacacatagttggggaagggttcttttaatatgcagatgcttcagggagaaccaaactatttcactggtaatctcccgtcccactggaactggtgcttggatcggaagggaagtgagatcagtcaattagttaccaacactgccatcagcattgccagagaggtggagggcagacatcatggaatcagacagctccctggggattttatctgcacatttctgtaaattcttactcttcagggaggatgctagagcctggccctgttgtagggggtccatctccatgatcctctgcagtactgggcagcagtccactgggcacacatccaccttactgtttttttttagggtggtggtctacattgagtttagcccaccccatctgatgacgattcggattggtgcaataaccagtgagatctccaatcttatatacagtagctttatcttcaatggcatctgctatttccatcatcggagaatggagcaacttgatctccattttgagtgggtctgtgtcacccaatagctcatcagattctccagtggccaagcattccatggtgtcttcattgacttgctcggtatcctcgatgtcaaagaacttggtcatttccttaattctcagcactgagatgggcaggcagagtgtgagtgggtggtggtggtctatagaagctgatcttcccgctcacccagtcagctaggacagttttggctgcctgctcctgactgtgtaagtctctcttcttccccaaatggtgggccactgctgtcagaaagtgctcagtagtctggtacccagagagaaggtaatagttggaaatctcctccaggttgcagcactgcaagatggtctccactggggtcatggggtctgccagtctctagatgtggatgcagttatgcaggatggtgcccacctctgagctgggccctggaacaatggctggagcatccagcagccggatgaacttgtccaggtagacctcctgcatgaatttcgtgaccccaggaatggctcccacactgcatgcatggctgtgcttcaggcttttaatcaggctgcttttcccaatattgggaaggcctacaatgtccatatggatgtgggtgcgcatttcaccaaggcagcaatagttccccagaaccctcatgaggttttcagctccaaagctgacctgatgctgggtcctggccttgaaagccacagttggcaactcattccgaaggtaatccagccacttcacaacctccttggggtccaggtcaatctttttcaagaccaggaccagcttcttgttgccttctgcccataggatagcctcccccatttggaagcagcagcagcagcctaatgggtctctggcatccaggacttccagaatcacatcagagtattctaccacctcacggactccttgtaataagccttcatagtggcctcgtcatccagctgaggaaacatatttaattcctgcaaaacttcttccttacactgaaactcctcctggcgtcttaggatatcctcacagtagctcttgatagacctgcgtttttgtctttcttgctcctgggcagcttgctgcttctccctcatctcctcaaccctcttctttatttcagcctctcgattggcatgatcattggagtgaacaaactgaggagcagagggcactttggaggttgctttcttcccattttgttttgcaggcttcttacagcccttggaaactttacctggcttttcatttttgtttctaagtttcatcatcatgatcagcttgaaagcagataggttcgaatccgcttgctctcttcctatacttccggcggggatctgagaagagagagtaacagacgctcttgtgctgctaggctccggacttctggcttccggatgccagcctggcggcgcccgactccgcccactgggcagtctccacgagggggcggggcttctcccttccctttatagttaaacattttttcatacacataatataaaatttaccatcataaccatttttaatggtactcaatggcattaagtgcattcatgttgttgtgcaactctcatcactatccatctctagaactcttcatcttgcaaaattttacccattaaacagcaaagatattcttaccccttgacctggtaattgctcctgggaatttatcttttttttttttttttttgagacagagtcttgctctgtcgcccaggctggagtgcagtggcgcgatctaggctcactgcaagctccgcctcccgggttcacgccattctcctgcctcagcctcccgagtagctgggactacaggcgaccgccaccacgcccggctaattttttgtatttttagtagacacggggtttcactgtgtgagccacgatggtctcgatctcctgacctcgtgatctgcctgccttgatctcccaaagtgctgggattacaggcgtgagccactgcgcccggctgggaatttatcttaaggaaataattaaatagcaaaagctatatgcccagaggaattctatccagtattatttagaatggggtaataactgagaataggtatatattcctaataatgttacattaactttatgatttatataaatcataattatgaaaattatgcagaaaacagggataaaggctaagtgtaaaaaagcacagaccataaatagtgtgtacactgtagttttacctttatataaataattatgtatttgggacaaaaattaaaattctttgcttgtactccaaaggtgtagtgtgcaggctcagcagtgtgagcatcacctgaagcagtcagacatgcagacttccaggccccaccccaatcctaccgaaaataatcttcattttaacaagatccctaggtaatccctaggtaaacactaatgcaaatttgagaagctttgggctaaataagttgatgggtttacttcctgataataattttgataagcttggggtgagtgtaaaaccagtaactaatcatttgggaatcatgatcatgcatatcaacaaaatccactgtcgtcagggctaatattgaagtttaaatagtgatttgtcggctgggcgtggtctcactcccgtaatcccagcagtttgggaggccgaggcaggcggatcacaagatcaggagttcaacaccagcctggccaagatggtgaaatcccatctctgcaaaaaacacaaaaatattagccaggcctggtggcgggtacctgtaatcccagctactcaggaggctgagagagagaattgcttgaacctgggaggtggaggctgcagtgagccaagatggcgccactgccctccagcctgggcaacaaagcgagactctacctcaaaaaaaaaaaaaaaaaaaagggattcacttttttttctataggttagataagtgtgtgtgtatgtgtatgtatatatatacataaataaaaacactgaggtcaaaatggatacatgctaataatctatggatactatacttggcttactttccctttaggctaacttgtgccagaaatgggtacatgcatttagctacctcatggcagtagcagtatagtgggttaaatattaaactcattttggtggacttgggttttaaacactcatcttttttttgccccttatgaataatgatttaaccacttcgtttcattcttcttatctgttaaacggaaataacatcatttacttatagagttatgtatcgtgaaaaagcaaatgaaataatccatatgaaagcacctggaacacaaaggtattcagtaagttcctagattaattcctatacatgtttaaaaatataacattccctcatttgtgtcttctgatcctacatgtgcaacaatttgcacaatgatatgggggtggggtgacgaagaaaaaatacaaaacagttttcaactagtatttcactgttccccctggaaaaattataaactgctagactgtgatggccttattcacatttgtttctcaggacacctagttataaaacttatggtctttccagtataccacattccttcccaaatatgaactggaaagtgttgaatgaggtatgaatattgaaccagggcattaacttttgtcttgtccttagggtttcttcctccaatccatcctacaacttaatgtcatattaatatttcttttcttttcttttcttttttgagacggagttttcgctcttattgcccaggctgcagtgcaatggcatgctctcggctcaccgcaacctctgcctcccaggttcaagtgattctcctgcctcagcccccaaatagctggaattacaggcatgcgccaccatgcccggctaattttgtacttttagtagagatggggtttctccatgttggtcaggctggtctcgaactcatattaatatttcttttttgtttgagacggagttttgctcttgttgcccaggctggagtgcaatggcgcgatctcggctcaccgcaacctccacctcccgggttcaagcgattctcctgtgtcagcctcccgagtagctgggactacaggtgcccaccactggctaattttttgtatttttagtagagacggggtttcatcgtgttagccaggatggtcttgatctcctgacctcgtgatccacccacctccgcctcccaaagtgctgggattacaggtgtgagcgaccgtgcctggcctgtcaactttaaaataaaaaaaagaagttactaaacggcaggactggttctatctgatagccctttaaaaatctgaagacagtgtgtttccccttaaagtaatcttttctggtatcaaccgtaagtattctatgtaggtcagtttctgggataccttagttacctatgcatgaattacttttactttgatcaagtccactgtaaaatgtattatccattttcaatacattattttagatacggacttaatagaaaaaaatccaaagggcatgagactcaccttcaagaaggaaagaaaaatggaatagaaccacatgaacaatttatatatacattcagtaccatttatatttatcacattaaactttgacacacatgcccagctactcttccagagtgatcctgtcacttctccactcacaagcctttagtggctttccatctcacccagagaaaagcctgaccccttacaaaggcttgcagggcccatatgatctggcaccctagttccttctgttcctcatctgttattcccttcatattccaacgcaagaacctcttagctcttccttgcgtatcccaaggaagttctcgcctcagggtctttgtaccttttttctttccctgactagaatgatatcccccagcaaacaactgatgagccacttccccatttccttcaggccaaatgtcaccttagtgaagcctaccctgacttccctatgtgaaacagcaactccaacgtcccagtatttcctgtgatcctttctttgctttgcttttcttcatagtccttacctaatctaatatataatttatccatctgtccatctattaattgattgatgcctttcatactcttgctgaaatgtaagctccatgaggataggacttttccatgttttgccaactgctgtctaatactgcctggcaaattaaatgctaattattattagcacagtatctgacatacaagctctcaataaatattagctattattattatcaccaaattataagcttttagtagtttgttctgaaaattattaaaccataggcatatctgataagactataacctacataaaaacaagtactagaaattaatagccacataagaatatagcaccttcgaaatatatttattgcagtagtattaaataaagtactacatattctggtactataaaattcactgtaaattttgtttataagtcatatatagtacaggttaagtatccccatccaaaatgatttggactagaagtattttggattttagaatatttgctttactgcctgaacatccctaatctgaatattcaaaatctgaaatgttccaatgagcacttcctttgtgtgtcatgctagcactcaaaaagtttcagattttggaacatttcagatttcagattttcagattagggatactcaacctatataaaatttgattacttagcttcatatctttaatttatatcagtagtcctcagtcttttatttttctctactacgctttgcactcccattgagaacagtggctcagtagaacagtgattctctgctaagtagggagaatgtggtaggtagtgggtaagggtgggttgtcctgagttgagaattactagtccacatagtagaaacacatttttaaaaacagctgtgattaaaagggaataaatgagttaaatatataaaaaaatcaagtgtatgtcacagatccatttcttaatttatacccaaatatatacttaaaaatctcttacaagtgtgttttctccattggaactattccagagcctcattcgattatctgtaccaacagtgaggaggtgaagtccatcacttgtaaaacataagccattaactttcccattatgagcagtgtttgctgcaatgaaaaacatagttcagtttatctgttcttgtattcaggacatatttaatgtttgatgatataattaaacatattaaaggacaactacttgagttacttaaaaaatgtaagtagattatacttaaccaacccttcagattatttgaataggataagctatataaatcagaaccataaaaatagaggaaaacaaaaaaaaaagggaaaaaatttctgcctaacatacttttcttttccagcaaggaaattgtgccatgaaattcaattaaatgtgtagcttaacactaaaatttaaaattaaatgcctttcatctctcatatatttttattgctaacctaaaaatcattctatggactattaaaatcaataattctagtgttttccattgaaaaaaaaaacagggaaaggatgactgttgtagtctcaaaatttatatcacttacaaaattaacaagtttgagaaagcataattctaaaatagcctaattaatttaaaaacatataaaacatgttttatatagtttacatgtttcataaggttttttaaaaaactatataaattctaatatatgaaatatattagaatgaactatataaaacctatgattgttttatatagtttttaaactttgtgattgttttatatagttttatgtagaaactacataaaactatagttgttaagaaattacataaaacaattataggttttatatagttcattctaatatatttctggtccagaattaattctctatcaaaatttctacacaggaattaaattctactgtaaaaatgcagtttaggtactttgtcacatggattgcagctgactcacatttaacacaattttatgttgatacaatggccacaaaatgttactatttctgtaatttattgtgactttttaaatggcattgaatatgtatagttggcctcaatggagcaaaaacaaaacaagtaaagcaagttaattcacaaaaatttctacttttgaaaatttgggggcaaatgaaactgccatttttatttgtatcttaaagaaagagaatcataatttagtttatgtaaattaagaaagtgatatacgatgaatgccttttgaaaaatcataaagtttgcaatttgtcaatatgcgtttattatgtggcttcaattaaaaattttcaatgtaaaaaaatactatcattgtcatatttattaatgcgttcttccttacctgattcaacagcttgtgactttttcccattatgttgatcaagagtaatcaaacatcctgatgctcttctcacatcccataattttactctactgtcagcactgagaagaaataaatgttacattgacatatgtagctaggacaatgactgtacccctcacccacctttctaattttatggcacacagaggtctcgttatataggtacatatgtattcatacattagggttgttgaacttttgccttttcagcaaatattcaatagtcaacagtagctcaaataagtgagtaaatagcaaaaaaaaaaagtaacctttcttttccagataacaagaacaaaattttgctgctttttatattgttttaaattacatgagcatcttttctcccaaggaccagaaaggcttgtagcttgttccaagtaagttccttaccataccttttctactgcttgttatccaaatgctgtcaagacaagcaattaactaatttcactttgctcaagaatccatttggtatgatttggtgtttttttcctttttatataaaaaacggtaagtgtaaggtgaataatgaggacaatgcatttccatttggtttcctatactcaaatcaatctttgccagatatatgagaactatatttaatgtctcctagaaattagacacttactttcattttctttcaagtaagcaaaaagaagaaaggcaaatctatgatcagacatctatttcagcttctagattatttctaaagaaaaatgcctggcaatccgacgtgctcctaatcagttcaactgatgctatcatgtcctcacaaggacctcaacaatattgtaacccagggggcttatcaatgccattttaataagagagagcattacatttttataagcctattttttatttaatttttttaaaaaaatatacacacaaggtttactggtttctataacctcgattcttttcacagatgaccatcaaacctagccaactggaatagttagcaaaaaactagcattacccattcttaagttggttttctttctttccaggtgaaggaaatgaaatcagtatgaggatttaagtctcttctgaaacagattagatttgaacatatccaacttttaacactgattactaggtccattgtggtactgattcaaattcctggagtattcttataattgaaagcttcttagctctcctcttatctgatgaaaaccaagttaagcatgaaaaatgtaaaatccacccaagcataaccagcacctagctcctaaccttcatacctcttcagctagccttcttatggctacattctagaccttgctgcacttcagaaatcataaatttcaacatcacattctgccagttattaacagaagcttctttggggcctgaactgtgacagggagacagggctggcaacttaaaaaaaaatccagacacagatctttataaaattaatatgaatagctttcgtaataattcttcttctacttaaagttttatgaaaatatataaaaatatttgattactacttcctatcccttcagtttttaaattttcttagtctaactctcatacttctacttcattagatccttgatccctcctacaagcctttttgtgatttttttccttttacccatgacttctacaattttcaggcacctaggtactttcctgtagacaccgaaaattgttaagtctctttcatttaatgttttaatttctgtggcttagtacagctgtgctctacatattcaacagggagcaagtgcccagtaatcctatgggcccttaatcagctccctcactctttcaatctattattccagatccatactatctttcctcaaaattgcatcctcattcctatattttcaagagatgacatcaagttctactccactaaaaaccaagagaagccgttaagtctgagtttcttgagcttctctgccaaagctacaaagttaactgtattcatgtccaccttttcctctttccatttagtctcacagtgctcttcatgtgccaaactaggtgtaccctccaccctcatctggatccttgatactacccacttctgtgtattcaaggacctaatgcaccaattattccctccatttcttatcttcacctgtttctctctactggtactctttccccagcagataaatatgcaatactctttttctccagcaaaaaataaacctccccacatcttttgatcctctcagagttaagtgatcctgctttcttttcctatattacacctaccagagatgtacctctattaaagcatttttctggatgccctgtaatcactgatttttgactatatgcctcattagatcattagattgttggtttttcaaagccttggttacctctgtgtccctagcacaatgcttggcacgtgggaggaagtcattaaatattagaaaattgaatcaatgaatgtgtggatatgttacatcaaattcaaaataactccaggttaaagataatgaataaaaatgctctatttaaaaattagcactgtgttatacatttgtgtgtaagaatgacacaacacagttcctctgtgttctaaggtgaaacaccttgaaggtggataggattagaattagaatacaaaggaagatttcttttggtgacatgaattaaaatttctaagtcaatacttcattttaaaggagtgaattaataattaaatatgctaaaatatatacattacataaatgtagacttttcaaaatgcttattattaattactaacttcaaaagcaaataagttaaattttaccttgctgttgccaagatatagtcataacgtggagaccaggaaactgctaatatttcttgtctgtgacctgcaaatacaactatatgaaaagtcttgcaagatatctgaaaaatcagaagataaagtgccaataattttgcctgattctgaagaaagtgaggccaaatattcaatgtgaatagatatgaccatttttcagatttataataatcgatgtttcaatgctaatgtgaagtttacaggggtatttcaaacatatggtattttattgtaaaagaactggttttgctttggaaaaaacagagttaagtaagtctttctttttaaatacagttgttagcttatgtcagtaaatccatataactcaagctcaattactgtaataaaacatataagataaacattttaaaggataaaaatgttttccaatttctcataaagttataagagaaacctactttaactcatgcttgtagaaaagcatttatataaaatgtttttttctagaaagcacaggtgataagttcaaagggtgatttcaatattttaattcacttttagctaactgaactattcacatcagacatttccacctgcccagcttatattaataaaaattcataataatgtcaaaaaatgctatctatctcatcaacttttcttaacatatttgttatgtgtttctttgagatcagtcaaaatatataaattatattctatcttttcattgtttagaattagacaatctaatactgataaaagtagcaagaataatttaaatacacctttaccaaagaattacttcaatatatttttctaaaatatttttactgagaaaaaatgtacctaaatattaagaacaatgtttactcattagccagaatattaaataatacatatgagacaagtacactgatgtgagttgcattagtctttttaatgtagaaataacacaaggttttgagttagaactatttttcatattgtttgagcttccccaatgatcattgttcatataaatgtgttttcaatggttcagttttataagaataatgcacagaaggatctttatttccctgctgagtctcaacaaccagcacaaagtacattagtcatgtcacttacaaagaatacactgttagtaacgtttctttttattgaatcgtttactcaaagtagttgccgtttgaaataaaataaaaataccctgtagaatgtgagaacaggatccagacttcaagtcacaaagttgtactttgggtcctctagtaccaactgtaaaaacagaaccggtttaagataattttatcataagtcatcatcaaaaggaaacaagacattatcattagtaatcatgacattttcactgtatccatgcagaaatatgaagatatatgccaaaattacattgtcatttttaatgtttacatttagaaaagttattttaactacagttatattttagtagtaagagacctctattattacatttattttttattctgaaataattatagatttgcaagcagttgcaaagctagtataaagagaaccgtgtacccttcactaagtttccccaacgattatgtgtgaggtaactaaaacacagtatcaaacccaggaaatttgtattggtaaatgtgtatgtatgtatgtacagttctattccattttatcacatcaaatcattgtattttaatagcttagtttttccaagttaatgatatacttccaatcactagtaacagattcacagaaactggacacagactgaaaggacctcaagacaacttagttcctagctcttcttcacagataaaagaggtagagactcacatggtgccaaagaaataatgaatcacagggcccagatacctgataccagaaaatcattttttcttccttatatatgaagatgtttgttgcaggtgcttttatataaattgatgcttaatttgaatcacaatcttagagaaagaaagaatttccttgttttattgtgtcaaattgggaaagttgccaaattttattcatgtaaaatctctgaaactttggtggtttaaaaggaactctttagacagaaatacgctcttattctctgaatcctggccacagcatagtgcttgccttgcaaaatatctgttgaatataaatagtacaatatctgttgaatatatatagtgtgtgtgtgtgtatatatatatatatatatatatatatatatatatatatatatatatataaaattgtgatattcctctgggttaaaatgtctacatcaaaactaactacatataaaaagggagaaagttttcagtatgtcaaaagacaaaagaatacacttacaaacctgctaccaaacagtgcttggtggagactggagacatatgatgactataaactgtttcctcaaaattaaatacatctgcagtctggtaatcaaaagacatttaaaaagtataaggtttaagtataaaaacaaagcaataaattttctatttactttttcctaaatttttagctatttttaaattgactgttagcaattcaacttaaacataggaatgtaataccccaaaaaaccttgataatttgaaatcctgtcatttacaacattcttttcccttctatgaaaaaaaatatgttttcccaataaatcccagaaattaagaaaatataagcctgtggctcaccatattcctctccacccaccctggtggggagggggctcagcatctacatggatgatgtagccagcactgcctctcagttccgtataacctgagctaccacacccaggacgctgtcactacctagaattgccccttctttgaaatcatacatttcagttatctatgaccacaatcttctaccattttcagcttttccccctccaaatactctcaagaaatctgaataaactctggaacccctaacagttcctttcatctacttctcttcctctccagcttggatttcaaggtccaataccaataccaaggtcaactgccaatatctgcaattcctttgctaacatccttccacttgtcaagacttcaccctgggtgaccccaaatgtctgccttctctgtacttatatccaaattgatctacaccaggtgttggcaaactttctttaaaagtcagatggtaaatattttaggctttcaggaccaactactcatctctgtcactgcagtgttaaagcagtcatagacaacaaatgaacatattgtaactgctcaccaggttcttcctgcctgctgcacaaacaaaatcaattcacaaaaaccatggcattgtagtaaagagtttaactgatgcaaggctggccaggccaagtgcgagatgggatttattaatattactctaatcaacctccttgaagtcttgtaggtttggggtttttcaaaggtagtttgggggaaggggtgggagtggttagatgatgaatagatgcttgctattgattggttgggggtgcaatcataagggtgtggggaatggtcctcttgtgcactaagccacttctgggtggggccacaggggcagttggcaggtccaggtggagcccctggtgtcagacatgaaaaaatcctgaaaagatatctcaaaaggccaatctcaggttctacagttgtgatgttatatgcaggagtaattggggaagttatatatcttgtgcctccggaataatggctggcaatcatttatgtctctttatttatttatttatgagaccaggttatgagactggctaatttttgtatttttggtagagatggggttttgccatgttgcccaggctggtctcgaactcctgagctcaagcaatccaccctccttggcttcccaaagtgttgggattacaggtgtgagccactgctgggcctatgttttagcagaattcaggcttgtctcctcctcctagtctggtggtctctcattagctttacaaaggtggttgagttttggagaagggctattatcatttaaactataaatggctgggggcagtggctcacccctgtaatcccagtactttgggaggccgaggcaggcggatcacttgaggtcaggagtttgagacaagcctggccaacatggtgaaactccgtctctacttaaaatataaaaattagctgggcgtggtggcaggcgcctgtaatcccagctatatgagaggctgaggcaggagaatcgcttgaacccgggaggcagaggttgcagtgagctaagatcacgccactacactacagcctgggcaacggagcaaaactctgtctcaaaaataaataaataaataaataaataaataaacaaatacatacataaaataaaaaaaatagagtattaactaaatgtcttccaaagttagcttggccaaagcccagcaataattaaggcagcttgaaggctaaaggcaagagggggtggtggctagatcagatctcccctactgccacagttttctcactgatataagttttgcaaaggcagtttcaatatttgtgtccaaaacctactttatttacaaaaaaaggccatgagccagacttgcccatgagcccagacttagccaatcccttgctctcctcaggtaaaaaatcttataattagggcagtgtgacatcaccataaaagattattcatttcctctggatttcagtaatgactgccagtcccactatatttcacttgtattcttctctgcagtattcctcagctatttcaaatcttctccacaaatataccaactcagtcacaacaggtaatttgatcttttatttcaaggagaaaataggaggcagtcaatcagaatttccttaatgtcttaccaacaaacctacaaacacatttgcttccacttatcctttttccttcttcactcctgttatcatagaaacatgattctttttttttttttttttgagatggagtcgctctgttgcccaggctggtgtgcagtggcacgatcttggctcactgcaacctccgcctcccgggttcaagcgattctcctgtgtcagcctcccgagtagctgggactacaggtgcccgccaccatgcccggctaatttttgtatttttagtagagatgaggtttcaccatattggccaggctggtcttgagattcctccccatttttaatgtcaatccccctacttgtgttcagattcccttcagcactgtcagaaatctcaccctatagattatcttctgggtatctataacctctgtccccactggctcattcccaacagcactacaagtgaaagtctttttcatcttaacaccgcttccctaagacaaaaaaaacaaagagcattttcgccctacattctccctaatctttcctcctcttcaaatccaaactttggctatctctaattccttatctcccacgtatttctcaactaattgcaatcttatttttatcgcactactgtaaatcacactattcttccaatattaccaatatgttcctcatctgatttaatctgtcagtagcattcaacacaattgattactcccatcctctttaaagcaatcttttacaggcttccattgtatcatatattcctgattttcctctttctctccttggctacatcttttcatcacctttagcagactttgctttcatttttctgtcctatttatctttgtcttcatggtcttgttctatgtactcctttcaaatgccacttgtatgttatgggttaagtatcccttatccaaagtaactgggaccagaaatgtttcagagttcagatttttttttttttggtttggaaggtttgcattatacttacaaggttgagcattacaaatctagaactcaaaaaatttcaaattttgaacttctggattagggacactcagtacatagtgaggcacaaatctgtatattcagtgtagacctcactcctgaattctgggtatgtatagatcgattcctggattatcttcatttggatttcctgtaaatccctcaaactcaacaaatcgaaaattgaactcatcattccaacccttccccatcttactaaataacaaaataacaatataatccacccaattgtcaagccagagaacctgggggtcattcatataaatacatatatatatatatatatattttttttttaaataatggctttgtcaagatacaattcacattatcatacaccttggaacccatacgaagtgtcactagtgatgctgcaagtggtaccaagaagcagagaaaagtcatgacattataaaaaaaggctgaattgcttgacatgtaccatagactgaagtgtgcagctgtggttgcccaccatttcaagataaatgagtccagcataagaaccattatgaaaaaagaaaatttgtgatgctgtcactgcagctacgccagcaggtgtgaaaaccttgtatgttttgtgaaatacctttgacctcttattgaaaatccatcttttatgtgggtgcaggattgttaacagaaaggcgtatctatatgtagactctaatatgacttttaaaaagcaaagtcagtatagtcattatatgacaatgtgaagccaaaggaaggtgaaggatctaaagctggagaattgaatgccagataaagatggtttgataatttttggaaagttttggctttaaaaaagtcaagataataggatgagaagcttctgcccaccaaaaggcagcagatgagtttccagataccattaagaaaatcatcgaggacaaaggatatctgcctgaacaagttttaaatgcagacaaaaatgccctattctgaaaaaaaaaaaaaaaaaaaaaaaaaaaaaaaaaaagccacaaaggactcttatgacatggacccttcaatgatatgggctctgaaactaaagcaaatagtggaagaaggttcagtactgtaatagaaacatttttagagaaatacagcagaacacacaaaaattacgatgtatttccatagttataccaagtgtggctgcctctccttccaaatcttacaccttttgctaccctagagacagcaaggtcaactcctcctcctcctgctccttctcctcagcctactcaatgtgaagatgatgaggataaagacctttatgatgatccacttccactgacttagtagtaaatatatttctcttcctcatgattttcttaataacattttcttttctctagcttactttattgtaacaacgcagtatataggccgggcatggtggctcacgcctgtaatcccaacactttgagaggccgaggtgggtggatcaacggaggtcaggagttccagaccagcctggccaacatggcgaaaccctgtctctactaaaaatacaaaaattagccaggcatggtgacacacgcctgtagtcccagatactcgggaggctgaggcaggagaatcacttgaactcaggacggggaggttgcagtgagctgagattgcgccactggccactgcactccagcatgggtgacagagcgagactccgtctagaaaaaaaaaaaaataataataataaaagaatacagtatgtattacatataacatacaaagttgtgttaattgactgtttatgtaatccagaaggctaccaattaacactaggctattagtagttaagcttttggggtaatcaaaaattatacatagattttcaactgtgatgggggtcagcttccctaacctccacactattcaagggttacctgtattatcataaatcaaattaatgtcatcaacgggtacatttcttgattatccagttccactgtatggtgtttttcttttttacttaccaatatcacattgccttcactagtataactttatagcaagtcttgatatctgatagtgaagtcttccaacttcactcttttgtttcaagagtgccctgctgttttgcatttccatatgaacattagaattagctagtcaattttcaaaaaaagaaatcttctaagagtctgatagaaaatgcattgattctatagatcagtttgggtagaactgatatttttatcacactgaaccttttaattcttgaacatggaataccccacatttatttaggtcttaatttctctcaataatgttctaaagttctctgtgtattcggaatagtcttgtatatttttcattaaatatattactaggtatatgatgatttttgatgctatggtaaacaatgttggttttgaaatttcattttataatcgcttgtgtttggaattcagaaatataatttaccttgtatccagcaaatttgctaaatttacttatattaattctaataatttggctatagattcttttgaattttctacgttcataatcatgtcttctgtgaatgacagtttaaatgcttcctgtccagttcctatcccttttatttcctttgctttattgcactgactaggacattcagtacaatgttgaacagaggaaataatgaggataatgcaaagggaaagctttcaacattttaccaccaaataaaatggttgctttagttttttaaaaaaatagatactttgtatcaaattaaggaatttctcttctattcctagtatgcagagaattttatttttatttttatatattttttaattatacttttaagttctagggtacatgtgacaacgtgcaggtttgttacataggtatatatgtgccatgttggtttgctgcacccattaactcatcatttacattaggtatttctcctaatgctatccctccccctacttctccacattctccccctatttctccacatactctccagcatctgttgtgtcctgactttttaataatcgccatcctaactggtgtgagatggtatcacactgtggttttgatttgcatttctctgatgacgagtgatgacgagattttttcatgtgtctgttggctgcataaatgtcttctttgagaagtgtctcttcatatgctttgcctactttttgatgggtttttttttttcttgtaaatttgtttaagttctttgtagactctggatattagccctttgtcagatgggtagattgcaaaaattttctcccattctgtaggttgcatgttcacttaatggtagtttcttttgctgtgcagaagctctttagtttaattagatcccacttgtcaattttgacttttgttgccattgcttttggtgttttagacatgaagtccttgcccatacctatgtcctgaatggtactgcctaggttttcttctggggtttttatggttttaggtctaacatttaagtctttaatccatcttgaattaatttttgtataaggtgttaaggaagggatccagtttcagctttctacatatggctagccagttttcccagcaccatttattaaatagggaatcctttccccatttcttgtttttgtcaggtttgtcaaagattggatggttgtagatgtgtggtgttatttctgaggcctctgttctgttccataggtctatatctctgttttggtaccagtaccatgctgttttgtttactgtagcctggtagtacagtttgaagtcaggtagcgtgatgcctccagctttgttcttttggcttaggattgtcttggtaatgcgggctcttttttggtttcatatgaactttaaagtagttttttccaattctgtgaagaaagtcattggtagcttaatggggatggtattcaatctataaattaccttgggcagtatggccattttcacgatattgattcttcctatccataagcatggaatgttcttccatttgtttgtgtcctcttttatttcattgagcagtggtttgtagatctccttgaagaggtccttcacatcccttgtaagttggacttctaggtatttcattctctttgtagcaattgagaatgtagtttactcatgatttgggtctctgtttgtctgttattggtatataggaatgcttgtgatttttgcatgttgattttgtatcctgagactttgctgaagttgcttatcagcttaaagagattttgggctcagacgatggggttttctagatatagaatcatgtcatctgcaaacagggagaacttgacttcctcttttcctaattgaataccctttatctctttctcttgcctgattgccctggccagaacttccaacgctatgttaaataggagtggtgagagagggcatccctgtcttgtgccagttttcaaagggaatgcttccagtttttgcccattcagtatgatattggctgtgggtttgtcataaatagcccttattattttgagatacattctatcaatacctagtttattgagagtttttggcatgaagggctgttgcattttgtcaaaggccttttctgcatctattgagataatcatgcggtttttgtcattggttctgtttatgtgatggattacgtgtattgatttgcctatattgaaccagccttgcatcccagggatgaagcccacttgatcatggtggataagctttttgatgtgctgttggattcagtctgccagtattttattgaggattttcggatcgatgttcatttgggatattggtgtaaatttctctttttttgttgtgtctctgccaggctttgttatcaggatgatgctggcctcataaaatgagttagggaggattccttctttttctattgattggaatagtttcagaaagaatggtaccagctcctctttgtacctctggtagaattcggttgtgaatccgtctggtcctggactttttttggttggtaggctattaattattgcctctatttcagaacctgttattggtctattcagagattcaacttcttcctggtttagtcttgggagggtgtgtgtgtcgaggaatttatccatttcttctagattttctagctgatttgcatagaggtgtttattgtattctctgatggtagtttgtatttctgtgggattggtggtgatattccctttatcattttttattgcgtctatttgattctcctctcttttcttcttcattagtcttgctagcagtctatcagttttgtggaccttttcaaaaaacctgctcctggattcattgattttttgaagggtttttggtgactctacttccttcagttctactctgatcttagttatttcttggcttctgctaacttttgaatttgtttgctcttgcttctctagttcttttaattgggatgttagggtgtcgattttagatctttcctgctttctcttctgggcatttagtgctataaatttccctctatatactgctttaaatgtgtcccagagattctggtacattgtgtcattgttctcattggtttcaaagaacatctttatttctgccttcatttcgttatgtacccagtagttattcaggagcaggttgttcagttcccacgcagttgtgtggttttgagttagtttcttaatcctgagttctaatttgatttcactgtggtctgagagagtttgttgtgatttgtgttcttttacatttgctgaggagtgctttacttccaactatgtggtcaattctggaataagtgcaatgtggtgctgggaagaatgtatattctgttgatttggggtggagagttctgtagatgtctattaggtctgcttagttcagagctgacttcaagtcctggatatccttgttaaccttcagtctcattgatctgtctaatgttgagagtggggtgttaaagtctcccattattattgtgtgggagtctaagtctccttgtaggtctgtatggacttgcttatgaatctgggtgctcctctattgggtgcatatatatttaggataggtagctcttcttgttgtgatccctttaccattatgtaatggccttctttgtctcttttgatctttgttggtttaaagtctgttttatcagagaccaggattgcaacccctgctttttttttgctttccatttgcttggtagatcttcctccatacttttattttgagcctatgtgtgtcagtatgcagagaatttttaaaaatgaggatgggcacagtggctcatgcttgtaatcccaacactttcagaggccaaggtgggaggatcatttgaggccagattttgacaccagcctgggcaagacagagagacactgcctctacaaaaagttaaaaaattagccggagatggtggtgcacacctgtagccttcactactttggagcctgagctgagaatcccttgagcccggagtttgaggttatagtgagttataattgcgccactgcactctagcttggggaacagggcaagactcttgtctcttaaaaaaaaaaaaaaaaaaaaggatattgacttttatttcaaaatgttcgtatctattgagatgactaatatgtagttttcccccttcattctattaacatgatgaattacattagttgatttatagatgttaaaacaaccttttttgtccactcatgatatattattctttttgtatgttgctagattctacatattaatagttgatttaggatttttgttatttatatttgtaagagacactggcttgtaattttccatataatgtccttgtaaattttgaaatcatggatatgctggccccataaaaaaagtttacaaaagttcctttttttcctcttgaagcatttgtataagattggtattatctcttttttaagtgtttagaataacttactcgtaaaggcacctaggcctggagatgtcagtcttcttctattgtctgtttttactcctaagctcatttgttggtaagcttggaagtttctgttttgagtgctagaaattatatagaaaaaattgggagagattctgcgttatgttatcctcctctagagaagatccaatctctcttttgcaggtaggagagggaagatcatatcaattcaaacataaagcttgtctgctattgtagagttctgtaataattttctactgatgcagtaaggaaagtacttactgtacttagtaagtaccacatacttagtaatttataacacaaatttattatctgtaataaatctgttctacaagttaaaattctcacataggtctcaatggattataatcaaggtgttgacaggctgcattcctttttggaggctctaggagagaatactttctccatcttccagagaccacccacatttcttggcttgtgatccccttaatccatcttcaaagctagcaattttacatttctctggccattctcccagtcaaatttaccccgtctccttctgcctcccacttccattttttaagattcttatgattacattgggcccactaggataattcagtattatctccctgtcttgaggtcaggtgattggcaaccttaattccccttcgtatgttctagagattagtacatagacatctgggagcgggacatgatgctgcctaccacaggctccatctacctcctatttgtacccattattagagtattcccctctaggtgccctaagagcctgggtgttttcctaggcccccttctacttagcaagtactgcactgcaattcttctctccagtaccatgtgactggggaaaattgctgttcttcaaatgtcttctgcttcatttcttaagtctatggtctcgcatagcttggtcagcaaatatctcaaagaaaaaaccagtgcaagatgttaggctgatttctctgcatctctcttctttctgtgatcttgaccctttaatttctggctgtcttggcagcccacattccaatttctgtctctctagctttatgaaattgactaaagtcccactcatttatctgcctcttagaagctatccaatgcctgtcttctcagtctcttgccttactttaatgacaaatgtccaaagagaaaaagagtgtgtggaaagttgaatgcatttctgtaagtgttcccctctctaggatctgattctcaattcctagatttcttggcagctttataaaaccctcaactagatgcctgtttatgctttatctagcttttctcaatggaggtgctggtttggctacaagatattccattatagtcagaagtgaaaggtcatgacattcatttaattgttaaaatatactctcattttcaatgacatgtattttaaataaatatactttattataaaaataaatctgaaataataggactattctaatgtagcaaggtcaaaaaaacacatctatttagtttgaattattagaagtatattaaatttacatttatatacacaacactgttttgttttgctcactagaatcataatatacttcatgattttattactttttagtatgtggccagttacatacattgttagtcatccctaaagcatttactcagcagttactgtacatagcactgaatttagtaatgtataagacatagtactttctttggggaagtaacaatctagaacaacaaataagacaaacaagtatgaaaatgatattataaagtagtatgagaatgtattgaaataggaatacagaaaatagtgctataaagtaaaataatggttaatatttactccagaagctgaaatcactaaactgcatgatagaactaaaagggaccttagacaccatctagtctgacactttaattttatagctgaagagacctttgctaacaaattaaatgacttatctaaagcaacaaatctcataagtggcagaatggaactagaactctggcatctacagtcttggctcaatgtaattgtaaaaaaagatgtgaccttaggagaagggaagagttgcaagggaaagggacttgaggtagggaatacaacagattcaaaacacgatcagtttagttgcagcaaagcatttgtgttgaaaactggtagaacataggattgaaggaacaagggttgatgtcatggagaacttggaatgccaggctgagtttagacaatgggaatccctagagggtttgggtagtgacatgatgaaactgctttataataagattaattctggggtagaacttagtgtagaaaatgtagaaggtaaggcagtgattttagtagtccagatgtgcagtaaaggcaaggtaaatagaaaagagaggtatgagagagtttgaagaaaggattgctaagattttatgactaaatttaatgagatgtgatcatgttcagttgggaccatgttaagtttgaagggatgacactacatttaagtatagaggtactgtagaaaagtagagacatatcagagtagagctcagagaaaagattagcactcggaatgtaaatttgaccaaatgtcatacaaactattatccattgcttgtctttactaagctacagtattaacagctttctccttcaagtttttagatcaatcaaagataaatccaattttctactttagattactagatcatagtatttttcacaaagggataataatattagctaacagtttttgagcatttactatatgctatgtactgtactaggtactttacatattttggctcatttaatcctcacaaccatactataatcattattcccatttacagatgagaaagacacacagaggtttggacatttgcccaatgtcatacagctgtcagcagcacagccaggatatgaactcaagtagtctagctcttcttaaccactgtactgctttcacatctaacatatatgacatctcagcaaataatcatactaaaatggtttaggattaaattctcctttatcctacaaagcaatctgcaaatgttttaatgtacttacttgtaatgtatttgtatcccatactttcagagttttatcaaatgagcttgatgtgaacatgccagtgtcatgaggataccactgtacagtctccacactgtatctgtgaacatcaggatgatctctacaaaacagcaatcaaaatttacattaactgacttatgtgagtttcaaaactggtactatattaagaacaagtagtagtctcaggtaggatgatatgaatggccaaaccgagatcacatgcctgtgtccaagctgtgtagaaggcgagaaagaatgtccaggcatctctagattcaggctcccactgtgtgatgtagagacatacctcctactaagggtcacaatgtgaaagattctctgtttttgtactatatacagcctggaggcatcagccaactacactggtcttctttcatcttgaaagagtgatttggtcttactggaagagacagctgttttggttttggatttgcttttccaaagtctcattctattagcactactattcttagaattattgaatgcctcacacacctccatggtattctatacaatattgcttcttatcaaggaacttattctatgaccaaagaatgcaactggtgtaggcccatgagattcacatcttatgtaacccaccatccataaaaacataacatgttgaagactctatgacgtcagctacaatacaccaccttgtgagggtggtatgctgtcctgaaggatgcagtatatgctctgaaccagtgaccaacatagtgtgttacctaactggatcttgattcaaacaaactggcttttaagagagatttatgagacgaagagggaaatttgaacacagactggatatttaatatagataatttttgtgtatttaagatagtggtactgtagttatgctcataaagtctttatcttttagagatataaataattatgaataaacgataggttgttcgagatttgcttcaacataattatgagggtggatgggtgggaggtagagatgaaacaagattggttatgatggttggtgaagctgggtgattgatacacaggtcattatacaactctccaatcttgtatatgtttgaaatttcccatagaaaacaaaagttaacagaagacttctgcaaccctatgcagatacaaccgtgatgcttttggattccttaagatgaaggtttgggaccttaaaacatttgtggtgctatctgaaggaatgagaacacaaagaaggaaagtcttaagtgccagctctggcattaaaacagctgcaaaaatacaagaactatagtgcctactcatatttcctttttttctctgtaaatattcatatattttaactaattttctctttcctctcttacctttattatttttataggttaactatatcattgagtccacaaattgtataatactgatataggataaattaaactagtggaaaaatgaacatgaccttgaaatggagccaggtgtggtaactaaatcaacttaggatcatcaccctttggggaagaggatgatcacctttttggctgtatagtgaagatttgcattaggttaggctggaacatttttttaaaaaacagtaattatgggaagaaaggtgtatacgcatgctggacagccaaatgggtggattgtagggaacatgtgcctttttttcttggctgatgagcattcaaactcctatttagaggaaatgccctttgttttactgaaaataagagctctacctcttcttacagaaagcaagggactctagacattctcttttcctaggagagttagccattattcaaagctgaggagttgagagtctgcgttggtgacatatagcaaaacccaaactaatgttcctgtggtgtgaccctgactgtgttctctatcctgacttcttttgttttctgctcattttctaagtctgattctcccatcttcctgacagttatgtgagatactaaatattcttccaataaatttcgcttaagataagcagattgatttccttttgctcctaagaatattgacttctacagagatttttccagtgatactacttttaaatgaaacaaatttttaatgtagtgataacaaataaaagctcacttatattttaagtttaaattttaaaataggatattttattatgttactatatatgttctgttattttcatttatatttaataagaattttggtagaggaaaggaatctttttagtgctcaaggacaaacacattaagtatactaatagtaagcatcagaaaatagtctaagtcacattaacttaataatagtctttattgaaattatttttaaattggattgtaaatccttcagatgtataaaatgttattataactcattttgtaaagatgcatactatatgtccattttcaaattcaaagtcacacttttaaatatagaatctgaatccaagaataaaatcacagtaaaacaagactgacacattacgcatttacttatgtcacaaaccaaaacaaagcaaatcacagttcctcacggaatattatgtagcacgtagaataggtgaaaatactattttgctatgtaacaaaataaatttaatgttaaaatgttagctaggataaaaataagataaaaatgaatttaattaattaacatgactttttttgttattgagggtgggaagagagtatatatggcctaagtctctaagttctagagtatttgaggcgatatcttgttttgtactaagtattcctgtaagtacattgcttttcacttatgcagtggtttcggttttcaacacgcttttaaaaagatagtatttcatttaattctcatagaaacgtataagaaccacagggcatgtatactgatttctaaaataaaataatgtgaagctgagattaactgattttcccaaatttgtatttctaatgcgaaacaccagagccaacaaacaatagcaaatctcctccgaaatattccatagcatatattctaatgctttgggaagagctgtaatagatagttgatgttaatgtttacaaagttttccctcttgaaagcattttctcagtgcccattctccctgttaattcaaaggtctgctcattatcagattgaatgtaggtgaagagaaaggattaaatgaccacaatggaaaaattacaatgtcacaaaacattttattagagacttaaaaaaaattatcacaagattggtaagccagtagagaacagtcagagaagacaagtattacagatgtatgtttttaagttagacatctttgagtaagtagagagacaagacaggggtgagtgggtatatgtgtatgtgtgtgtttggtgagggaataccaatatgtttagtatatctaaacctttttcttccattagtatcaggtgaaaatctaatttgtgtttataattagctgaaggactataaatgaatcttacactaagtggtactaaaaactctaattagttactgagatgtgctatgtaggtaaagaaaaagaaggacataatcacaagttttttaaaaataaaatactaatgaaaattgatactgaagttgctttggggaagacacatgttaaaaaactatacctgaatgtcagttactattttcaagaaagtgtcaaggaacagccatgcaaatgtgttatgtgaaccattcgcttgacccattcacttgactgcaattttcatgttttgcattcgatgcaaaaaatactcaactatttacaaattcataaatttttacattttaaatacatacctgccaatggaacacactgctttacatgtgtaataagattgtctgctggagttctcaaggtcataaagtacaatcacaccatctgaaccacctgataacatgctgataataaaaaagttcacattaatttatcattttatttattatttagtccatttatttatgattgcaaatttctaaaaactgatttgcaaacactcaaatgtattaaggatacattaatttataataagttaatcctcaataacacagacttcataaactaaaatttcttaatatttaatacaagaatgaatataaaaaaattcattctgtgatcatttcaagtttacttccataacttcaaaaagaaagggtgacagaaacaagacggcaaaagagatttcttaagaaagtaaaatattacaaagttattttaaatgtcctaattatgactatgctaaataaaaaaggaattagacaaaccaactattactgacacttgctatttggctctgggcaagttataccacctgtctaagactcaacatttgtaaaggagggggacatttttacctgaatcacagtgttgataataaaagtgcaaaattctttttatagtacctggcaaaaaataggggctcaataaatgttagattccttccttctcttatgaatgcattcactcaattcattcaactttaagttcctacaatgttagacactctgctaaaacaactgtcaacaaggcaggcatggttcctgtcttcgcagagtttacaatccaatagggaaaacaagtagtatgcataatcacacaaattattagttatgattgggatcactgtgacaataacttatttttattctagtttggaaattcaggagcagtttccctgattgcaatatttaagctggtatgtgaaggatgattcaaagttagccagaaaggtgtgaaagtaacaatccaagcccattctaggaaccaaaagaagggatttgttgctggagcagtgtggaagggaaagagtggtgagagatgagaggcaggagccaaaccactgaagccttacttttgggagtaaaagagggtgctaaaaaattagcagtatctttttttggaaacaattattgactcactctcaagctggtctattatattggtagaacctacaaaattattctattcaaaaactttgcaaaaatatttctaaaaagtaaaagtaacaagcatatatactaaagctatatacattgattgaacttaataatttgtaaaatcattcttggtacttcatatactttaatcagtttcttaaccatatttgtctctaatactgttactgtgtttttttaaatgggatttttcaatatgatcttattagtttttttggcataaaattgtctaaaaatcatctttaaatctggagttgttgacacctttaactgacttccctaaaagccataatgtttaatttaggaaataacaatagttgatgaggtatatgataagttcagagaaaattctgcaaaatggaggatattcttgaaatgtgcaaatatttcaggttattttcactgtttttaccttaattcaaagtacctttctttagtatacttatttttttacaagacaaaattctccttgaacaaattctttatgtctcttttggaagttacaccaaatttaaatattataaaatcttagacattgtgaatgttattccattacaaaatatacatttatcccaattacaaatatacatttatcccaatcaaaaataggggaaccatcaaaaattcttcacagagatccaaacaatgcaatctctctacatcatcactctttccttttcacctcaaagtaactcattatcatgatttttatcgtagtcactgtctttctcttctgtatagttcatagttcatcaccttagagtgtacacatgaatattagctttgctttttaaaaaaattttaatgtcttttaactttaagctataggtctcctctacctttcttcctccctcctgtacttttcccctctcttgtaatttatttgttgcaaaaaccagatcatttgtcctgtaatttccagcctggactttggtgactgcattcatgtgctataatttaaaataatttctatttcccattgctctttgttgtgatgtgatattagcagacaaaccaatatctagatccatcaatttatacatttatataaagtgttgctatctgctaatattattgctcaccgtcaatccttaagttgctgtctctcttgtcattctggttgaatgatttcattctctggttgattcctaaggaatggctaatgagaacaacagtctctgaattcttgtgttgttgacaatttatccgtcctttttgtatctgaaatcagtttggctggatataaaatccttgactcacattttatttccttgagcatcttggataagaagcttcatttcttctgccagaaagcccaaagtcaaagtctagtgacaatataaatccccccctcttatataaagttccagatcttatttatcctagaaaagctttcttgaattattgttttaatatttattctgctcttttgccttggtttcttttttgggaacttctatcatatgttatgctggatcttctttgcctatgttctatatatacacctcttgaattattttcctctgttcatttctttttggcttttaaaattttcctcctttctagtttctatttctaaggcattacctcttccatttatttgtgttctttaagttttagtcagtcttcatttctgaaatatttttatttctaattttctgagtttgagcatctcatttctgaggttttctaataacttaacattattctctcatttattatatgtttataaaacaacttttacctagttttgaaatattaggttagagttctcatctgttttatagatacttctttccggtgtgacttcactatctgtagcagctttagtccacttcttattctctttgtttttataatgattttgtaggaactttgaccttaatcctattcctttgctcatttttatgtaaaattaattttcttaaccttttagaatggaggcttgacttacaataatgtttaaattttatatattaaaacatcctcttcttcccttaaaaattttttttggggggtaagatttcaaaatatggaagcttactttcagagatttcctgtttctgttcacctttccaattttatcggggacatctttttcctttgtttctattgtctctgtactgctcaatttggattctatttccagcagttttcctcagtatatagttctgtactgggggcgcactttgactggttagctctttggaaagatattagagtccagactgctatagctccttctggtcttaccatgggccactcaaacatatctacaattagagtatgccatcttctcccagtttgagctgctgtagtcaaatttgcttgctaagttttcaaccaacctgttggttactttggacttatccaggtatatcagatgccttatcgctttttactgcctcctctagcaaaaatgctggtagtgcacagatcttttagttgtcagtggtttgttcccacttattcacagtttggggtttgtagggatacttcatgacctagtttggttgtaagtgttaatctggtttttcctatttgccatttttagtctctttatgtgttttaatggagaactagaggaacattaaaaactgcattgacattgtcatctttctttctttttttctgagaagaagtctcgctctgtagcccagactggagtacagtggcatgatctcggctcactgcaacctctgcctcccaggttcaagtgattctcctgcctcagcctccagagtagctgggattacgggcacgcgccactgcacctggctaattttttctatttttagtagagacggggtttcaccacgttggccaggctggtcttgaactcctgacctcaggtaatccgcccgcctcggcctcccaaagtgctaggattacaggtgtgagccactgcacccggcctgtcatctttcaagaatggcacccaaactacagtttttggcactacattcactgagtattttgattgaaagattttcatctgattttgaacaaaatacaattaaatgtagaggcagtgctatttaactctccaagataaggagcttgtaccagaaacaaacacacgtctttcttcactgagaatgtcttgttacaaacatgtcttagctcctttaaatggtgtgtgtaatgatgtagtagatttatgttttagcacaagatccttatcttgtgacccagtcacaaatagttcatgaactagtagcatgtattgatttatagacttgtttttaagataaattcaataccaatttataaaacaatagggttaatttaaaagtagttatttgaaggctcaaaaatccaattgatgggcagtaaagaaagactgctaataatgccctacttagttattttaaaaaatattccacattagctttattacattttgtagttcagttactctaattgtgtacatagagaaatatttgtaaattttaacaactacaacttttatttagattgataaaatgtttggacacagttgtgagttacatgtatactacaaccaattcccaaaacacttttgcttcgtaattaatcttcatgaaacgttgcttttcttgccatacagatgtattatcaatataaaacaaaattatgttaaaagttgaaattttaatcttaattgatatggtatttacaataatgtcagatgttttgactctgttaaaatggcttccaaaagcttttctctgattccattaactttctatttgaagtatctgatggcactgacattaactatgagatactttttgctgatagagtatgaagagatatggtttcatgtttttatatagacaagaaaacttagtattaaagatgaatgaaattaacttagaagaatttaaaaggtataaaagaaaattcaagcttcacagagtgatacgcaaatgcaccctctgcagttgcacctgttaaactgtaattttcagatactttttgtaaaataacaccttactttgaaaatctctgccagatttgtgtattctgtctggtttccaatctgattttcagtgacacctttacagctctcatggtggatggtaaatattaacaggtgttttgaacaagttatatacacatcgatttttttagttttccacagaatgtacgctttccttttaatatctcttgttgctatcaaaaggggttaatgcaaaatacaagtcttagcaaacaatgaaatagttgtagacttttaccgtgcaataaagcggaaaatcactgtagcaagagtcttcagacttttctctatgtgctgtattaaaagatgcctcatctgcatttctcaaatatatttcatgcacatataatctgtaacttcccatatttctcaccaactctgccaactggtagtctactggcttctcatacatcacaggccacacaactgattactacaccaagtggctggctggagtaacagtattgattactttcctgaccagcatccaaacccaaaagtcagctatctcctgctgctcatgtctgcatgtttcataagtgagtgcccccccagctgtccttgaatagaaggtgttacactgagcctggaaaaggtcaggaaaaagaaaagaattattactcatcttttagatttaaccacatgctaaagtaagatgtttctcatatactagtagatgagaccatggtggaagctggaagtaaaaagtggaagtttatcaaatctgttctgacttgacttaatgtattaataataatatttcagtataaaataaaaattctgggggaaatgctaaacataccataacaccaaaaactgtttcctttagttaatgctatatgtggcctaattataggccacatgaaacataccataacacaaactgcttcctttagttaatgctatatgtggcctaattgtaggccacatgaaaggttttgtacggtcttttaagagtaatgcagtgttatgacgaattgtaagtaggagaatatgttcagaattgagtttttcaaagcattttggctgctgtgtagagactgggctgaaaggagtaaaagtatatgtaatactgcttttgattaatagtggcagcagtggtggcaactgtttatgacgtgccaggtcttacgttaatcatgttgtgcatattatctcaatcttcaaaacaagcttgttaggtaggtactattgttcccattgtatagctaaggcaactgataattcgaaaggttaggtaagggtaaagccaggaagaactcaaatataattcttatttgtttctaatctaattcttcaaaagagtctttcactttttatatttattttaccattagacttttttgagagtagcaactatgttttaaaatagcacctaaagacacattctagcacctaaaagccctctgcatccaaaagaagttcaatgtttgttaatttaacaataagtaaatatttatattaaagtagcttggaaatgtttatttgacaacatttggtaggttcgatgttttgtatttacttgaaattaataatgccagattcaaaaatgctacaatttaggattttcattaattttaatgaaacttctacatcattaatttgaaaaagcaggttttactgcatttcacttagaaagaaaaatgattatacaagtataataaacttactatctcccttcaacaggttcaatgtcaagggtgttaattccaccgccgtggattctttcaacatctctgtctttatttaattccagtcccaaaactcttaaaaataaaagggggagaaagaaattaacaagtaatttaacatttaaaaatttcttatttaaccaagattacttatggtacaaaaatcacaagaaatgtctaaatcttctaccacacatcctaacgtatttatagatttttagacatcttgtataaatgtttaaaatatcagcagtagtaacaattacatgcaaacttttaaaggtatttaaagacggaaatttgtacgaaaaaagttaaattctgataaatgtagctgaggacatctaatggacaaaagcataaattacaggattaaaaaaattccttgaaatgtttcttaaagacggacagaaataaaaaatgagtatgggctgggtgcagtggctcatgcctgtaatcctagcgctttgggaggctgaggtgagaagactccctgagaccaggagttggaaagcaccccaggcaacatagcgagaccccatctctacaaaaaataaaataaaaataagctgggcatggtggtgggctcctatgcaggagactgaggcaggaggattgcttgagcccaggagttcaaggatgcagtgagccataatcacttcattgcactccagcctgggtgacagagtgagatcctgtcttaaaagaaaagagactatgttcaacttaacatttatgtgtatttaaataaagccacttaaatatcaatacaaataattaacaagtactctcacaaactaagacaaatgacatttctgatattttataactgtaaaccatcattatcctggtgagcatattattaagattaaatgagtttgtatataaaaggtgctaattacaatgcctagtacattgtaagtatctagcgaatattaactatttgaatctctcttaatctgttggctgttattagcatctacactaatttaaccagaattatttctaaattcattattgattaaaataatgctagtttaaatatcaaattataaatttttggcctataaaattatcagttttttaaaaagataacaatgcacaatgctggaaaggcataaactgatactttcattcattgacattagtacaagtaattataagcattttggaaatcattttagcagtataaagtatctgatttgaagatatacatggccctttgtcttctagacattacatatagtacaacaatgacaagcaggccaggcgcagtggctcatgcctgtaatcctagcactctgggaggctgaggtgggcggatcacctaaggtgaggagttcgagaccagcctggccaacatggctaaaccctgtctctactaaaaatacaaaaattaggctaggtgcggcggctcatgcctgttattccaggactttgggaggccgaggatcacaaggttacaagattgagaccattctggccaacatggtgaaaccccgtctctactaaaaatacaaaaattagctgggcgtggtggcctgtgcctgtaatcccagctacttgggaggctgaggtaggagaatcacttcaacctgggaggcggaggttgcagtaagccgagatcacaccactgcactccagcctgggtgataagagcaagactccgtctaaaaacaaaaacaaaaacaaactaaaaaatgagccaggcctagtggcgtatgcctgtaatcccagaggctgaggcaggagaatcgcttgaacccaggaggcagaggttgcagtgagccgagatcgcgccactgcactccagcctgggtgacatttattgcaatacatctatatacattgcaatttagccttaggtttaaatatccagacaaacagtaatgagttatctgactttgatcaataacaataacagctaatataaaaagccaggccgggcatggtggctcatgcctgtaatcccagcactttgggaggccaaggaggccggatcacttgaggtcagcgattcaagatcagcctggccaacatggtgaaaccccgtctctactaaaaatacaaaaaaattagccaggtgtggtggggcatgcctataatcccagctactcaggaggctgaggtgagaaaattgcttgaactcaggggacggaggttgcagtgagctgagatcatgccactgcactctatactccaacctgggtgacaaagcaagcaagactccgtctcaaaaaaaaaaaaagcctactactcattgtaataggtagtaataagaagtgtaataagtggtagtcccaggagtggtgattattattaaatgcatctcctgattataagattaatagaagagtaatttgcccaaggtcacacagctaatatttggctgagccgcatttgaactttaacattaaatttttttttaaatttacttttagagacagggtcttcctctgtcacccaggctggagtgcaatggcaaaatcatagttcactatagcctcaaactcctgggcttaagggatcctcttgcctcagcctcccaaatagctaggactacaattgcatgttaccacacctggctaagttttggtatttttttgcagagatgaagtattgctatgttgcccaggctggtttggaactcctggcctcaagcaatcctctcaccttcacctcccaaagtactgggattacaggtgtgagccaccacattcagccctgaactttgacattctttccccagaccactatgctgttctgtcatttctgaacttcaatatttcatcaaaactttttttttcatatttttccattgaaattgccatttttctgaaaatatttttccatatgatcatttttcaaattacaacagaatatatgctctttgtaacaagtaaaaacagtatcattcaaacatgtataaaggtaatcatcttttccttcagctccctcttcctaacagtaagaagcatggctcccagtaagaagcatggctcccattactaccaatatatttatcaatcccctgtatgtaaccaatctcccatctccactaccatcccctcccccaacagcttgggctctgatttctgtctcctctaaaatccttatcacctaaatttgtatgtccccacaattaaactacttcctcaacctgctcaggctctgaaattccactctaggaaacctaatcccatactaagtgagaaagcttacctctgcccaacataatgacttcaggactgaattgtctgtgaactagaaggagagtttaagatgaagggaaaagggcaataatactataaagggaaagagaggtggggagtggcaggagacaaggtgtacaaaacataggttaacatagcaggcctgagacggctacccttaaaaagttctgcttgcaagattggctcttggttacagtctgggatttcaggagggtgcccaccatgactggataagaatggctcactgtgcctaaactatttgagaaaataatgtgctttatgatgaatacctgctctacttttgggagtctggaattttggtacatgctagatagagggtgcctttatgaacggtacccagtaaaaaccttcaacattgagtctctaatgagcttccctgatagacatttcacatatgttgtcacaatttgttgctaaaggaatagagtgtgtcctgtgtgactccactaggaaaggattcttggaagcctgtgcctggtttcctccacactttgcccatgcacctattccctttgctgagtttatcttgtatcttttcactgtaataaatcacagtcatgagtaattgagtcataattaaatgctgagttctcagcccttctagaaaatcataaaacctggggatggtcttgaggacttcccccaacacaatggcataggagtagagggaaaagagaagggaaaatgggcaaggagagaggaaagagtagacacataaaggagggagggtaaaaagggaaagagaagagggaaggcagaagagcctggggtagaagggtaaggacaaaaagcaagccctggtgtcttttaaaatcacctttccaatctcttttttatataaaagcattgcttactggttattaatagctagcattcacttggcttagttcgtttccatgccaaactgattgttaaatattttatcagtctcttgcttcttctatggcacatgcttgcccaaatttcctatttaatttcagtttttaccttttatttttgttttaatgttttaaatggcttttataggatgtatattatatgtatgtatatctatgtatgcattttttccttttttttcttttttttttttttttttttgagacggagtctcactctgtcacccaggctggagtgctgtggtgcaatctcggctcactgcaacctccaactcccaggttcaagtgattctcctgcctcagccacctgagtagctgggattataggcatctgccaccacacctggctaatttttgtatttttagtagagatggggtttcaccatgttggccaggctggtctcaaactcctgactgcaggtgattcacctccttggcctcccaaagtgctgggattacaggtgtgagccaccatgcccagcccctgtattttctatctactatatattacttagtttttgttttacttttttgaatttttagaattttttatttatcaataggttttggggggaacaggtggtgtttggttacataagttcttcagtggtgatttctgagattttggggtacccatcacccaagcagtacatactgtacccaatgtgcagtcttttaaccttcaccccacttccaccctttcccccgagtccccaaagtccactgtatcattcttatgcctttgtgtcctccatagctcagctcccacttatgagtgagaacatacaatatttggttttccattcctgagtttcttcacttacaatatggtctccaattccacccaggtcactgtaaaagccatgatttcattcctttttatggctgagtagtattccatgatacacacacacacacacacaaccacattttctttatccacttgttgattgatatgcatttgggctggttctatatttttgcacttgcgaattgtgctgttataaacatgcatgtgtgagtatcttttttgtataatgacttctcttctactaggtggatacccgggagtgggaatgctggatcaaatggtagtactacttttagttctttaaggaatctccacactgttttccatagtggtggtactagttgacattcccactggcagtggaaaagtgttcccttttcaccatatccatgccaacatctactatattttgattttttgattatggtcattcttgcaggactaaggtaatatcacattgtggttttgatttgcacatctctaatcactagtgatgttgagcattttgtcatatttgttggccatttgtatatcttcttttgagaactgtctatccatgtcagcccactttttgttgggattgtttatctttttcttgatttgagttccttgaatattctggatattagtcctctgttggatgtataggttgtgaagattttcttccactctgtgggttgtctgtttactctgctgattatttcttttgctgtgcagtttaattaagacctatctatttatctttgtttttgtcgtgtttgcttttcggttcttggtcatgaagtctttgcctaggccaatgtctagaagggttttatcaatgttatcttctagaatttttatggcttcaggtcttagatttaagtctctgatccatcttgagttgatttttgtagaaggtgagagatgaagatccattttcattttcctccatgtggcttgccaattgtcccaggactatttgttgaatagggtgtcctttccccactttaggtttttgtttgctttgctgaagatcagctagctgtaagtatttggctctacttgtgggttctccactctgttccgttggtctatatgcctatttttattaccactagcatgctgttttggtgactatggccttatagtatagtttgaagaagggtaaggtgatgcctccagatttgttctttttgcttagtcttgttttggctatgcaggctcttttttcctagttctgtgaagaatgatggtggtatttgatggaagttgcattgaatttgtagattgtttttggcagtatggttattttcgcaatattgattctacccatccaaatgtagaatttagctgtgtttccatttgtttgtgtcatccatgatttctttcagcagtgttttgtcttgtagaggtcttttacctccctggctaggtatattcctaagtattttatttttcttttttgaagctattataaaaggggttgagtttttgatttgatcctcagcttggtcactgttggtgtatagcagagctactgacttgtgtatgttaattttgtatcctgaaacttcgctgaattcatttaccagttctaggagctttttggatgagtctttagggttttctaggtatacaatcatgttatcagtaaacagcaacagttttacttcctctttactgatttgggtgtccttgatttctttctcttgtctgattgctctggctgggacttccagcactatgttgaatagaagtggtgaaagtgggcatccttgtcttgtttcagttctcagggggaatgcttcccaacttttcccctttcagtataatgttggctgtgggtttgctatagatggcttttattaccttaaggtatgtcacttctatgctgattttgctgagggttttaatcataatgggatgctggattttgtcagatgctttttctgcatctattgagataatcatctgatttttgtttttaattctgtttgtgtggtgtatcacctttatggacttgcatatgttaaaccatccctgcattcctggtatgaaacccacttgatcatggtggattatattttttatatgctgctggatttggttagcaagtattttgttgggggtttttgcatctatgttcatcagggatgttggtctgcggttgtctttgttctttcctggttttggtattagcatgatattggcttcacaggaggatttagggaggaatccctctttatcttttggaacagtgtcaataggattgatacaaattcttctttgaatgtctgatataattcagctgtgagtctgtacctaaactttttttggtaacttttttattaccatttcaatctcattgcttgttgctggtctgtccagggtttctattttttcctggtttaatctaggagggttgcgtatttccaggaatttattcatctcctctaagttttctagtttatgtgcataaagatgttgatagtagccttgaatgatcttttgtatttctgtagtaagggttgtaatatctcccattttgtttctaattgaatttaccagatcttctctcttcttttgttggttaatctagctaatggtctatcaattttatttatcttttgaaagaaccagctttttgttgcatttatcttttgtgttttgttgttgttgtcctttcaatttcatttatttctgctctgatcttggttattttttttcttctgttgggtttgggtttggtttgctgtttctccagttccttgaggtatgcccttagattgtctgtctgtgctgtttcagacttcctgaggtatgcatttaatgatatgaactttcatcttagcaccacttttgctgtatcccagaggttttgacaggttgtgtcactattatcattcagttcaaagaattttttaatttccatcttgatgtcaggtattctatgtcaattttttgtatttatgtgaatccttttcccctaaggtgtgtgatcctttgggggtgttaaacaaccttgttttatcatattaccagaattgtttttctgattacttctcatttgggtagactatgtcagagggaagatctgggactcaagggctgctctgcagattcttttgtcccacgaggtgctcccttgatttggtgctctcctccttcccctaaggttggggcttcctgagagccaaactgcagtgattgttatttctcttttggatctagccaaccagcagagctactggggtctggttggtacagggcagtttctgcaaagagtcctgtgatgtgatctgtcttcaggtctctcagccgtggataccagcaccggcaaccgtagaggcagcaggggagtgaagtggcctctatgagggcccttggttgtatttttgttaaatgtactggttttgtgttggttggcctccagccaggaggtggcactttcaagagggcatcagctgcagtagtatagaaaggatacatgcttgccctagggttaggtggtgggcaggccgatagagctcccaggagattatgtcttttgtcttcagctaccagggcaggtagagaaaaaccatcaggtgggagcagggttaggcatgtctgagctcagatctccttgggtgaggcttgccgctgctgctgtggtagatgggggcatggttcccaggccaatggagttatgttcccagggggattatggctgcctctgctgtgtcacacaggtcaccaaggaagttggggaaggccggcagccaaaggcttcacccagctcccatgcaacctacagcctaaagggctggtttcactcccactgcgcccctacaacagctctgagtttatttccagcagggctgaggacttgccccaggctttaagccacccagctgagaaagccagccaactcacagttccttggctgtcccacagtgcctgcagcggcaatccacttccttcaaagggtctgtggatcctctccgctttcctggagcgttcctgtggtagttcttatagcaaaagttcacgatatgcatctccatacactgctctgtccatctgagtgggagctgccaagttagtcctgcctcctatacaccatttcctctcattctcctctgttttagtgtcttaagatggctacatattctttttgttcaatgagttaatatgtatgcgtgtgtgtgtgtgtgtatacatacatacatacatacatacatatatatatatatatatatatatatatatatatatattttattttttttttttttaggttacgaagtttcattgaatataagtttctctgggtcccctaagttgtagaagtggttattctccttttccttgatttccaacttgtaacttcaattttcatttcatctttgattctggagttttctgaaatgtaattatgaatttccaaaacatgaggtggtggtgatgttaccatgaattatttccagtttctataccttatgatcaaagaatgtggcctgtaagatagctacctttttgaattttttttttttttttttttttgagacggagtctcgctctgtcgccaggctggagtgcagtgacactatgtcggctcactgcaacctctgtctccagagttcaagcgattctcctgcctcagccccccgagtagctgggattacaggcgtgtgccaccacacccggctaatttttgtatttttagtagagacggggtttcaccatgttggccacgctggtctcgaactcctgacctcaggtgatccacctgtctcggcctcccaaagtgctgggattacaggcgtgagccacagcgcccggctgaatttgttaaagtttgcttagtggccaagaacaattttggtaaatgtaccactgacttacaaaaagtatgtacgttctccacttaagggatgtaaagtcatgtatctactaaatctagtttgttgtttcttcatttcctccatatatatgtagctttatataatgtccttctttaaaatgtttggtgcttttaaccttaaatcttaccttacctaatattcgtagtgatgtccacattttgtttacagttgtctgatctctctttatcctttaactttttaactattcaagaattttgtaaagtattttaaaatattttaacttaatgtatttatgagaaacagcttttagctttatttgttttaaaaattaatctgataatatatgcttcttaatggaagaaatcagcctgttcacctttgttatgacatctgatatacttggtattattccttctttacttaatgtcatggtttcttcttttacctttacttttgctagtttaatgaagttgctattcatttccatcttgtcaattgagaagtgtctaaaaaaaatttcgcagccatattatatatttccagcttgtttattattatatatttacatttaatcatacacatactgcaaggttcataggtttcctctcctcttcatctttaatgttccttcggatttcattcaaatacatttggtttttgattaacgttctttcctaatttttttcctgaagggaaattgggtaaaatatttctatggaccttagcacaaagatatttcttctgatagactggtttgtttggattccccggttgcaatacttcttttttttaatttttagataacttttagttgctttttgagacagagtctcgctctgtcacccaggctggagggtggcacagtctcagttcactgcaacctccaccaagagatcctcgtgcctcagccacgtgagtagctgggattacaggcacctgccaccgcacccggagcacgcccggctgatttttggatttttagtagagatggggttttgccatgttgcccaggctggtctcgaacacctgagctcaagtgatccacctgccttggcctcccaaagtgctgggattacaggctgcaatacttctttcttgttagtaggtatcattccagtgttttctagtctctagaactactgatgagatgttttacctttatgaatggtaaattctttaccattagaagcttttaataatattttcttcattgctagataaatttactaggtatacatacttttatgtcttttttatcaatcttgtctggacttcagtgagccctttgagtctatgaatccagatcttttgcaattctttttctttattactatttgttttgttctccctctggaactattattgtctgctagatcttttgaatctaccctcctaatctcttatcattttcattactggtcttttaattcttgttttatgagttgtgatatttaatttgataatttcattcattattcaatacttcagttctgggtaatactactataaaaactaaacaaaatgcagagacagctacttgaggactctgaaaagtaaacagccacagacaatcccatgacagaaatggctatggctacgcatagtggcctgcagaagccagaactctgaggaagggaaattgttttctctgttcatcagagtcccgatcccaagagggtagggacaatccctgttgtttattgcctctcttctcacttctgagcccagacttgggcctaaacttggaagcgtatggcagaacagggtaactgaaccctaaagtttctggctagatggccaaaacagggagtcccagagaactgggaagcatccaggagatcacagagaagaaggagctcaggaaagtgatcccataaagttgtttataaactccagaactcatccctgagtgaggcatgcatagatctaaccctgagtcgtatacaaaggattttgaaaattgagctaatcactcaggtcacagtctgaccattgaatggcatacacctggggaagatctgaagagactttgaaaactgagctaacattaaaactacagtccataagtaggtaggttcttgtagcctgaacctaatcttgctaattaaatgttaaaacaaaaatatcaacattcttcataggatcaaaacaagacccagagtattcaaaatgtccaggatgcaaatccaaaatttccctgcatataaagaaccgtgaaaatttcaacttgcatgggaaaagacaaacaaaacaagccaaagctgagatgacacaagtgttgagattatctgataaagacttcaaggcaaccattgtaaaatgcttgaacttgagcaacactggcatggtggcccgagcctgtaatcccagtgactcttgtgaagctgaggcagggggactgcttcagcctaggagttcaggaccagcctgggcaaaacagtgaggcctcatctctaaaaataaaaaaaaagcttgagtaagccattgtgcacacacttgaaacagatgttaaaacagaaagtctcagcaaagaaatagaagacataaataaaagccaaatggaaattttagttttcaatataaaattattttaacttaatgtattcactaacagattggagatggcagaggaaaaaatctgtgaacttgaagatagatccattaaaattatacaatctaacaatatagaggaaaaaagatcgaagggaaaaagaacaaagccttagggatcagaggaacaattataaaaggactaacatttttgtcattggaggtctagaaggagaagagaaagagtgtagtgttgaaaaaacattggaaaaaatggctggaaagttcccaagtttatggaaagatataagtctacaagttcaagaagcagaatgaaccctaactaggataaatccaaagagatctgcaaccagacacatcataattaaactgctgaaaactaaagacgaagtcttcaaagcaaccagagaaaaatgataaattacctataggaaaacaatgatttgaatggctgcagattccttttcagaaaccattagacctactctaaaaaaattgataaactatattcttcagagacaagaaaaagatataagaaggaaatttgaggcatcaggaataaagagacagcaacagaaataactatctggttaaatataatggctacttttttccttaaaatatgattgatggttggaaaaaattataatgtctgatagagtatataatgtatgtaaatataaaatataagacaacaatatatatatggtgcaggggaaagggtgataaggtttctatatgccaaatgaagcagtaaaacaatgaaatgatccgaagtagacaacgaaaagtaagtattttataattcctagagcagccactaaagaattatacaaaaagatatagtcaaaaccatagtatataaaatagaatactaaataatgttcaaacagtcaaatgaaagcaggaaaggggaaacataaatatggagcagctagcactctcacctattagtggtgggactggaaaatgcttttggaaaactgtcagtttcttaaaaagtaaaggatttatctagtagctccactgttatgcattaacttcagagaaataaaagcatatgttcatacaatgactcatacatgaattttcagagcagctgtaaatgtattagtcctgaactggaaacaactcagatgtccatcgacaagtgactagataaactgtggtatatctgcacagtgggatactccacagcaaaaaaaaggaattgatacatgcaataacatggagaaatttcaaaataatgtaattatgctgagtgaaagaagccagacaaaaaagattccatttatataaaatactagatatgcaaactaatctatagtgacctaaagcagattagtagtttctagagaaggaagagggtaaagcagagaaagaagggagacagggattataaatgaccgtcaaaaattttttagggttatggatgttctcttgattatggtaatggtttcaaaagtaaatatatgtcaaaattcatcaaattgtatattctcatttaatgtgcagggtattgcatgtcaattatacctcaataaagttgtaaaatgtttttttagagggtgtaaactgtgaacactgcatatcagtgttcatccttttgctcttacatgatgacaaggaagaacagtagacatctcctatgaataaaatggaactatataattgtttaagcaaaaacatcacttaatgatggaaatatttttaaaaaaattttaggctgtgtggtagctcgcacatataatcccggcactttaggaggcaaaggcaggaggatcacttcagcccaggagttcaagaccagaatgggaaacatagggagaccccatctctacgaaaaatttaaaaattagctaggtgtgtgggcacatgtctgtggtcccagctacttaggaggatgagatgggaggatcatttgagcctggaaagtcgaggctgcagtgagctgtaactgcaccactgcattccagcctgggtgacagagcaagaccctgcctcaaaaaaaaaatatttttttaatttttaaatactttatttgtcttaaacgtataagcaatcctcacttggcacagtctgatatgaatttcagttaccacagtttattaaccgtgagaaatagcataaaagtttgctactagcttttcagttcacaaatcattacataaataacatatgaatcaaaattgaccaatttgcaattttacttctttcaaagtctatgggtgattggtcactgtgcatctgttattcagttcacacacaggctgcaaagcatggaggtttgttattaatatttctgtgcccttgagataaacccacatggaattttacagattaaaagaggaaattggccaaaagaatgaaagtgcactaaagaagagtgataatactagaagtgaaacttgcattaaacataaatggagcaaatgaaaaaaaagctgcctgtgggaacatgctgattgtggcaacaatgacactgccgccatttgagacattctagatatgcagactgaggaaatcagtgaaggtgaacttatagacataaatgaggaaaagtgattgtgatgaaaggctgatgatgtgtcagaggaagtgacactggcaaaaaaaacacattaaaggaactctcagagatatttcacaacattgaaaacgtaatggataaaatgttggaaactaatatttaaatttctccagaacgcagaactcataagcaactgtgttctccaagtaaatatcttcacaggttcctcaattaatgtgggcaaaattaaaagtacaacttgcttcttccctttggaaaaccctctctcagagtatattaccaacattcaacttcttatacaaggcatagatctgggaatcattattcattcttctctttttgtcattcacgtatccactcaatttccatggcctgttgattctatttctcagacgttgttcaaatctctccactatctttattctacttggcaactctgtggcccaggcttccaacaactctctcccggacaagtgtaatcacaacagttacctaacttggctcccactcttgttctcagttgcaacccattctccaagcagaaaacaaaatgcaatagctgttaccttattctcatcttcacacctctactcaagtacacaaggctcttcctcatctagtttctgtctacttcatctcttgtcaatggtccctaccccaattctccgctctagtcattctgaactttgttcaattcctggcctgtgtcctctgcctttaataggctgcctggcacactgtaggaattcactaaatatgcagactgaatgaatgaacgagtccgtggagggcagttattctttggagtaacttaagagagaaggaatacagtacaacgaagtattcttatttaggtttatagtgtcttcacctgagcccgcgggggaaccccccccccacccccggggaaccccccccacccccgccgccccccgcctgcaagttgttaccagtaaataaaagggatcctattttagcaagccacacagcattagagggcaaataatagtttggtggcaggagagcgatgagacgggaaagtgtggggcaaagcttacagtcattggtccagattctaactggcctgttagccaaaaagtaaggttttctttacctccgtgttgactctgctctccgaaggcgaagagggtcctccaaacccgtttggcgtgcggacaaaaaccccagcatatcgtgtcctcacaccggctggagcactggacgtcgccatgacagagctcaggggcgggactggaacagc

SEQ ID NO: 89 - DNA, 85059 bp, Homo Sapiens
cttgaataagcgttactttattctacatgcttttaggacaatttccagtggcattaagtgtttgtgtctctctgtatgagaggaaggtgtttattttttgttacaattttcactagttatagctaattcctaggacagtgggtccacagggcccttcacattgccattctggaagtgaaaatctaaaagatatttcaatgttagaaaatttaactgtgtactttactacaccaagaaaagctatacaattatatcaatatataccagaaaagactttgaggacaatcattctaccatttgtgataatcaattatgataccacaatgataaaaacagtgggttactaagcaaagttagataaatggaccaatttaacagaatgcagagccaagaaacatttccgtacattatatgtaaattggtaaaggtggccttatacatcaggaggaaaataataaactattttttaaaggtgctagggaaactagctatccatatgggattaataattcataagaatgtattcatgaccctagctagggaatggttcttaaataaacaaaaaaaaatggaaagactgaatttactatattttaaaacttccgtatgataaacatcacaaaatagatatgtgaatatgctaattctccatatttttatgtaagttaaaagactcacaaccaaaactaaaaatctataaaacacctaggaataagcctattatgaaatgtgcaagacatttatgaagaaagttattaaaatttcatccaagaatataaaagactttaataaaatgaggcctatcataacactaatcagaaacattatattaattataaagaggtctattattctcaaattaatgtgtaaacaaatgcaatcctagtcaaaagaacaccacaattttactggaatttaataaactaattcttgattcagctggaacagaaaacacccaagtataagacactgaagagggggagaaaggaaaaggaacttgcccatgaatggcaaaacacaatgcaaagcaccaaatgacagcgtgaggagtgtggttggtagaaccaacacctggatccacaggacagaaatagacaacttagcatgtgatgagttgaaagctgacattttaaactggtggagaaaagaatatttgttgatcattggaataactgcctttttgtttttgtttaggggagcaatcctaaaagataaacaacccacaggaaaactaggccaacataacactaataggcaatgtacggtagagatctacaaatggccaataaacatggaaatgtttgattttgtacgtaatcagggaaattcaagtgaaaacaaggtactttcaatcacgagactggttaaaacaaaacaaaacaacctatcgatattgataccacttactgttggcaagggtttggagaaatgggtccttttatggagggtgaattgatgcaagcaattctgctacatccactgacatttaaaatctacatcattaatccaacaattctgtgcaggcagagctatacttacaggaatagaaatgtcttgcatataatattaaatgaaaagttagttgcaaaataaggatggtataaggccattaatataaattacatatttaaagcaaactaattgctataatagacttcaaaagacagtagcttaagcaagtcagtattttattttactcttaaataacaggtcaaaggagagcagttcaagactggcaggccaacttctccttcctcaacacatcacttccatctcttgagatgccaggtcactactgaagctcccattggcctcccagccagcaagaaaggggaatgtcaaggagagtgcataccctgcttctttaaagggccaattgggaagtttaaaacttagtcatatggccacaattaactataagagaggctgagaagtagtcttaagctgagcagccagacgtccaggtaaaactcaaaaattttattagtaaaggaagaatgggaaaatgacattatagcagcagtctgtgtcatgtgattctctaaatgcatggagaatacacaccaaacctagggctgtacttagctgtggaacaggtgcaagatggtgtgggggtggggaggcagactattgcttgaacatttttaatggtgatagtattaacatttaattttttgacaaaattttaaaatcctttatttgtgctgataaagcatgttaaatacattaaatctatttacactgtacaaagcttttaaagttctaaaaatcagatttttatctaaatgaataaatttctctgtattgttaaaaccattctacttaactgcattgttctccaagtccctccagccaggaggcacggtaacaatgtgtcagatctccacactgagacaccaccttcccaagatcatggtacatcagcagcagaactgagacaaaaactggaacaaggaccaccttgctcctactgcattatagcttttgatagtatttgctacttgaagaggaggctataccttgtctagctcaatacagtttatgtttcagacactataagtatgatacccaaatgcttcatgagtgaacaaggtcagcagatcaccctgagaacaaggaagacacaatttccttataggctaatgattataaaaatagaaattaagagctccccagaaacaaaccacttagtcaaaaaggaaggagttttgactttcttctaagccaagtactcaagtttaagacttattggcctatttaaaaattctttctatgacttctaaacaatgatggcaaagtgacaaaaataatgtaatcatcttcttccctcattatatataaaccaaactaaaaacaaaagaaatgaacaagctataatccaaaaaaaactagaaaatcctgacaggaatcatatagaacatctctaagaaaaggattcttggcttaagcaaaatattagagcagagaaagcaaaactcatgtcctctcatgcagtccggcaaggcccccctgcccagaaccctcctctctgagtcacatggatgagcagacagaagatctggacacagctatccatgttaagcatgagagagatgtaaagaaatagcagggtaggagggcaggcatactacagaaaaatgagagagaggaaaagagcatgccagagaatacaaatccaagaaacaaactgcactaagacagctaagaagaaatttcaggaatacgatgaatttcggaaaacaacacttcaaagatgagatgataaaatcatcctgagaaggaaacaagaaaaacatgggtaagaaaataaactgaggatcaaagcaacaccatcacagaaccacaaacacataaacagtagtgagatacaaacagccttggctggaatccaaaccgcagaaacaagaaagcccgtcgcaaggaatgcaaaggcaggcgcaagacgaaggcaactggagagaagacagcctgccagcctgcagacaagagaggcctggagtggtgtcacttcatggtaacaacggctgggtctgctgtgggctgcagtgatgtttgtgtgcatgcatgtgtgtggtttttatgtacctacttttggctttaatttgattttttttaatgataacacattttgtgactgtaggagagaaaaagatgccctctgcttaaaggaaagccagggtaaactgaataccctacagctttccacaaatacatgtcttatcatttattaccatactatttcatgctttactaataaaaatactcaccaatttaccagtaccttgaaaagaggatctttccaagaaaattaatataattatcaaacaacaaataacaaacctgacctttgtgggtggcaaatggtaaatataaatgtttaaagtttaagcatcaaaataatgctgttatcagatattgatgaacttattgaacaggtctgactgaatgtaagacctgtttttagcaccaataaaaaaaaatattgagatttctgttctgcaaacttctaactgtgctccctgacagcatcttttgggtaaaggaacaaatgtgctccaaggagtaactgttaggtacctgatttacaatataattagattgccaaaaaaaaaaaaatcaatccaagtattttctcctttagctagcattattaaaacttttaactttcagagaagagtttcttcttccttaaagttttaattctgaggtagacatcatgcaaacaaacatcaagtgcagccaacttccattgacaaacatgattattaataataaattaataatcagaaatgcccgttagaaaaagggacttgaaagtttaggaagcaatgttgtttagcagtattctggcttgagtttccaaattccttcaccaccagaagttctatggaaagtgcacagatttctcaatagttctcggaagacacaagactgtgatgcagataacttggattcaaactcctgcagtatctccctggtgctggcctggccatcagtgtgggcctggaaagcgatgaagtttctcatctccaccagaaggtcatcgtgttctgtggtgggcagcagggcagaagcttcctgcaggtgcccgctttcactttctaaacgctctggcagaatcaggtggtttctagctctcattttagccaagagtgaggaggaagcgaggggcccggatgaagagtctgcatcttctgctcttccactaaaatgctcagggacattatcttttccctcctttttcatgatgccatcctataaaaagaagaccactatactgatatatttaatttctagtttatgcccccacttccttccccaaaggctgtgaagggtcacaagacaacacatgtgccagggtggtgaggttgacagggtgagactgagactccacctaatgaaaagggaaaggaggagggtctggtatctaaatcctcccactgttaagagaccgtttcctaaaaaaaaataaagagggggcaaccaagccattcccttagtcaccaccactcaacatggtggtggacaggaaggcagagtggaggcttccaggcaaggtttcaggaaaatctgtctctaggaggcccaggaccactttcagtacctgtgggcttttcctgttcttcctctcaaatggaccctgtacactgtggataaggaacaatatcatagctatacttccttttcttcacttttaagtcttcttactctttcctaccttacatctaatgcaacttgccttaaaaaaacacaaatctaactctgaaagggtctcaaatccctactgctaaaagcacagaacatgggaagtcaaaaaggtactagtattcctaaacatgttcacattaacttaaaattggagtctgaatctgggagttttaacataatccttaatcagaaagaccagaaagacttccactgaatggtggaatctggactagttttaaccacagtagcactcaaggcaagcagggcattcttgagcagagaaagacaggcactctgctctagcagccagtgagttacagacaccaacattcaaggcagttttctggacttttatttcagagggttgtggtctctggagctggcactttccctctagacaaggcaggctgtcctagcagcgacacacctatccctgtgtcaaccttctaatggcaaaacagaaatgctgctacggatcttgggttaaagactttgtctttaggaaatcagcaggtccttttagattcaagtgaatgtgcatcgtaaatcagagcgtgcaacacaaatatcaggtgtcattacaccagagatgaccattttcttcacatccagaatcaggtgaaattttcacagcattcaatcaagcaagtctcaccctggaaagcaaaaaggttatctatattacctggcacttctctgttggagatgttgatgaaggatgctgcacagagaagttagaattccttttcttaccaaatctactcctaaaaaaggaaaagcatcacagtagattaaatgtttgcttttgagacttagagatcaaaatattctttcaacaatgaacttcttcctggaaacatttccatctgcatgcttattctttcacagccatgccatttctgctctatccccctcgattcttccactccaccctcctagaaagtaactgctggctgggcgcagtggctcatgcctgtaatcccaacactttgggaggctgaggcaggcagatcacttgaggtcaggaggtcgagactagcctggccaacatggtgaaatcccgtctctactaaaaatacaaaaattagcctggcatggtggcgggagcctgtaatcccagctactcaggaagcagagaatgcagtgggccaagatcacaccactgcactccagcccgggcgaaagggcgagactccatctctaaaaaaagaaaaaaaaaaaggaactgctgcatctcagaatgagaaccactcagtatcttgttcaaaagatgatgggaaccattctcaattccaagtaggaaaatcattctaaaagagcatactgaatagcaaagtaattaatgtgtgctgtaaactggctaattatctcattaaggtttaatcattatcctgtatctcttactatttttaacaacaccatctctcaaataaaaccaatcacttctcctgaagccactttggaaaacaggggatgaaagcaaggaggaaggcaaagttataacagtatttctccaagtcacccagattttgctgctataatccctccctggggatttattcctgaagagaaataacagtataagcctccacacctgccctgattttatttctagccttagttgtttggactccttgcaagtatggcatgcagcaatctcttacttttttcctgctggtgcaccagaaatccccctgtggccagtccaggtgggaacaccagacactgctcccagacaccgctgacgagagagcctcagtgctttcagggcatcctgggccactcggttggcttctgcctccaccagtacataatctgggctggctccatccatgatggcatcgtgcttcatgacactgtgcacgccaactagcaagaaaagaaatagcaaagtgatatttcactctgtatgcaagaaagacacttttctcctctgtataagtacagtactgtagtagacaaaaacaaagtgatagtacacttagaaaaccctagagaatcaatgataaaaaatagtaagataattcaagcaacataaaaaatataaaattcacacacagaaacctataaccttcctatttacaaacaatagccagctaaaaatataatggtgggaaaattctatttacagtaacagaaaagaccaaacacttaggaataaacccaagcaatgtgtaaagcctatatggagaagacatgaaaacactcctgggaagatagactatcagacttaaacaaacagaaagacatcccttgcatttgagtagaatgactcaataaccattttccctgagttaatttatatgtttaatgtaatctcaataaaaatgtcaacctttcttatgaagctagacaaactgacactaaagttcatacagaacaataaaccttcatgaacagatcagaaaacactgaaaaggcaaagtaacaccctattggacaataaaacacgctccaattacaacagtttggtgctgaggaaagaagagacacaacaggagattgaccagaaaatagaaatagattgaactgcatttggaaatgtactacatgataaaggcatctctaatcactgagaaaaacttatttgaaataaatgatgctacaaacgttggggcacaaacgttggggcattttatctttgaaccaagataaaatccacacctcatactccaaatggatcagaaatctgaatgtaaaaagcaaaaccatacaagtagtacaagaaaacatggcgaattatcatatgatctatatgtagaaaaggcttagaactacaattccaattaataaaagactgacaatttttttaaaaaaaaacctgtttcataggaaaaaaatcataataaaggacaaccaatgaggaaatacttgtaacatatatgaaaaatgaaaagctaacatccctaatatataaagaactctttaaaaccaaggggaaaaagggaccaaaaacctgatttagaaaatggacaaaagacatgaacagacaagttcacagaaagaaaaattttttaaatataaatggtcctataaaaagttcaatttcactcaaagaaaataactggaaattaaaacttaagatatcctttctcacctatcagattgggaaaaattaaaagtgtaacaccacactcttgacaagcctctgggcaacaactgctcgtgacaattcaaattgatctaaaccttacaaaagggagttgggcattattcaaacaaacaaacaaaacaaacttacatatgtgtttaccttttgatctagcaattcctcttgtataagcacaggattatttagtgcagcactgtggctaaaagaagctataaaaaatctaaatcctcatatgtggataaactgtggtacaggttgaatatctcttacccaaaattcttgggaccagaagtgcttcagattttgcctttttcagattttggaataattgcatatacctaatgagacatcttggggatgggccccaagtctaaacacaaaatgtatatatttttaacatacaccttacacacatagcctgaaggtaattttaatataatacgtttatcaattttgtgcaggaaacaaagtgttaattgtgttttgactgtgacccatcacatgaagtcaggtgtggaattttccacatctggcatcatgtcagtgcacaaaaagttttggattttagagcattttagatttcaggttttgggtcaacatagcagagcactctagcaataaaaattgctaaaggaggaatagctctctgttaattaatactgcagtggctgtcaggatatatgaagtttttttaaaaaaaggaacagaagataatatagtatacaaccttttgtgtaagagaataagggaatataaaattatacatgtgcctgcttatttctacaaaagaaacatatagttcagctgtgtccccacccaaatctcatcttgaattgtaactcccacaattcccacgtgacatgggaggaacccagtgggaggtgattaattatgaagatgcgtctttcctacactgttctcatgagtgaatgagtttcatgagatctcatggttttaaaaatgggagttttcctgcataagctctctttgcctgctgccgtccatgtaagatgtgacttgctcctccttgccttctgacatgactgtgaggcctccacagccacacagaactgtaagttgattaaacctctttcttttgtaaattgcccagtcttgggtaatgtctttatcagcagcataaaaatgcactaataaaggcaactggtaccagtggggaggtgcgctcctgaaaagatatcccaaaatgtggaagcaactttggaactgggtaacaggtagagatgggaacagtttggagggctcagaagacgagaggaaaatgtgggaaggtttgcaacttcctagagacttcttgaatagctttgacaaaaatgttgatagtgatatgaacagtaaggtccaaactgaggtggtctcagacggagatgaggaacttgttgggaattggagcaaaggtgactcttgttatgttttagcaaagagacaggcggcattttgcccctgccctagagatctgtggaactttgaacttgagagagatgatttagggtatctggcggaagaaatttctaagcagcaaagcattcaacaggtgacatgggtgttgttaaaggcattcagttttataagggaagcagtgcataaaagtttggacaatttgcagccttacaatgtgataggaaagaaaaccccattttctcaagagaaattcaagctggctgcagaaatttgcattacgtaacgaggagccaaatgttaatccccaagacaatgaggaaaatgtctgcagggcatatcagagaccttcatggcaacccctcccatcacaggcccagaggcccagggggaaaaagtggtttcacgggcctggcccatggtccccatgctgtgtgcagcctggggacttggtgtactgtgtcccagccactccagctgtggctgaaaggggccaacaaagagctcaggctgtggcttcagatggtgcaagccccaagccttgggagcttccacacagtgttgagcctgagggtgcacagaagtcaataactgaggtttgggaacttctgcctagatttcaaaagatgtatggaaactcctagatgcccaggcagaagtttgctgcaggggcagggttctcatggagaatctctcctagggcagtgcagaaggaaaatgttgggttggagtccccacacagagtccctactggggcaccacctagtggagctatgagaagagggccacggtcctccagaccccagaacagtagatccactgacagcttgcaccatgcacctggaaaggctgcagacactcaatgccacccatgaaagcagccaggaggggggctataccctgcaaagccaaaggggcagagctgcccaagaccataggaacccacctcttgcatcagcgtgacctggatgcgagacaaggagtcaaaggagatcattttggagctttaagatttgactgccctgctggacttcagacttgtgtggggcctatagcccctttgttttggtcaatttctcccatttggaatggctgtacttacccaatgcctgtaaccctattgtatctaggaagtaactaacttgcttttgattttacaggctcataggcagaagagacttgcctggtcttggatgagactctggactgtggacttttgagttaatgctgaaatgagttgagactttaggggactgttgggaaggcatgattggttttaaaatgtgaagatatgagatatgggaggggccagaggtggaaagatatggtttggctatgtcccagccaaatctcatcttgaattgtaactcccacaattcccacatgtcatgggaggaatctggtgggaggtgactgaattatggggttgggtctttcctgtgctgttcttgtactagtgaatgagtcttatatgagatctgatggttttaaaaatgggaatttctctgcacaagctctttgcctgctgctatccatgaaagatgttacttgctcctccttgcatgattgtaaagcctccccagtcatgtggaattgtaagtcaattaaacctctttcttttgtaaattgcccagtctctggtatgtctttatcagcagtgtgaaaacagactaacacagaaacacatgaaggaaatgccagaaactcatgagactggtaaggtaaggaaggggtggggacagggtgggggatgacactactctggtattcctttttgcatattttgtcttttgttactatgttaatgtgttactactcagaagataacatagagtcaacaaggatgggaggaaaccctaaagtggaatacaaacaaataaattaacctaactgtattttaaactgatagcacacactgaaaatatgatgaagggtgagaaaaaagaactaagttatttttgactcaagtagtgttttgaccaaaaacttagactaaagacaaaaagaaataaaaacaaatattgaactttagttagtataaataaaaacaaatattgaattctagttagtataactgtttcttgccatagttcaggtcagaaattgtaaaaagctaccatgtatcctaggattgacaagtaactcagtacgttgtgaatgaaggtcttgaagaaggaagctacaaacatggaaagggccctagggtgctgaaatgaaattggagacaacagtattccctcatcttattttgctttttggagcttattagagtgtaactgatatgcaataactgctaaagtacagtatttggtaagttgtgacattatgtacataccatgaaactatcactacaatcaagacaatgaacatagccgtcacctgcaaaactcatgtccctttgtaatcccaccgtcaaataccccatgcccagacaaccaatccaatttctgtcatgactgtgtgttttctagaattttatgcaaacggcatcagagtatgtactaatcttactagtccgaaagtcatccatgctgtagcatgtatcaatactctacttccttttattgttgattagtatatatattttttgagacggagtcttgctctgtcgcacaggcaggagtacaatggtgtgatctcggctcactgcaacctccacttcccaggttcaagcgattctcccgctcagcttcccaagtagctgggattccagacacccaccatcatgcctaatttttgtatttttgtagagatggagtttcaccatgttgtccaggttggtctcgaactcctgacctcaggtgattcacccacctcggcctcccaaagtgctgggattacaggcgtgagccaagccccacctgtcgactagtatttgatcatatggatatgccatggttagtttaactatttacttgttggtagacatttgatttctacatttttggctattactaataaagctgctacgaatattcatgtacaagccttcgtatggacatatttttccatttctcttgggcaaatacacacccaggactgaaaaagctatatcacaaggaaagcgcatgcaactgccaaactgttttccaaagtgattgtgccattttacattcccaccaggcgtgtatgagacccaactgcttcacatctttaccaacacttagtatggtcagtcttctttcattttagccattctagagggtgtatagtggtatctcgttatggttctaattggcatttccctaataactaataatattaacaagtttcatatatttatttgccatctacatatctttcttggtgaagtctgttcaaattatttgtccatttaaaaaattgggttatacattttattattttttgacatggggtctcgctctgctgcccaggctggagtgcagtggcatgatcacagctcaccacagcctcaacctcccaggctcgagcaatcctcccagctcagcctcgcaagtagctgggaccacaggtgtatgctaccacacccggctatttttttttttattttttgtagagataggatctcactatgttgcccaggctggttttgaactcctaggctcaagcaatcaacccacctcagcctctcaaagcactgggattacaggctgagccaccacacccagccagtaattttttattgggttccagacattgtgaatttcatcttgttggatgttgggtatttgtatattcctgtaaacactcaggtagggctgaagcagtgctcactctaaggctgatcattccctactacagaggcaagaccccctactctgtatcatacccaatgccccatgaaatatttttccagtcttagctggtgggaacaggcactatccctggccatgggtgagcaccagacatgtttcctctaattcgaaaagttaaagaggaaaggccttttcactgaccttaagtagttttcttgcacaatgtgctggtcagtattcagctgagtgccagtggagactctgcagacctgtggggttctctccctgtgcagagctgtctccgctatcgtctcttgcatgtgaatgccagccaccctggcctcccctgatgctcagctctgccttttcaacagagggtctgcctggactcccatctgggttctccctctttctgttacagcacgaaaattctctcaaggcagtagggcagggcaactggagagctcagttcatttgtttcccatctctcaagagatcactgccctttggtgtctgaaaaccattgcttcatatgttttgtcattgttttcattgtttcacatggaagggtaaatgttaatctgcctttgctggaagccaaattcatggttttcacagacatagagacaggtgtatctgtgcaatttgttgtgcatatatatgcacgtatgtatgtgtatatgtatgtacacaacaaacacatacacacacatacatacatctatttcctgatactattggctacgaaagcaatgacataatagcagcaatgaacactctgagaacccggatcctagttcctaaataccattctccagggttccttgaagaaatggctgattccagggctggcacagaatacaaattgagctcagcatatattagtatgccaagaagaaaggaggtgctcaaagaatggtggggacataccagagggacaaaggagccagcttgaaggagctcccacccatgaggcaaatctaagacaatacgagcatcataatacccctactaatggattacagtcatggaaaaaaaaagaatccattagtccacactgatctaaaaataaattaataaataaataagagagaaggaaaaccttccttacaatagaatgttaatcaccatttggcaaccattgtagtaataactgactgaggaaagaatcatcaatagatattaaaactagtggataaaagtttgatgagaaacaggatatttacacagtctcaaagcatattccttgaaagcacaaattaattacaaaggtaaaaatattaaccttagcattgagaaacctggcagactccaccttaaccaagtgatcttaaaaatcaacttgtaataggtcaaaccagcatgtgtctcctgatagatgcactgagtaagatacggtatcacctctgtggcattcctaccaaaaaaaaaatgtatgcatagatgggtgtgtgtgtgaatgataaagcaaaagctgaaaaatgttaataacttagataaaggatataggagagttcttcgtattattccaactgatttttttttgagacccaactgatttaagtttgaaattacttcaaaatatgaaattaacaaaaaaattaaccatgctaaataaaagtctttctgaaatgctacacataaacctgccttcttaaactgagtaccataagcagcaatctttggtaactcaaggccatcacattgtgaacacagtgactgctaagggatcactaagcagggctatctatatactccatggtcttgagcaattgttgagtctacatctcctaacttttctcccttgacataagctatcagctttcatacttctagaatgtctgtctctagccacacgcttgtccctctcccttatgatgttactttaatctcctgtggttggaaaatcagattaatgtagcatatagcatgtaaagtaactgcctactaatgttcaggtagtacacatcgatttaagaattgcacacctcccatgagtggccataagtactattgttttccaaagtttcaaattattctaggtcttcagaaaagaggtgtaaatacgatttttaaaatgtcaatatatttcaaatctaaatttttgaagaaaaacactaatggctgacagccctctatgcaccatcagttaaagactgctactgctagaaacagcctactcattttctaatcctagcatccctgtggcaaacgtatcaaatggattacctgattttttgaaaagcttttccaaaacataatcgtcattgctctgttccttggcctcactcttgttttcactgtcttgcttctggtaacgccttttcttcaccaggtgtggaattcgagttccttcaaacttggcgtctctgcaatgcttagagttcttaggcttttgctttggtctcagatgtttctccagggtctcttcttctgccacactatgatgttttgtttttgacttgtgcttataaaaattattttccatttgtttattctcccaaaaagcttctgtttgagcctggctgggtctttctcttttgtaagaaagacctaacttttcatcaatgctttcatcaccagatggcatagaagttttgcctgttcctgaagaatttgaacattccccatttccactaatcactgacaactcttctggtccagatactgcatttgtctcttctccaagcctatcattgctagttacattactactcatgtgagggtcatctttcaaaggatcacttcgattagaagttactgcatttacttcagctcctttagcctcagatttctcttcagatgatgtggcatcatttacagatatgttagaagcagggaacttcttgcgttttggaacatcatggtctgctccaaaggctggttgaatccttctttttagatggcatttgggtgtctgaacatctgatccagttcctgtaaagaggaaaaacaccactaatactatattgtatcatcttgtgcaattgattactttaaattaaatgattttatgtaatacctgcaaaaattgcacttgtttcagtgctctgggatgcatcaggactagtcagagtaaatagctcatagagatcattggatttgaaaaaccgcctttgttttgggtcttttagcactctatttgtcaaaaactgcttgaagatttgtctaaaaaaataaaagataagctggtataaaacaatgtgtagctctacctaaaaattcaagttataaagcaatataagagagagatgataacagctgctgcatgaatggctaaataatcccccaaactttcagccttggaaaattacaattcaggaaatatataatacatcagttaatctcccaggtcttgcagaatttaaattagaaataataccttattatttacaccgaatgagctttttcaacctccaagatctaacacatttcaagaaacaccttttcacatgccatcatgtgactcatagtctctcttagcctccttgacttgaataccaagggtcctgccctgcctagaaccttcctatcatagggctcagcaaactctcttacctgggctttgcaatgtctccactctgacctctctctccctgctcccacctgcaggtccacactctgctgaagccccacaccactgccactctggaacaggcacctccaccagccaccctgtccctccctgtcatttattctcccagctaaagcatgaatctataaaaggaagctctcttctcacaggatccaactcgtcctccaccctcacacaacactccctcgaggaagatgtaatgttccaggaatggcccagcatgtggtaaagggcacagagcttcctataaaagctgggctatggctcaaggataaagtctgtggtgggggagtgggagaagctggcaatgtcttgattctactgttgaagttaccactgtctaaaatcccctagtcattatggaaagacagaggacgaaacagccatcctgtcgacttctttgtaaggggcatcagagtcaaagactgccagaacacccacactgatcctacctgcataatgtggtatgtaaacaccaatatggtaacattcaaccttgtcattttttaaaatttttctgaaggcaacacaccatagcaggcagaaatattcctttcaaataacaatatgaagtttacatgtatgtgattcttgaggtagaataaggtacaaaaattatcaggttcaaagacattttttgacaactcacagtaagacatctaagcatattttaaagggaaagaaaaaatacaaaacaaaaaccaaagccttaagttatagcaactattattctaagatgttaagacttttaaaaacaacactttggaaaaattccctgctcaagactctgggaacgcacagccaagagtggccactgtgtgcactgaccggtggtagatcttttcttcaatggtgcccgcagtcaggagcctgtacacagtcacttgcttcttctggcctattctccatgctcgctcccgggcctgcaacagagagagagagacctctcaacgagaatccttcccaatgacaagcactgactataagaaacaaagctagctggtcactacctgtcactcccagagttagaattttgactcatgacgtcaagtacacctaaggcctactcaggaagatgaacagccagttgaaaagacatctctacttgaaaaaatgtttgtaactttgcctatgttctttttaccccaactctaggaatgaatgctatggataaactgctgaagatggttcctgtccatttgactctgaagggtgtcttctttcacgttgaagaacaggagacaatcaaaatgtgaaacgtatgctgaagccaaccagaacatcaaaggacagtcaaaagcgctaaccatgaaactatatttctactaatacattcttttaaaaaaaaaataaaaacaaacctgcgtgtccgtgcttgggttccagtctgggtcatagatgacaactctgtttgcccccgtcaggttgacacctaagccgcccacccgcgtggtcagaagaaacacaaatatggatgtgtcctagaggtaagacacacaacactgagcacacacacttaagaccagttacagttctcagcctctgcctccacatattgtacacatggaattactgggctgttcccaatataaggaatggtaatgtcctagagacctctggtgaatcaaaatctcatttcacagcttttacttttaatatttaatagaaatatttaaaaattgggtttttaggaggaaaatacatgctgtagaaaacgcattctttgtttgaacatacacatgcccacaatccccgcccccaaatatccagaagtagggcatagagttaaaaacaacaagtctccccttaggccccctcccaagcccagatgtcaatgctgctttggtgggtaagggtgtggatacgcttagtcctttccctccacgtacagcagcaccactcaacttccctgttacattcacatgttacctcattgtatctcgtaatcagtggctgtcttgaagctattgtagtggtaccatccatcttgagataggtatacttttgggctctaaggaatacttcaagtatgtccagcatctgtttggaggtgggggataggagtttgcaaagcaaatacacattcccagtgagtgcttctctatttgtgtaaatggtaacaccttccccaacaggcctatgttaaaaggagtttcttgctttaggacagataaacagaactgttaaaagagtatttttggtatttccgtatggttaattcttacttttgtaaacagccaaagctcaggcctaaacttacttgcagactagaatcacatggtgagcttttttaaaaagtcaacttttagacaccaactctagagaaagatctaaactcccaaagaaatcggtagactgccacctcagcatcagtggtagacttgcttcagaatcattactttagattgaatcccattttgtgagttgatggctgtcataaagaaccagcctgtttcccgtctgaagtctgtgcactcacctgccttgactgagaaaacagcaatactcgctgaccctgcttgtgccatattttcaacaaagactcaacaacaatcattttcccagaacgtttccagtacccaaactgatcttcttctagttcatcatcaggaagacctttgagattcttgggacctccagaaaagagatcagggtggttgcaaatttttcttagggctataagtccggagaaaatctgtggtaagaaagagtacatgtacactcagatgaccccatgtaaagtaagattccctaggcaaggaggctgtttaacctataacacagactaaaaaacagttctccaccagcttcttagtttcttctctagtcacagcattatcatgagctgggagaaattaactttcactcatcttgtttccctgatagaacaagttctcagaaacaaaaaaattctactggactgaacacgtctacaggggtcatattcaattgctgataattcattttccctcactagaaaaaaggtatgcagttcacggtattataaacctaatataaaaaaggaattcgccttttaaatatggatcagaaatgtcctatcaacctaaatttggagacatcagtcatgtgacttatcaaatgcatttaaatattacactcctaattacctcactaaaagttctgcagtttaatatgagtcagaggttgaggatccatttacctttagattattattatatcagaaaaaaaactgcatgaaaaatgcacgaataggaatgcacgaatgggaaagatatggtccatgcagaagggcacagaagacaaggggtgagtgccccggcccatccccacaaaagaacattaacaaaacttcaataatggggctcttccagccttgagaggatgattcaaatcaaactcactggtctaaaagcttgagcagaggagaaatcaccattaagccaataatcaaagggtagggtagctatcactagtaaacaacagtaaacagattaacaataaatgatctgaataagtcaggaacattggtaaacctccccagagtcatccgtgactcattcttcttcctttcaatctgcactgtccaatgcagtagtcactagtcacacgtggctactgagcacatgaagtgtggctagtccaaattgtgatgtgctgcatatgtaaaatacatacccaatttcgaagacagaacaaaaaaggagtaaaatatctttttaatcatttttaatttttgattacatattaaaatgtattttagatatatgaaataaaatatatatcaaaattaatttcacctgtttctctttttcctttttaatgtgactactagaaaatttacaattccaagtgtagtttgcattccctttcctggatagtgtgatctagaccccctaacttggaaagacctgaagaagttaaggggagattcatggagatgaatagatgtgaatgactgaagaacctcctgtagcaaccaataagaaatgaaataagaaattgtgagagatggttaaaagaactgaaatgacctaatcacactcacattatttatacaatagagtcttttggagaagacactagctaggaacttctgaattctggacactagtagaaagagagctttctcagtattgaaaggaacagaatcaccataaataaattactgtcctaccctggggacaatgagaattagagccagggacatttgaaccagatttatatctggttcctaacatggcaatggttcataaacatttattggggaatggggctcctttaggaagctgatgaaagttatgaatcctcatgatcctctccacaagatatataattctggtcataatatctgggaaaatgcagctatgtacctgacacccgcccacctaccaggtaagaccctcggaagtaacagtaactgcacagctcgcagctgcatttgcgtctgggttcagatccacagcacacagctctgcaactttccacctttcaccagttacctactcctctgcaccttacggctccaggccataggctgactgcacatctaccatgcgggacttcatgcaagtgaagtgagatgacagtacgtgaaaagcctggcacaatgtagatcctagtttcttttcctccctcacttctcttggtccacaattcatttctccagcttctattttttagctgacctgcatctctccattgagaatcctgtaaacttctttggaatcaacgaaattttggtagactttatgctgctcatctgtaagacggcaaaataagacctacggacgggaaaaacaaggaaactataatttcaaaaaaaaaattaacagaaataattaaaatatcaacaaaacttcctgatcaaaagagcacaatgcatgcgattttaatgatatccctattattaatattaaaacaacaaagggtgacaatacttctcaccataccctgctcaccagcccctccatctctgtcacttgtctacctccagggcccatcccacagtccccaaagactggcttcctgctcacgggcaagttcagtgcccaggtgcacagaccatcctccacgttagcctccaagtgctcaaaccatcccacctcccatgacccatgccatgctctactcggcagacctgaccagagaccacaacctcacctggagctctccctctcctggagctctaagtgcaggcccatgagttaccagacttgccttggacggcaacccttaccctcccagcccactgcaccaaccactccatgcgatcgtgctctgtgacccttcacctctcaaccctccctccttcgcaaagtccaccaccgccagttacattcccacggatgctcatttagccacccctctgccacctacctggacccctttcaaccccctgcatcttccctgtaaacatccaaaggtaggtcaactcaaccatcagtcttctgcagacctatggtcagtgccggtgctgctggagaaaagctcatacatggcagcatcctgccatggcctgtcctgctccagggggtcctctacgcatgcccgcccagcatcttccacaagcccagagcaactgtgcccatgctcctcaccacccaagccacccgcaactctgtctcaacttctacttaaaaacaatcagacaaataaaaacaaaatgaaaatcaaacctgaacctaccaggatcaggcatgattccctggttttcactccctaacatgtctctacttctgcatccacctcattttcctttattcccagaggaagaggttcttgtacaggatggagggcaacccttccacctctgcactgtatctgaagacccactcattctccccagtacagtgcctcacccattagcctccaagtggaagatgggggcattcctgagaaaattaggtaccatccccacctccacttcctcacctccagtcactcctgaagcccgcacccagagcaagcctcacgggcacctctgttgatgccactgaggcatcactcatgacttcctagtggccaaacacactgggtcctttccaggtcaccctactcaccttccgatgcccaggtcttcacttctgttcatgcacctgtctgtgccagcctccccagtcttcccagctagctcctcctcttctaccctcctccttgctcccagccctgaccacactggcctccctgctgtctatgaaggccccaaagcactgccacagctcaccatctgcaatgctctgccttcaaaacctacaagacttgctccttcgccttctttaggcctctgctcaggtgtcagttcatcaaaggtcttctctgaccaacccttacaaatggcccacttccccaaatccttgccctcagcattcccagcttatccttcaaccctgcttcatttgtctccacacttaatgctgccacctgacatcttctatacctttttgtgacactctccctcaagaataaatgtgagtccccatgagaacaaaacttgctttgttcactgctgtatctcagagcctaggatcacgacaggcatatggttggcacctaatacaatttgtagcatgaatgaattaggggcttaaggagaatggagatgtttaaaagagtagctataggaatccatgtgtcagtaagagggaggtcaaagcctgtggactagagaagaatccactgagggcagacgccacagcgggcctagcctgcccacagttccaggatcatacctcaccagactctctcatccgcagaggagaatcagagtgaagggaaagacacacttgtgctttaggaatgcttcgttaactcctggatttacagacctgttcatttttatctggcaaagaaaggctcatcttgacatctgacttcattctccgcagtaggtatggatttatggtatctcgtaagacacatgcacacttgtaagcagttttgacctttaataagagcagagaagggaacattactatatatgtttaaggaacgcatttgttcttacctctcaattgcttccattccttaaaaaaaaaaaaagaataaccaacagctgtataaagtcagtgggaaatgattgcaaaatggtttgaaaaagctagcataagttccatatactccaaggggtggtagctttcataatattatcagttaaaaaaattatctcattaaccaaaatgtacaacaaaagaaaaactgataattttgtgccttatttctcttatacactttcctttaattattactatacagttaaaccctaaagtagagacttactgggttcttgaccaccagccctaggggaaaaactgcttttgtacaaatctctgtttatgatcttgtattctccaaaagctacaaaggaactctgcaaagctgaagatcaaaagctaactctggggaaaagctacagtgatggagcagccagccaataagcagagattactgtccactggagacttacaagagtaagttcaacaagagccctctgatcccagaaacgaaaggtcactctgccctaaaatgcagcatatggttctgtaatggagcacggccacatgagatgagtactaaatatacgcaaaaaaaaaaagccccacagcccagaaaaccactccctctgcaattcacttacaggcaaagtagtcaataaattattgctacttcaaaaaaaatctaaataggcttaacaacttagtaaattactatttcatggaaaaaattccaaccaaagtttaaatttaagaaagtcagctgtaaaatgaatgataataaaaaagagcttgaccacacacacagaaaaaaaagttaaaaaattaacttgttaaaaaatgttcttaaagaacgctaaaaatacctcactcatgcacatatatgtatgtgtgtgtatctgttgtatgaatgcatgtgcgtaaatattaaaataggctttactttgaataatacataaaaaagaagctcaactaatcaatgacttttagttatatataactccttaaatatatcattcagactgatgaatatcaccttgaagatgatgatgaggtacatattatgatttctgatgcagagatgatgaaatttcagaatttaaaaacatagtcccactgaggaagcacgaatgtacagtctataaagaaaactgcccccacatcctccctccacccacacccccttccgcagaagagcgagcatgctggttggaggtgctggtcaactaaaccagggctaggctggggaacggccgggctgtggctcctgctctctcctgcatgccaccccatggagatgatcttctgtttcactcccaactggctcccagtctgttcctctattcataaaaacacaaggtggggattcagctagatttctctaccaatgctcacatcccagtgctgtggaaaacagacaacttgctgagcatgcccatgctccttcccattctgacaaggcagagctctgcctcttcctgagcacagtgaccttaggcaagtcaccagaacgctgagaatcaaaaaccttgcatgtggaataaagagggtcaactaggcgtccctgcaggctcttctcagttctcacatgccctgccccagctgagcacaccaaccccagcagcagtctatatttgggctgctgacatgctccccatcaccttcctcacctttcaggccccaggtgagtcatcccttctccgagaagcctttctgagccccataagctctgacactgggcatctcccctgatcacagtcctcactgccctgtactgggaccaggtttatttgccattttcccctgtgcccacccctactggactggaaataccttcatgggaaggttctggtttctagcccctgccatcattttagcaccagcatgacagaataaataccggcacacagactatcttcttagaattcaataatgcaaggcaacatggtctcaaacaaaaaggagcaaatacaaccaatactctgcttccaaagatctcacccgctaggaaggggagaaagataagtacacaaattcctgaaacaagaacttcaaggaaaaaaacagatcataatgacatgttctcaaataatttttctataaatgacttattaatgccaaaggagaagtggtaatctcacagagtttagatctggccaacaccaccttaaagtaatcagagttaacatcacccatagtggaacaaacagacagcatgttcctccagataccatgcactgaggaagacacatcacttctgtgatattcctagccaaaatgtataacctgaatccaatcatgaagaaatgtaaggcaaacccaaactgaggtacattctacaaactaacaggcctatagtctttaaaaatgtcaaggtaatgaagggcaaagaaacagtcccagattaaaggagactagagacacggaaactactggaactgacaaaatatgagtgattatagactagataacagactcctattaatgttaaacttcgttctgattttgttgcttacactggctatgtaagaggcgatccttgtttttggaaatacacactgagggatttggagaaaggggcatcagatctgcaacctgccctcaggtggttagaaaacagtaacctcagctgtgaatctacatggaaagaggtgtgggagagggaggggaggaatggtaaagccaatgtggcaaaatgtttgcaaaatgctaacaatcagtgaatctgggtgaagtgttaagaaggttttcttgtttgtttgttcttttaaaattcttgcaactttctgttaagtttgaaattatttcaaaataaatttttttaaaaaaaagaatggtataacaggagattcagagaaagaagagactccttacaaaagttaactgaaaatcattcaatctcaaaatgtaaaatatattaaaattgtttttgacaatcttttaatcttaaaggtctaaaattctttttctaattaaatactccaaaatacgagagcttcccttttggtggaaggtctcatccctggctcagccatgacctggtaggcacaggcccacccaagaagggatgcacagaaaccgtgcctcccacccaggctgcagcctgccatacaggccacaaaccaccctatggctaacttcacctcctggcatttctgcctgtgaccaccccattccatcaggcacccgggcctgaaacctcaggagtcagtcagtcattcacagcaagcttagcccctactccatctcctcgatcctgtcagcctccaaaccttgtttgttctgcctaaaaatgccacctgcgtctcctgccccaccatctttctcagaccaccacccaagatcaggtccaggtcctcatggccctcaccccagtggttcctgcaggtcactcagtgccagcctccctcttgtgactaccctgtagcctgaggaacccctgagaaccagcatcctccagagtcctgctcagacactttcagtaacccagccctccctgagtgccactgcttccctttcaaggccccacagttctagcatccacagctttttagctatgcccccacaagcatctccaatccagtcaagtgggtctcttcactgcgccctgccacatatggtggctgcatccacactgttgccctaatcaagaatgccctcactctccatggcctacattcccagaatcaggttaaggggcatgtctcattaaatcatccctgaacagtccaatcctcctagtgtccccttttctaagtttctccactactttataagatgcactaccccagtttgcaggactaaattacatgctgttccaaactgatttgtccttgtttcataatttctaactgctcttctgaccacatgtgacatctttttaaacatcccaggaacaatgccaaaactgtttaatttccattaaacaaggagatattttattctagggctttcctctctgtgaatagttttcatgatgttttaagtgaaaaaatatgatcaagcaaagataattttgtgattttttttttttttttttaaccagataccaatttatgagcctggccatctttctcacattctgaatgacttggctacaaattatagtatttaataggagcactttaaatattaaaatgccaaaagtattatcatcctaatattttacctgtactggggaagcatttgaatatccccccatggtgatggggacggagaactgctccataaacacaggcaacgtgcctaactttcccgggaagatgaagtcaaagagcgaccacagctctcggaggttattttgcatcggtgagccagacagaatgatccgatgaggggtgcgaaactatttgaggaaaggaagcacctttttattaaatttaccttttagcaatcgccattcctaccctaaaacgctcctctgcaaattatttacacatttactcatcattcttgcatcattttggtactctccaaaacatacacattttatgcaattacaaatccttaattacatttagatgaaaaaatgagaaagaattttttcttattgttgaagctgaatactatagattagagttgggtttggttacattctaacaactggcccctacaagagacattaaataacatgaacaatcagaattaaagacatgattaagggcaaaaataaagagttttctgcattaaggaaaatgcacattttaaatttcttgtgcagttggcacaaggaaagattcaataaatgtgttactaaaagcagatagtttattctgaattaattattcttctccacttggaaatctcccttgttaaaagaggtcatacctgtttgcaagcaagggtgacagcagcatttggatttcgaattttgtgtccttcgtccaagatcacatagtgccagtcatacctgctaatgtcatcctgcatcaatcgaatgtaggagtaagatgtgatcaaaattccatgacaatgagcaacatctcgaattagtttctcctgagaccacaataaaatggtaaagtcagttttaaataagaagtgacaccctttcaatcatgacacaatctaaagtactttataaaaatgcacaaatacaaacataacatgcacaatcacagacattatcagcactggaagtgtacttgttaacctggcaagtagtaaacgctgactaatacagccgttattaggggaaggagactctcaaaaagatgacaaagttataatacatatatttataaatatatacatatattaaattattatttttattttttcaaaacatcctttgtgtccattcttgtcaaaacaacaatgtggatggaaaatatattaatttaaaacaaaagcaagaaaataagagaaaatccaaagagacaaggcagacaaatctaggatctctaacaatgtataacaagaattccaggacagagtgaaaaggatataaaagcaatgattttaaaatgatagaaaaaaagccgggtacagtggctcacaactgtaatcccagcactttgggaggctgaggtgggtggattgcttgagcccaggagttcgagaccagcctacgcaacatggtgaaagcctatctctaaaaaaaaattttaaaagttagctggatgtggtgccaagcacctgtagtcccatctactcaggaggctgaggtgggaggatcccttgagcccaggaggtcaaggctacagtgagcagtgatggcaccactacactccagcctgggtgacagtcagactctgcctcaaaaaaaaaaaaagaaaaaaaaaaaaagaaaatgttagaaaacaatcaccataaatggagccgagatttgaatctacagaacaaaacatctcccagagtgtcaggcagagacactaagaaaaagacgcatctgtagacatatcttactagatgtctgaattccaaaaataaataaaaacagccaggcaaagtggcttatgtctgtaatctcagcactttgggaggctgagggaggagaatcgcttgaggccaggagttcaagactagcctgaacaacaaagcaagaccctgtctctacaaaaaataaaaaaattagcactgcatggtggtgcacagctgcagtgccagctacttagcaggctcaggcaagaagatcccttgagctcaggagttagagtctacagtgagctataatctcaccactgcattccaggctagacaacggcgcaagatcctgactcaaaagagaaaaatgtttttaaaaataaggagaaaatgtcatagattctagtcagaacaaaacagaaaaagaaaatattcccttcagaggaaaaagactacctgcatcagacatcttttctgcaacactaaaaatgtccgaaggcaaagaggaaaatctttacgtaattctaagaaggaaaagtggtgaccatggattctacatcaatccaaactagcagtcatgcttgatgaataaaataaacaaattccagcttcagataggcaaggacttggaagatcagtcaccaagagattggctaactacagtgcactgcacccagacagtggagtggtgcagtcgtggacaaagaggaaggcatgcacaaatgccatgccctgaagaaggaaagacagcaatgctcctgcaccacattctcaccacagaccatgctcacagcagctccccaaggaaggacagaggggccatcactaaccccattttacagatgagggaactggggcttggaaatggtaactaatgtaccaggtcacgcagctgctaagtggtggagtcagaattcgaacggagaaaggcagccaaatccaaagctagtactattgacactaggctacactacctcctactaaaatataaaagaaaaagtttaaaaagaagattgtatgtgatatacataccatttaaaataaatcattaaagcataacaacaaagcctaaatattaaacacttaaatatgaatgaaactgttaagaggggatctaaaatattaaaaggtatatatttttaaatgttactgtaattcctgttcagtttcataaaagctggattgagattaagggaaaataaaagtgaactaaaaattccaccctgtccaatggtagaaaggtacacaggcaatagatatttaattcttaactatgtgagaaaaatatgttaaaatacatttgccaaaactttatgctgattactgagtaacagttgctacttccacctaaaaactagaaaatagaatgtagaactatcaaaccattacagaggaaaataatagaaaatagcaaaaatcaggacaatataaaacagaaaacaaaataccaggtttcaaactaaacctagtaacccaccacaagacagtgagttattaacagggagacattccactgggtaaggcaaaaacctagccttctgtttaaaagagacccaaaccagactggcactgaaagttgtaatatgggaattatcaaagatatatcaaagaaatgccaaccaaaaaagggcaggcttagcaatgtaaatatgaaacaaaaaggagtgaacagaaagagggatattttatattttaatggggatgccacaataagaaaaaagaaccatgaacctttacctaccaaaacgcacagcaataaacacaaaagcagggcccttagagctgtcaaaatgacacatccacagcctacccagagagctgaccacagcctctctgagagaaagtcagatcaaagaaaataaaacatttacaaagaggatgcaaaggatttgagtatcaccatcagacctcctttcaacagtgatcagcagcactttagactatacaaagaatattcattctttacaaacactctattaagaaaagctgaaatcaaagagagcagtcaacttagcctcccaaaaaaggaaaatgagagaattagtaagataaaaattagtgggtattaaaaaaactggtagaattgataaagcaaaataataataactctttggaaagactaaaccaaacaaacctctgaaaagtgagccaaaataacagactgagatgtacagcatcagaaatgtcaaaggaacacaattacagatgtagagaatacaaaagtgttaaccaatatacatgctacaaaatctgaacattttgacagatatgatagctaaaaagttcgttgcaaaaatggacccaagaaaaatcagaccaacagaacaaaccaatactgaacaatgtgaaaaagatgttatactcttctcaccaaaagtctaccagacccaaaggggttttatgagtaaagtaggactagatcctattactgaaattgttccaaaatatagaaaaagaatggattccaatcattgttacaaggctagcaaaccctgttttcaaaactgacacagcacacttatgagtgtgcatacacgcctctaaactagagatccactactttacagataaaacctagtaatatattaacctactaaaggcttatcacaggaatacaagaatagctatcaggaagcctaatataattcatgtaatcacaatcatctaatacaaattttataaaattcaacatcttcaaaaaatggtaattttatatcttcttaaagaactaggattaaaatgtgttttaattcaacagagtataaaagggtacaagaaaggctaagaaaatctgaaggaacaaaataaagagacattgtcttctcatatgttgtaattcatgtaacattcaaagagttaatacaattgctgcagagaataaccacaatgcctggacctattaataatttgacaggtgtgtgccatacttttattactattatgactactcatcttccatcttcccattcacaaaattcgacacctgcacaataccatattgaaggccacatctgaaagacccatttcctgacttttgacctcacaagaatacagcaataaacgccttggggtgcacaacggccttaaaaacacacgtacgggttccctcaggactccctcgccaccagccccacttagctgctggtgccagtgaagaaagcagtctgcccagagaaaaaccatccacctttagcacctcacctggtcagacctgcgacctttagaagccaaagccgaaatgaattctggacatcacctagtgtagctggagctttcccacagttaccaaatgagacaccaagcttcccaaatgtataccactggaatgatgtttagtttcttatgcttgcttaaggattgaaatttatctggaaaattctaaatattattataggtatagaaatgttagctatagaaatacaaaacttcctgtgttcaggaagatgtattaatgattaacaagaattaaaaagatgcttatgtaaaaagaacaagaaattgttcaaaatgtcccagttgaaaatataatctccacttagccactgggcaaaaccccatctaagactatttgttatcacctgattcaatcgcagaattctatagctgcctagactggagtttcaataatggtgaattgttgaatattatggacggctctatccaaacacttaagacaaatcatctcgggcggtttcaaattaaaagcttgtaaaatatgtaacctctcctagtttttgcaattaatagggtacatctgcaattagcctgacttactgaatgcagtgctgttgtcattagaagatgtctgtgaaagggctgctgttattatggaggctcaagagaccaatccctcctagagggcaaacagtggactggtggaaaacaacagccataaatcacactgtcaggcggcggggagaggagcgaagcacaggcacatgaaggccattcacaggaaacacagtacagccgcttcctaggcaggatttactgcacctgtaattaattaaaatttccttcaagctaaatctttaataaacaaggatttgtgctgacaataagaaaaaaaagggctccagcaacacaattttacaacatacctcgcagaacaagcccagcatctatcatgtcttctataaggtgtatacactgactctaaagttaataggaatgataccactttgcattctattataatttgtgtactcagaatgtgtctgaaatatttcagatgcttaaggaataatgtggcctctttcttttttttttttttttaaagttttttactcccttctagctttttttaaagccacgtctttttgctctagtgtttcagaaaacaggcccttttaaagaacatgttgatgggagtttcatcggatggccaagtttttgtgttatttgctttttttctttttgagacagagtctcgctctgtcgcccagactggagtgcagtggcgtgatctcagctcactgcaagttccgcctcccaggttcacgccattctcctgcctcagcctcccgagtagctgggactacaaggtgcctgccaccacgcctggctaattttttgtatttttagtagagacggggtttcaccatgtggccaggatggtctcgatcttctgacctcatgatccgccggcctcagcctcccaaagtgctgggattataggcgtgagccaccgtgccaggccattatttgcttttttaaccacgccctgcacttcactgtttccatctggggccaaatgtatctgaacatgagaataaaaggtctagatgatcttgaatgaccatgaacatttttgataaagtagatgtgtaccttctctctagactacatactgagtcaatcagcaatgcctcattcagcatcttttcttttcccaactactgaggtgaagaggcctaaatattctttgtttctaacaacagcaagaattacctgagtaaatgttacctattagggaccacactaagctcttcatacatacatattaacccaaaaagtcctaacaagtttaccaaaatttacccattttataagtgatcaaatcaggctcaggaaggcaagtgattcgcccaagcttgcaaagttataaaacagcagatccaagattcgaaccctggtcttgtaagcacaaaaccaatgcacttaaaactgcatgctcttgttgcttttcccactcttatgcatctacatgtcatgaattgatcaaaacgaaacaaaactctttaaattacctaagatgttacagaactactagagactacgtagcaaaaaaaggtaggagagagacaactgtttcagaacataagcaatttatcattatgtatcttccaataaattgaaaaaaaaatccttaatcattaaataaactttacaagacagtgctaaagatgtcaccacctactgtgagttatgggataggtatcacaagactgccttctttatctcttcatttactacattttctttccccaaggaaagagttggctttttaaggttagttaaaaacatcctttattttttttgagccctagcaacatcaaacacctgaaatgcagtgtttattgttgttttaacaaataaatattaatcaactcacatgaaagttgctctatattagaaaaaaggatcacgaaatataatcagaaaaaggaaatcttgaacttttattaaatgcgatttcaagtgaccattaaaagagattcagaagcctaaaaatttctttatcagatttcatcatttggttgaaactatcagttgtatatttttttgcatggctgctgggtgtacatttgacaattctaaattatgctgccaatcagagactattaacaaagataacataggatcaaagggtgagagaggtgggaagctaaagggcaacttggggaagaagaatgatagatgtgcttaattgagaaattgaccatttgatatttttccaaatgaaaaattttcctttttttttttttttgagacagagtctcgctctgtcgcccaggctagagtgcagtggcacagtccaggctcactgcaacctccgcctctagggttcaagagattctcctgcctcagcctcccgagtagctaggactataggcgtgtgccaccacaaccagctaatttttgtatttttagtacagacagggtttcaccacattggccaggctggtctcaaacccctgacctcgtgatccacccgcctcggcctcccaaagtgctgggattacaggcatgagccaccacgcccggacaattttcaaaatttatgtcataccagctacaacaaagcatttggaaaataaagataatctacttgaacgataaacaaaacaattctggcattattattcttttaaatatttctaaagagaaattctcttctcttccctgttcctaatacatccagtattgaatgtcccaatgtcagagtaccattattaaattcagacagaacagctggtgggcacagaaagctcatccactgtaaaaagaaatcacagctgataaggaagtcaggcattagacgctgagttagaggacgaatcaccacaaacagaatttttgaaatatgaataagaaacatagactctattgtaatttaacacacgtgtaagccagcaggtatgcatgtgtggtgacagagatctgcacatacacagaagatcgaaggtgcagaggaagcaaataccccttcagtagttgaatccagaaaccaaagttatgatcttagaaatgtcaatagtaaggcctatggaaaggaactattaatacatttccaatgtgtcgtcaccacaaataagccaatattaacattaatgaaaagtaataaatatagggcttctaagttaagaatatagtttgatacatataaaagtacatatttttgatcttttgcctaacagtttacatctttagtgatctaagatactttataatggaaaaggaacagtaggaagagttaagagtttgagtaaaaacacaaggaaactgtaatgctgtttttcctcaaaagttaattaagaatcttcaagttagagtccttggtaaactgtaaaacactgaaaaaattattaacaaccatatgtatgcaagtgtctgtgaaggtaaaacaacctcagaaggtaaagccactgcaaccaaaagtgaaatatctcttcttagaagtttgccctccaaagtcaaggagacaaatttcaccaaatttactgtcaattctatttccataatgagtccatgtatgtggtttacacgaaggcagttcttcaaactatggtgacaaaggaactggaggcaagccatgatccaggtgaaggtgtccaatacacacactttactaccccaaaagaaaatgaaaggaataacatttttttaaattgcctttataagacaaacatcagctaatgagtcctgccacaggattttgcagcacaaaacactaagagatgttaacagataacagaaatgaaaaaggaaccacaaatgttttacaagggtagtgacaggatagtttaaggtttgacaaacaatttaaggtttgactagacaacaatctatactgctattatcttcatactgctaaaaatcactttttataactcacagcatttaccctaatttattaattatcttatccagtttattttccatttatcacttaaaattctgggcaaagtcagttggttttaacaataacagtgtaagcaaaattccatctcgccttatttgtgctaccaaaccatagatttttctgagtcacttctatcaaaagtttgcttttccatgaacacaaacacaacaggaatcctggagtttcgtggtccccgtgcatctgactccgtgaggcaaacactccatagcccttgcagccggcactgctttcctgggccccgagaacgaactcaagagctcagaagactcaggaaagaaagaactagctcctaagagactgctgcttctccccaataatgtaacctgcaaattcacagtgaaactgcgtgattattatttattcagcaaatgcttatgggtcacccgggatataaaaatgaatcagacacagtccctactcaacagagctcacagtctggatggttagacagatgagaagaaaaaaggaagaatacaacgtatctatgctacccacaggagcacagataaagctcttttttgatactgtgatattaccaaactctaagtgaagaaatacaactgtcaatacatgacgatcaaggattcaaggaacaaaacacaactaaaaagcaacaatacttgcgaaattctcaagatggaaggttaaatgcatactaacaaatgcatttaccaattaagagttgttattttacttctgtatccaccttcctaaaactgtttgaagccactaatgcgcaaagtctctccttactggacgcagccacctgacttatgactccaacccacactgccaggcttgtgccctgtctgagatgattcgtattttactggacaacagacattgtcacaacaccaccacagactgttagaacaataagacctatattcataactgttctgaaaacacagagctctaaagtaagtcaataataataaattaactttaaatgcaggaaaaaaaacacaggaatatacatttgagaaacacatggatcagagaaaaaccaaatatgtaaaatggagggcattaaaacaaaacaaaaaggtactgaaatattgtgttacctttttgtgggtataggaaccggtttcatgtagaattgccactctgaacggaggccaccacgtgtgaaattccttcacccactgatgcatcactgttgttggacagacaattacagttggacccaacccctcaaacctgcatccaaacgtccaagaagaaaacaaccatgaaagagcatatacagtcatcaactgctcaaaagatcccccaaaacaacaaacaaaaaacttagttcaaaaaaacaatgctaactatggaaatttattgatattttctttaagaaaaagttactgatgttaaaacccagtaagtaaaatctccataatctcattcatcaattagtggatgtaggtgttaagagaaaacacttaataatatattaagagatataacatctatagtaacataaaagataatcaaatattatttaacaaaaatactcttttcccttctactacagattagtgaagtttttatacagtgtatcttaacctaagtgaacataatagaatcttaaatttgtctgaagttttatagtctaccaagagttttcaagccacagaatttcaatctcactgccctaggaagcaagtaggccagaaatgctccactgatgggggctcataaggctggcatggcccaggtgacatggctaccaggggacagagggctgcctagcagccagtcttcacttactgcagcctgtcctcactacaccaccctgcctgctcctctacaccaccaaagcaccatggaggagcatccgagcgagtgttctctcctgggaagcccacaccgacagtgtacaagctggcactgctgtgtgggcaggtagttcggcagcaaaatcaagagcctcaacagcacccatgcattgacccagcaatcccaataaaaacatttacacactgggatacacactggagcattctttatactgcagaaaaagtgggtgctacctatgtccatggagaagaggaaagctgaatgaactatcccatttctttaacaaagcatgggccagtggttagaggcactgcctggatctgaatccaactctgcacacattgtatgatctcgggcacaccatttaacctctgggaacgtcagtttttcattttcaaatgggaataataacagtattgatcttatagggttattacgaagattaaatcagttaacatctgtaaagtgcttagaacaggaccatatagaaaatactataagattctgttaaataagatggaatatcatataactattaaaatcattttgaagaagttaataaactagaaaaatgttcaccataatttttaaaaattatttatggaatcaccccaatttccttagacataggtatacgtagaaaaactggttgtggccattgtctcaacatgcattcccctctccctttttcctgaagaatcagatctctgcaggtgccctccttcttccttactgcagacacacagtttatgggactctgaccactgcctggctcagaagcaggaatcctggctcatctataacctgtcagtgcatggtactcccctgaaactctcactagtccatgaagctggcctggcaagactgaccaactttgtaaggaaaaattacattctgggttgggagagacttttctctcctggtctttctggctacatgtacagaccaatggtcactgggttacagtgataaggagatctaatgattacaaggacacctggccttaggcaaaaattaaagtatctgggtccctgaagacatcattgagctgctgatcatgctgtgtccacagcctccccctctgtaggtttctaggtgtaccatacatttgtgaatgtttaacccaatttgaggccaggtttcacttaggtgcagtcaaatatcctgatacgtcctacactgtattccctgtctgcatctgcactcctcctgcccttctgggacaaagggacagtgtcccttttcttgtttgagaccaatccctttagctaagctcttgagcttgtatctccacaagcggcactcccattactgtagcccattaaccttcagtcttgctgggagttgggtgccagtcagtgcataagaagaaaattaagcagaagtcaaaactaaccgtggcaacctcttcaacaacactcagctcatgctacaagaggcaactaaaaactgggattgactgagggcatcacagggccacacgcctgcctctcacacacctggagcagagtcactgcactctgcacactgtcattcctctcctccactcccttttcctgccccacaaagatgttgactgtgtgaagcaaaatgcacatacattactccactgtatacactaccccttctatctcactaattcccacaatttcaattctagatgctggtaatgccaaatctaagtctccagcccagatcactcttctgaactccaaaccaccacacactagaaatctcactgccgatatccccaaagcaccacacgccatcctcccctacctggctgtcccctgtccccgtgcttccaaaccaatggaaagaattttgtcccactgtccaggtgcccaaatcagaaacctaggcctcatccttgagcagacctgcttgctctccaccacgagcaacctacactgagttcacatcatttttacctcctgaatcctttcagtcgccatgtctctccgtctacactgttgctatgccaggtccagccactctcctctctcatctgggttactgcatctccgaggatgattatttcaaacagtaaaatttgaattcctcatcctctcacttcaaagcctctaatgactgcccactgctcttgcgacagagattaaacacctggacgtggcctacgaggccacgaagactgacctctgctcatctctcctgccttacctctcactgccattatcctaccacttgctcctgtggctagcagcccaccagcctgaaccgtcttcccttcctccaatcgaccttcaccatgtcctggttaccctcttacccctccagctaccttctactcaacattcagatctctagcttcctcgacaaagccttccctgtccctttctctgtaaacaagttaacgactcttccttagtgcactccacattaaccctgacaaaacacaaatcacctttactgtaattgtatgagatcctccctaaactctgtgagagcagagataatctcttcttcaaatgatctcaatgcctacctaatagcaagcaattaatgaatgctggctttattaaattaaaacattttttaagattggaagaaaatatatcaacatgctaaaagagattatttcagagttggggaatcataagtgatttttgttttcttactagagctcagaaataaattattcctgaacttaaaacaatttttggccgggtacagtggctcacacctataatcccaacactttgggaggccgaggcgggtggatcacctgaagtcaggagtttgagaccagcctggccaacatggtgaaaccccgtctctacctaaactataaaaattagccgggtatggtggtgagtgtctgtaatcccagctacttgggaggctgaggcaggagaatcacttgaacccgggaggcggaggttgcagtgagctgagattgtgccactgcactccagcctgggcgacaagagcgagactctgtctcagaacaaacaaacaaacaaacaaaatacaatttttacaaataactgaagagtaaatcatacaatgcttgaaatattaaaaatcatctactacacaactgaaaaataatttgtagttctatagaaaaacaatgaaattttggtaaagccctaacttaaatgaggcctacccttatactccaacgtaacaaaataacctatgtccactttgaaaccctccctgcctccagctacagtcactgtccctgcccttcaactgggtggaaagggccagactacaagaagccagaggctacaagagactccgacactcttcctacagagtttctaagccatgctcctcaccaaggcagggcctgtccaggtgccccttgagctccccaaggagagtgggactctgcctggccccttccatggcagcaagcctttctaaaaggattaaatgcaccagcttctttctatcctccaaggggaataaaagagttatcatcaatatgcacttagcagggattaggaaacaaccaatcaaaagctgtctaaaatatttttacaacaaactcacattcaaataagcataaacacatgcatatgttttttcaggttatacagtatttttttctcttttataatgtgccttctgcaaactgctacattgatgactcacattttgttatctaaggctagtatattcttctggctgaacatctatctggcattatcaagatgccctttaatttctgccattttcccccttagtagaaaaaattggagattttcacgctgagttgagatctaggagcagacctagactgttgctggaccacagcaggacaatcaactccattaacagtcacatcgtcaactgaaccaccctttcctaactcttaataccagtgagatgaacatgagtaatggctaagtgtactacagtgattagcatcaattaccaaacagactacaattcctttaatctttgattaccattgattacctaataaatttagggaaagccaatagctccatggtcaaatatatcaacctgcaggatggaaatctgctagtcatacccagaacttaccaggaactacaaagtaaaatatttatccttgaaagtttattaaattcaataacattaggaattaccaaatgatatccaagactttaaaaaattaactgagtttgaaagtcaatttatttccttttcattataagattgaggggcctatcattataatatgaatggcaaagtgaaaagaaggtggtgtatccattatgaaggggaacacagcaaccagtacagatgtttattaaccataagcaatatgtttctctgtcttctagaaacacacatacaacacacattttttaaaaaataacaaatcaaacttcttttaccatgaagtttcttggtatcacagagacactgttcccatttcaatgttcatggtccttaaaattacaacaccaaaatcatctcaaattagggcccctctacagtttgtaagagttcacaggaaatatacatagccaatgaggcaataacagctcacacagaacttcatttgaccttaagagctatttttctgtaagacataagtatagagaactcccaagttcatctggttccagaggaggatgtgttataaagttgttaggaagatgtggtccagtccgccctggtacatatgagcgggggggaccacactcctctgtaaacttccactcatgaggagcccaggtgtttgtggtgcagcaccacattctcacaagccacttccaccaataccatcttaataaagacaatctgggatgtagtccaatatgccacattatttcattatagagaagaggatatgagcattgatagttaattgattacagctgctgttcattattagccttgacttcattcttagtaggattgtcaccacccaagagagcatgttttaatttttagatcaaaactacactgcagggatgactttagttctcctaggacctgagcactggactccacataagtgtgatgataataggaagggaagcaaagaaaagaaatgaaatgggaaataagaaaatcccagaaaccatttaaggaaagaaagagtcctagaaaccatttggaggagtttggggttgtctagttaccaaaaacacccaacagagttgcagaaaacaagccaaccaaagagcttatttgaaacagaaaaagcattttatttgaaacagaaaaagcatattaaaaaaattaacagtcatagataagaccacactaaatgcccacttggaacttcaacttttcctttggtctggaatgttttcacatgcttccaagcaaaatgtaatagaattctcatctttgaaaaaatcccctgcttcaatataacttccttgtaacaacaacaacacgatgtttagcatttaaaaatctccaagtgttttcttccccttcctacatctatataaatgcaactggcgttctaaaatattctaaaactccaaacactcctcacagaagtattgatctgctaacttaacgaaagagtaagaaataaaacactaaactctggagactaaagaaacatgatcttgactcagtttatggttcatatttggctctctactaagcatttcgctgctgatgagctggagagtaggaagaactttcggcagttgctgacttcaggcacactgacactactgtaaaggttatctccaaatcatatatagggagtgtctgaggtttcctgggcacacccctctagcaactaccttgctcttactctttatataagcctactgaaacacaaggagctcggacttatctgggttcagtatgatgaaatatcctacataatttaccgaccaatatttttaccaatactgatttctacagagtcaatttacagtttaaatatggaagtgctcatagtactttctttcaaaataaagtatttcagtcctaccatatcaaatagattaaatgcttattcttctggaatacaaaagccttaatagtttatttaaatttctaaagagaataaagattaacatctaaacatagttttctaccattttaggtagtcacttacgttttggcattagaatttattacataaagttcatagattgggaagggcagaaaacacagggatcagacaagtaacttcattcaaaaacaagagagagagcaagctatctagaaatgctatcatgcacactcattataaaggaaattagggagaatggcttcttcaaagctccaactctccccatgaatagactttgtacttactgtaatgctcacctggtctcctgccagaacaaatattttaatgtaaaatttaataaatggaactaaaggtattatgtctaatttaaaattccatattgtgtaaactattgatattaacataattgagtttgtaaacaatccctttgtagaagctaaccttagacatcgtattgacccaaaatatctagtggggctcatctgcaaaatgaagcatcaatgcctggaattcattaaaagtgttacatgtttaatttctcctgccctacagctccattgtctcgtaaaatttttcctttgatgtcccccactaaaagaattaaaggaatattgtaattgaaatgtcatcaataattcacaagaccctcctccacagcaatacatctgatgaaatattaattgagctccacagactgacagtctgcagaggagcacttgcctgtaatttgaaccacgagtcctgatcttgctgtagctcagacctgccaagaaggcaattatctggatggtcttgcccaatcccatttcatctcccagaattcctcctgcctgctggcagtgcaattcccacagccacctaacacctgtctgctggtacctatgacaacaaacaccaacaagaaaagagaaaatggcaaatggtggataatacagatcataacagaaagtactcatgaattaatcatttggctaggttctagtaccagtcagagaaacatgcgggatgtgtgttttacatgagtattatatttataaggtcatacatttttgatcacctaggcataaaaatcacaaatttttctttacaaaacattaacacatttctaattaaactgatagatggggtaattagagactatttcctttcttttcaacattagaaatagcttgctaaacaagcataaacttactattttttactcactttctgggggaaaaaatcccaaatatttttcatatataaagttccattaatttttctataaaaaaggggcactaatgtttattttttcaatctgaatagcatcaaaaaagcaggacagagaacaccacaacctatagcttatactgttgaaaagtcacttggtgatcatattatcttttaatagaaaaaattaaattttaaggccataaacaagtctgaataataggtctgctctcaaaattagaacataacagatgattctgtcatattactagcagatgcaaaaaaaagcacagtttaaagactcaacaatacaaaaggtctttttaatatttcaaagcagaaattgattcagggagtttaccaaaggtacgaaaagatcatagctattaagattttaaataaggaatatgggtcaaagagaaataatttaaccttaacccctccccctgcaaaaaacagaagttgatatttttctttctccatcaatgatatgtttaatctataacctaaaaataaagttaaaaaaggaaaaatacaaaaaaattttcggagagtggaagaaacacttaacaacagggaatggtatgaagattatatcccaagttacaaaatctaaagcaaaaaccacttgaattaaaagatgataggttagatgaggtggctcatgcctgtaaatcccagcactttgggaagccgaggcaggaggatcatttaagcccaggagttcaagaccagcatgggcaacatagtaagacctcatctctacaagaaaaaaaaaaaaaatttagccaggagtggtggcacgtgcctgtagtcctagctacttgggaggctaaggtgagaggattgcttgagccatggaggttgaggctgcaatgaaccatgattgcaccaccggattccaaactgggcaacagagtgagaccccatctctaataaataaataaaaagatgatgcaagataaggcatttttttttcaaagaaaatatcaaggctgatgggctacccaccttaaaagaagatagttttgttgttttgctgtccaaatacttactatctggtacctataggtatgtctacctaaaatctcattttggacttcagctcatttaactggttttatttaatctcctctcagtaaatacgtcataattaactttctcccagtattttgcaaagcaattctagaagtttgactctagctgttccattattacctattacataaggaaaactctaaatgagaactttgctgcttattaagtttgctaattataatacacacactggatatgcaccttggagaaaagaactaaaaatcaaaacacgatgaagtgtagtacagatacaagatcatttaatttgggaagaaggacaaattccgaaaatatgtggtatgtaatcagagaataatggctaccacttaaggaaccaactgctgaggaggcaccaggccaggtggtttggacacagcctcacaatcaacttgcacaaaggagattatcagcacactttataattaggaaacaaaagctcagaatggttaggtaacttgccaaaggtgacatcgctagaaaaaaatgagcaagccagagctgaaatccagaactgtatgtttccaaagtgattctggaaatgatctagaccaatagttctcagccaggggtaattcttctccctatgggacatttggcaatgtctaaagacatttttgttacaaccagagaagtgcaatagtagaggccagagaagctgttcaatatctgatactgcacaggacagtccccacagcaacaaattatttagccctaagtgtcaattgtgtcaaggtcgagaaaccctcatttagaacaaaagctggttcatgaactggctacactagaataatctcaacttttgaaaaagacacactgcaaaaagctctccaaaaaaactgatgtgcaattagtttccagaatcactacattctagtcagttgacctctttttgctgagatacagaacaactggaccagctcctccagtcggggaacaaaatctcccagtgattattctagtgtattactcctacaccacactgcctccatcctacatgggtccaacaactctttttgcttggggctcatcaacttaactaaagtagggagagtgcggaaaggagcagttgagaaattattaaagaaatggtaaacagcataggatcccaaaaggaacctgagagggggttaagacaactagattctgtgtggcccaggaaaggcagcatacaatgtgctgggtgtttcctcatctacaaatctaatcttcgacggctttcaaacagcatgtgagtgtgtttacaagaagatgaacagcactaagaaaatgacattaaaaaaaatcttactaggcagcatgtaagtcatatctctagcaggatccccaaaaactagggatagttacaaagatagcaaagagtggctctttctttccacacaatacacgaaggccctcagatggtatttaaaggaaattcacttgcagattaaaagcactagccacacagctggtagatgatatacatagctggtgttgctagatgaggaatataagggcctgagctcaggtttcagctgtgccactaactgactttggttttattgctttaccttcctaataataaacagtgtaaaccaattacatagtttaaataaaaacatattatagaatctagttttcaaaatttttgaaaagcatataaaaattactctttagggacagttaaagatttttatgaatatacaacataaaaaaatttattctgctatcccttgagactgaggcatcacaatgtgaccacaaataattggtgtacattggcattgccacactaacccaagattgcatttactagtgtggctgaaaataaggtcaaaagattgaagtttgtcatttgactgctaaattagatagacaaatatacttgctgggcaaactttcaaaacagaaatttaaaagttaaacactatcttgcagaaaatgtacttaaatggctaattgtaccttctgactcccttgtgtacaactctataccctgtcaattcaattccacagaatgcagcaaatacagtaaaaaaatatatctacagtttaaaattaaattggccccgctaaaacgcaatcataaaagaaaaatggagactctatcaatcctattaatttttttcatacagcaaaagaaaatgaacagaagttttatgacataaaatatttaaaatcctgtttttgcagagattaaaaaaacacaatactttccaggaatgtgcaattaagactaatttttaaaaaacgaatattatttatattaactactatagagttttgttaatacactgaatcctaaatacttttagtaagcaaagtttagtactattaattgtgaaatatctttgctagaaaatctgacatttatacaaaaatgcagactcaacttgatccttgaggatatctgccaaatcacttactacaaatacacagaagtatcctgtcttttttaaatcaatttaatctataatttgggtattccttttgctagtacaacactgatggtatttggcttgtttcttaacaaagaatcactgtagagaaaacaaaaagagttgccaataaaagtggcctttatttacctttccatagttaattctcatttgggagaagcaataaacaaagcaaccacctctgtaaatattactacagattcagatttcaacttctacacggctgttcctctgtccagttaaagcaatcacatcaagtcacttcacatctttagagtttggctttctataatgtttagtgggataaaaaaactactcttcactctcccctaccccaatggagagaaaaattaaaactataatataagctctttgagagaaaatataaagagcatgctgtttttaagtagacttcttccacaagtttagggcatggctgacagctgaatctataaaggagaccaaacttaatcatctcgaacaaagaactttgcatcctgctcccaactacaaattgattatacaaaagagacagaaagaagctatgtaatggtttaacttcctatatgcatctaagaagccttcctaaagtatcttgttaagtaaatcccaggagtgacgagactgaaaatgttcctcagtatttacattcatcacgggagactggccagcccttagagacaacatgaacacatctatcaggcagcatccggtcatctccaatgcttggccacttacacatgaaacctggcttcaaatagcaacttaatcatcaaggtgttgcccatatcttctcttttgacattagaatgacatcctacataaaatatttagatgcacatttggtcagctcaaaaatattataccctcaggtacaatataagacactcaaaaaaaatgtcaaaagttttttatttccacatagaagaaaaaaaatccttcccaatattgattttaatatgcaactcttcctattaatcttatttaagaaattaggagtttggcaccttaaaattactaagaacaaaaaaattattcaacataaatggcttttaaatgtgttgcttttagtctgctgaggcaggtccatatagattcatcagtttacaaacatacccaatgcacattttagtcaacttattatcatccaattttaatgaacagcacgtggctataatttcatttgacagtatctgtttttgcaacaaattgctgcaagtaccttcagggcccacaggtaactactatgtaattcctaaaatgttaatttgtacataatggcttgatagcaaatagaaaggaaagaacatatggtacatacttaaaaagctttttgaacagaaaacctggcactttaaaaccttcgtcaaattcagcatcactttcctcagaatcgtcctccagcttcagacgtttctctttgtcctgcagtctcagtttattccatctcctaccatgaaaataaaaatcacatttccattattttgatcacaagacagatttaaaaagatagctcctgataatgtacaagaaaaaacaggcaaattagaacggtctcttaggttaatgctgccattattacccaaaacactgatattcaaagaggaaaaacaattctcttctccagccatctcaattcatttcttatgtaaattattatagctgctctagaaatatttctttaaggtctcatttcattatcaaaactacttgctcctcttctggcataccctaagggaaaatttctctgctggttcgtaagacatgaaattagtcctagaaaagattcagtaaaaatttcaatataattgagtgtcttcacaaccgcaatactatgtaacaaaaaatagatttataattactatttctgttctaaagatatgatagtcacagcataaaacaacaaagccccttaaacataaagcaaatttggggtcaaaatcactgaatcaggttcacattactgattacttaactgggggaagaggcatcagcaatatacaagcactgatagtgctaccactcaaaaaaatgtgttcactgaataaaatctaagttacaaatttagtaatatgatactttcagatataaaataaggtgaacacttatatttcagaaggaaatatatttcatctaaatatctgaaagtcttagcaatacaccaaggttgtggagaaggtgcacccatttaaccagactaattttgcatttacataactataatggactctagttgtcgtgagtggggaaaaaaaaaaagcctcaaattctattcactttcaaaataaaaagatgatgttttcattcagcatggtgcaactgatgctctgaatttcacaaaatggtggaaatggaataaaacaataatacagagaaatgctttcaaactacaataaaaaaaaaactcataggaagcgagtaagagcagcaacacatataaggcatttatctgccactgactatgcaagagtaagagagaatgtccgagggaaggcaagagaaaatgaaagggtaatactacacatgctgcctggccaaaggtatggtgtgttgtccagtatccattacaaaaccacacagagcccaatgctagtatgtaggtagctactggtggaccttaaagcacatcctctgataaactcttgccttgttgaaaatttcaactcttcaaggtaacaaaaggaagggctagctgaaatttacttgtgatcaacaagaactggttatctgaaattgcactacacggtagtaaaggacctataaataagatcaatgaagcactgttggtcatttccagagaagaacagcaaatggaagaggcagtatatggccaagtctaaggaaatagctatcatctaacaacagtttaataagtgatactttttataaaaaaatttaatgtcctttttgtgcttaacttctaaaggcaatctcttcttctccactggtattttttttccttaaaaattatctccatgcaatggacaaaatgaattatctctaggtggctataaaagtcttctgggtttcatgttatttacaaatttagttaaatgcaatggtgtacaacaatcgttcttgacagggggcaattctgtcccttcaaccccaccctggggtaatctgacaatgcccagagatattcttggttgttagaactgtggaaggagtcgggaggatatactactactggcatcttgcaggtgagtccaggtatgctgctaaacatcctacaccacacaggacagcccccaaacccctcggtaaaaagttatcaagtctcaaatgtcaataatgtcaaagccaagaagccctggcatataggtatcccttactatcaaaacttagaaactgaacagatatatatacactttcctgatacacatatctgaattcttgatatatatacactttcctgatacacatatctgaattcttgctactcactctgaaattcagcagtcgaggagtttacataatgagagagtcctcggtatcaaaactatgaacgcagagccaaacttctgcataacaaaggatacttgtatttagcaaacttgtggataacataaaccttggaagaatcacagccacttaaacatacttcactttgcaatttctccaagataattttacagaaggagaaataaaaacaccagaatatattgccttttgaagtttggcacaaggccattaaatattttatatacagggtatcactttttaaactttattgatatatgatgaccatttccttagacttagccagtcaatctttgtggctgctaaatttcccaccacatcactctgcatcgacaagattcagtttcctcctcctccctccctcctaaaatatacaggcatcttgtcgccacagaactcagcacctaggaaaccacataagccactacagaaacgattgcattctagtgccttccgcttcataaagaaagatgaaaagggccaaacatttattcagtttggctaaaggatgactaaaagtggtggggaaaatcattattgcctgcaagtatttgtatcattgtgaagacaaattgccccagtagaattatacacatattaaagacagaaaatatcatggttataaaaccacatgcatacagagctcaggcgaagagattcttctgttacataagcaatacttcctcatgtgacttgtagccaaaatagacctgaccatctgatgagggtccactgaagcagcacagctaaagatggggccgacaagtacaccacaacacactagggaaagggggagaaccaggttcatctgcacatacacagaaacgtgccttcctcatcccagacgctgccaagagactttaagggctctctttaacatgtctaaccagcctgtactgtagtctggcaggctgagtagtctgtctggccagcagatataaaggattctgtatataaacatcctgggtttgacatatgcagaagtgcaggcccaggcacaaaagtctgagctcagactagctatagtcaaatcctggtgccatttactagctcatgaaccctcagcaagtaacttaacttcatcagcatctaagtttcctccactgagatggggagaacagcagcacctacttcactgggttctgggaaggattaaataaggtgtcacatataaagcaccttagcacagaacctagattaggaagtgcttaataaactactatagtattatataaaaccacatacattttctgaaatcctcacgacaaccctgcagcagatactattactatgttcactgaaagaagagaaagcaagttacgtatgtggcccaatgcaatgtgcatattgcaacgtactctgtttaacagaactacctgaacatgtatacttaaacagaaactatgatagctcatcaaatggatgctcagttaattattatgaataatgtgctcaccataggagtaaagatacctagtcttcagatggtacctgctggaatatctcaatttaaaaattctgtcacaaatttgtaaatagtaaactgtcattaagtatggcagtcttttacatgatagtaacaaaaatagatacagattgacttaaaattggtagggagtgggtaagaattaaaatctgggccaagtgagctgaaatcttaaaaattagaaatgacctcaaaatgtctaaattctgttatttcaaaaagtagaccagttaactgagaaaaagcagaagggggcagtaaatagtccaatatttacccttttagaaaacaaataactttttcatgttctctattctctcattttaaaaaatccacacacgtaatagtcacagctgcagccacataaaacgaagtggtgggcatggtgttcactggctgtgtttctagctcctcacacaactgccagattcagcctgctgtcaactccactggcagccaattacaagagaagctgggaacaaacataaacctacaattccagtcagatgcagacagagaaaacactccctggtttccctacattcaggtaggaatgagaatctggcccaggctgtggggcctggggctgagactgcaataatcatctgtcagaagcaactcagacccagcacaaccagttgaacgacaccaggaacaatgcttcccccagttgtaacctattagggtgccgcatcaatggaaccctgaaagctagttgctgccatttaaagttaatttattttagaagaattttcagcattccaaggatgttcaaaataaataagtggaaagacacagctagctaccaccgtgccataccatgtatgcagcctcctcatctctgtgcacctgcattcctgtactgtccccaaatccttccccttacatatccacacattcagcagacctttcaaaccctcactcatgcagcaccaccatgcacagaaacctcccatgaccagccagacttaggtgtcctgtcttccaagggccctcccaatcccgtgacatcttggacacacctgggatctctactacagtgcccatcaagtgtagcatattgtgaaatccataccagtgtcctccactggactggaagccacctggggacaaacactgtcttagccatttttatagcactagagactggtataatgcctcctcatggcagaccgttaagtgctgaatgaatgaatgaagttcataattcggttagggaaaaggaagacacagacagagaagcgtgacttgaaaatggtcaaatggggtcatccagaaatgggttctggaaactttctgttctgtctcatttagagcctacctcttgctgcatttcctactccttctacccatatgactttaaagcactgctcctagctctgtccactggataaaaatggttaaggttcgctacaaaaaaatgacccataatgagggtggctgcaacatcagagaagttcttaatttagaatcttataacaaaaaaaaaaaaagataaggagaaggaaagctcatcattttgaacaataaaaaggtaaataaataaaaattgtgtgagtgatttaagtctgagctccattttttgggttcatcaccagtaggtctcctctgtaaggagcctggtttctgcacgccagctgatggaaagaaccaggagccctgagtttgctcccaagcttccccaggaccaggtgggaaaggctggacaaaagaagcaccttcttatgaaagaattcttatgatgggaaaaaagtctagacttaaactatatttacattactaggaaggaaatagtgtttttgatgttcccactttcatttttttctttaatctatacatgtaaaagtcacagctgcacccaaataaagtaagtgtgttgttcatcttcttttttactttttttttttttttgagacaaagtctcactctgtcacgtcagctggagtacagtggcacgatctcagctcactgcaacctccactttccagattcaagcaatccttgtgcctcagcctccagaatagctaggactacaggcatgcgccaccatgtccggctaagttttgtattttttggtgtagatggggttttgccatattggccaagctggtctcagactactgacctcaagtgatctgcctgccttgccttccaaagtgctaggattgcaggcgtgagccaccattcccgacccatcagggcattttctaactcctaaagcccgtctcaggctccagtggtggtcactagaagagaacccaacaacagacacagatttaagataaccacagagaagtgaaaaccgaatgtaggcaaaagaggtgcattacaggcatttaactggtaaggggaggcctgaactttagaaaatataatgtaacattgttgaatctgcctcctccaccacaaaatgagccaaataatgactttttatgaggactaaatgaaattatgtatgtacattatacttttgaaactacataaatttcagatgctataacagttggcagattacacaaaaagattgagaaattttaattaattgcaggttaaatgtgaataaaaaataacaaatgtcaaaacacctattgcagtcttgagccagcaggagctcagttcaacccccaagcatagcagactgtcatgctagctcactccatactggtcagtcaagatcagcaggacattccagtcaggacatcctatcatccaggacagcaaggaggctggaaatcaagccaaaagagaagacacaaaagagatacaagagaaggatctggtacatctacctcagaatacaactgtgagaaaccatactgcaatcctgacctacctacacttagaaccaaggggcatgttgcacggtttgtcccctagacagatgtctagtgccccctagtgtgttcaaaggagaaataattacatttcttcccaatattgatactgtacttatatttttatagatattttatcattaagtgggccttaagcttattttaaaaaagtatgaaaggtaccaaaagcataacatcaataaaacaaagtttgtaacagctaatgattttactatgcctatgatacgttgaacagcccttatccaaaatgcttgggacaagaagtgttttggattttggaatatttgcatatacacaatgagatatgttgggatgggacccaagactaaatacgaattcatttatgtttcatatataacttatacacataggctgaaggtaattttatacaatattttgtgcatgaaacgaagttttgactgtgtcttgactgagacccaacatatgaggtcaaatatggaattttccacttgtggcatcacgttgctaaaaaattttcagattttggattttcggactagggatggtcaacctgtaatatcaattgttaaactgcctttacttgtgaaaggtcaccttttcatacgtatgagtattcattatacaccctccttcacggttctcacagaccctcatttcaagcatcttactgccttggtggaatctttgtggtaacttttagctagtgggcatgtaacaagaatagctaatacttacggagtgcctgatgtatgccaaatatcttatacatatcatcacccatgaagaaggtactgctgtgatccccatcttacaggtgagtggatacacaagacctcagagctactcggctaggctctggcactcactccatggcccgtggtgtctaacccctatgctatatactgcctccttaaggaaagtcagctagctctggacaagttttgttttgagattacatatacacacatacatacatatttcttaattgggtcagaaaacaaatagtaattatgactgacagtgatactgggtactgggcactattttaagtatttcacatttattaattcatttaatctttacaacctaataagggagatactatattgtatgagtccattttcactgctataaagaaatacccgagactgggtaatttataaggaaagaggtttaattgactcacaattcggcacggctgggaggcctcaggaaacttataatcatggtggaaggtgaagggcaccttcttcacaaggcggcaggaggaagtgagtgcaagcacaggaaaaacttccacttttaaaaccataagctctcatgaaaactaactatcgtgagaacagcatgggggaaaccgcccccataatccaatcacttcccatcaggttcctcccttgacatatggggactacaattcaagatgagatttgggtggggacagaaagccaaaccatatcaatactattgttattctctctctctctcttttttttttaacaattaaagcagacagggagaaagaaaggaagctgtccaagattaccaatgagttaagggaaaagattcaaacccagataatcaagttccagagtctatattcctatctgttacataatactgtcttcaaaaaagtattttccaaactccctagtaccaccccttttctcacagtgccagcgaagggtcctctaactgccacagaacgaaagcaattgcacaagaacaaaccaaattctaaaacttcaatccaaatgttgtcttaaaaaaacatcaggactaaggtttaaagaagggaaagattgccttcatttttgtacaataacatgattccttccccaccttaatagtgtgcaaagtaagtcaaaactcactcttcactacacccctgcaaacttttccaagtaacagtaaaatcagtttagcagttctttgaactatacataatataggctgaacaatcatgtaatacacattttatactagacaaatcaatgtacacaactgcccataccaacacacaaaagggacaaaatacacatattaatgggaattatcaaatattagttgcctgagatcatattaataaaataaacatgccctctccaaaacttcaaggaggtcacctaccgtggtgctcaaaattcaaaacagaccttactgctctattgtaatatttttatgttgcaaggatcattgtacacagagcagtttaaatctacaccgtctgtaaggaaaaagctgtgtatcatacagttaaatcattcttaatacagagtgacatttcaacctcaagatcattctctacctattgcaatatccatttaagaaattcaacaacagaggcacaatgagtacaatttgatttttaaaaatatattcaggcaccaagctgggtatttaatatagtttgcattctgtagtatgataggttttctatttcagacagctaagaatgccttacagattagtctaatttgctaaattgagatacttggtgttttacttttcttatcttcctttttatggtctatctgggtaaacttaattggcaaatctgagcagatgaaataccctcagttaggagtgcagatctcatggagtaaattaagactgatatagacaattatgcccagagccaagaatgaaaggtgtgtgcagagcaggaagcagaattagtcttcatttgtgtctcagctttgttatttaaaagaaggcaatgtgctctctaagaaaacatctttaacccatttatgtctgaggttacaattttttgaatttttgcatgaaattcatatatgttacctagaaaaattcaaggaacaaaaatttgaagagaaaaaaaaatttattatgttccattgttatgtgacgttccaaaattggaacactaggcaaaaccactgctacactgtacataatgtataaaactatgtttcttatctcaggaggtggtgacacctgctattcagtgtgatattcaacggaacacttcacatgtaaggcaacatcacatttttcacatcgaaaagttgtgttcttatgacattcagcgcatcgcgtttgctttccctgtttgactatcacatgatttatgccatcataacgtgagtcaatgttacgcttctgaggtcttcctttttggccaggttctggaggatgaccatgggtctccagataatggcataccacacgtcgacgaaactccagaaaatccactggtttctcatcatatgttttatgcaattgccaagcattttgtaagaccagttcgaaacagaacaaaagagggcttgaataccatttctttccacggattgatgcccgatacttatcaatgttttcatcagctctgtctacgcctcccatgaactggttatacactttgatcatgtttggctgctgaacttgtatcttctttttcagtttctgggagtaacgactgacaagacacaggggatggataccagcaccagatgaggcaacagtgacaacactgttatcattccatctgcagacaatattgcctttgccatcaattcgataatcaaatgtgcctctttcttttttctttaaagctacatctgattccagtggaactctgtcaatgtgatcctttctcactgtacctgttgcctgatgtcccattgaactgagcttatcaagaagtgcaatactggtgaaaaagttattgaatacaaaatggtattgtccagggtgtgcctctgtaagtgcctcactaaactgaaggacaagtgacgcaccgacaccatattcctcatgtttagtatttgggtttttaccctgatacggctgaaaccagcaaatgtagcccagacaggtggcaccacaccaaaacttatagccaaaccgaatgggctttccccgaataaattgtttgcacccgtgacgaccaaaataaggaaccatgaattcatcaaagctgaaatatgtttcatttggaacaaatttcatgcatctctcattaagtttgcttatgagaggtcgcaatttggaaaatttgtccactggatccaaatttgcattgtcagcaacatgcaaattagaaaatatagtttcaaaccggtcacgtctcatggcagcactaaccagtacattatgcacatctgttctttgttcccaaaacatacgccttctaggaactgagacataaccactcagaaaaataattcccagaaaacatttgaattcagagctagtcaagccaagatgtacacctttactgcaagcatataagttggagtacttgacaatgagttcaatgacctcgtcatcaagaaaaagttcaagaatttctgtgggagttctcattacggtgaagaaatcgtttggtggtgctgtaactctacctgctacgggttgtacagttaggtcggcttttttccatttgcaaagaatttttgtcattttcctcctccttgatggtggaggttgctgcacagtaaacgtagatggaacttcatcaggagagtcatctttaggtgcgtatgagggatcatctgagtcagactcagcatcagagccatcttgaataagatacgcagctgtgtgcaacaaagaacctggcagattatttattgttccaccttcttcatctcctgattcctcatcagaaacaggtgctgtagcattttcaggtggttgtatcactatagcacttgcttctatgctgtcatctgtctctaaaaggtcagttatttcatgtaaacttagtgttcgaggcatcttgggactaaaacggaaaaaaggtattattagtcctagtggtagtggttttgcctagtgttccaaaaatggaacatgaaaaatgtcaaacccataactaatgcaataataatactttctgtattttctttttaccgcacaatagcataactagtagagaagttatttcttaaaaattactagtataggatgtagtgcagtaaagttatatgtacctgtctttggatactcaaaaatgtttctgaaaactcacatcactttttgacaagctcccagcatgccagtatctgtagcagtaactaactctgtgcaccaagtgataacatgtaccctcaggaggcagacatgtgtgaaaaatcagaccttggcaatgaccttgagcagtagggcatgaataactcccacatgcttagcgttccaataatggaacactaggcataaataggttttaaaagtgtaactttttctttcaacttatagattcctaaaagaaaatgaacacagtcttctttcttttttttttttctctcaggctccagtgatccacccacctcagcctcctgggtagctgggactacaggcgcacatcaccacacccagctaactttttctatttttggggtttcaccatgttgcccaggctggtctcgaactcttgagctcaagcaatcctcctgccttggcctcctaaagtgctgggattacaggtatgagccattgtgcccggccaggcttatttcttgagaaaaatgaactctcagagatgttaagaacattcttaaaataattgtatttaggtttctggataaaatctcaaacttttactaaattcagattttgggagagttttgttttttctctttaatttgggctttaaaaaaaaggcacaatcaaatcaacctccacattgtgagttggcctttgccgaagcacagcctaaaattgctaaatcctcatcgggtgcaaaccaggatccaactgaaggacagacaggacaatcccagtgcaaacaggtgctagacagaagggagaagttcccagaagacaataaaatggagacaggctgtgaggttggtggttctcagggcactgcctttagaagcatttcaggataggaatgggacattgggttggagttggcccccatcaagtggagggagaaaccaggcactgaaacaatgcttgtccgagtctgctgcagcaaaccaagctgcgagatcactctcatgtgtcccacaccaccttcagaccccttctccttctccaagcccttccactgactgctgccttgagcaaatgacttcatctctctgggctcaaagtcctatctcctgggtggctgtaaggattaaacgaattaacctatataacaagaagaaccacaagaaccactaagtcgtacgcattcaaacatgtcagccatcattgttcttgtgcaccactcccgcccctgcccccacctccacttgatgccacctttgctcaggccctaaaggctgcaacgttccaaatccacaagactctcttcataacagtcattctacttggcttgacccctagcatctgaaatgctgacagctccctcctcagaacagtggatgtgcacaacccaaccctcccaagccagggttcaatggggccctggccacagaggcccagtgctcaggggaaggacaatgaagagtattatcttcgcaggagattatgtctcacagactattagaagacattctgtaagacttacacaatgaatggaatctttatcacccctttacatctcagagttactcatgtaaaaaaggtaaaaaatagggcacaagaaaaacctttaggatcaaaaatttattaaaaaccaattatatcaacaggcatcaagtctacagattcaggttacaccagaccatgaagtaaattctgtccccatccacaccatacttgccaggtcttctagactcctgagccatctccctatatcctcatccaaattcccagattacaggcttaggtttttggtttggttttcagtccaatggaggtgggggcagctatgtgttgatttttggcaccaccctgtggtcatacctaaatattgcaccttctactcaatcccacaaagggaaggaaacatgtatgtagagggcccagccgacttcaaatctcagctctacttcacagtaaaactgtgggcaagccaattaactggaggggccgtgattataaccatgtaaagatgtgtattcacagaaccaaagactggaatgacatgtagaaaataaaaacataaaagaggtcattttttcatcttaatattgttgtcatacttttacaataaaaatagggactcatcagaagtgctgaaaggtggcgagggagccttcaaaccatgcagaggaaccaactcaaatccacttcaggctatgcatttagcagcttagcccaatgcaccaggtcatctgaggagactcaggcaccgcctactgaagagtccgtttctgaactccccactatgtttccctgatcggggtgggcatgggtcggggatttatcccagaggcaattatttgctgagtgtgggccatagtaaagaaaaaagcattacattctcaagcctcaacatccttaccaacaatgcttcccaactgcctcaaagctctcctaaatgagaacatagttctttctgagcaaggtcctgtggaccatgaagaatgtcaccaagctcccctcagagtcagcgggagctcagccaaagcacaagtgcagtgcccagctcctcccactctgcacctgctgcctcagactccccacgctgagcccaggcccctaccctctgaaggtgtttcccatgtgattctgacacacacaccccacaagaaccagatgatctatgacatacagcatttagctaaggctccctgccaggccctcccctgtgtacatacaactgtgcagggcacataaaagaggatttttgagaaactgatatacaaactgcatcagccaaaagctgcagccccaaaaaagagaaatacataagactgacttatttccatccctagctcccaaacctgacagtgatcagagccatctgggaacattttttaaaagtcctgcccggtgaccccacgctacacttcctaagtcagcgtctccagtgttaggggctcccagtgacactgcataatcagtctgtgggtggggaagctttgctctcgtctgtgctcgttgccctcactgtagtctgcgagggcagcaacttaaatagtaactgccgatacatgaaaatagagtaagaacttgggggaatgagtttaagtcaaatgataaacactaaccctagtcctgccagcaagaagagacaaaaacatatctggaaatgcattttctcactcaggatgcaacccatctatgccctgcagcctgaccaagcagtgctgaccactgctggacaaagaggcaggagtcagtgacatctgttttattatgtcaaggctggcaaatacctagcatgaatgttgctagttccccactgtgcctatgatagacatcactaaggaactgcacactcttcccaatccacccaaacagggcctcggagccccctgaatagactaccactccccagaaatcagagctggctggaaagtgaagcccacctgccctccctgtcctcagcctctctgcacattgtggcatcacaccaacctccaaggcaatccaaatgagaaccctgaggaaataatgtgcctccaaagcaaagcaaattccttcccttctcaatgatgcacctggagtttaggggcaaatgcgtaacattgttaatttggataagggtcatattaatatatctgagccacccaacaagacaaggccctgcactggatgaacttccccaacagtctctcccaaatgcctcagtctgaattcattattcccttcacacttggttaggtcctatttgtgcccaagtctattaacagactgcaaattttttgccagaaacccttgaagccagtccaaggatgcagacatgcattgttgacatgaaagcaaagataaagctatggaggcttacctcgaatatggcaactgggaagtgaatcaataacatggaggtaacaaggactggggacaagcgacctgatctttatcaccctgaaggggaaaggttcacatgaaatgtttggtcttctgggccacacagggctgtcttggctgcacagcctgtactaggtaagcagcatgtaggtgctcaccgggaacccacatcactcaaacactgaaggtgtgttagtcctaatctttatttggcacccggagctcccaggcccacaatgtgcaaagcagtagtatattttaagaaagcactagacctcacaaccaacagccataagcaaatggaaaccgtggtagcacaaagtaaaatgaaaaaataatgtatgttttacaagacctgtataccactgaccatagaaccgacagaacatttacttctaagcagtggctcatccatcctgtatgacatgaaagggtatgaaaaccagggaacccactgaggagtcagcctccagatacagttcagtgcagaggaggaggcaggagaaacacatgagaagggggaatacacggtttgaaaaatggttaaaacttcaaagactgagctgagggcttgagccaaatgaaggaaagcaggatccaaagggcgactgcccagttccattaaaaaagctatggaaagggcttgacggaaaattcctagtaagtatcagctaaaacaaaggcacctagttagggtgaacctagtgccagtgaaaggccgatggctctcaagctgagagaataaagaggatgagatatccagaagtcacccactctcacttcctagagttgaaaagagcattataattaacaggctataccctcagtaaaaggtgttaagttcagcaaagggtgcctaccctgggaactactcctaaattctaaccactaaaaaaaaactaattttctatgttgtaaactctatgactttattctaatcatccatcgtcaaaccactgctaagacaagcaaccctaaaggtctttctgtttctcaagggaatagcattaccatttcaattagtctacaaagatcagcaatgagtaacaaaatatagagagactggcagttctaatatgcttctcaatcctgagcattttattttctttcatcccccaaaccaaacagcaccaaaggagatgtaataacaaatatttcaatgtggatatctgcagtttaacagccttaataactgtagctataaaatgttaagagctatcgtattttggtggcaattaagagttattgatatttctgaaattcatttgagatttcactgtagctttagcaaaatattggctctggaaataataaattgttttacaatcttaacattattaagaaaaacttattgccatcaaattaactaaacccacatttaaaattcaatcaaaataaattgctcttgatcaaaatactgatatattttaaacatatttaatattgacccaatttaattggaaaaatatatattgctccatttataatcaatatgttgagattaacacttttattaattccttgcagtagttaagaaaaagtctgacaccgctcactgttcaagagtactgggcaacattcctcaaacaacttcacaggtaataaacgtgcacagaaacgaaagctgtgctgagggatgacaaatataagccagccctcatctgtgcattactacataaggtgctactagaatgtgagtgccgcaactctaaagaacaggatttaagtcacaggtcctcaaattactgtttaaaagaattgacacatctatttcggaaaggttatggaatgtctgtagtgtctggacgggggttaatgagcagttctaagtaacaagaaaaaacaccaggtcaaccttcactcacaaaggccaataaatacaacaaactaggtctcttcaccttgagaaataagaaaaaactgttgaggattgggaaaaagccatcccactatcaagtattttaaaagtaataaggttcctttttccctttgacttccttagagctaagtgagctctaagtcaaggagacttgaaatgcgcggcagtagcacagtgttcagtgggccaccatggggaggcctgcaatacagattatttttcctggctctcagaaaacgtgtggcaatatgcaattcagacttcatgtttcacatgttcaccttcccttttatggtgcttgctttatacaatgacaatgtcatggagctaaaagccaaagtcagtctctaacataaaaaacaacagtgaaaagaaaggtatgctgtgcatacaaagtacactttttgcatgatggtggcttataattatgcagatgactattttctcaagacaaaggaaggatttacaaaagcaagcttattctttctatgccaaagcttaagtttcagctcttttttgaagaaaagttctctaaaattactttcctgcttcaaaagggaaaacagaaacccctatccagtatgcattaattcacccttttctttttcctgatactcattctagggtgactgtcggtataaaggcgacacagctcacactcagccctctgtatgcctcttgccccagccttcccttaagtttttcatcttagacttgcctccaaatccaactaaagacctagaagtacatgcatttggggccagcatcattaaggactcaggggccccactgcttctagcaggttaaggctgcagaaatccaacctctgtataatcgggggggtctaatatattaagctggatctagaatgcttacatattaataaacctgtcacctaagataaagcaaacagtacaatgtatttataatccccacagaccgaccttaaccgctgcttataataatcttcatctccatcatctcggtatcttcccactttccgacctcctcctcctccttctcctacagaagcagcttcagcttcttccccagaacttgggaaaaagtcatcatcaatctcctgcactggcactttcttctgccgtttcccgcccttgggcagaggcttcagctcatagtcagtaccatctccagacaggtccgcctctgccccctccacctcgtcatcttcctcctcttcctcctcctctgtggggaaatactcagactcttcaccctcagagtctccctctgcctctggcctcatgtctgactcccaaggtctccttgcctttggcaatcccactttcccctggaactgcaaagccctcttctggagtttcttgatgtgctttttcaaacgctcctcttttttggacagaactctggctttcttgtttggtttgtttttattttgcactggggctggaggcgtgactggggctggagcttttctagctgctcttttattacaaccttgcttcttcctttcaaaagacagttttgcttgatctgccaaatacttttcgaagcctgatgcttcattaagcatgatttttctgggctttttctcctgtttctgagggatctgggtaccaaaaggtgtcatctggccagtgcggatgagctcttcccaggcagtctcctggacaggcatgagcatgctgccaagactggatggccccggctctgaaagaacaatagcaatgcgtttcgcactagcatgaaactttccgagggtacaaaagaaatgctcactctttcaagaaatattaggcagctacaaataactcatataaaaaaagaatcatccatgtactaaagcatgttacatatgaaggacagaataaaattatagcatcatgctatatttaatatattcctgttcaaaaagacaacttctcagtaacttttccccaaaatatttcactataaatatactctctgccatccaaagataggcttattactgtataaatacagttataaatagtcaagtttagctgtgtttccttatcagctgagtagtcgtccatgaggaagcaagctccgaagttctcacgtcattgctaaaaccaacattcagatggacttaaattcaagagacagtaaaaccaaaaacagggatcaccatgtacctaaaaaggaaaaacataaatgtcagctctatgctgcccagcatggcagttaccagtcacctgcagctatttaaatttaaattacattaagttaaaaactcagttccacagttgcatttgccctttttcaagtgctcaagagctacacgtgactaatggctactataatgggcaacacagagaacattttcatcactgcaaaaaggtctattggacagcagcactgtgttagatatgtgaagttaactgacttgaagacattacaccataagtgtaaagtcaccagaaagtatccctctttcattagttgaaattcatctctggcaaaattaccacataaccaaaataccaaaagacctaaggcttaataggaaggaatccatattctaaaatctacaattcttgcaggccaatgatacccagtttttcattaaacttgcactgaaataaaacatacatctgaaagtgcacaaatcattaagtgtagaactcagtgaatattcagaaaaaatgtactcataaactagcagccatatcaactaacagaattactagcaccaccagatgagcccttcaggctacctcccagcctctacgccccccaagataatgatggacctggactcctaacgtacagacaagttgtgcctgtctctgaacgctacgtaagtggaaatgtttgtgccctgtgtccaccttccttcacccaacattatgcttttgagctgcatccttactgttgaatgtagctgtagtttgttaactctcactgttaatgcacatttgagtggcttccaggttttggctactaggaataatgttgctatgaatattctgatgcacatcttttggttttatttatatttatatatttatatatttatatatttttatatatatatatatatatatatatatatatatatatatatatatctgggtatgctaagctttagtagacactgtcagttttccaaagtgttacgttccaaagtccccatcaactgtgtcagaaagttccaactggtgtatattcttgccattccatgttagctattttggtagatgtgtagtggtaccacattatggctataatttacatttccctgatgactaacaaaataggtgcctttcatgaatttatcttttggatagccttttttgtgtaggaagtgttccagtctttcgcccatttttgtttgtctgtttctttaaatgatttctagttctttatacatcctagatttgagtcctttgattcacacatgtattgcaaatatcttccccagctcagtatcttgccctaaatgctatcttctgatgaacagaagttcttggttttatatatagtccatttaacaaatcttttcctttacactgagtattttgcctcaattaagccttaggtctttacactgagtattttgcttcctattaagccttaggtcttttggtattttggttatgtggtaattttgccggagatgaatttcaactaatgaaagagggatactttctgggtgactttacagttatggtgtaacttccaatttcagttcatgtcttcaagtgttggctggtgtccagacggagagatataataggaaccaggaactcaaaaaaagagcaaagccagatgtctacagatctgtataaggtactagtagaacctaggtggctgcaaaagccatggggaatagataaccagggagaggcagtagaacaagaagagggctcaaagaaatcctgagaaacatcaatatttaagatatggccagaaataactatgcagaagtagtcagagggctaaaaagaaaaccagtagagaagcagggatcccacaaggaacagaagtgtcagctgctgtggacaggcagagtggaacaaggataaaaaggggctcttggatttgaggaggtagctattaaccctagacaatgtagctattaaccctactaccaaagttttagctattaaccctaagaggtagctattaaccctactaccaaagtcacagtaggaggtgaaagacaacagcagatctgagacggccagacaggaacaaacatctgttatcaatgagaaacatagtacacagcagttaaaagcactggtcataggcctaatgaattctgagaggctgaactttaaaaccacgtacttttgggctgggtgcagtggctcacacctgtaatcccagtactttgggaggccaaggtgagcagatcacctgacgtcaggagttcgagaccagcttggctaacatggtgaaaccctgtttctactaaaaatacaaaaaattagctgggcatggtggtatgcgcctgtaatccagctacttgggaggctgaggcaggagaatcgcttgaacccgggaggcagaggttgcagtgagctgagatggtgccattgcactccaaacttgggcaacaagaacgaaactctgtttcaaaaatatacatatttttttctattgcttcaattaattcttcataacaattctcatcttactgaataaacttctaaagctagtagaaaatagttgcttagagaatttaatgctaagcagctttaatctgtatttcaaatagtcaatgcctatgcagccaccaacaatttgtacacacacacacacatacacacacacaatgactgcaaagataatttagttccagagcttacgaattttcccaaaaagttttccaaaagacaaccatccaagacagtaatgtaaatgaaatactgcccagagtacctgaatgaagatgtcttttcttaaactgatgcttggaaagcctgccaaatacgctctttaaagacacgtgagagccattctacaaatgcgattaatgatgttgggcttccaacatgtaatttaatcatgatgctagttgtctttatcaaattaacaaaataagaatgtttaagatttccagtgtattaaatgtaataataaatgtgtaccagcagcctcctatgaactgagttaaaagtttactttaattctctttgagagggatttggttctgcaggtgtagagaataaaattttcctaaatctgttttgacactaaggcaaagaaacgtatttttctcaaaacccaggcaaagactaaagagacaccctccactgactacaggcatcaggcatcaattcaagaacacagagaaactgctcctagcatcctcacctgcatcctcctccagactggcgtgatctagttcaattttcacctctgctcctccaaggatggcctggagatgcttttgttttgcagtgatcttttttagctgttgttccttgaatggtaaatatagaagacagaaaacagcaatgaagtgatttattgttaaatacaaaagatagcattatgaaattttaaacttaaatccaaagtaaaataaaaataatatacattacataaaaattccatacattactattactagagagccctatgtgagcaactaccacttttctaggagtaaaggggccgtgaatattcccagcagacaggcatgcctgcacccccatgctctcctgaggacggcagactgccttctatgtgcccgagcccttaaatacatgggcactgacctgaaaggtggacttgttctacttggtttcccccttacacactgggcaaatccctaaactactctgtatttctgattcagaaccaatgggctatggaagtcaacaggccataagataagaaataaaaacacaaatgttcaattgaaaaagttagtctcctttgataacctactatatttatgactgtccttttagtattctacctaatcaaaaagctttaagaaaaaaatatatcttgccatgcctctccaccctggccacgccagactcctctttgtcttgttcccttccacatcaccagaactcagatatgtgcccttgggcttcactggggaggcccaatgaactgggcttgtggtacctggttcatctttccaaggtcaagaatgtttcaacttcaaatacgagtgtgggacaaggggaaatcctgaacataaatgccacactgcaatgacttgcaatttgttttttctcagtttttctctcagcaacattctgtctaaagcactttccctctgaatagtctacctctaaccatcaaagagctgctaaagacaagaatgcataattaagttagactaggacctgaagtggtctcaagtttgatgctctacacccttgaaattccagcccactagaagcccaagaaggtctctgcacatcaatttcacatgctcccacaagagaccagatgtcctctctctgatttgggaggacccacctgccttgggcaactgctagctttgacctttgggctgctattctggaagcaagtgagagaagatggggtagtgcaggtaacagactggtgagtggaaagtataataaaaggagggccacgtgaactgaaccaacgcacagccctgcccctggagagcttaaagaaaagatgcaaggactctactcactgcagtgaatcaactgtaagcacaagttgggatggcagaactgaaatggttacagctagtcattcctatctattgcaatgtattttcacaaaggggtacataaatcataaaaaatgtttcagacctcacaaagctgtacataaatccttaaaaaaagtttcaaacttcataaaaataatatcctaagtaacaaatattccctacccttaagttttccaaagctaagtacaaccccagtgtggctgggtgctgactgtaacacccaaggtgggaggaagggccaagctctcgcaactgtcagcaaaggtgtgtgagggtcaatggctgcaccaccaagaaacagagtggagacaattagaggaagcaagggctaagcagaaaagagttcacaggagaccaggagactgaggccagtgtgaccctaagccaggccaaagaaatggtgatgcaggaaaactaaggaagtgcgcccaagtgaggcaagcaacaccaaaaaggaacttttctcaaatacacagatggtctccaacttatcatggtctgacttgcaatttttcaactttgtgatgggtttatcagggcataaccccattataaactgaggagcctctggacttaactatggtttgacttacaatattttgactttaagataggtttttcagtgtatttaatgcatttttgactaacaatattttcaatttacgatgggtttgtcgggatgtaaccctgttgtaaatcaaggagcaactgtatacgtatggatgtgtgtgtctatgtatgtgtgtttttttaaatgcaatagaatgggatgttaaaggaaaacagcagaaagattaaacatacaaaagaaacccaaaatttctctattgtaattataagtatttgcttcacatcttataagcactttttaaaatacttcctaaattaagtgcccctaaatgatgactttttcaaaaatgcaatactgaatgttattctgaatcaccttattatacttctgtcgttttacagaatctagtttcctgttgatgtctctgctggtggcagcttgagggctaagctgttcaataattttattgatttgccttagggatgtcgtacatgacctgaaaaataagataaattgtctattttgcactctgataacatttttatagcataatataaagagaaaaatgctaaaaacatgtcccttttacttcttattaactaaaagataaaggaaactaaaccagaatacatacccttattggccacaaataaaacttgtaggatcattagaggtttaagatgactgctagtgttttcttttatctagctgatttagatcagctcattcccatttgtaagctgcttcagtcattctacaagcattatttaagtgcctactttattcaacacactatgctagaacaatgtgcaataagttgtccttttacatgaaaaaatgcatacatgggttttttaagcccgttacggaagccttccaaagtctggaagcatcctaaatatgcttaaacatttttttatataaatcacacatctgcgacaatatttttcttctacataaatggaagattcacttactacagcactaaactttgtggtgcaaagaaaacaaatcaatttaaaataaattactcctaaaatagacaccatagaattgtagcttccaattttcaaaacacaaattcaatcttcttgatgattgtgtaatttgctgtttgtatcctctgtggattacaggataaacaatgcgtattactggctgagacaccacatgccaccagccatctagcatcactctgcatggagaccccacaactctcctctgtcacctctggagaaagaggacacatttccaagatcaaatgtaaaagtatcattacaaagagttgaggtcctcaacactcagactataaccatgaacgagcacctgctcctgaggaggccaaaagaacacaccagggaatggttagcagaaaacatgtctttgaagtaccaacaaccacattcatgacagcgccacactccaccctccccagctatcctctgtgacactgctccatcctccatcccgttcagccctcgccttctttcttgcttacctgacactgcccagaacactgcccaacgggggccaagcagcaatgataagtgagctcaacccctcccacttcccctctcctgtcctcacctcctacccttgctcaggtctacagcctccccttcttccccattaacgtgctatgctcaaaacagctcaagtcttctccctctctaagacacaaataaaatctccatttccagagtcagaacaaggatggaagaaaagaaaaccggggagtctttattatttctaaaaatgcaaatctgaaaaattgcccaaggactgaacactaagtttggggacagtaagctagaaagaagctaccgcacagagaaaaatgtgaagggggcgcaatgtattcctggcatctcgaataggaaacacctgaatttaggtgcacctctcctgagatcactttgtgcacatgctggtgaacagcccttctcttctggacattatgcatgcaactggctttcacgagctggacagagactctaactaccatgtacaatgccactcctaaggggaagggctgggactcaaagatgaggttgaggactgcccttattgactctgtcctccaaataaaaggttctacacatctcctaaacttctggaatactagagctttccattacctgaatatccctgtcatgttttaccaccactttgaaaggaagaagatgggctgcactcacgtgaggtcatccaggaccgaccgatactccttctccacgtcaacgagctgggaggcacggctggcctcatggatggcattgtccacctgctgaagcactccctgttccagcacgtcctggtcatagacgtccacacccaaaccctgcagctcaagggcctgggcgctaggctctactgcctggatctgatgtcggtcgatgtgcagcagggctggccctctcctcggagctgctgatgcgcaccccacagcagaggtggacagcccgtcacccacagaacgaaaggagaggtactcctccacctccccatcaccaccactttcttgcttgattgccatttcttcattattactgacaggttgactctgtaaacagtcttgctcctgagtttgacttgagtgggggattccctcatttggcattctctacagactacctaaaaggaaaaaaatttataagccttttcgttatataggattcattgtagttcttaaatattttataattagagcagactgatttctcaaaagatcaagtaataatcttccaactacataaattcaagtttccaagtattaatttactaaaaagggacaacgtatcttcttgagttctgataataaataagaaaaattaaccagaaaaagaaatgcagtatcatcaacaaaggacatttaggcagccagctaagaaagccagccaccaaaatcctggggtgatggccatggaatattcttcaaaacagctgaagtcatttggctgctgttttccaagttagcatcttcatttcattatgacacaaatgatttataatatagtggcaagatcaactgtaatgcataggaacagcgatgttaggaaagagcttctgtgtgaatctgagactagaaactcctaggctgaatacctatccagtaaataggagctttgaacaaatcagaagctcagaagattaattaggccaggcacgtggctcagtcctgtaatcccagcactttgggaggccaaagcgggaggatagagaccagccagggaaacacagcgagctcaggacttcgagaccagcctgggaaagataatgagaccttgtctctactaaaaatttaaaaccttagccaggcctggtgatgtgcacctatagtcccagttactcaaggggctgaggcaggaggatcacttgagcctgggagatggaggctgcagtgagccatgattgcacaactgcactctagcctgggcaaaagagcaagaccttgtaaaataaatttaaagtttttttaaaagattaattaaaatattctcaaaaataggctgggcacgatggctcacatctgtaatcccaacactttgggaggctgaagcgggcagattacttaaggtcaggtgtttgagaccagcctggcaaacatggtgaaacccgatctctactaaaaatacaataattggctgggtatgatggtgagcacctgtaatcccagccactcgggaggctgaagcaggagaatcacttgaacccaggaggcggaggttgcagtgagatgagatctcaccactgcattccagcataggcaacagagtgagactcaatctcaaaaaaaaaaaaaaaaaaaaacaaaaaaaaaactccattttaatacacagtataatttctcacccatcaggttagcaagaattcaaagcctgatagataaatccaatacagacaaggagaaggatcccccctcacatagtgctgctgagaatataaattagtaaagccccttgtagggacaacttagcaatatctattaaattaaaggcacatgacctttgtcaagcaattctaggtatttattccagagaactagtcacacacaggtgcaagaatgtttagtgcagcacatttttaatagtttaatgtaactactaagtatattctgtatactgatataaaagccatgttaagtgaaaaaattcatggtatgaacacacttatgctgaaaaaagtatctatcctgcacacagaatgatctggcaggatacaaactaagcctgcaaatcaggatggggaagagaaagcacagggaaaaataagggggaatgttcacattgtactccacatactcaggacctgctgctttaaggagaatatattcactatattacctatacaactatcacatctaataaatatattaaaaagcaaaacgataaccaaaaatcagtcttgctttttgtttaactgtgaataagatttctttgagcactgtaacttttctgttaaatgacaagttcccccagtgggccccactcatcccttattaagtaaaataagcccagcaataaagcaccgggatacaaagaattcagcatcatctacacccgagtggctatccactggagcagcagcatgtcagttaacaacagagcagggcaggtcagctagcccgggacacggacaagaggtcacacgagcatcgagcgaactatatatggtgtctggggcccaagaaatatcacggaggaactgagatttgaacacatgggccatgcatggtctgatatataggaggtgctcaatatctgctgaaaggaagtgaggttcagagctaagtctaaaataataaaaagtttggtctggacaaatgagtcaccagtgaattcagtcacaaaaatgagactctcaaaaaggaagcagataggaagcaggactggcaagcagcttacatgtaatcagtaccatttgcagcatgcagtcagaaatgcaaatctgagctcaagggaaagtctgggtgacatgtggacacatcagcagagtgagcagttccagggttcccaaggctctgacaggtacctaaggtcattttggagggtacgaggaggctaacattggaaaggttaaaaagtgaacaacacagtgagaaagttccttcttttggggcctgctgattattttcaagaggaaggctcagctcacctcactttccaacagagagagcaggattccagctcagagtgtctgtactagctggcagttaacaattctgttttcatttttcttatttgtacacacatgaggatttctttttaagaaaaaaggatgccaattcaaccaaaaatattaagtaaccatttttctatttctgtaaaataatatcaaaaagcaatagtattgtagtgtaaagacaaggttaaaaataaagaagtttggggaaaacttctaataataaaaaaggaggaagagcgtccagtgaatgagaaaaggctgagtgaatttggataccaatgggtcaccatttaccttggtaaaagaagtttcaggccaggcttggtggctcacacctgtaatcccagcactttgggaggccaaggcgggtggatcacctgagttcgtgaccagcctgacccaacatggtgaaaccccatctctactaaaatacaaaaattagccaggcgtggtggtgcatgcctgtaatcccagctactcgggaggctgaggcacgagaatcgcttgaacccaggaggcagaggttgcagtgagctgagatcacaccgcagaactccagcctgggcaacaagagtgaaactctgtctcgaaaaaataaaaaagtttcagtggagcgatagggccaaaaaccagactgtagtggttgaaatgtagttggtgtgtaaggagtggatgaggaaatggaggccacaagagagtggcctgtcctttaaagagcttgcctctggcagggagacagctacagtgataaagtaataatggatttgttgggggtagggagagaactagggcaagaaaaactagagcacgtaatggctggagggagacagaggagataacccagaaaggtgtaccaaaagagacagcaaaagtggaaggtcgcaagcagaaatgaacaggaggcacaacacatctttctcggactctggcagaaggaggattcctgatagatctaaatttgcaggtggaaaggagggaagctgaagtggattacagacaaaatatcccacaaagcagcaagttgggcagttcctgagtcaggagacaaagttggcactggggctaaagactaagagtctggaataaatgtcctgtacaagagaaaagggagttgacagggaacaaacactgatgattgctgtggaggacctacctgaggatctccccagccctgcaaagccatagactgctaacaatctccagggctgaacaatctcctccttcagtagtcctgggggaaatgtcactattgagggttttcagagcagaaatggtagcgcaaaagagtcacggggttgaagatgctgagaagagtagctgaagcaactgacttcagggtccaagctgggtaggtttaaaaaaacaaaaacaaacaaacaaaaaaacagaaggggcctggaaatgggagaaagggttcaagaagtcacttagtatctggcaatggccagaaaaccaagtcttctggaagtgagagttggaaaccagaaggctcttatcaggttaaagaatttcagaagtgaaataaatcatacatttgccgggagcggtggctcatgcctgtaatcccagcactttgggaggccgaggcgggaggatcacgaggtcagaagttcgagaccagcctgaccaacatagtgaaaccccgtctctactaaaaatgcaaaaattagctgggcatggaggcgcgcgcctgtaatcccagctactcgagaggctggggcaggagaatcgcttgaacccaggaggcggaggccgcagtgagcgagatcgcaccactgcactccagcctgggcgacagggcaagactccgtctcaaaaaaaaaaaaaaaaagaaagaaagaaatcatacatttaacaaatagttactgagagttaattacaccaggcaatgtactaggttaactaattcctgtccccaaagagcttagagtctcatgggaaaaacagacatttaaaaactatatatatatatatacacatacacacacacacacacacacacacacaaatataattgtggtgactgctgttaagaggaaagtacaaggctttctgacaaaatgagagaaaccaaattgaaattgtggaggtagatgtggggtcaaggaggcctctctgataaagtgacatctgataagtcagtcaggtcgaaagtaaagtgaacgtcttgcaaggaaacaacgtgtgaaattttttttttttttgagacggaatttcgctccggttgcccaggctggagtgcaacctccgccaggctccgccaggctcactgcaacctccgccttccgggttcaagcgattctcctgccttggcctcccgattagctgggattacaggcatatgccatcatgcccggctaatttttcgtatttagtaaagacagggtttcaccacgttggtaaggctggtctcgaactcctgacctcgggtgatccacccacctcggcctcccaacaacgtgcgtaacttttaagactagaaagagctgatgcacttgtgaaaatgcaagaaggctggaacaccgaatttttgactttatttttaactttgagttaagaagagcagagaagggctccgttcatggcctaagtcttgcagagtatcttctaaggcttaatcatctgggacactagtatcttcaccgtcctcccccatcactggggctcccgcagccaggggcaagctgggtctcatttggagggttggtcggacacaggcacagttctgagaggggacaggcaagggccaaatcacacaaggcctgggaaaacacgagcatggattccactcccagtgcaatggaatgactctgaaaactgttaagtaggctgatgatggcatgacctactttatgccagagaccacctggacaactgtgcggataatggattggaggagacaaagcaacaagaagatgatgggaaaagttgaggagaaaagcgagggctgcctgtcacaggatgacagcagttaagacgctgcgtggaagtcacgtaacagcagcatttacaggcggcctgcctcatccgcccacactcttatcaatttgactctatcaacgcccaaaacgtcggacgtacatctagcccgactctctttaaaataacagctccagcattttaatcgagatcaaaaaggacccagctgaccctgcgcgcagggggccttatacaaagtcggagaagtagctgggtcgctggccggccagggactcaagccgcctcaggtgagcgctccttggcgctacttccggtctcaggtgaggccgccggaagcgggcacttggccctaagacccgctacagtgcgtcctcgctgacaggctcaatcaccacggcgaggccaaggcgcggggccgcggcccgcccgagaagcctgagctgggccccgacaccccctgcccgacattcggccgggacccccgaacactcacccagggccgcgcgagcgcccacaaggaaacagagacgctaccgccgccagccgccttggaacccagctcgacgggccgtggcgcctgcgccctcagctcaaccatagacaccgcccccaacagcgactccgacttctgctggtgcggggaggcccgtggcgcatgcgcctggctcagcgtttgtttttaagcacgggcaagaccacgtggtttggagggacgggctcagcagcgcctttctacttgcgtgcgagcagggcgagaaagctgtctccgctgccggtcagctgggtggcttgcgaaggacgcttcgcccctagcgaaaaataccctgctggcaaggcagttatgaaagttaagacatatttccacgtagagggggatgcgggtgtgccatgcgaatgtaaatcctcacaattaaccttgaaccctgcagagaaagtcagcttgggcagggaagttagccgcactttttggtcgccaggctgtgacctctcttgttgtctcccacgactgaacacgggaaggatggagagctgtcctgcttctctgttccccctccgccacgcgcgcacct

SEQ ID NO: 90 - DNA, 42388 bp, Homo Sapiens
aaaaaaaaaaaaaggctgcagggccatcagcggatacagagggcagtggacgggcagcttggctgtgctgttgagcctgagggctgagaggacaccccggggcagtgtaaaggagactggacttagcaattggtaagaaaagttggataaagagagggttttgttagtatgggagaaacggcacccttttatactaatgagaactagtaacaacaaaaaaaaccacgctgtagaagacagagggaaactgctggatgggtgccttggaggaagccacaggccggggattggatgcacagggcaaggggcgctgagggagggtctggctgcagcttgctcagtgaagcaagaggcagggtgaggaaggggtgaggcggaggagcggctcggggctggctgcaagctaggagctgggagccactgacgcccagggacagaagctggtgctgcagagaggggcggcgcagggagtccctcttcttttcctttttaaaataattgctttactgagatataactcacacatcctgaaacccaccctgtaaaaacacgattaacagagttgtgagctaccaccaccgtaatgcaagggcacgcccatccccccgaaaaagaaaccccggcccgccgccggcggcccccgccctgcacccagccccgggagcccagtcgggcgtctgctctgcgtggcctgtgccgggcgccccgcgagtggggtccacaccacgctcctccgaagccacggtttcccaagcgcggtctccaggtccgtccgtccgcagccgacctcgcactcccctgcgttcgaggctgcggacttcggcggcaggacggacggcgcctctgcttctcattccgcccagggccagcccgggcccaggggtacctgctgtgcgtctggcgccgaggtgggccccgaagacccccaagcccgcccagggattcccttcccgaggccggagcggggaggcgccgcggggttcagggcgccctgcgcggggcgagctcgggggcgggggcccgcgcccgcccgtctgggcggtcctcaccggccctctgcaggtgaagggacctggctgcgagcccgcgggcgggcgtggcgttgaggcccagaccggaacttcctttcggcctcagtttcccggccggccccgcccccggcgcccgtacatgcggcccctttaaggactttctgcgccctcccgcctcttttttctcgtgcgtccccctccccacccccggcagcctgcctcgccctcgccgggagcgcgcctacgtcaccgcgcagacctcggccgcgtctttgcgcctgcgcctcctgggctggggtgagccattggctgtcgagctcagggcacgtgctagggggcggggccttgaccggaaagggtggggcaacggcgagaaaggccgcgtcgagcggtaggtgcagtcgtcgctgtggtgaccccaggtcctgatgcgtccggcccagggccagccaatggcggtagaggtcttgggcacctgacaagaggggcggtccccccgccggaaggggcggggcgaggcgagcggccgcgtcagcggtaggtggggctgtggttacgctgccgggcgggggtcgcgccggttcggtccccggggctctgcgggcgccgggcagagacctgcggccagggcgtgtcccgtgtgcccgagagcgccggcggcggggccggagggcgggccctgggccgagtgacaggccgcagccccccgagcaccgtcgaagccggcgcgcccgcccggtgcagccgctgtgcgagagcgaccccgcggtccaagcctcgcgtggccctgccgggccccttctttccccgagtagggcgcagcttcccagcctccgccccggcctcgcctggcgcttccttccgggtccttcggcctttccctggcggtgcggcaggccctcgcctcatcccaccaggcacgccgcggtgctcggccctgggtatccgggcaggctgcctccgttagggccgcccctgctctccggacgcgacttttcattggtctcagaatttcttggctcctcttggcctctgcagccttgctggaggctgccctgcggaatctgagtgaataagggaaacagcaacagtcacgttggggaaaagctgattcggacagcgccactggttcctttaacgcacgaccctcaatgcagcgtcccacacacgggattgtagaggtcccgagtttaaggttcacttttaaaactgcaatcaccgccgtaaaggccttgctggacacacatatttcccagagaggcacccacagatggaccccagcctcagggtcctcccggagctttcggtttatagtggaacccagtaaacacgttaataacaccgagagctataaaatacagatggtgatatagcatctctgccttacttatttctagatatggatcagaaactttcgaagttggtagaagagctcacaacttcaggagaaccccgactaaatcctgagaaaatgaaggaactgaagaaaatttgcaagtatgtcttagggttcagtaacagtaactgactggcccactgagcccaggacacacacagggccctgccctcctgcccccacctgggagagaaccacccgagggacacacccaggacattttctcggggccctgcagtacccggctctgacgggtggtcatgttctggggtcggggcgtgtggcgttggggaccccactgctctgtggttggtgcttctcttcattcccatttgtgtggtctggagcacatcctgtaggagttcttgagtgcacaaatgtgattcagagagaaacgtgcatctttttctttgctgctggacttttcgaagggaaagaatagagcttgctgatgggcgagttggtccatcgcctttagggtatgtccacctctgttcacttcctccaaggaaaacgccggaggggatctctgccgtcaccctcaggcagccagagattcatgggggaagcaaaacttcccctcggagggtggagcataagtcgaggacactgattattctgtatcctgtgtttgtaaaatggcagtttatagattgtttatacagtgatggagtgttgacattttgatagaaaatttcaggtcaggttttgtggcctgcgccaggaaatcgaattcgcaatggtttatgtggggtcaggagctgggaataggagcattcaggaggggctgggagatgtcccgagctctaggccttccttccttcctgcagcaggaggcacccagctgaaacagtgtgcgtgctgggcggtgtgcgttgtgccaggcggtgtgtgtttgtgccgggcggtgtgcgttgtgccgggcggtgtgcggtttgtgccaggcggtgtgtgtttgtgccgggcggttggcgtttgtgccgggcggtgggcgtttgtgccgggcggtgtgtgttgcgctaggtaacgtgtgtttaaagagccagatggtttgtgtttcaggctttgctgtaatgcctcagttgtgaacacagctgtagatgatgtaggtggatagatgggcgacgttccaatgacactttgtgaatgaacaccgacatttgaagtgtatatgattttcacatttcaccaagtattttttgtttgtattgacattcttggcttgtgggccacacagaaacaggcaggggctggggaggtagatgtggcccttgggcagtagtttgcagaccctgctctagaaaaggggagaatgaagatgggaaggcagtggtggtccctgccacacgtgcgtgcggcatccatgcacggagagtctccccccgcccatcctctgcgtgtggggcagttgggtcaggccagctcgcatccccaggtcttcagaggagcagctgagccgcgcctaccgcctgctgatagcacagctgacccaggagcacgccgagatccgtctctcagccttccagattgtggaggaactcttcgtcaggtctcaccagttccggatgctggttgtttccaacttccaggagttcctggagctcacgctgggcacagaccccgcacagcctctgccgccccccagggaggcggcacagaggctgaggcaggcgaccacccgggccgtggaagggtggaatgagaagtttggggaggcctacaagaagcttgccttgggctaccacttcttaagacacaacaaaaaggtaggtgggcctggcccattttttcagagactggttacctgacgtgaggagggcagacgataccagggtgaagatgcgcctcctgttgaacctagcacagcaggggcctgcttggccttgcctgaacacccaggctgccagaccatctgtggggtgtgggaaagagggcagcatctagggtcacggcctccctgagaggggcggcgcagctctgagaggaagagcataagctttatgtgtgggtggagctgaggctgcatgtgtcattttttatgtgcgtgtaggagacaaaggaaaagccaaatccaacttttcagatgcaacgttttctgtgacagtggcccctggactctgggacctgtcccaaccttgcactttaaggctccacccgcaccctactatgggctcgggctggtgcctggcatgatgaaacccaccaggatctgccactgtggcctgaacccagcctcattgcccagaccctaccgtgccccttaccccacctgccacgaaggctcagtcctccccagtgcaatgacccagccctgctggcttccctgtgtgcccttggagtgccctgtctcccagggttcatgctcagggtttgtttcagactcctgggtccagtcagcagcctctgcctgctaatggaacaagcacactgctctcctacctgtgaggtacttggggtgagaagtctcgtcacctcttttaagttagcagacgtgctggctttcccgggctcagacagcagagagacgtgcattgtgttttgttgtaatgcactgtgaacacctgggtgtgagggtgcacacccacagtcccactgactctggaagccgaggctggtggatcacctggtcctgggagtttgagtccagccttggtaacacagcaagaccgttgtctcttaaaaaaaaaaaaaaaaactactgtgaacttacagacgcatagggctcttggccacgcatgggtgctgtcttttgttaggcctacttgagctttatcttcctcacattctgtatagatagctctagtttttgttgttgttgttgatgatgttgtttttgagacagggtcttggtttgtcacccaggctagagtgcagtggcgcgatctcggctcactgcaacctccgcctccctggtccaagtgatcctcctgcctcagcctcccaagtagctgggactacaggcacacgccaccacacctggctattttttgtttttaagatggagtattgctttgttgcccaggttggagtgcagtggtgcgatctcagctcactgcaagctccacctcccgggttcacgccattctcctgcctcagcctcccaagtagctgggactacaagcaccccccaccacgcccggctaatttttgtatttttagtagagatgggatttcaccgtgttagccaggatggtctcaatctcctgaccttgtgacccacctgcttcggcctcccaaagtgctggggtgacaggcatgagccactgtgctgggccagccctagtctttattttctttctttttttttttttctttgagacagagtctcgctctgtcgcccaggctggagtgcagtggtgcgatcttggctcactgcaagctccgcctcccgggttcacaccattctcctgcctcaatctcccaagtagctgggactacaggcgcccgccacctcgcctggctaattttttttttgtatttttagtagagatggggtttcaccgtgttagccaggatggtctcgatctcctgacctcgtgatctgcctgcctcagcctcccaaagtgctgggattacaggcgtgagccaccgcgcctgtcccctagtctttattttcaattgctcaggtggattttcaagacacgaatgctcggagtctggcagaaaggaagagagaagaggagaagcagaagcacttggataaaatttatcaagaaagagccagccaggcggagagggagatgcaaggcaagtgtccaggacggagggaggggcccacgcctctgagggttgcccgtggtccagcagttcatcctcctggtcccagggccccagccgcaaggaacccaggttttgagacaggctaggtggagaggattcaggtcgggccggaaggcgttcttagccgtaggcctcccaggctgtccatgcctctcccgcgccctctggtggtcacattcatccacgcccgttcgctgcgcggacctctgggcagagatgccaggcacaggtgtgcctgtgggcagtggtctgagccccagcctggctgaaggccctgccacctgtttattttgtggctgtcttgcccttgccagccccttccccaaaacttcactgtttgcttctcggcagtcagcctttcttgtgaggggcaccacgagagtgtgaggagggggtgccacggccctcctgagacacctcctgatgtgggcggaggcacggccctgtgtcttcagactacatgtaccccagatccttctcctgacagactgtggtcccaggtgtgggacctgccacaggccactggaaacgcaggcctcagggcagctcacaaggcaggcagctgggtgcccagacaatgaggaggctgccaggaggaaagctgctccggcccgggaggtgtggcatgaacgaggctgttttgttgccctagggaagaggtgcagccgtgtcctgggaagtgcaggtgggctgacctcccctgcgcactcgtgcttgctacccagaggtacacagagattgccttgcaggcccagctgctgagctgggtgctctagtaagcggttaaaaagtgcagcacacgactgggcgcggtgactcatgcctgtcatcccggcactttgggaggccagggcaggcggatcgcctgagtccaggagtttaaagccagcctgggcaacatagcaggaccctgtttctacagaaaagttagttgagcatggcatcacgtgtctgtagtcccagctaatcaggaggctgaggcggctgcactacctgagcctggaaggtcgaggctggggtgagctgtgattgcaccactgcattccacctggtgctgaaaagtgacaccctgcggggagtgggcctctgagtgtggttttgagtgggctggtgcttttgctccacatagcgcagcaaacaggtgtcttgatcttccggcagaaatgtctggagaaattgaatcctgcttgacggaggtagagagctgctttaggctgctggtgccttttgactttgacccgaacccggagacggaatcccttggcatggcttctggcatgtccgatgcccttcgctcctcctgcgcgggccaggtgggcccctgccggtctggcacccctgacccccgggacggggagcagccctgctgcagtagagacctgcctgcctctgcaggccaccccagagcgggcggcggggcacagccatcccagacagccacaggtgacccctcagatgaggacgaggacagcgacctcgaggagtttgtgcggagccacgggctgggctcgcacaagtacacgctggatgtggagctctgctcaggtaactgccttcgcggggtctctgtggcgccaccctgccccggctcccgggtaggctcctccctcactggcacccggcccaggagcctggggatgcaggggcctcccctggggagctaggtcaggggtcaccaccaggtttttcctttctgtgtggcctctgcactgggctccccccacccatgccaggcctctgtggccacagggacacttctaagagctcatggcagcccccacctcagtgaggctgtgggcagagtaaggacccacaggattggggtgaggtggggtcgtgaggctgttgcggtcctcaaaggatgagggagcacaggcctgacctccaagtgactggatccctgggcaggctgtgtgggcatcccgtcagctcacaggcctgtcagggtcccgtgtcgccatgaggggtcaggtagcaccggcccttgctgggaggaaaatgtgttccagaaatggccacgggcagccttggcactgcagcctgggtgggtgaggattgcagagacatagccgcccccgccccccagccccagcttcctcccaagccccctgctgcccccctggggtgtgagtggaggctggggccctttgcgtatgtgtgtggcttcaaatcgctctctttgaggaaccttcttctttggaagcaggcacagcaggtgtcccttcaccagggccaggaggcagccgggctgggaagctgctgggagaactgatcctcgggtctcagctgcccagaggtgcctcagcagtgaggctgcaggcctgtgcggggtggacaccgctgctgcaagcctgggctgtcctcgcctgtatagagctctgccctgcgccggacactgagggtgccacagcgggggaagccacggcagggcagaactggagttggggtgtccagcggaggagaggccgggggggtgggggctggtgaggctgggctggaggggcgccatcctgtggcgtgggctgtggaggggaaggttctgtgcccggcgtgtgggggcggtgagtagaagaggctgtgggtggtctcgccctccagatgggatggctgcagccaaggagactgagacacaggcagtggagctgcgtgtgaggggaggctttggtgttaagccacagtgttcttttctaagataataaaacacttccttctcacagcatcaggtttgggattcccgggggcaggcatgggcgtctggcaggttcccctcaggctagagcagccttccttgcatggtctgcctctccggggcctgtgggagacgccagtcggcgccctcttgtgacctctgtgtgcttctccccagagggcctgaaggtgcaggagaacgaggacaaccttgctctcatccacgccgcccgcgacacactcaagctcatccggaacaagttcctgccggctgtgtgctcgtggatccaggtgagcctcgaacctgggacctgtgggtggagggacgtgtgcagagtgccatgcatggggggggtccctttcttggggggactgtggcccggtgactgaatggcccttaacccgcgagggctctgtccctcacccgcagctttgtcctctgcatcccaggtgtgccagggaccccccgggccagtggacctggcatgtgcctcccagcaggacagcttcccaggtcctgcccggccggcccctgagctgttcgcacccccgtttcgcagcgcttcacccgcgtcgggacccacggtggatgtttaaagcgtgccattgacctgaaggctgaattggagctcgtactgagaaaatacaaggagctggacatcgagcctgagggaggggaaaggcgcagggtgagtgggcaggcggcgagcgggaaggggtcccagaggcctcagtgggggaggagaagctgtgggggggttgtgccctgggcctgtgggcccggcggaccccagccacaccccaagcccactcagcctcagcaggacctgcctccccagcgagggcttcctgtgagcccagggtcatcaccatggcagaggggacagtgcagctgtcgggtgttgcccggctgccgtgtatggtagctgagcagaagtgctgagtgctgtgcgcgcctccaggaagccaccagtcaggctgtcccccccgtgactccttctagggagtcatcagcagtgcggcacctgtcctggcaggcactgtatccaccagaggagagaccctcggcaaaccctcagacggccaggagggtcagcgcgggcactggtgcccacttggggtgaagacttgggttactgtctgctgggccttgcgaggggcttgggagggtcatgggggcactgcacttccctgagcagggagcacggggttagaaggggcagggctgccgcgaggggctggaggctggagggaggtttggggtgcctctggtgggtgaagctgggagcagagaccgtcgcattgggtgtgtcggagccgttcgagggtgggggtgcccagcacactgctgtgccagggaccttgaactggctgagcatggaatggaaatctgggcctcggtgcctggaggggcctgagagctggggtcctctgcagacgtcctcggcagcacccagcacagtcgggccttaggactggaggtacacagcggccaccctgagctcccacagcagtgctgtctctcaggcacctctcccttcaggaacccaagccctgaaccccaacacccctgagctcggaccccaaatccagccctggcctaggagatggtggccttttggctctccccactttaaggaaagctttggggtggaagtgacactgtgctccttgctgaggaagaggttgggttccacagcagcagacgtgcggggccttggaagttggggggtggggaagctcctctcgattaaatgctgagcctgtcgttttccccaggtcagtggccccgcgtccccaacgtggtggtgtgcagcccccccaggggccagcagagggcgagcttgcttttctcctttaagtccgaaactgactcccggagaatttatagacatgtgggagcccactggcctcgccgctggtgtgtggccgcgtttgtgggtgctggtcaacaccttgctccacaaggaaatacttctgtgagttgtgacgaaaatatactttttgcaatgcgaaaggatgctggtctaggcttgggaggaagatggtgagtgccgtcagcatgtcaagatcagggtgagcccactgcccatgcccagcacacttgggcccacaggatggcagccgcaggaccgggcccctatgccagcccctgtcactgttgcctagtgggctgcgtgggggctgccggctggggtcacgggcacttccctgtggctcacattgaggccctttcaaggtcactgcccggtctccacggcatgggcaaggcttgctggagcctcacgctgagaccctgcaccaggcactgcaccggtgcacctgctgccctggactcacctggcacggcttctgcagtctgcagacagttttgtctgaaggtggccggtgggcctttgcctggcagtggcaacccctgggtcagctggcttattggtgagggtccacagagcagagcggggctgatgggtggcatggtctggtctcatcaggcctgggcccctccagctggttattggtgagggtccatagagcagagcggggctgatgggtggcatggtctggtctcatcaggcctgggcccctccagctggttattggtgagggtccatagagcagagcggggctgatgggtggcatggtctggtctcatcaggcctgggcccctccagctggttattggtgagggtccacagagcagaggggggctgatgggtggcatggtctggtctcatcaggcctgggcccctccagctggcacagtcctttagtaccagcagcagtgctggggctggggcagccaggtggctcttcttggcctgagattctggcagtggaaccttctggaatgcctggtgctacccctgcctgcatctcacagctctacagcatctgggatgccctccaagtggggttggctggtggaagtgaatctgggcagcctccgggactgctggcagctcggcctgcttgggtgaggatgaggagctgccgttccccgagtcaggactctaattcagcgcggccacggtaccagcgaggcctgcaggctcccagccatggctgacttgcacccacatctccacctcaccctggtggatgcagactccccctgtgtgccagggaccctgcgtgctcttcatgagtgttcagctcagcctggctcctgccgtgtgtgggctcaggagtgctggcctcccagacctctgcaggctgcaggctcctgctggccgtgcccttctggaggcagcactagcccctcctgcctcagggatgctatattcagggcctggtctgtgggggccagggcccataacacgggtgtgggccaggccatgcaggagggtactgggcagggcacggccgcctgaaggaccccagcagctgctgctcccacccaccaggtcccggggaccccgccgacactgttagctgtctctgagcttctgagtgactctcacatgagcatctcacgccccacgtggtggagccgccagcactgtccctccgtggcgcgtgaccccagcccttggcacacaggcagccaccctgacccagcgcccagggcctgctgccatcccactgtccttcctcactcctgctggccggggcccactcctgacccatctgtgtgcatcctcttgagatctgagtggtggcactgggcggggggtgtctgcggccaggactgacagtgcttggagggcccctcgtccccttcgaccacatggtctggccagcagatgtgccccagctgtgcttcagagctggtgagtgtgcaagggcagcagggcctgtgaggctggattgaggatgtcacagctccggtgggaagggaggcgccacgctgcccatttgtcagttgaatggacactttctagactcttctccgcaaactggtttctttttaaagcaccgttctgaagtccttggagattttgctcccggcagctggagtgcaaggagctgcctggagatgaagtgattggcgggctcgcctagctcaggtgagcgatgcttcccagaatagatgccgtggcaccactgcagtatctgcccatctccctcctggctccgcgcggccgctgcgtccgagtggcgtgtgtgcggcaggtggggctggctgacaaacgtggacgttaattagagccattttaattagaaattatggacgaggtgctcctcgttaattttcaaataaaatttacagagggtttaaatcacttccctccgtgtctccccatttagcacggggattggcgtcgttaactccgtgtgtagaacagggcacgctaattcagtcatgcctgatttaaatatgtttagaacttccaactaacatgtaggagatgggaacatggaacgctgctagctgcaggcaggaggcaggagcctagccccggaaggcccagcccgtcctcgtgctgtctccggccggtgctcgtgctgaggctctcctcgggcagccacccgggagcagacaccgtgtctttcctttttaacatttcccacttggtttctacgtaatactgttttccttttgacgcagatgttctgtcttcagaaaatacttaggcgggtttgaatatgtgtgctgtgcatttggagtgcctctgagtggcttccgtctggggacagatgttccgtcttcagaaaatactcaacgctggtttgaatatgtgtgctgtgcgtttggagtgcctctgtgtggcttccgtctgggagcaggccgagggtgaatctcctggatcaatgtgcagcgtcatttggtagattgcgtgtccagccttgccgcgctgtagggtgggtgtgatcatccgtggctgcgtcattcgctgagctgataaaaatcctctggaaactttcacgttgcctgctgccaaattacatagctcaaatcaccaattactttgtattgtgtaattaacaaaatattaatttcctatcagccagtgagtcagaaacgcatcttaagcatcgttctctttagtaccgtcagcgtggctctgtctttccttctgctagttaccgggttacttgtttccgtggctgaaagatacgggtttgtttttgttctcgccgatgttgagtctgatgtggcagccacatgggtttggccgtggatgcatcctccattgcccacagaaccagagtcgtccccccgactctgtggttttctttctctgtcggccgcctgcctgcctcctccaccggcctcaccaccaaagctctgatctttggagttagatgccagaagcattctgccctctgatgttcagtgggctccaggatgcagctgacagcctcccggggaccctgtcagcccctgggatcgaggccccacctccttttcctgctgtgcgtgagggaaagttttctgtgatgctctggagccatgggagtgtctgacttccaggaggtgaaagggacagaaactgaaaacccaggaatgaaacgtggacccaccaggcacaggcaggggaggagggacctaaatcagcgctgctgggaaaccttgtaccgccctagggctgggaaacaaccttcctgggtgatggggcccctccatcacgccgaaggccaagccgctgtgtgcgccaccgcatcccaagggctgcccacggggggcggggtgcagatacacaggttctctggagtcagcacagggaacacggggagaacatcttaggcccagccagggccttgtgccagccctccctcccacaccggtggcacagacccgtcttttgggctttcaccgtccctcagtacctgtctgcaaaacacagggcgcttgccagacaagcccagcgctccttgaaacaccgccccatgctgttacccctttcgtttggaaagcagccccgtggggtcgatcggttttccaccccattttacagacagggaagctgagcccgggagaagctgtgtaggccccggcctccttgtccaggcctggcctcctgatgaatgtaagtgcgcctgacaaacccgtgctatggccgcgcccagaggctggcgcctgcttcccagaggctggcgttctggcccctgtgggccctggctgcactctccttccctgagaaggtcaggctgaagcagggtcctttcccgcccccgtgagccgagtgtgtgtgtgactcaccagagcccgggagcaaggacacaggcagctttcattttcccgagcccagagttagctttctccgcagagctcgggggcaggagctactaggtttggaggccccagatgttctaagaagtcattccgctctccactgaagggggcgtttacataaagtctgcgtgacccctggtgcctcaaccagcttcctgagcactgcacccagtgctcctgctcagtaagaaccaggcccacaacctctgctcagaacgtcctatgtgggacccaggggcaaacaccagtttggctgccccaggagaagaggccgccctggcccagctccatccatctggagagcaacacagacccaggacccccggcccgcatctggtcgacagatgtgtgtctctatctggcaggcagccccggggacccagcagaaattttgcccctagcctagctctggaatcgacctccaggtatcttgtgaacctgaggcctcctcctctcacacccaagaaggcccccaggcctgtggtgctgtggtcctggcccctgcagctgggactccaggaagcggcccgaggcccaccatgctggctggcagctcccaagggcaggtctgtctgagcctcattactgggagtgacctgggttagacgagaatgggaagaggcccacagcactgtgttttgtgatattcttgtaagagcgtgttgatgagtgtagattttatagtaaagaaccagtcattctagaaagcaacgacttgcttcagcagaacctccaggctctcgtttcagaggtgaggacacgcctatggtgctgtgtctgtgtccagcaggttctgctcggccccgacagtgctgcccgccaggtgcccttcccgcacgcttgctgcagtcagccctgcaccgctccgccctccgtcctctcaaggtgcgtccctggcagccggagatgcacatgagatattggcctggccgggcaatttgcacggccttccagggagggcattagcatataaatagcagatgcaatgacgaccatcacagctgagcacgtttaatttttggtttataagatagaatgggtttttaaacacatagccatcaaggcgctgaaagacaaatgcaatttggaactcacttgtctgacgaggccttacatcatttttttttttttttttataaaaagggaaacagacacacataaaactgaacaaaagtgatttcttgggtgaaaagtaattgagaccgcgtaccaagttaattagatcgtacaaaatttatttaatggccccagctgtatctcccagcctgtgtgtggcggacagacctgccccttcacacggcctctcctcttcctttccttctcaaataattagtaacctcgccaccctacttctgtgaactgattgcattgtatattttagccattttattgcttgtttaattatgatcgtggaggctcatttttctaaatccttttaagtgtgggtgagaatccatttgtatgaagccagcagaggccggagtgctcctgcccgcctccccgcggtggctggggttcctttggaggtgccctgtgcacgggtggtcttggctctccatgtcgaggggtctatagctcctgtagctcctgcactgtggaccagccttgggaggcttccaatgccccgcaggggacttggcccattagggaaggtgtgggcacgggtcacagcccccttgggaggggacagcctgcaggtgacctgtgcctcccatgcccctgctttatcacaggaaactcggctgccaggtcggggtaaaagcagactgctcttgagaaccttttccaaacctaacctcattttgtagacatctccagccccagcaccacatagggtgtatgatctcctttcctggattcttgctcgtccagagcccccccgcaccggtgcccagcccctcagcagggcttgcagacccgtggtgctggcccctggctcatctgtccctcaccttgagggcgggtggctcttgcctgtcaccacttgatgatttgacttcttagaggtgaactggaggcgtgtgggaccacgtggaaggggggcttcgtgcggggcctcaccctccctttgggctccgtgcgcttcgaggcctcggggagctctgtccctggtgaccacgccgttcctgtcctccgaacaggcctgtgaacagccacacagcttcctaggctcacggcttccccatcttcagcatccctgcctgtccctggcgttcagtgtgcccagcagcagatgttggaggtgaccgcactgtgcgtctgtgggtttcagacatgagagtttatcccgtgtgacttgaaccctgaaaacagcagctttcagccttgcatttagtatccgcagtgaagcccctcaatgctgagttgctgtggtttgaggggtaccacggcctcagtagttgcaagctgaagtatggaaacggtggctgtggtgggaccttgccagggaggaagccctgcggctgcctcagaggtgaagggagagccacccacggacctggccgctgttacggagggagatgctcaccgggaccagggtgccctcatcagcgctgatttaagaacaaaggggaacccagggctccaaatttagtcacagaaatgaaccattatttggggagaaagaaggtgtaattcctaatagttacctgagcagttgaatattttttaggaaatgaaaatttgataaaagtccccgatgaaattcaagggtgcgaacaggaagcataatattttttgaaaacgacgcccatatttaaaatctggcactatatgttatgcattgtagcacccggtccacatctaccttttagaaaattaaaacacataaattctgtttagtgtgtgataacgcgctgcactggctgagaaccgtaatgccctgaaaccttgggctgctctccacctttcataaattcctggcagattctgtacagaaataattttcaggtccgtggcttgttgttattcagacgtgatggatcgccatcatttgctcagcgcgggagttaagtgcccctgtcatttccaaagagtataattgggacgtttcacaggtcagcggtggagacaggcttcccttttgatcagtgttagactgataacaaaaattacagtttccagtgattaatgtctcctgtgcttcccagatgctcagcagtgggatgctcctaaacaaagtgcacttggtctgatgattggtgtgggggccacctcccggcagggtgctggtgcccgggccccgtggccttgtgtggcctggctccgtgggggccacctcccggcagggtgctggtgcccgggccccgtggccttgtgtggcctggctccgtgggggccacctcccggcagggtgctggtgcccgggccccgtggccttgtgtggcctggctccgtgggggccacctcccggcagggtgctggtgcccgggccccgtggccttgtgtggcctggctccgtgggggccacctcccggcagggtgctggtgcccgggccccgtggccttgtgtggcctggctctgtgggggccacctcccggcagggtgctggtgcccgggccccgtggcattgtgtggcctggctccgtgggggccacctccccgcacggtgctggtgcgcgggccccgtggccttgtgtggcctggctccgtgggggctgggcttggagccgcagtcccctgcacacctgggctttgtctctggtgaacatgtgggctcccgccctaggggtcaggggtcaggcccctcttcagttgtccttcctcccttcaggaaacagctgcgatcgcaggcgcctttgaggtgttgctgctgggaatgctttttagagatgcaggtgtgtgtcagagtgattctgtttttcggtttttctcttataaacccattaagggtccccttgcttggtattcctccaacagggatctctctcccgggaagtttccctcagctgtgctgtgggaacaggaatgcaggcgcctccatcccgggggtacctcaaccctgggggcatctccaccctggggcacctccaccccagccaccccagggcaccaccaccctggccaccctgggggcatgaccttcagctgccctagcagccctgccagcccctctcctggcctgagggagctgaaggtgaggaatgaccgccctgctgtgctgagcccacaccaggtttgcggtgggtgagctgcagaggcggggctctcagggaaggatggtgcgccctgggggctgcgtgcgagctcccacaccctgtcctgggccgtggtggggctgttggaaggatgcaggccagagggaaggtgaggcggagaagagcttgcccacagccgcttctgagcgcgtggatggagcagttgatgcccaccgtgtggccatgttactgagcagtgggctcgctacccagtgcacacagaagccagtactgcagcagcagcttttgggaagagaaaggctttaccagggcaggcagcagggaggcaggtgcctccccagttcttcttggccctgttatgcccgcaagacagcttggcgttctgttagcaacagagcaggcctgcctgggctggtcttatggtcacagctgcagccatggtgtcttgtgccacagccgtgctgtgtgcaggagccaccgtctttctctggcctgatgagatgagtcaccacacaggtccctgcctctgcccactaagtcgggcgcaggaaggggcagggtgggctcaaggaactggcttttctcaggggaaaaagaaagcaagccttcctgccattctccagctcctcaatgggaggagggaggcgggggtggcacgagggctctccagactcagtgagggatccccccacacctaccctggcagagaagtggccttgtcaaaaggaaatggaggtggttttcatacaagtcctcaaggacagaatgttccagaagtacttgtccctttctgtcacctgacatgctgtggtcacaccagcaccacgggagaaccctgtgtggggagctagccctggcccgttgcctaagagcagacgcacctgctccacctggtgggaagataactcacctaagccccgggggcaccgcagacgcacctgctccacctggtgggaagataactgccctaagcctcaggggcaccgcagacgcacctgctccacctggtgagaagataactgccctaagcctcgggggcaccacagacgcacctgctccacctggtgggaagataactcccctaagccccgggggcaccgccgccctcgcaccggtgtgacgccattccacaggagggcagcacctcccacagggacctggggagtcagccagggttacagttcgtggttttaacatagactctaaacagcccccagcacaggggcagtgcagaggtggtgtgattttggggaacaagaacagccttggagacgatcttaaatgcagtccaaccgtggctgatgttggagccctaagcaggggaaaaagctccacaagaaataggaatttccagggctctgcccaccgggagctgtgttcatacacagggtctgggggttgatttgtattggggtgtttttccacagacagaagccctgggggatgcggaggaagatgaggacgatgaggactttgtggaggtccctgagaaggaggggtatgagccacacatccccgaccacttgcggcctgagtatggtgagcagtgggtcccgtggggggggcacctgggtggagggtcccccactcaggatgtggccccttggggtcatgacctcaggggcagggcctggagcccatcttgtggtaactgctgctttggtttaaaatgctgcttttcctgctcacggtcgtagccacgaggccgagaagtcgtgtgtgtgcttttcctctacgttctggctccgtctcgggttctcgggcctggggccctccctgcagcctgccccgcggtgggcttcctctctggtggtcctgctggtcctcctctgccaggcaggccctcaggtgcccgggtctgggacaggggccaccatcctacccttggttcttgtgtgtggaggacaccggcctgcacacccagcacaccggcctgctgtgaggacgcagcggggcaggtctctccctctgtgccatccgcagccctgctcagggacagaaaggtctcactcacgagggtgggctctcgtgggctccttgaacttgagggttgtgggtgtgattcccgcagctacaggagctgttgctggcaggtgggaggggccaccaccccgcgccttccaggctcccatccccgcttacgggggtcacaagcacaggcatcgctcctcaccgctggtgatgccacagcctcgggtctgggcccagggctgctgtgcactccacggcaaggggctcttctcactgtcagggagcactcgggaggtgccgaaccctgccacagcctgtgccgtggagggcttaggtttttcaaaaatacctcccaaaactgcgttccagtgacacacccaggattgtggccctgggggatgggcgtggacccaggtgggtctactcttaaagttccccagagtacccacagtggtgtttgcatggaggggaggcaaatgaaaacaagaccctcagcttttgtgtggaatggacaagttggtttcaatcagagtctgtaagaagagatgtagatttgttaagagaacttagatgattagacaactcatgtgtgaagatatgacccattaagggtgtcatgccgaattagcacagccaggcttctaacgaccttccatttgtatggtcctgtttactggggcctgctgtcttctgccctggggccgcccagggagggcccaggctgggaaggctgagctcctggggtcagtgtgagcttgagggtctggaagaaagcctcagacacctggagccagccgggacctcgctctgggaaccactgtggcctggcccattccggaccagggtcctgcgctgcttctccaggggcaggcaggcagaagccgagggacctgcacgcctctccccaccaccgacctcactgcgtcagaccccttcccccaccgagacgcagccccagctgtgccctcatcgggcttcccctgtccccaccccacacacactgttcttccaacaccagcatccacctgaaatggtgtttctgctgattccccacctcgggcaggcgtccccacgcctgacatgagggccctgggggtgcctgagcacaccgttggccgctgcaatctccttcatggctcttggccgccctcaggtggaccaggccgtgggtccagcccccggagcatggtggaagcacagaggtgtctcctggaggtgctgcagccggggcctaggcagccgtcttgtctgcgcaggcctgtcctgacctggcctgctgggctgcctcatctcccggacccctcctgggcatcttcagagtctgggagctggcactgacccttggcctgtagtgtcacacatttcctggccttgggcctctgcacaggcctgttatgatggcttctgaaccttttcagcagaagttacacatcttagacggggtgacgtgtggcgtctcaaaagcagaaatccacactttccctaaaacctgacttgtggctctaaattatctgaagcaaggccagaagcgaaactcaaacgaggtgactttccccaaagaacagagcggtctcctttcatcagaagaggtgaggctccccgggcctgtggccaaacacaacggtgacagcgctcactcgtcaccaggcctggccatcccctccccactgaagcccaggggtcctgagcccatcgacaatagcgtccagccaagggggccgagcggcctcgcagcccctgccgggtgtgctgggacgcctgctctgacacagccctgctgcaggtacaccgagcctcacagggtcacaggtaggcactgggcttggcagtcccggctaagcctcacccgtaggctgtcccagcctgaccctggttgtgaaggcacctccagatgtgtgtctccagctcaggccccaggctcagcagatgatgagctgtccctgctgggtccgtcctggtccagggaagtgtgcacagctggtgcactggcggctggttctttcgctgcagccgcaggtccccacagcgccctcctctgctggctccaagcctcctccactgcatggcgcctgcccctttcctctcaaggcccacgcctgccccggtggaggggagggtgccttagacctgccccggtggaggggagggtgccttagaagctgggagctccatcacagccttgcctggggcaggcagaggccctggtggttttattgccactgattgacttcttgaggtgagagggctaaccacgttctgccgttctgccgttctgccgtcagccttgaaggtgccgatgtgccctgtgggcctggcctgggtacccttggcggccttgctgggagtcgaccgggtgcgagcatgcagcaccagctgtaccagccccaggcgagggctggagggcccaaaggagggggcaggccctggtgacagagctgccctctggggtgcgcagggaggacccctggccccactcagcttcacaccccgggggccccaggagtgccggaggcggggaccaggcgggaagcgtgggggcaggcggaggggccagctcagttcataacactagtttatattctgccgctgttttttcaattaaacgtgggcgaatctgaagtagttagatttagtctaaatccacaccacggaggaaaccgtgctctttttctttctcatttcttcctctgaattttcactgaggggcctttatcttccccttaatcctaccatttctgtcaggacataatctctttctccaatttacattttaattacaaggccagctgaactaggtaaaatcaataatgtcagcgctgggcaggccgcctgggcgcagaggcccccctctccgtttcctaccatcgattccctccctcactgtctgctttggtgcttcaggcaaataggtgccacttggccaatgtaaacagaaaaggggatttggacatttttatgattctttctcaaaacaactgtgggagtgaatttgagccaagatactggactcgagtgagacgccgtgcgggcaaggcgggcgccgcgttcggctgtgacgtgtggcctcttgttttccgggagtcgttattcttcctgaaaatgccctcagtgcctgaggaatgctgtctgatttttggggttttgctttgaaagtatgtcagagagattgattttccacgcgatgcgcaagtgggagtgtgtttagtgccctaagtatttaccctgctttaacacgcttacccatctttttaatggtttaaaacaacaaatcgatgaaaaatatatttcattcttgtaactcttaggaattctcagattgatcttttggctgcgattgtatctaaatgtcacattgttcacttgtcagtcttgcctccgtcactgtgagcatgtgcgtgtgtgcgtgtgtgtgcatgcgtgtgctgacagcccgtatctgtgtcatgtgtattgccggaatactgaggggcacttggcaggtttgtgagcaacacccgggacacggcattgagtgccagcgctgagcaggggctgcccggtgtctcccgggtgcgcgcctcggggctggaggtccgtccccatcacctgctctgtgtggctctgtctcacaccctccgctttcagcccctgggaacccaggaaacgggagcagcctggcaggcgtgcagccgtgcacggcttagaggagctcccgagcgggacaggcaccttctgtgaagggccagagcgcagtctctccagcttcgggggccacatgaggccttgtctccacgtgtagatggtgggtgtgactgggtgccagtaacaccctattcacgaaaacaggcggtgggctggacttggctcatagccacaggctggcgagccctgcagctactgagcacagggtgcatgtgccaggctgacctctgtccagagagtcagtggcccaagtcagaggtggctccagacagcccgagttctgtgagccctttcagacatgcagctttttcctcctctgcaactcagggacggggtcggtggctcactccttgattcacgggatgcttgtcatgggcctgagcaaggccctttgtccttacccacttccctccctggaagcccctgtgcccggcggccttgcagtacccccagttctcatgcctcctcattctcctcccagctcttctctccaaacagagcattcccggctctgcacattggtaagtggaggcactgtgggtgtcctcagaaagcctgtggtgagcacatgtgtgttcagtgacagcatgcctgtaagtacttgtgtgtggacgtgtatgtgtgtgtatgtactcagtaagcctgcacaaaagaaggcctgcacgctctgcagctcacccgtgttcagtgagagtacgtctgtgggtggacctgtgtgtgtgtgtgtgtgtgtgtgtgtgtgtgtgtaaaatcgatgacgtgtacatgactttccgggtgtctgagctctctggtggcctctgtttttgacgctctgttctgtggtctcaggacacagtctgggcggtgctgattcttgggaggtgactgaggcccctgttgacttagtacttggttttctttcgtcagttccgcgtgtgtgttggagaagggacttcttgcatagtgtattactccgttttcctgctgctgataaggacatacctgagactgggcaatttacagaagaaagaggtttactggacttagcgttccacatggctggggaggcctcacaatcatggtggaaggcaagaaggagcaagtcacatcttaacgtggatggcagcaggcagggagagggcttgtgcggagaaactcccgcttttacagccgtcagatctcgtgagacccattcactctcacggggacagcacggggaagacccaccagctccctcccaccacgtgtgggaattatgggaactataagatgagatttgagtggggacacagagccagaccatatcagataggaaatctcacggcatctcttagtttggtggttttgactgtgctgtacaaaccacccgtgatacggctcattctttccctaacagccacttcccaagagggttcgccgaagtccccacagtcagggatacctctgcacccgtagccctcagcatggcttcttatgttttgagactgcatttgtaagttacatatctcttcttgtttattacaccttcaagcattcctttttttaccctcctattttttacttaaaatccagcttttctagtacccacataggacctcctctgtcttttggtcactgttttcgtagtaaatcttttttcgtccctttattttcaacttttcactaaccgttgtatcaagtgggtcttctttagacagcatgttgctaaagacatccactccagagtctgtctttctgttaatctgaatctgtttagttaacggttgttacgaagtcttcaaaagacacatctggcggcctgtcacgcgtccatccatggcactttctctccgacttctgctgccgtccttgtctcgtttccttctttctcccaccatttatgtgccccgttgttgtgctggtttttattcttcagatggtcactcttcattgtagaaaggatttacacacatatgtgtttctcaatttctgtactatttcctgcataaaacaaataacctagcaccctctccccacgtgtggcctccttccaccccatcacattggatcatccagaaccaacttaattcaggttgatatgaacacgtgggtttggggtagggacaggcgagagtcaactttacaaagtcatgtgctcagtgttcctcccgcgtctcagggcactcacgtcccgcatctcagagcactcatctcctgctactcagcactcacctcccgcgtccctgcactcacctcccgcgtctcagggcactcacctcccgcgtccctgcactcacctcccgcgtctcagggcactcacctcccgcgtctcagggcactcacctcccgcgtccctgcactcacctcccgcgtctcagggcactcacctcccgcgtctctacacactcactgcccatgttttgctccaccccctgccccctggcttttctttgtgactactggctctgaaggtgttttcaaagcggacctcaccatggcaaacctcaaaaggccttgtctccatgaggtcgtcgtcctgtgcctgcacaagaaatgaccttttagctggctataaaatcctgagcttgaacttctccttcggcactttcaaagtgaccttctaagatcttgcattcacggttgctattgaaaatcttgtgtcaatagaatttttattttttgaaagtatcagctaatttatatgaccacaaggtcccacaagaggccatctctaggctgaggatcaaggagagccagtccgagtctcaaaactgaagaacttggagtctgatgttcgagggcaggaagcatccagcacgggagaatagatgtaggctgggaggcgaggccgtccctccttttcacgtttgctttatattcgttggcagctgactagatggtgcccaccagattaagggtggatctgccttccccagcccactgactcaaatgttaatctcctttggcaacaccctcgcagacacacccaagatcaatactttgtatccttcaatccaatcaagttgatcctcagtgctctgtgttaaccgtctcgggccatggtgttcttaggttttcctgtagtgcctctggccatggtttttcctctgtctcctctgactctcagtgagccttccaattccaggaaaatgtggctcattgtttcttcaactgttttctgcactccaattatgtctctcctcctgggattttagaagagacgaggatgctgacacctgcgcgtcccccacacccctcagagctcttaagagggtgttccgtgcttcctccctcgctgtctgcggtcacctgtgtctcactcgtgctgtggccggtcccctcagccacccaacaagtcctctgcacctgacaattttccttgccctttgtctttggtggaggcatcttcaggatcccctcacttcctggcctctcgctgtgtctctatggtgcccgtagctcctggggagcgtggcatgggctgtgcacctcttcgccccagctgccagttcgttttcttcctgtggattctgccgcagccaggacgccttgctcggtccgttttctttccgtggattccgccggggccaggacgccttgctcggtctgttttcttccatggcagctctccgaagtctggcttccctgcggtccaggttcttctggggtcctgagcccccctggccggcagcccacaggggaggacaggctcaagtgcaggccttagttgctcctgcagcaggtttggggaggtgggtggtgccctttgtcctaacccatagcctacctggcacctcctgtgcctcctgccatcccgacgcctcaggacaccagcttagccgctagggagtataggccccgccctgaccgagaggcgccgtcagggtcggggtgagccccacggagcagcctgagagccaagcgcaggctgtggtgcaggaggaggggagaggcaggtcagggcccagcagtgttggagaatctccttgtcctggtccggggaccctgggtgcacgctgggctgcggaggccaggggctggtggcctcgtccctgtcatctctgtgggacgttggtgagacgcagcgccatggccttgtcttgctggcggcggggcggaccctcttcgacgggcactccgggacggcatcttggtccttggaattcagcctctgcctggcagacggagggagttgccagggccaagaccttggtccagtggcccctgtggctgtcagaggcgcctgctgaagctgtggtgcagccccgggcgtttctgtggggacacaggggctggaatccccgctaacatcgcggtttgacgtcagcgtgagatgtgggttgaacccctgtgtggagctgtgcgtctcttctccttgaggaccatgtgagcaccctgtgggtggcctttccaagcggctgccacctcaggcttgggtgctggggagggctccaggctgcctacatctcaccaccggagcctgagctgccggggctatgggcacagggtgccgggcagtctgggctctcgctgctgcccagcttctttccagcctggcgaatccatctgctcaggctggcacttctgcaaagcccggcagcacagtgtgtgaacagcgtggccacaaggcgggactgccggaccccccgacgcacgccatgttctggcagagcgtggcctgagctgctgctccgggcctcaccctcgcccgtgaggagcagatagcaggcacccacctcgggactgttggaagatggaacacgctaacgcataggcgcgtcctaactgcccggtcttgcctgatgtgcctggcgggttgtgggagtggtggcagggagtggacacgtgtctgtttcagggctggaggcagcaccagagaaagacacagttgtgcggtgcttgcggacgaggacgaggatggacgaggaggtgtcggaccccacctctgcggctgctcagctgcggcagctccgggaccacttgcctccaccctcatctgccaggtgactcccagtgtcctgtgtgctgagccccctgcccggcgctgccacagcctctgcccagagcactggccggcctcgagaggctgcttagtgccttttctggatatcttggtggaagccttgggtgtgtacccccggccgggtgagcagtgttggtgccatgtttgggcttgtcagtgccagcatcagctggagcccgggtgggactgggccaacaaatacccttccagacactgcccgtgcctctgagaggagcccccagggctggggtttgagaggcagatgtcaggtcacctctgggccagggtgaaggactgcagaccagaggccagctgttggcgagggcccagagcttctcacaggacctcagcggtggccctgaggcccaggcgtcgtgtggcagaagccattgctcacctgatccgacccgaggccccagccttgctgtgggggtggggagggagaggagggtggctgtgggtggcaccagcagcaccgtcaggctgtcccactctgctcctgtagcccctccagagcgttgccagagccacaggaggcccagaagctggcagcagagcgggcccgggcgcctgtggtgccctacggcgtggacctgcactactggggccaggagctccccacagccgggaagattgtcaagtgagtccccatgtgtctgaagtcggccagggcacacaaccagggtcccagcctgaggagggggctgccggctcaccaggcctccctgggtctgaggaagctggccctgcctcccagctctgccccaccttccgggcacctggaggggcacaggggtgggcctcccctgctgatccggctcgtggagcccagaaaggcttttttgagcctttctgctgctgtgtcgggggccatccatggagcttgggtgttatgaatcttgtgggaacagctggacgagaaaccactcccctaaaggcggccctggggcccgttcagtttgtcctgcttcaggactgcacggttggctgaggcctggggcttcctgaccgtgttgcagctgctcacggtgaccgtgtgtccagacctcaggcgggggctctgcaaggagcctcgggaagccaccctccctgcccactttcccctctgcacccctcaccgcactggcctcttctctgtgaagctgcagcagaagggggcacacgggggtcatctgtgcgaaagtccggaccgttgggcctcaagaggccacctgggtactccagcgcctgccacagctcgctggcacggcctatcgggggaacagggcccctgccgccgcctcagctcctgccgcaggacggttctccacacccgggagagggtggggaggacagtgccaaggctgtgtcctgggatggaaggtcaccctaaggcgtcttccttagagggcagaggtgggtccccctggcctcttgccagtccccgccatcaagacccagggccaggtgtgacacggaatattgccgtccccacagcacccatttcaagggccgggctgcctgtgcaaacaccgtaaccactaaagccaatgctgcggggtctgcggggcgtgatgcgggagcgtctcatccgtgtgaggggctgatgtcagaacctccagagagcgggggggcaggggagccgggcaagggtcctggggcagcttcagggcctgaggagcaccgtgtgcccagggcagccactgcctctgtgtctggatgcccaggaacgggccccgagtgccgggacgtcctggcacattgtccacagctgcctgtgttcccggggttctgctgggctcacacacgacacacgagagcaggatggtaagcgaggcaggccctggtctcactcacagcaggactgagatttgagggccccgtcctcagggctccacagacaccgcccctagtgggggccagattagggacagtgtgaggagggaggggctgggcaggctgctcagcggccggagaggtcgggaagaaacagctgtccctgtcacacattgccaccaggggtgccccaaggccagtgcttggtttctgagcctgggaggtgacgcccagcaaagctcccaccgagaagcggatgcccgtccctcctcccacctgcctggcccgtccccaggaccacaggctttgccctgagcccccaggcagttgggctgagagagaggcctgagcagctgctggtgaggacccggttagtcctggatggcaccggggccctgctgggcaggcctggcttcacgttccacctgcctggcccgtcagcaccacgcacctggtgcatcgagctcacggcttcatgtttcccccaactgcctgcacactgctgtggtcggcttgatggagttgcagcctacacatggcagcggcccgggctggggaagggccccatgtcagctgcgtggatgggggtacatgggctggtgcaggagatggcacctgggtgccacatgtgccccacagccagttgagggccacactcctcctggctggcccctagccaggatggcaggggctgctcaccccacattccctcaccaagtggaggggtcctgccctctggctctcagccacatttagggatctcggagagcctgggctcgcccctttcatccaggaggtcaagatgatgcgggtccgggaagccagggcctggccaggccgtggtgggagacagggctgatgggggtggcggccacaggcaaccactagaacaaagccgtcctggtacacagagggctggcgggccctggctgggtacagtggctcacgcctgtaatcccagcactttgggaggccaaggcaggtggatcacttgaggccaggagttcgagaccagcctggccaacatgacaaaaccccatcactactaaaaatataaaaattagccgggcgtggtggcgtgcgcctgtaatcccagctactcgagactgaggcgggagaatcgcttgaacccaggaggcggagtttgcagtgagctgagatcgcaccatcacactccagcctgggcaacagagcaagagtctgtctgaaaaaaaaatagccagtggtcctcggccgaggggagtagagggaagcatccctgcacctggacggggaggaagcggtggagcccgtggtgtggctgctgtgcgccggctcctgagtgttctcactgcgatccacggggcgtctctggtccgagttccgggtggcagaatgcatcgctgcttctcccacggggccttgggtgcagcaggaagcatttggccgggcggtcaggcaccctcgggggagccgcatgtacctccttgactgcggggcacatggccaggtgctcttcagcccaccagggctttgcccgagacgcctctgcctgtagtggggccaaggccctgggcagcacattctgcctgcgttcccacccactgccttatcccaaaccagcctcatcccagaccaaggtggatgcagaaatgaggtccaggcggccccagggcagggcctactgctggtcccttctccctagcgtgggccgtgcctggggctgtgctcctgtctgtggacctggggtgagggcggggctgctgggctctgctcctccagcatcctcaggcacagggtgtgggagcccgggagcttcgggcagagccgaccgttccccagtcagcaggcaatgagcagcctctcatcactgggagcccttggcactgcccatctgtcctccccagctcctgctggccccaactgtggctgtgtgtcctagaaggaggcctggtggcagcacaggggcagtctggtctgtgtgagggcccctcagacacttctcccctgcctgggcatccaggtgggcagggggtggagtcctctgaggccggcctcctcttggccggcacacccagcccccccatcccatggcatccgccggaaagcgtccctaaccaggttgatgacaacagcagagcgtgggagcggacgcacctgggacgcctgggagacctgggacgcctggggcagtggagtctggtctccagcacccggcccctctgtgctgccaagggctgaacggccttcactccttctcctgggtgtgctaccgccctgtccttacgtccctgcagtggaaggacgaccttcatgtggatgccccgttggccttcaaggtcacgcctcaaggacgcagcagctgtcgcccttgtcctatagggagagcccatcttgcaggtggcagtcgtgcccgtggtcgcgcggctggttcacgtggcgtcagaattcagacgcaggcggtcgtgcccgtggtcgcgcggctggttcacgtggcatcagaattcagacgcaggcggtcgtgcccgtggtcgcgcggctggttcatgtggcgtcagaattcagacccagccgggagtgaccgtgttctccctgggtgctgtccacagtgttggggtggctgggctgcagtggtgtttggccttcccctgtgcctgcaccaccgtggccacgctcttctggggtccctgcagatgctatgagggcctctggctgtgtctgcaggtctgactcccagcaccgcttctggaagcccagcgaggtggaggaggaagtggtcaatgccgacatctccgagatgctccggagccgccacatcacttttgccgggaagtttgagcctgtgcagcactggtgccgtgccccgaggccagacggccggctctgtgagcgccaagaccggctgaaggtgaggccgtggcccgagggcgggggtgggtgtgggctggaccaggtggggcagccagaggggtgctgagccccacctgcccctgccctgggtcagggtgcttgtgagcactgagaagcccatggaaggggcttatccgtggtgggcagaaattgcttagccgttggccatcagagcatggtgtctggggctcctgcccacggccctgaagcctgacacctgggtacatggcttggggactctccaggggccaagacacacagtatcctccatggttgcagcccgggtctgtgctgggcctgggatcctcaaaagtgaggagaggccagggggccagggcagctcccagccgggcagctgggcatggtgcaggggggtcgctatggccatgctggatgagggaggcctagactttccacagctgcccaagaccttccggctccagaggagggacggagccatccccacgtccctgtggctctcaggacgccctcctctgaggggcgcgtgattccaggttgtgtacactttggctctgtgataccacccaccctggtcgctgtttgtgcccaagtcgtggtggtggggggaggtggtcaaggcaagcggacccctccccgccatcagccaccgtgtcctcgctgtgcagtgccctttccatgggaagattgttccacgggacgacgaaggacggccgctcgacccggaagacagggctcgtgagcagcggcggcagctgcagaagcaggagcgcccgggtaggtctgggcaaggcggtcaccgtgggaggcacagcctgggactcactgccactagtggcccggggtgtgtctgcagagtcacagagcacccgctctgccagcttcgtccatggagctacaagcctctcggtcataactggcagaatcaggaggggatgctgccctgagggtcctgggtttgggggctccagaggatgctccagctttagggggtcacgtgttcatgaggccctgaccgggaggtgggcacccacggccccgaagccacaggtgccatctgtgtggctgggtcctgcttccctcgtgttttcaggcaggtgaaggccttaaggcgagagaagtgattgggctgagcccagagtggcttctaggaacccctctggcctcctcagccataccccgcacctgcctcagtgtgcaggtggccacagctctgtccaggaggcgtgtggccactgctatggcggcaggagtgcgggtgcccagaggccctggacagcaaggccactgtggggcagcactgccacatcagcagggcccatctgcccaccctgtctcaccccaggcccatctgcccgccctgcctcccctcgggcccatctgcccaccctgcatatctgttttccaaggaagatttgtttttagaggccctggccagcctcaggcgctctctcttctttttactttgatttggctttttttttttttttttttgaagcagggtctctctctgtcacccaggctagagtgcagtggcgcagtcatggcctcccaggttcgagcgatcctcgtgcctcagcctgccaagtagctggaattatcatgccaccatgcccgactaatttttgtatttttatttttagtagaggtggggtggcactgtattgcccaagctggtcttgaactcctgcattctcctgtctcacctcccaaaatgctgggattacagatgtgagtccccgcccggcctcggtcccttctggagagtggccacacctgcaggcctggccctggcccgaagtgggggttcacaccttgtcttgaagagcagctctgggggcccaggatcccttccaagctgtctctgtcatggctcccgggtgtcttgcactctggtcatgagaggcagatgttgagtgcagcctgatgcccagaggcagcagctcagccctgggcggcgggagggccctgacctgctaatctccgggtgaggccttccctggtggctcacactcaggagcaaattaagtgcctattttttgtgtcaaccctgaagagtatctggttttccagcccttggtgacttgttaacaaacaggtatcaggccgcgggctgcggccagcgctggccagtcagatgtgaaatagtgtctctttactaactacggtattgatccccgcctccctcgcgcacggcgcaattttcctttccctggtgctaacctcagtgacaatgtgcgtgctgctgcagggcccgtcagcgcccaggaaggccgcgcggtcccagcatctattgattttcctcaaaggcttttaaattgctccttcatttcactgagacgctcgctccatctctgctgggtgccggggctttttcgttgtgtttaaacaattgctccattcaccgggttcctaaactgtggcgccttcttattactgggagataaactgtttggacagttttccttaatcttggattaatcgttcctgtatctgaattgtgggccccgtattccttcacttcaaagaatccgcttgggaggcctggccatccgtccgagatgtgggcattcctccggggatgtgcccccgtggcctggtcgcccccgtggcctggtcccactggctcagctcgtggggtcctgtctgcaggagcgggtgcctctgtagcattggtgcctggcccccttctgtgagccagggttgtctgtaagtcccatggccatcacagtcccgtcaggggtggccttcccgagcccgaccagcaccacacctggtggaggcccacctccgccttgtgtggggaaccccacaggaagcctgggcctgtgacccccgagggcctcagtgccatctgcacggtgggtactctcagcctgggaggctgcccagtggggctgttgacatttctgtcccctcactgccacagggcctcaagcagacaatgcacggcttgcttgggaagggcagttctgtctaggagagccccagcctgcatttctgaggcctgaggccaggtcatctttggatcaacgaaaaagaaaagccctttgctgagcatcatgcttggcccagccctgccacacgtacctccccaccagcaggcgtgtccagcagggccacagtttgcctagtggggcacggtccagcctgcaggcaggaaaggagcttgcggatggtgccaccccccaaccgctggccttagccgccttccagcctgggaggcccatgggtgccctaggagtggcctctgggctgagcccctgctccccatctctgggctgcaggggcctgtgggggtgtggggcggtgggggcaagctctgtgtcaccttcaccctgtgggggccagcatgcccaccctccccagcctgttgctcagggaaccctaaccgctgagcatcctctcaggcttgctgctgccagggtacggccgtgggcaaggcgacccagcccccctgtcaggacgagaccaagagcccctcctgggggcctcgggtaagaggctctggtcagtgccagacgtctcctgaagtgcttgagttttgtttgcagaatggcaggaccctgagttgatgagagacgtggaagcagccacagggcaggatctcggctcatccaggtacagcgggaaaggcagggggaagaagaggaggtaccccagcctcaccaacctgaaggctcaggctgataccgcccgcgctcgcattgggagaaaagtcttcgccaagtaagagtggctgctgggtcacctcccaccgcgtggcccccccgtgtgagggtgttcgaggggggccatctgagcgccaagatattccagggacttggggcctccaggggctcccctgctttgagttcccctgggggaccacccagcctttccccggggaggggcagtgccagccagcaggggcagcaggcaggtctgctcaggaacgccccccagcattccccaggataagaggggctcgaccgccaggcaccgccatcctcgcttcctgggggagccatgccaggacacaggccttggctggtgcagagtgagcccctcgtctctcccttgcctggctgtacccccaggtcagtgcctgcgtatttctgcagcggtgacttcagggagggcgatgactgcaaaggcgggcagaacgggggtccacgcgtcagccccagcagagcccagccccagcatgtcttctctgagcactggctctgggaggctggcctggtgtctctgcagcccagcatgggcctgtgtgactggtgaggacttggcagggccagagtgcgaagcccaccagcccggcgtccctgcgtgcagtctgtcagctggggcaccagccactcgcacggccttgtgtttctgtcttcatattgccttgttctcgcctaagaaaatccagaatgcttgtttagaagccacctgaggctgttgactccctcccaaatctgtgtcaagtccctgctggtgcaggtttgtctggtagcaccagtgaggtggcccccacccatcgccatcccagaaaccctcccttggacacacctggaaggtgctaagtgcaccgggcagaggaggcccctcctggccagcatgaccgtgcaccggcctgagtgggctcgggtgggaggcgccttcacagcactcagaccaggcttcccccaggcttgtgggtggtacatccacagccttgcttgggtggggcaggggcgctggtgggggctgtggagaggctgcctggggcccctggcacagggctggacccatcccgtatgccagccacccaaggcaccttagcccttggagctcagggtgaggctgttttcccgtggatcagccaggggcagaggccagccttggtgctgatgcccaggaggaggaatggccagtgggcccatgccaggcctcctccctgtgtctcatggggacactgaagcccatggcaggagctggctcttcgccacagctgtgtggcccagacccctccctacagaaaggatctggggtgaccacaggcaaaaccctgcctcgaggggcccccacagcagcgcctggcagccccacaggggccgcagctgagcggcagcttcaccacattgtggcctcaggccctgctggctccacagctccacaccctcgtgggtcgcagcagctgagctggtcagcacagcacacctcatcctgctccccggaatgcctgcctggcccgtgccccccctgctgcagccctccaggtttccagccctggccgtggagccgtgcgtgcagcagcgggcagggctgtcctgacgcctcctggctgcatctcctgcgaggccgctccccgggaggccaagggggaggctgccctcatcctggagtgcgggaggccacgggagaagtgccaaggtggggctggggccaccttcaccgcgcagaaccacccgccgcagactccgcttctgggacctggggcggccctttctaagcctgtctgtctcgggccagggccaaggggcccgtcgcccatctgtctctgaaggtggcacccacaggcagtctgtcagtgtccgagggcagcagttgccccaggaccagtgcctaactttggtgatgccgccactgggagcccaggcccctggcggaagcctcccaggtcacatcttgccttgtttccccacagggcagctgtgcggagggtagtggcagccatgaaccggatggaccagaagaagcacgagaagttttcaaaccagtttaactacgcactgaactagagagcggggcccagtgcactggccatcagcactttctccctctgccagtgtctcaggacagcagagtgggcgtgggtctgggcagtaaccatgctttgtctattactgtgtttgatgtaaagaaatggtgtgttgcaatgccctgaaggtacggccgctctgctgctacagggttcggcatcgtctggtgatgggtctggcctcgcagaagaggccctcgggcctggagatgtgaacacaggcagcgaccctgttccagagggcttctgcgagtcctcgtgagaccagtgcttgtcgtggtgtggggttcagcacggacggaatgtgtgtgcagctcagccttcagagcgtgcattccccagccaggaggcgaccactcagaggaactctgggaaacccacttttgtgcaaatgctgtttttaacacaaacacaaaggctagtgaaccgttcagtcatctgctttctgtttctggatgtgccttttcatacatgtgtcctcttgtccctggcttcttacacttggcgttgtttttaaggtttatccatgcagttcccctccaatgtataaaacaaaggaggtgaaaacctgtccatgcggaagcttgtgcacccatgttcacagcagcattggagaaggataccgaacatcttctcgtgggcttactggccatttgtgtatctcctttggagaggagtctattcaaacctcttgcctatttttaattgaatgatttatcttgagttgtaacagttgttttttttgtttttccttttagagatgggcttttgctcttacccaggctgagtgcagtggcagaatcatagctcagtgcagcctcaaactcctgggctcaagccatccttccacgtcagcctcccaggtagctgggactacaggcacacaccacaacacctggctaattttttaaattttttgtagagatgaggtctcactgtgttgcccacggtgatctcgaactcctagcctcaagcgatcctcctgcttcggtctcccaaagtgttgggattacaggcatgagccaccactcctggccaggagtttatatgtatactgtggatactagatcctcatgtgatttgcaaaaactttatttatttatttatttatttttgaaatggaatcttgctctgtcgccaggctggagtgcaatggcgtgatctcggctcactgcaactaccacctcctgggttcaagcgattcgcctgcgtcagcgtcctgagtagctgggactacaggcgcgcaccaccacgcccagctaatttttgtatttttagtagagacgggatttcactgtgttggctgggatggtcttgatctcttgacctcgtgatccacccacctcggcctcccatagtgctgggattacaggtgtgagccaccgcactcagctgatttgcaaaaactttcttccatactgttgtttcactttctggatagtgtcctctgaagcacaaaagttaattttgatgaagtacagcaatttatctgtttttttcttttgttgcttatgcttttgctgtcacatttcagaagccatcacctaatccaagatcacagagatttacacctagtttctaataagcattttataatttcagctcttatgtgtagatctttgatccattgtgaattaagttttgtgtgtggtgtaagagcccacattcttttgcatgtggatatccagttgtcccagcaccatttgttgaaaacattatttttccccattgaattatcttcgcaccattattgataatcagttgaccaaaaatgtacaggcttatttctgggcacttgactctattccattgacctgtttaaccttatgccagtgccacagtgccttgatcagtgctgctttgttgtgagaagttttactttgttctgcttcaaggctgttttgactcttctgcatctcttgcatttccaaatgaattttaggatccactcatcagtttcttcaaaaaaaaaaaaaaagcagctgagatttttgataggaattacattaaatctagagattgctttggaatgtattaccgtcttaatattaaatcttctgagtcatga

SEQ ID NO: 91 - DNA, 10029 bp, Homo Sapiens
tgatgtacaaacgtagctgtattggggagggggtggggaggggggatgggggagggacgggtcagtcttccttcaggctcccaaacactgcggctggcacgctctgctgctccagccgaacctctgtggggaaggcgggagccagtcaccctcctggcgttggcctgtcccccgaggcccaccctggtaatgccaccgtccccgccccagccgggccctcaccgttgggctccaggtccatctcgtcctcgtcctcgtcctcgcccagctggatctcctcggggttgacctgctgtgccagctctgccagctcctcccgggaggcgtcactcctagggacgggccatgctgcctcagttccccaccccgggcccccttgggacctgtcccagtcctgtcccgtccaaggatccgccctcacctcacgaacaggatcttgctctgggcgcgcaagggctggtcacgctccgcctcagccgccagctgctctgcccgctgttccagcagcttcatgtcgtccatgccactctgcccaggggccaggtcagacactagggggtgggagcagggggtcagcgccacgggggcccctcccacacatcggacgttgcactatcccagtcccccaggtgatggcccagccctcaaggagattgccatcaggatccgaggctcccagacccggaaagcccaggtcaggccgggctgagatgccctggatcaggaactcagccagctgggacggctcaccggtgcccgtggcactgcccgagaccttgagcatctgcgaggccatgaagttgacctgcgtgttgtacgtggcctgcacgctgcgccggatacgcagcatttccttgatggtgtcctcattgccatgccggacctcaaagtccttccacgtctgccagaacgcgccggtcgtctgcgtggggggcagggcaggggtgggtgtgtgtgcccgtgagctggctgactccgccgcagcccccaaccctgatacccgtccctccccacagccctacccgggggtcacagatctgggagcagaagctgtagatggcccgggcgcggtcaatctccccgagcttgcactccatgtctgcaaaccgcaggcacatctcacgcgcgtgctcgtccgacagcacctggacaccggggttggggaggccgggagtgaggccggggtagctcgggggctcccaacacaccatggccatccctgtgcttccagaaggctcctcctcagcccctcccacctgcctggaccccttccgtctgctcagggacctctggccccggcccagccccccacggtgggtacctcaatggccttctggtagatgccgcgggtgtgggtgaccccatagatctcggccgcccgcttgatgtagatgttgaacatgtcatactgctgggcgggctccacggccctggtggcacgctcgtacacggccatggcatgccgggccaggccccactcctcctccagctgtgcgtacagcaggtacaaggctgggcggggtaggcggggagaggggagcacggtcagccggggccagtcagaaacccagcccgcccgccaccccccccatgccctctgcccgcctcactcttggcatattttggggggcagccgtccagagcctgttcaaacaggtcccgtgcccgctccagcttgcggcccccatagcgggcaatgaatttggtcaggtaggtgctccagatgtcggacacgttgggccacttgaacagcgagatgccgcgctcgtacgcctgttaccagagggagagtcacatgtgagagtctgcagatagagaccaccaggcacccgggatgtccttgggtggcgtctgtagggagcctgccaggaactcccttggggcccttccctgtccacgcctccctgtccctaatggcagttgtgggggtctgtcctctgcactgtctccctctgtgagaaccccaagaacaggggtgcaatgggacctgctaagcacagtctggccccataggaggtgacatgatgggtgaaggtgggtggctccccagctccgctgacgctggctgcctgtccccagggagaaggccgcaccccctgacagaggggcaggcagtagcacgcgtatgcatgtacgacctccccatttgtgtatctgtataatgcccacacgatccatagaaacacacactcaaacatgactgctccggccgcgggacatggccttcccacggacacgcaacccaccccctggaccccacaacccgtctcctgagcagcggggcagggagagcccgcacacactggcaccaacaccctccccatgagtcatgggtgcacgtggaagtaggattctgtgcctgctatggaatgaactgtgcccccctcaaaacattcatatgctcaaatcttaacccccagtacctcagaaagtagattcgtttgaagatgagatcactaagttaaactgaggtcgttaggggccacctaatccattatgactgatgtcctttataagaagaggaaatttcaaaagtgacacacacaaagagaaggccacacaaagacatagggagaaggcggctgtctgtaagctaaggagagaggcctcaggaggaaccagccctgcccatgcctcgatcctggacttccagcctccaggacggggagaagctaaatctttgttgtttaagtcacccagtctgtatactgtgtcacacaagccccagcagattcgtaagttgctgaggacccctggggaggggacactgccatcaggggcctctgggtccaccctagcccctcaccttgaagctctcctcgaagtacttgtgctcctccaggaacatggcatagttgatgacgatctggggtgttgcgatacgcaggtccaggatgcggtcgtacacggccttggtggactgcaggggtggggatgggaaaggttggagctggttctggagctgagtccggggccccgtccctccccagccacaggcagctcacctggaaggtgccgaggctctcctccaggtcggcgagcatggaccagaccttcagtgacttgtacacgcggttctgcacgggctctgaaccatcaaagtactcggcccggcgggcaggcagcgccgtggccttctgcaggggcagacagtggccggggaggcgctcaggggctgtccctggcccttgccctacaacctgcagcccccaccccacagcctgggcctgttctcactcgcagcagccgcaaggcctcatcgtagttctcgtgtcggagctccagctctccgcactgacaccacacgcttgccaggtcatccacctgcttgaagttcaccttggtggccttctccaggatgacacgggcctgccggggcgggcagaggcgaggctgagaccctgcccacctggacagctcccaccatcaagggtcagaaaggtgaccatgctcacaaacatacaggcacaaacacacaggcacacacacaggcacacacatgcgtgcacatatgcatgcacccaaatgcacatgcacacacacgtgcacacatccatgcacaaatatgtacacacacatacatgcacacatatacaagcacacacacatgcatgaacacacaggcacacgcaacagggtgctcacatcgtccagctgtccgttgtcctcataaaacttggcaaacgccacccacagagtgtggggcttgcctgtggccttgaaggggtccaccgtctgcacagcctctgtgtaggtgttgatgatctggggacaggagggaggaggtcatataggactcaggaccctgcagatgacggtcggggcagagctgtggctctgaggggtggggcctggagggtgctgtggcccctgtcgggagaggccagaaacgaactatggcccttgacaatggtcaggaccaagagagagctgtggccctaaggggcggggccaggagagagctgtgaccctccaaggggcggggccacgagggagctgtggccctccaaggggtggggccaggagggactgtggctctgaggggcggggctcgggcaggaggagaaccccaagaacaggggtggaattggacctactaagcaaagtcaggcccctagaaggtgacattatgggtgaaggtgggtggctccccagttctgcaggaaactggccctcaggggtaggactggggcaggcttcatgtacctcccgggggcggccctggtgcagggcgacacgcttgtgccactcgtgcacgtggtgtgggttttggcgcagcaagacgctgttgaggagcaggggccgccggctgatgagctgctcgaagcgggccaggcgcagctccaggtccacatcatctgggagccgcgaacatgtttgtcaggggcggagacccaggatgcaggtccccggatgccaccgcctccactccccaccctcactccgctccagcccccagccaagtgctctgggccctagacactcagctcgggtgtccacctgagccccacccccagccccaggtactgtggataccccctcctacccccactgttcccctagccctcctgccctgccaggctctggcccaggcctgagaagtgtccccattcctggctccttcaagacccccacaccccctgcatccactcagcctccttccctgctggcccccagctgagcctcccagggctgcctcacctgagatgtgtcccgcccctaccgctaatgtccactcagctctctccccaccagccggggcccccagaggctcaccctcctcctcgcgccccagctccgaggcggtctccatctttgcagcgatcatgctctcctcgaactgggcgtagctgtcaaacacctgtgtgaagtcccgcacggtcatcactgtccggatggcctcctcgtacacgtcccgagcctgtggggacccagggaaggggaggtgagaggaaagtggcgcaggggacaggcagcagcactcttagcaccagcctcaatgtggaacccctgggggccttctgggtagtgacgcatccagcacctctgggtagtgaccccaggacagagcctccgtggagccttctcacccccgccctgccctgcactgccagggtggtcttgggagcttcaggacctcctcagtaaactgggtgactgccctttgcacacagtgacctcagggctcgactgagacacatgtgtgaagcacttggcacccaataggtggccaaaaaccccccagcgcctatgggtccaccctgcagggaccctcgcctcagctcatcctccgaggcctcagaatttgctccaaagcgtccctctcgcttgcctgaccctcttccccagcccgcctgtcctccacctggctcgcccaccccagctcaggtcccctctctctacccagccctgacgggtcttgccctgctgcctccgacagccttggcctacacgtgcccctggaaggggcgctgcgaagcgcataccgcccacaccccactggcggctcccccagccaggagcatggccagcccgtttggctttcgaggctcccaacctatcttccctgggttcctgagcctccccgctctcggctctggccccctctgcacccacctgcccccaggccatcccctgagcttgccactccactgcctgccaagagccacagtcagctaacccctgagggagtggccctcacaccacgtacctcctcagtgctgtgcctgcgtcactgagctgattggtgacaggcagtaactgtcaccctgattttacaaatgaagacaccccaccttagtggggccaaggccgcagagccagagggtgaaccctgaacgcaaatgtggctgactccaaggctgacgtgcctgcgggcaggagtgctcccccaccctcagcaggatagtaatcgtgtgcagggatatgcatgtctgtcaaaaatggcactttttttttttttttttttttttgagatggagtctcgctctgccacccaggctggacttccgtggcgcgatcgcagctcacggcaacctccacctcccaagttcaagcgattctcctgcctcagcctcccgagtagctgggattacaggcgcgcaccaccatgtctgactaatttttgtatttttagtagtgatggggtttcaccatgttggccaggctggtcttgaactgctgacctcaagtgatcctaccgcctcggcctcccaaagtgctgggatgacaggtgtgagccaccacacccagccataaatggcatgttttctgcctgtgcatgtgtcaacatgtgtccccgagtgtcggagggagaccccgccccgaacccagagccccgtgtgccagcatgcaccttctcgaaatggccgctgcggatgtagtagtcggcgagagaacaccagagcttgcccagctggtcggtgaagcgggtgaggcccccgcggatgatggcgtccacattgagggactgtaccttgtccggattctgggagatgaggtcgcacagctcgtgccacagctgcagggcatggggcagtgggggagagtctcaggctcagtcatggagggggtggccctcccacccagttgccggctcccggcaggcccacctggtagttggacttgccggccttagacacgaaacgctcgtcgttcaccacggtggccaggcgctgggcggcctcatccagccggtcacttgacttgaggtactcaatgtactcctctgcactctcaggactcagctggggaccgagccacccctcaggcagtcagtggggtggcagggctacgcccacctcccgattcagtggcttcggggcgtccccccccacccatttatgagtgtcttgggcaaaagcaagccctgtcaaaccagcctcagccccactggtccagcccggttcctactggtctagccttggccccactgggttaggctcaaccccctgtgggtcctgccttggctccactggtccagcctcagtcctgactagaccagctgtggactttttgggttagccttgacccgcaagggcacagccttgactgcggtggtccagtctcagccccaatggtccagccttggtccttttgggttagaattgacccccaacccacaatgggtccagccttggctccactagtccagcctcagtcctgactggtctagccttggcccctttgggtcagccttgatcccatgggtccagccttgactatagtgtccagcctgggccccacgggtccagcctcagtcctgactggtccagcttagaatccaaacgtcataaaacagatactttaagtttgagcaaaccatgccccactcccgcccggctggtgcttccactctccaccctgcctgcttctccccacccctattcctggccctcttcatggctgtggttttactctagttcatgccatcagctcatatgcatctgtcttcctacttagactaaaagctccgtgcaggcagggagtgtcttagtcacactgtcctcagcacccatcgctatgcctaatgtgaaaccagtgtgaacaaactatttggaaaataaagacatgaatcacggacaacaacaaaacacatgcatctccaggagcctcttcccacatcccgtctgctgggtgacatcctacgcggagctagtgtcacagtgaggccgtttctggaaactaacctggggaaccagcgcacctgctaggctcaccttgaggaagcgccgatagcctcgcacagctgtctcaggcagtgggtgtgagcgcaggaagcgcagatacaggggccaaattcgagagtgctgcgtgatgggcagtgcccggagggcacggtcgaaggtgcggcgggtgtgtgtgacgcgcccctggtccatgaggaactggcagtaatctagccacagacgaggcatctgggggtgtggggagaggcggctggggctaagccacggactccatggcctggccacagacactcgatgtcctgtggctgagccacacctggggccaccacataaatgcggcgggacccagaaacccccagctccaggactgagtccagcccaacttcccatgcaaagaagcaacaggaatccaagcccccatccctaacatgctgagcccagcccctgtccccgccccacccaccaccatggactgagctccacttcccgattcatcccctcgccgagccccaaaccttgtgcatgaacacaaaggccctctcatgacagttgttgacatcttcataggcagggtcggtcacacagcgatgcttcacctgtgcccgacgcgccttcaggtatcggtaccagagtttgtagctggggaataggaggggacagatgctgatcggtcagctttatggacacccccagaaccatttgccctgccccagttggcaaatgtgggaagaaggggtgtgggaggggtgacatgtctcagcaatgacagggacagactgggacatcagagaaggtgtgctgacccatcaagggatgtacaggtcagtgatgaaacacgaagcaatcacccgggacccgggacccacttggcagttttgttataactggaccaggtggggtgggggctggtgggcagggcagctggagccattcccacctgcagggcagcagcttgagtgcccgctcgtatagctgattgagcctgggcttcggggcgccctgtttgaactcgatgtagcgaagccagcatttgacagagaattggttccgcatgatttcctcctcataggggaggtcctcttcctcctgccagggccagggaatgggaagaagagaggcctaccctcagagcctgtgtgcagcaccatcccactgctggggctcaggtccaaactccggacttttacctagatcccaccacccaccaaggaagtcaggtcaccagatgcccaggcaccaaaccagatgcccgacaccaagacagtggcccagacctttacccctcagaattcaactacccaaaatcgaacccaaatcatcagacttctcagtcattagggctctgggccaggaatgagtccgcatcaccactcgctttctgccccagatggtcagactccttagataccaaggccctggcccagatgccagtcctggacaccagaccccacttcttcaaaacgtgcctcttcccagacaccaggcctttggcccctcagactcccactgtcaccatctgacccatctccaccccaggcccagatgaccagatctttaccccagccaccagggctctcaggtccagattccaagccactagccccgcccccaggatcccactagccagcgtctagctcaactctgccccagaaattaaaagctaggcctttatctcacaggaggagttatacaccagaagccaagcctttaactctgcacaccaagaatctggtgaagatgtcacgcctctactccagagagtaagtatttcactggccatcgcctgacaagctccacatcaccagggttcttctagcctggccaccaccccagaaactgtcatgctgcagtccaggcctagagaccgctatccagaaaaccaagccttcatcccagaaaccagaaccctggcctcgtaagcaagcctttacttcagacaccgatcttcacctctcaaggttcagttatgcgatcttcctcctctcccattccctgcacgcccccatttccgcccctggttcgggaggctagacgcttcccttcgacagtggttttctactcagacccgaagatacaacaccatatttttactcctggacagttcggtgcggacatgacgatccggtctctggcccattagggttcccagaccttggcctggcagtttcggcctaaatctccttgccgacccagcctcgatcccctgcggcgtccaggtcccaatgccccaacgcaggccacccccggctcctctgtggactcacgaagacaaggtccggccgctcgggccgcgagagtcgcgccatcaccaccatttttctggatgcccaggtacaggaga
